United States Patent 10,501,513 (MODIFIED POLYNUCLEOTIDES FOR THE PRODUCTION OF ONCOLOGY-RELATED PROTEINS AND PEPTIDES) - sequence listing, part 15

SEQ ID NO: 25563 - DNA, 3213 bp, Artificial Sequence
  Description of Artificial Sequence: Synthetic coding sequence
atgtgcttcagcttcatcatgccccccgccatggccgacatcctggacatttgggctgtggactcccagattgcaagcgatgggagcatccctgttgatttcttactccccactggtatatacatacaactggaagttccacgcgaagccacgatctcctatattaaacagatgttatggaagcaggtgcacaactaccccatgtttaatcttttgatggatattgacagctacatgttcgcctgtgtcaaccagaccgctgtttatgaggagttggaggatgaaacccgcagactgtgcgatgtcaggcccttcctgcccgtgctgaagctggttacaaggagttgcgaccctggagaaaagttagactcaaaaataggcgttctgatcggaaagggcttacatgaatttgattcactgaaggatccagaagtgaacgagtttagaaggaagatgagaaagtttagcgaagagaagattttgagcttagtgggcctcagttggatggattggctcaagcagacttacccccccgaacacgaaccttctattcccgaaaacctcgaagataagctttatggaggcaagttgatcgtagcggtccacttcgagaactgtcaggatgtattttctttccaggtgtcacccaatatgaatcccattaaggttaatgaactcgcgattcagaagcgcctgaccatacacgggaaagaggatgaagtgagcccttacgactacgtgctgcaggtgtctggacgcgtcgagtacgtgttcggtgatcatcccctgatccaatttcagtatatccgtaactgtgtgatgaatcgggcgctcccgcacttcattctggtagagtgttgcaagataaaaaaaatgtacgagcaggagatgattgctatagaggccgctattaaccggaactctagcaatctccccttgccccttccacctaagaaaactaggatcatcagccacgtatgggaaaacaacaatccgttccaaatagtgcttgtcaaaggcaataagctcaacactgaggagactgtgaaagttcatgtcagggcgggactcttccacggaaccgaattgctctgcaagacaattgtctcatcagaggtttcgggcaagaacgaccacatttggaacgaacccctggagtttgatattaatatctgtgatttgcctcgaatggcccgcttatgctttgctgtgtatgccgtcctggataaggtaaagaccaagaagagtactaagacaatcaaccctagcaaatatcagaccatacgtaaggcaggcaaggtgcattatcccgtcgcctgggtgaacaccatggtctttgatttcaagggtcagctgagaacgggtgatatcatcttgcattcgtggagcagcttccccgatgaactggaagagatgctaaaccctatggggacggtccagacgaacccctacaccgagaatgccactgcactgcacgtcaagttccccgagaataagaagcagccctattattacccgccatttgacaagataatcgaaaaggcagcagagattgctagcagcgattccgccaacgtgagttctcgagggggcaaaaaattcttacccgtgcttaaagagattctggatagagaccccctttcccagttgtgcgagaacgagatggaccttatctggacgttgaggcaggattgcagagaaattttcccccagtccctgcccaaattgttgctgtcaatcaagtggaataagcttgaggatgttgcgcaactacaggcattgttgcagatctggcctaagctgcccccgagggaagcgctggaattactagacttcaactatccagaccagtacgtgagggaatatgcagtgggctgtctaagacagatgtcggacgaagagctaagccagtaccttctccagctggttcaggtgttaaaatatgaaccattcttggactgtgcactgagtaggtttcttctggagcgtgccttgggcaacagaagaattgggcaatttctcttttggcatctgcggagtgaagttcacatcccagccgtctccgtgcagttcggcgttatccttgaggcgtactgccgaggttccgtggggcatatgaaagttttatctaagcaggttgaagctcttaacaaattgaaaactctgaattctctcatcaaactcaatgccgtcaaacttaaccgcgcgaagggcaaagaggcaatgcacacttgtctgaaacaaagcgcgtaccgcgaggctctaagcgatttgcagtctcccttaaatccgtgcgtcattctgagcgagctctacgtcgagaaatgcaagtacatggacagcaaaatgaagcccctctggctggtttataacaacaaggtgttcggggaagacagtgtcggcgtaatctttaagaatggtgacgaccttcgacaagatatgctgacactccagatgttaaggcttatggacttgctttggaaggaggccggtctcgatctgcgcatgctgccttatgggtgcctcgccactggcgaccgaagcggactgatagaagtggtgtcgaccagcgaaactatcgccgacatccagctcaattcatctaatgtcgctgccgcagctgcatttaataaagacgccctactcaattggttgaaagagtataactctggagacgacctggaccgggccatagaagaatttaccctctcttgcgcaggatactgtgtcgcaagttacgttctgggtatcggggataggcattcagacaatatcatggtcaagaagacagggcagctcttccatatcgatttcggtcacattctcggaaacttcaagtctaaattcgggatcaagagggaacgagtccctttcattttaacatacgattttatccatgtgatacagcaagggaagaccggcaatacagagaagtttggcaggtttaggcagtgctgcgaggacgcttacctgattttaaggcgccacggcaacttattcattaccctgtttgcattgatgttgactgctggactccccgagctcacttcagttaaggacattcaatatttgaaagactcactcgccttgggcaagtccgaggaggaggctctcaaacagtttaaacagaagttcgatgaggccctgcgcgagtcgtggacaacgaaagtgaattggatggcacacacggtgcggaaggattaccgctcatag

SEQ ID NO: 25564 - DNA, 303 bp, Artificial Sequence
  Description of Artificial Sequence: Synthetic coding sequence
atgtgcttcagcttcatcatgccccccgccatggccgacatcctggacatctgggctgtcgattcccagatcgcctccgatggaagcattcccgtcgattttctgctaccaaccggaatatatattcagctggaggtgcccagagaagcgactatcagttatattaaacagatgctgtggaaacaagtccataattaccccatgtttaatcttctcatggacatcgattcttatatgttcgcttgtgtcaatcagacagccgtgtacgaggagctcgaggatgagacccggagactctgttag

SEQ ID NO: 25565 - DNA, 171 bp, Artificial Sequence
  Description of Artificial Sequence: Synthetic coding sequence
atgtgcttcagcttcatcatgccccccgccatggccgacatcctggatatttgggcggttgacagccagattgcaagtgatggctcaatccctgtggatttcttactccctacaggcatatacatccagttggaggtgcctcgcgaagctaccatctcatacataaagtag

SEQ ID NO: 25566 - DNA, 3213 bp, Artificial Sequence
  Description of Artificial Sequence: Synthetic coding sequence
atgtgcttcagcttcatcatgccccccgccatggccgacatcctggatatctgggccgtggatagccaaatagcgtcggatgggtcaatccctgtcgactttcttctgcccacgggaatttatatccagttagaagtccctagggaagccacaatttcatacatcaaacaaatgttgtggaaacaggtccacaactaccccatgtttaaccttctcatggacatcgatagttatatgttcgcttgcgtgaaccagacagccgtgtacgaggagcttgaggatgagaccagaaggttgtgcgacgttcgacccttcctgcccgtcctaaaacttgtgacccggagttgtgatccgggggaaaaacttgactcaaagattggggtcctgattggaaaaggattgcatgaattcgactccctgaaagaccctgaggtaaatgagtttcgacgaaaaatgagaaagttttccgaagagaaaatcctctccctcgttgggcttagttggatggattggttgaaacagacctaccctcccgaacacgaacccagcattcctgaaaatctcgaggacaaactttatggtggcaagctgatcgtagcagtgcatttcgagaattgtcaagatgtgttctcctttcaggtgtccccaaatatgaatcccatcaaggtcaatgaattggccattcagaaacgactgaccatccacggcaaggaggacgaagtttctccgtacgactatgtgcttcaggtatctgggagggtggaatacgtgttcggcgatcatccgctcatacagtttcagtacatcaggaattgtgtgatgaatagagcgttgccccactttatacttgttgagtgttgcaaaattaagaagatgtatgagcaggagatgatagccatcgaggctgccatcaaccggaacagtagtaacctaccgcttcccctgcctcccaagaagactcgaatcataagccacgtatgggagaacaacaatcccttccagatcgtccttgtgaaagggaacaaactcaacacagaagagacagtgaaagtccatgtgagggctggactttttcacggcacagagctgctctgcaagactattgtttcaagcgaagtctcaggcaaaaatgaccacatctggaacgaacccctggagttcgacatcaacatctgtgatctgccacgaatggccaggctgtgcttcgctgtgtacgctgtcctcgacaaggtcaaaactaagaagtcaaccaagacgattaacccgtcgaaatatcagaccatccggaaggctgggaaagtccactaccccgtggcctgggttaatactatggtcttcgatttcaaagggcagctgagaacaggcgatattatcctgcattcttggtcttcctttcccgatgaactggaggaaatgcttaatcctatggggaccgtccagactaacccttataccgagaacgcaacagctctgcacgtaaagtttcccgagaacaaaaagcaaccttattattatcctcctttcgacaaaatcattgaaaaagctgcagagattgcctcttccgattctgccaatgttagcagcaggggcggtaagaagtttctgccagtcctgaaggaaatcctggaccgtgacccacttagccaattatgtgaaaacgagatggatctcatttggacactcagacaagactgtagagagatcttccctcagagcctgccaaagctgctcctgtccataaagtggaataaactggaggatgtggcccagttgcaagctttactacagatttggcctaaactcccgccccgggaggcccttgagctgctggatttcaactacccggaccaatacgttcgtgagtatgctgtgggatgcctgcgacagatgtccgacgaggagctgtctcagtacctactccaactggttcaggtgctgaagtacgagccattcctggattgcgccctgtcccgatttttgctggagagagctctgggcaatagacgcattggtcaatttctgttttggcacctgaggtcggaagtgcatatacctgccgtgtcagtacagttcggcgtgatcctagaagcttactgccgcggatcagtgggccatatgaaagtgttaagcaaacaggtagaagctctgaataagctgaaaaccctgaactccctcataaagcttaacgcagtgaaactgaacagggctaagggtaaggaagccatgcacacttgcctgaagcaaagcgcgtaccgagaagccctctctgacttgcagtcaccactgaatccctgcgtgattttaagcgaactctacgttgagaaatgcaaatatatggattcaaagatgaagccactatggctagtctataacaataaagtcttcggtgaagattctgtgggcgtgatcttcaagaacggggatgacctgaggcaagacatgttgactctgcaaatgctccgcctgatggatttactatggaaggaggctgggttagatctaagaatgctcccctatggctgtctggccaccggagaccggtcaggattgatcgaagttgtttcgaccagcgagacaattgcagatattcagcttaacagttcaaacgtagcagcagcagcagctttcaataaagacgctctgttgaactggctaaaagagtacaattccggagatgacctggatagagccatcgaggagtttaccctgtcctgtgccgggtactgcgttgcgagctacgtattgggaatcggggataggcattccgataatatcatggtcaagaagacaggtcagttgtttcacatcgacttcgggcacattttgggaaactttaagagcaaattcgggattaagcgtgagagagttccgttcattctgacctatgatttcatacatgttatccagcaaggcaaaacagggaacactgaaaagtttgggaggttcaggcagtgttgtgaggacgcctacctgattttgagaaggcatggaaacctctttataactttgtttgccctgatgctcactgcgggcctccctgagctaacgtccgtcaaagacatacaatatctgaaggactctctagcactggggaaatccgaagaagaagctctgaaacagtttaaacagaagttcgacgaagcattacgtgaatcctggacaaccaaggtgaactggatggctcacaccgtgcggaaagactaccgcagctag

SEQ ID NO: 25567 - DNA, 396 bp, Artificial Sequence
  Description of Artificial Sequence: Synthetic coding sequence
atgtgcttcagcttcatcatgccccccgccatggccgacatcctggacatatgggccgtcgattctcagatcgcatccgacggatctatccctgttgatttccttctccctaccggcatttatatacagctggaggttcctcgggaggcaacaatctcatatatcaagcagatgctctggaaacaagtacacaactaccctatgttcaatctgttaatggatatagactcctacatgttcgcctgcgtcaaccaaacagcggtgtacgaggagcttgaagacgaaacccggcgactttgcgatgtgcggccctttcttcctgtcctcaaactggttactcgcagttgcgatcccggcgagaagctggacagtaaaatcggagtcttgattgggtag

SEQ ID NO: 25568 - DNA, 2109 bp, Artificial Sequence
  Description of Artificial Sequence: Synthetic coding sequence
tgagtgcgggccggcctgttccacggcaccgagctgctgtgcaagaccattgtaagctcagaggtgtctggcaaaaatgaccacatttggaatgagccactggagttcgatattaacatctgcgatctaccccgcatggcacggctctgcttcgctgtgtatgcagtgctggataaagtaaaaacaaagaaatctacaaaaaccattaacccttctaaataccagacgatccgtaaggctggtaaggtccactacccggtggcatgggtgaacacaatggtgtttgacttcaagggccagctgcgaactggcgacatcattctacattcgtggtcctcattccccgacgaactggaggagatgcttaaccccatgggcaccgtccagactaatccctataccgagaacgctaccgcgttgcacgtgaaatttcccgagaataagaagcagccgtactattatcctccctttgacaaatcccggggaggtaagaagttcctccccgtgcttaaggagatcctggatagggaccccctttctcagctctgcgagaacgagatggatttgatatggacgctgcgccaggactgtagagagatattccctcaaagcctacctaagttactgctctctattaaatggaacaaactggaagatgtggctcagttacaggccctacttcaaatatggccaaagcttcctcctagggaggctctggagctgctggacttcaactaccccgatcagtacgtgagagaatatgcagtaggatgcctccgtcaaatgagcgacgaagaactctctcagtatctccttcagttagtacaggtcctgaaatacgaacccttcctggattgtgccctctctagattcctcctagagcgggcactggggaatcgtagaattggacagtttctcttctggcacttacgatctgaagtccatattcctgcggtgagcgtccaattcggcgtcatcctagaagcctactgcagaggttccgtgggccacatgaaagtgctgtcgaagcaggttgaggctctgaataagcttaagactctgaattccctgattaagctgaacgctgtaaaactgaaccgggcaaaaggaaaagaagccatgcatacgtgcctgaaacagagtgcttaccgggaggctctcagcgatctccagtctcccttgaatccttgcgtaattctgagcgagctgtacgttgagaagtgcaagtacatggatagtaagatgaagcccctttggctcgtatataataataaggtgtttggtgaggacagtgtgggtgtcatattcaagaacggcgatgatctgcgacaggacatgcttacgttgcaaatgctccgactcatggatctcctgtggaaggaggctgggctggacttgcggatgctaccttatggctgcttggctaccggtgaccggagtgggctgattgaagttgtaagcacaagcgaaacaatcgccgacatacaactgaacagcagtaatgtggctgccgccgctgcttttaataaagacgccctgctgaattggcttaaggagtacaattctggcgacgatttggacagggctattgaggaatttacattgtcttgcgcaggctattgcgtagcctcctacgtgctcggcattggagaccgccattccgataatattatggtgaagaagaccggccagcttttccatattgacttcggtcatatccttgggaattttaagagcaaattcggcattaaacgggaacgggtcccctttatccttacctatgactttatccatgttattcagcagggcaagaccggcaataccgagaaattcggcaggttccggcaatgctgcgaggacgcttaccttatcctcagaagacacggtaacctgtttattacactgttcgcactgatgctcaccgcgggccttcctgaattaacatcagtgaaggatattcaatacctgaaggactccctggctctgggtaagagtgaagaagaagccctgaagcagttcaaacaaaagttcgacgaggccttgcgcgagtcatggaccaccaaagtgaattggatggcgcacaccgttcgaaaggattatcgaagctag

SEQ ID NO: 25569 - DNA, 1566 bp, Artificial Sequence
  Description of Artificial Sequence: Synthetic coding sequence
atggacctgatctggaccctgcggcaggactgccgggagatcttcccacagagcctcccaaagctgctcctgagtatcaagtggaataagctggaggacgtcgcccaactgcaggctttgctgcagatatggcctaaactgccccctcgcgaagccctggagctgctggacttcaattatccagatcagtacgtgcgggaatatgccgtcgggtgtcttcggcagatgtctgacgaggagctttctcaatacctcttgcagcttgtccaagtgctcaaatacgaacccttcctggactgcgcactcagtaggtttctgctcgagcgcgctctggggaatcgtcgcataggacagtttctgttctggcacctccgttcagaagtccacataccagcggtgtctgtgcaatttggggtgatcctggaggcctactgccgggggagcgttggacatatgaaggtcctgagcaaacaagtggaggctttaaacaaattaaaaacgctgaacagccttatcaaactgaacgccgtgaagctgaatagagcaaaaggcaaggaggcgatgcacacttgcctgaaacagtcagcttatagggaagccttgagtgatcttcaatcaccgttgaatccgtgcgtgatactttctgaattatatgtagagaagtgtaaatatatggatagcaagatgaaacctctgtggctggtatataacaacaaggtgttcggtgaagacagcgtcggggtgattttcaagaacggagatgtctgtttccccctggacctgagacaggacatgctgacactgcagatgctcaggttgatggatctgctttggaaggaggcaggtttagacctgcgcatgctgccatatggctgcctggcgaccggagataggagtgggctcatcgaggttgtgtccacatccgagaccattgcagacattcaactgaattcttcgaatgtggcagcagctgctgcgtttaataaggatgccttattgaactggctcaaggagtataattccggcgatgacctggaccgggctattgaggagttcacattatcctgcgccggatactgcgtcgcatcctacgtcctaggaattggcgatcgacacagcgataatatcatggttaagaaaactggtcaactgttccacatcgacttcgggcacatactcggcaacttcaagtcaaagtttggtatcaaaagggagagagttccgttcattttgacatacgatttcattcacgtaattcagcagggtaaaactggcaatacagaaaagttcggccgattcagacagtgctgtgaggatgcctatttgatcttgagacggcatgggaacctgttcattaccctttttgcactgatgttaactgccggtctacccgaattgacctcggtgaaagacatacagtatttgaaagattcactcgccctaggtaaatcagaagaggaggcattaaagcagttcaaacaaaagtttgacgaggcactgagagagtcatggaccaccaaagttaactggatggcccacacggttcgcaaggactatcggagctag

SEQ ID NO: 25570 - DNA, 3207 bp, Artificial Sequence
  Description of Artificial Sequence: Synthetic coding sequence
atgccccccggcgtggactgccccatggagttctggaccaaggaggaaaatcagagtgtcgtggttgacttcctattaccaactggagtgtacctgaacttccctgtctcccgaaatgccaatttgtctacgataaagcagcttctgtggcatagagcccagtacgaaccgctcttccacatgttgtcgggccccgaagcttacgtgttcacatgtatcaatcagactgccgagcaacaggaattggaggacgaacagcggagactgtgcgacgtccagccttttttgccagttctgaggctggtggctcgtgaaggcgatagggtgaagaagctgatcaacagtcaaatttccctgctcattggaaagggacttcacgagttcgacagtctgtgcgaccctgaagtgaacgattttagagccaagatgtgccagttctgtgaggaggctgctgcccggagacagcaactgggctgggaagcctggctgcagtattctttccctctccagctcgaaccctctgcccaaacatgggggccagggaccctgcgattgcccaatagagctctgctcgttaatgttaaatttgaaggctctgaagagagtttcaccttccaagtctccacgaaggacgtcccgctggccctgatggcctgtgctctccgcaaaaaggccacagtattcagacagcctttagtggaacagcccgaggactatacgcttcaggtcaatggtcggcatgagtacttatatgggtcgtatccgctttgccagttccaagtgcagaagcctcgggctaaacctccccccatccctgcgaagaaaccttccagcgtttccctctggtccctggagcaaccattcagaatcgagttaattcaaggttcaaaagttaatgctgatgaacgaatgaagctggttgtgcaggcaggactgttccatggcaatgaaatgctctgtaagaccgtgtccagctccgaggtcagcgtctgctctgagcccgtgtggaaacagcggttagaatttgacatcaatatttgtgatctgcctcgcatggccagactctgcttcgccctatatgccgtgatcgaaaaggcaaagaaagcacgctctactaaaaagaagtctaaaaaggctgactgccctattgcatgggcgaatctgatgctcttcgactacaaagaccagctgaaaacaggcgaaaggtgtctgtacatgtggccaagtgttcctgatgagaagggcgagctgctcaaccccacggggactgtccgaagtaatccgaacacagacagtgcagccgcgctgctgatctgtctcccggaggtggctccgcaccccgtgtattatccggcccttgagaagctgcccggaggcatgttgctcgcctcgcgggagtggcggcccgaacttctgtggatgcgactgcatgctgaagattccgccccttcacgcatgattggggtggcgatgcctggactgggcgtcctgccaggactcgtgcaggcgcctggtgatgccgagtgcagtaggctgctgcaaattctagaactgggcagacactcagagtgcgtacatgttactgaggaggagcagctacagctacgggaaattctggaacggaggggttctggggaactttacgagcatgagaaggacctggtgtggaagctccggcatgaggtccaagagcactttcccgaagctctcgccagactcttgctggttactaagtggaataaacacgaagatgtggctcaggacgcacttccagccgtgagctggcccgaactcccggtgctgtccgctctggagctgctggatttcagcttccccgattgtcacgtcggctccttcgccattaagagcctgaggaagctgactgatgacgaactgttccagtatttgcttcagttggtgcaggtcttgaaatacgagagctatctcgattgcgagctcacaaagttcctgctggaccgcgcactggctaaccgcaagatcggacacttcctgttctggcatctccggtcagagatgcacgtcccaagcgtcgctttaagatttggcctgatcctggaagcctattgtcggggctcaacacaccacatgaaggtcctgatgaagcagggcgaggccctgagtaaattaaaggctctgaatgattttgtgaagctttcctcccaaaaaacaccaaagccgcaaacaaaggaactcatgcacctgtgtatgcgccaggaagcttacctcgaggcgctgagccacctgcagagcccccttgatccatcaactctgctagctgaggtgtgtgtggaacaatgtacttttatggatagcaagatgaagccactctggattatgtattcaaatgaagaggctggatccggcgggtcagtgggcattatttttaaaaatggggatgaccttagacaggatatgctcactctacagatgatacagctgatggatgttctgtggaaacaggagggcctcgatcttagaatgactccgtacggctgtttgcctacgggggatcgcaccggcctgattgaagtggtactgcggtcagacaccatcgctaatatacagctaaacaaatcaaacatggccgctaccgccgcattcaataaagatgccttgttgaattggctgaagagcaaaaatcccggggaggccctcgatagagctatcgaggagttcaccctgagttgcgcaggttactgcgtcgccacttatgttctgggaatcggagatagacactcagacaatatcatgattcgtgagagtggccaactcttccacattgactttggccacttcctcggaaattttaagactaaatttgggatcaaccgagaacgggtcccgttcattctgacctatgacttcgtgcacgtcattcagcagggcaagactaacaattcagaaaagtttgagcggtttaggggttactgtgaacgtgcgtataccatcctgaggcgacatggcctcctgtttctccatttgttcgctctcatgagggccgctggacttcctgagctgagctgtagcaaggatatccagtatctgaaggacagtctggctttaggcaaaacagaggaggaggccctcaaacattttcgcgtcaagttcaatgaggcactccgcgagagctggaagacgaaagtcaattggctggcacataatgtgagcaaggataatcggcagtag

SEQ ID NO: 25571 - DNA, 3207 bp, Artificial Sequence
  Description of Artificial Sequence: Synthetic coding sequence
atgccccccggcgtggactgccccatggagttctggaccaaggaggagaaccaatcggtagtcgtcgattttctcttgcccaccggggtctacctgaatttccctgtgtcgaggaacgctaacttatctacaattaagcagctgctatggcaccgtgcccagtacgagccgttgttccacatgctgagcggaccagaggcctacgtctttacctgcataaatcaaaccgctgagcagcaggagctggaagacgaacagagaaggttgtgcgatgtgcagccgttccttcctgttctgcgactcgtcgctcgtgagggagatcgagtgaagaagcttatcaattcccaaatcagcttactgattgggaagggacttcatgagtttgattccctctgcgaccccgaggtgaacgatttccgtgctaaaatgtgtcagttctgcgaagaggccgctgctaggcgccaacagctcggttgggaagcctggctgcagtatagtttcccacttcagctcgagccctctgcgcaaacctggggtcccggaactctccgactccctaatagagctctgttagtgaacgtaaagtttgaagggtcagaagagtcctttaccttccaggtctctaccaaagatgttcctctcgctctgatggcgtgtgccctcagaaaaaaagctaccgtgttcagacaacctttagtggagcagcctgaggattacactctgcaggtaaatggtagacacgaatacctgtacggttcctatccactctgtcagttccaggtacagaagccaagagccaagcctcctccaatcccggcgaaaaaacctagtagcgtgagtctgtggtccttggaacagccctttagaattgagctgatacagggctctaaggtaaacgccgacgaaagaatgaagctggttgtccaggccggtttgttccatgggaatgaaatgctctgtaagaccgtcagctctagcgaggtatccgtctgttccgaacccgtctggaagcaacggttggaattcgacataaacatatgtgatctgccgcgtatggcccgcttatgttttgccttgtacgccgtgatagagaaagccaagaaggcaaggtccaccaagaagaagtctaagaaagccgattgtccaatagcctgggcgaatctgatgttatttgactataaagatcagcttaaaacgggcgagcgctgtctgtatatgtggccttccgttcctgacgaaaagggtgaactgcttaatcctaccgggacggtcaggtccaacccaaacaccgactccgcagcggcactgttgatctgcctgcccgaggtcgcaccccacccggtttactaccccgctttggagaagctccctggcggcatgctgctggccagccgggagtggaggcctgaactgttgtggatgcggctgcacgccgaggattctgccccttcgaggatgatcggagtggcaatgcccggtctgggagttctccccgggctggtgcaggcccccggggatgccgagtgtagcaggctgttgcaaattttggaactgggacgtcattctgagtgcgtccacgtaaccgaggaggagcaacttcagctgcgtgaaatcttggaacgtagagggtcaggagaattgtacgaacacgagaaagacctagtttggaagttaaggcacgaggtacaggaacactttccagaggctttagcacgactcctcctggtgaccaaatggaacaagcacgaggatgttgcacaaatgctgtaccttctgtgcagctggcctgagctgccagtactcagtgcccttgagctgttagatttctccttccctgattgtcatgtcgggagcttcgcgatcaaaagtctgcggaagctaaccgacgacgaacttttccaatacttactgcagcttgtgcaggtgttgaaatatgaaagttacctggactgcgaattgaccaaattccttctagaccgtgccctcgctaacagaaagatcggacatttccttttttggcatctcagatccgaaatgcatgtgccttcggttgccctccgattcggtcttatcttggaggcttattgtcgaggcagtacacaccacatgaaagtgctgatgaaacagggcgaggcactgtcgaagctcaaggccctgaatgattttgtcaagctgagtagccagaagactcccaaacctcagacaaaggagctcatgcacttatgtatgcgtcaggaggcgtaccttgaagctttatcgcatctacagtcacccctcgaccccagtacattgctcgcagaggtgtgtgtagaacagtgcaccttcatggattctaagatgaagcctctttggattatgtactctaacgaagaagcaggatccggaggcagcgtgggtatcattttcaagaacggcgacgacctaaggcaagacatgcttactctgcaaatgattcagttgatggacgtactatggaaacaggaaggactcgatctccgaatgacaccatacgggtgtctgcccacaggggataggacaggattgatagaagtagttttaaggtccgacaccatcgctaacatccagttgaataaatctaatatggccgccaccgccgctttcaacaaagacgcactactgaactggctgaaatctaagaaccctggcgaagccttagacagggcaatagaggagttcactctatcttgtgccgggtactgcgtggccacttacgtgttaggcatcggtgaccgtcatagcgacaacataatgatcagggagtcagggcagctgttccacattgatttcggtcatttccttgggaactttaaaacgaaattcggcatcaatcgagaaagagtgccgttcatcttgacttacgatttcgttcacgttatccagcagggcaagaccaataatagtgagaagtttgaaaggtttcggggctattgcgagcgagcctacaccatactgcgtcgccacgggctgctgtttttgcatctgtttgctctgatgagagctgccggattgccggagttgagctgttctaaggacatacaatatttgaaagactccctggcactgggaaagacggaagaggaggccttaaagcacttccgtgtcaaatttaatgaggctctccgcgagtcgtggaaaaccaaggtaaattggcttgcgcacaatgtttcgaaggacaatcgccagtag

SEQ ID NO: 25572 - DNA, 3135 bp, Artificial Sequence
  Description of Artificial Sequence: Synthetic coding sequence
atgccccccggcgtggactgccccatggagttctggaccaaggaggaaaaccagtcagttgtggtggactttctgctccctacaggagtttatttaaacttcccagtttctcgtaatgcaaatttgagcacaattaaacagctgctgtggcaccgagcccagtacgaacctctgttccacatgttatctgggcctgaggcttacgttttcacttgcataaaccaaaccgccgaacaacaggagcttgaagacgagcagagacggttgtgcgacgttcagccttttctgcctgttcttcgcctggtggcacgagagggcgatcgcgtgaaaaagttaataaactcccagatctctctcctgattggcaagggactccacgaattcgatagcttatgcgaccctgaagttaacgatttccgtgcgaaaatgtgtcagttctgcgaggaggcggcagctagacgccagcagctcggctgggaggcctggctgcaatactcctttccattgcaactggaaccatcggcgcagacctggggccccggcacgctccggctaccaaatagggctctgctggtgaatgtgaaatttgaagggtctgaagagagtttcacgttccaagtatctaccaaagacgtcccactggccctgatggcctgcgctctaagaaagaaggctacagtgtttcgacaacctcttgtggagcagcctgaagattacactcttcaggttaacggccgccacgaatatttatatggctcatacccgctgtgtcagtttcagtatatctgttcctgcttacatagtggcctaacaccacacctcacaatggttcatagttcgagtatccttgccatgcgagatgagcagtccaaccccgcccctcaagtgcagaaacctcgcgccaagcctccacccatccctgccaagaaaccatcttctgtcagcctctggagcctggaacagccctttaggatcgagttaattcaaggttcgaaggtcaatgccgatgaaaggatgaagttggttgtgcaggccgggctcttccacggaaacgagatgttatgtaaaacagttagttcttctgaagtcagtgtctgctccgaaccagtctggaaacaacggcttgagtttgatattaatatctgtgacttgccaaggatggcacgtctttgtttcgcactgtatgccgtgatcgaaaaggctaagaaggctcggagcaccaaaaagaagagtaaaaaggcggactgtccaatcgcctgggcaaatctgatgctgttcgattacaaagatcaacttaaaaccggtgaacggtgtctctacatgtggccatctgtgcccgatgagaagggcgagctcttgaacccaaccggcacagtgcgatccaatcctaacacagatagcgccgcggccctcctcatatgcctgccagaagtagccccccaccctgtttactaccctgctctcgagaagattttggaattaggacgtcacagtgagtgcgtacacgtgaccgaggaggagcagttgcagctgagagaaatcctggaacgaagaggctcaggcgagctttacgaacacgagaaggatctagtgtggaaactgcggcacgaagtgcaggaacattttcccgaagccttggcccgactccttctggtaacaaagtggaataagcacgaggacgtggcccagatgttgtatcttctgtgctcatggcccgaactacccgtattgtccgccttagaacttctggacttcagttttccagattgccacgtcggctcattcgccatcaaatccctgcgcaaacttaccgacgacgaactgtttcaatatttgctgcagttagtccaggtgctaaaatatgaatcttacctagactgcgagttaacaaagttcctgcttgacagagccctagcaaaccggaaaattgggcactttctgttctggcacctgagatcagagatgcacgtcccgtcggtggcccttagattcggccttattctggaggcttattgtcgagggagcactcaccatatgaaggtcctcatgaagcagggtgaagcgctcagcaagctgaaggctttgaacgactttgttaagctgtcctctcaaaaaacacctaaaccacagactaaggagctgatgcacctgtgcatgcggcaagaggcttatttagaggccctatcacacctgcagagcccgttggaccccagtactttacttgctgaagtatgcgtggagcaatgcacttttatggattccaagatgaagccactctggatcatgtattcaaacgaggaggccggctccggtggatccgtaggcatcatttttaaaaacggggacgacctgcgtcaggatatgctcaccctacagatgatccaactgatggacgttctgtggaaacaagaaggattggatcttaggatgactccttacgggtgtctgccaacaggagaccggacaggcctgatcgaggtcgttctccgttcagacacgattgctaacatccagctaaataagagtaacatggctgcaaccgccgcctttaataaggatgccttgttaaattggttaaagagtaagaaccccggtgaggccctggacagggcaatagaagagttcactctgtcttgtgctggttactgtgtcgcgacctatgtactcggaattggagacaggcattctgacaacattatgatccgtgagtctggccagctgttccatattgactttggacacttcctggggaactttaagacgaagtttggcatcaaccgcgaacgggttccctttatattgacctatgattttgtacacgtcatccagcagggaaagactaacaattcagaaaaatttgagaggtttcgaggttactgcgagcgagcctacacaatcttaaggaggcatggtctgctgttcctgcacctgtttgccctgatgcgcgctgccggactacctgagctcagctgcagcaaggacattcagtacctgaaggactccctggctttggggaaaacagaagaggaggcgctgaaacactttcgggtgaaatttaacgaggcgctgcgcgaatcctggaaaaccaaggtgaactggctcgcccataacgtgagcaaggataacaggcaatag

SEQ ID NO: 25573 - DNA, 3207 bp, Artificial Sequence
  Description of Artificial Sequence: Synthetic coding sequence
atgccccccggcgtggactgccccatggagttctggaccaaggaggaaaaccaatcagtcgttgtagatttcctcctacccacaggtgtctaccttaactttcccgtatcacgcaacgcaaacctctccacaattaagcaattactgtggcatcgcgcacagtacgagccactatttcacatgttgtctggcccagaggcctacgtctttacttgtattaaccagaccgctgaacaacaggaactcgaagatgagcagcggagactctgtgatgtgcagccgttcttgccagtattgcggctcgttgcccgtgagggcgaccgggtcaagaaacttattaattcccaaatctcattgctcataggtaaaggactacatgaatttgattctctttgcgaccccgaggttaacgatttccgggccaagatgtgtcagttttgcgaagaagctgcagccagacgccagcagctgggttgggaagcttggctgcagtactcctttccattacagctggagcccagtgcccagacgtggggacctggcacattgcgcctacccaaccgtgccttgttggttaatgtgaagttcgagggatctgaagagtctttcacattccaggtgtccacgaaagatgtgccactcgcactcatggcctgcgcattgcgaaaaaaggccaccgtatttagacagccattagtcgagcagcccgaggactatactctgcaggtcaatggtcgacatgagtatctttatggcagttatccgctctgccagtttcaggtgcagaagcctagagcaaagcctccacctattccggcgaaaaagccctcttctgtgagcctgtggtcactcgagcaaccatttagaatcgagttaattcagggaagcaaagtgaacgcagacgagcgcatgaagctagtggtacaggcaggcctgttccacgggaacgagatgctgtgcaaaaccgtctcatccagcgaggtgagtgtgtgcagtgaaccagtctggaagcagcgcctcgagttcgacattaacatttgcgatttgccccgcatggctagactatgtttcgctttgtatgccgtgattgagaaggcaaagaaagccagatcaactaagaaaaagagtaagaaggctgactgtcctatcgcatgggcaaacctgatgctgttcgattataaagatcaactgaagactggcgagcgctgcctgtatatgtggccctctgtgccagatgaaaaaggcgagttgttaaaccccaccggaacggtgcggagcaaccctaacacagacagcgccgctgcattactgatctgcctgccagaagttgctcctcatcccgtatactatccggccctggagaagctcccgggaggaatgctgcttgcgtctagagagtggcgtccggagcttctgtggatgcggctccacgctgaggactccgcaccttcccgcatgattggagtggccatgccggggctgggagtgctgcctgggctggtccaggccccaggcgacgcagagtgttctagactgttgcagatcctcgagctgggccgccattccgagtgcgtccatgtgaccgaggaagagcaactgcagcttagggagattctggaaagaaggggaagcggagagctatacgagcacgagaaggacttagtctggaagttaagacatgaggtgcaggagcattttcccgaggcacttgcccgcctgttgttagtcaccaaatggaataaacatgaggacgtcgcacagatgctttaccttttatgcagttggccggagcttcccgtactgtctgctcttgagcttctcgatttttcatttcctgactgccacgtcggctctttcgccatcaagtccttgcgaaagctcaccgacgatgaactgttccagtatcttcttcaactggtccaagtcctgaagtacgagtcttacttagactgcgagctcaccaagtttttgctggatagagctttggccaaccgaaagatcggccatttcctgttttggcacctccggagtgaaatgcacgtcccctcagtggccctgagattcggtctaatccttgaagcttactgcaggggcagtacacatcacatgaaggtgctgatgaagcagggggaggccttgtccaagctgaaggctctgaacgattttgtgaagctctctagccagaagacccccaagccacagacgaaagaattaatgcatctttgcatgagacaagaggcttatctggaggcactgtcacatttacagtctcctcttgatccctcgactttgttggcagaggtatgcgtggagcagtgcacattcatggactcaaaaatgaaaccactatggattatgtattctaatgaggaagcgggcagtggtggcagcgtgggcatcatttttaagaatggagatgatctgagacaggatatgctcactctgcaaatgatacagctgatggatgtgctgtggaagcaggaaggtctcgacctgagaatgaccccgtatggatgcctccccacaggtgaccggactgggctgattgaggtggtccttcgttccgacacaattgccaatatccagctgaacaaatcgaatatggcggccaccgccgcctttaacaaggatgctctgctcaactggcttaagtccaagaatccaggcgaagccttggatagggcgatcgaagaatttacactgagctgcgctgggtactgtgtcgccacatacgtcctgggcataggggatcgccattctgacaatatcatgatccgggaaagcggccaactgttccacatcgattttggacacttcctggggaacttcaagaccaagtttggcatcaaccgcgaaagggtcccgtttatattgacatatgactttgttcacgtaattcagcagggcaagaccaataattccgaaaaatttgagcgattccgtggctattgtgaacgggcctacacaatcctccgcagacatggactgctctttttacatctgtttgctctgatgcgagctgccggtctgcctgagctgagctgttctaaggatatccagtatctgaaagattcccttgcactaggtaagacagaagaagaagcactcaaacatttcagggtgaagttcaatgaggcccttcgcgagagctggaaaacaaaggttaattggctggctcataatgtgtcaaaagacaaccgccagtag

SEQ ID NO: 25574 - DNA, 960 bp, Artificial Sequence
  Description of Artificial Sequence: Synthetic coding sequence
atgatccccgagagcagcgagctggtggtgcaggccggcctgttccacgggaacgaaatgctgtgtaaaaccgtttctagtagcgaagtgtcagtctgtagcgagccagtgtggaagcaacggttggagtttgatatcaatatttgcgacctgcctaggatggctaggctctgtttcgcgttatatgccgtaatcgagaaggctaagaaggcacgtagcacgaaaaaaaaaagcaaaaaggctgactgtccaattgcgtgggcgaacctcatgctgtttgactataaggaccaactgaaaacaggtgaaagatgcctctacatgtggccgagcgtgccggacgaaaaaggtgagttgctcaaccccactggaaccgtgcgctccaatcctaatactgattcagcggccgcccttttgatttgcctccccgaagtagctcctcaccctgtttattacccggctctagagaagatacttgaactaggcaggcattcagagtgtgtgcacgtgaccgaagaggaacagttacaactgcgcgagattctggagaggcgcgggagcggggaactctacgagcatgaaaaagatctggtgtggaagcttagacacgaagtccaggagcactttcctgaagccctcgcccgtcttctgcttgttaccaagtggaataagcacgaggacgtcgctcaaatgctctacctgttgtgctcctggcctgagctccctgtgctgagcgcgttggagcttcttgattttagcttcccagattgccatgtgggcagttttgcaattaaaagtctccgcaagcttactgacgacgagctgtttcagtatcttttgcagctcgtgcaggtactgaagtacgagtcatacctggactgcgagctgacgaagtttcttctggacagagccctggccaaccggaagatcggacattttcttttctggcatctgcgatag

SEQ ID NO: 25575 - DNA, 3309 bp, Artificial Sequence
  Description of Artificial Sequence: Synthetic coding sequence
atggagctggagaactacaagcagcccgtggtgctgcgggaggacaactgcagacgtagacgcaggatgaagccccgcagtgcagccgctagcctgtcaagtatggaacttatcccaattgagttcgtgcttcccacttcgcagcggaagtgcaagtcgcccgaaacagctctgctccacgtggcaggtcacggaaatgtcgagcagatgaaggcacaggtctggttgagggccttggagaccagtgtcgctgccgacttttatcaccgcttagggccccatcactttctgctgctatatcagaaaaaaggacaatggtatgaaatttatgataaataccaagtagtacagacacttgactgcctaaggtattggaaggcaacccacagaagtcccggtcagatccacctggtgcagaggcaccctccttccgaggagtcccaggctttccaaaggcagctcacagccctgatcggctatgacgtgaccgatgtctcaaatgtgcacgatgacgagctggaattcactcgcaggggtttggtgacccctcgtatggccgaggttgcgtcccgggacccgaaactgtatgccatgcacccctgggtgacatctaaacctctcccagagtacctctggaagaaaattgctaataattgcatcttcatagtgatccacaggagcactaccagtcagaccataaaggtcagccctgatgataccccaggagcaatcttacagagtttcttcaccaaaatggccaagaagaagtcacttatggacatccccgaatcccagagcgagcaggacttcgtgctgcgcgtctgtggcagagacgaatatctcgtaggggaaacacccataaagaatttccaatgggttaggcactgtctcaaaaacggggaagaaatacatgtggtattggatacaccaccagacccggccctggacgaggtacgcaaggaagaatggcccctggtggacgattgcaccggggttaccgggtaccatgaacagctgaccattcatggcaaagatcacgagagtgtcttcactgtgagcttgtgggattgcgatcggaaattccgggtgaagattcgcggaatcgacattcccgttctgcctcgcaacacagacttaacagtgttcgtagaggcgaatattcagcacgggcaacaggttctctgccaacgcaggacttctccgaagccatttactgaggaagtgctgtggaacgtatggctggaatttagtattaaaattaaagacctgccaaagggagcccttctgaatctccagatttactgcggcaaggcccctgccctctcttccaaggctagcgcagaaagtccctcctctgagtccaaggggaaagttcaactactgtactatgtcaacctactactaatcgaccataggttcctgctgagaaggggggagtacgtcctccacatgtggcagatttcaggaaagggcgaggatcaggggtcctttaacgcagataagctgacatctgctaccaatcctgataaagagaactccatgagcatttcaattctgctcgacaactactgccatcccattgcccttccaaaacaccagccaacacccgatccggagggggaccgtgtgagagccgagatgcccaaccaattgcgcaagcagttggaagcaatcatcgccactgacccccttaaccccctgactgcagaggataaagaactcctgtggcacttccgctatgagtccctcaaacaccctaaggcctaccctaaactgttctcatccgttaagtggggccagcaggaaattgtggcgaagacataccaactgctggctagacgcgaggtctgggatcagagcgcactggatgtcgggcttaccatgcagcttttagattgtaacttctctgatgaaaacgtacgagccatagctgttcaaaaactggagagcctcgaggacgacgacgtcctgcattatctcctgcagctcgttcaggcggtaaagttcgaaccctatcatgactctgcgctcgcccgattcttattgaaaagaggactgagaaataagcgcataggccactttctgttttggttcctccgcagcgaaatagctcagagtcggcactaccagcagagatttgccgtgattctcgaggcttacctgagagggtgtggaacagccatgcttcatgatttcacccagcaagtgcaggttattgagatgttgcagaaagtgactctagatattaaatctcttagcgcagaaaagtatgacgttagtagccaggtgatctctcagctgaagcagaaactggagaacctgcagaattctcagcttcctgagtcgttccgggtaccctatgacccaggcctgaaggcaggcgcattagccattgagaagtgtaaagtgatggcatcaaaaaagaagcctctatggttagaatttaaatgcgccgacccaaccgccctgtctaacgaaacaattggcatcatctttaaacatggcgacgatctgaggcaggacatgttaatcttgcagatcctgcgcataatggagtctatctgggagaccgagtcacttgacctctgtctcctgccctacggttgtattagcaccggggacaagattggcatgatcgaaattgtcaaagacgctaccaccattgccaaaatccaacagtccaccgtgggcaatactggggctttcaaagacgaagtgctgaaccactggctgaaagagaaatcccctaccgaagaaaaatttcaggctgctgtcgagcgcttcgtgtattcatgcgccggctattgtgttgcaaccttcgttttggggattggggatcgacacaacgacaacataatgatcactgagaccggcaacctgtttcacatagactttggccacattctgggcaactacaaaagcttcttgggcattaataaagaacgggttccttttgtgctcactccggactttctgttcgttatgggtactagtgggaaaaagacatccccccacttccagaaatttcaggacatatgtgtgaaggcatatcttgctcttcgacatcacacaaatctgttaattatcctgtttagcatgatgcttatgaccggtatgccccaactaacctctaaggaggatatcgagtatatccgagatgccttgactgtgggcaagaatgaggaagatgccaagaagtactttttggaccagattgaagtctgccgagacaaagggtggacagtgcaattcaattggttcttacacctcgtgctgggtatcaagcagggtgagaagcactctgcgtag

SEQ ID NO: 25576 - DNA, 3309 bp, Artificial Sequence
  Description of Artificial Sequence: Synthetic coding sequence
atggagctggagaactacaagcagcccgtggtgctgcgggaggacaattgtagacgccggcgacggatgaagccccgaagtgcagccgccagcttgtcctccatggagctgattcccatcgaattcgtgttgcctacctcacagaggaaatgcaaaagtccggagactgcgttactgcacgtagccgggcacgggaatgtggagcagatgaaagcccaggtgtggctaagggcccttgagacttctgtggcagccgatttttatcaccgcctggggccccaccatttccttcttttgtatcagaaaaagggtcagtggtatgaaatatatgataagtaccaagtcgtccagacattagactgcctacgatactggaaagcaacacataggagcccaggtcagatacaccttgtacaaagacacccaccctccgaagaatctcaggcctttcagcggcagttaactgctctgatcgggtatgatgttaccgacgtatccaatgtccacgacgacgagttggaatttactcgacgcggactggtgacccctcgcatggccgaggtggcaagccgggatccaaaactttatgctatgcacccgtgggtgacttctaagccccttcctgagtacctgtggaagaaaatcgcgaacaactgtatctttattgtgatccacagatctactacaagtcagacgattaaggtgtcgcctgacgacacgcctggcgctatactccaaagcttcttcactaagatggccaaaaagaagtcactgatggacatccccgaatctcagtccgaacaggacttcgtcctgcgggtatgtggcagggacgagtacctggtgggagaaacacctattaaaaacttccagtgggtccgtcattgcctcaaaaatggagaggagattcatgtcgtcttagacaccccacctgacccagctctggacgaagtgcgcaaggaagagtggcctctggttgatgattgtaccggggtaactggataccatgagcagcttacaatccatggaaaggatcacgagagcgtgtttaccgtttctctctgggactgtgaccgcaagtttcgcgtgaagatcagaggaattgacattcctgtcctgccacgcaacacggacctcaccgtattcgtagaggcaaatatacaacacggccagcaggtactctgccagcgaagaactagcccaaagccctttactgaagaggtcctctggaacgtctggctggagttttccatcaagattaaagatctgcctaaaggcgccttgctaaaccttcagatttactgcggcaaagcaccagctctctctagcaaggcttctgcagagtccccttcaagcgaatcaaagggcaaggttcagctactctattacgtcaatttgctgctaatcgatcacaggttcctcttgcggagaggcgagtacgttcttcatatgtggcagatcagcggcaagggcgaagaccagggatccttcaacgctgataagctgactagcgcaaccaatccagataaggaaaattctatgagcatcagtatccttctggacaactactgccacccaatcgcactccccaaacaccaacccacacccgaccctgaaggcgacagggtgagagccgaaatgcccaatcaactccgcaagcagctggaggcaataatagccacagatccactaaacccacttactgccgaagacaaagagcttctgtggcattttcgatacgagagtttgaaacatccaaaagcctatcccaagttgttctcgagcgtcaagtggggacagcaggagatcgttgcaaagacatatcagctcttagccaggagagaagtctgggatcaatctgccctggacgtgggattaacaatgcaactgctggactgtaatttcagtgacgaaaacgtgagagccattgctgtgcagaagctggaatcactggaagacgacgatgttctgcattatctgttgcaactggtgcaggccgtgaagtttgaaccataccacgatagcgctttggctcgctttctactgaaaaggggcctgaggaacaaaaggattggccacttccttttctggttccttaggagcgagattgctcaatcaagacactaccagcagcgttttgctgtgatcctggaggcgtacctccgtgggtgcggcactgccatgctacacgactttacccagcaagtccaagttattgaaatgctgcagaaggtcacacttgatattaagagcctgagtgccgaaaaatacgatgtatcttcacaagtgatttcacagctgaaacagaagcttgagaatctccagaattcccagttgcccgaatcttttagggtgccctatgatcccggactaaaggctggcgcccttgcaattgaaaagtgtaaggttatggcctctaaaaagaagcctttgtggcttgagtttaagtgtgctgaccctactgcactttctaacgaaaccattgggatcatttttaaacacggcgacgacttacgccaggatatgttgatactgcagatactccgaataatggaatccatttgggagaccgagagcctggatctatgcttgctcccatacggatgcatttctacaggagacaagatcggcatgatcgaaatcgtgaaggatgctaccacaattgccaagatccaacaatctactgtcggcaacacaggggcgttcaaagatgaggttctgaaccactggttgaaggagaaatcacctaccgaggaaaaatttcaagctgccgtggagcgcttcgtttactcctgcgcaggttactgcgtggccacattcgtcctcggcattggcgaccggcacaacgacaatataatgattactgagactggcaacctgttccacatagacttcggacacatcctgggcaattacaaatcattcctcggtattaacaaggaacgcgtgccctttgtgttaactccggactttctgttcgtaatgggcacttcaggcaagaagacgtctccgcacttccagaaatttcaagacatttgcgttaaggcttatctcgcccttcggcatcacacaaatttactgatcatcctgttttctatgatgctcatgaccggcatgccacagctgacctcgaaagaggacattgagtatatccgagatgccctcaccgtggggaagaacgaagaagacgccaaaaaatacttccttgatcagattgaggtgtgcagggataaggggtggaccgtgcaatttaattggtttctccatctggtgctggggatcaaacaaggggagaaacactcagcctag

SEQ ID NO: 25577 - DNA, 3309 bp, Artificial Sequence
  Description of Artificial Sequence: Synthetic coding sequence
atggagctggagaactacaagcagcccgtggtgctgcgggaggacaattgccgaaggaggagaaggatgaaacccaggtcagcggcagcctcactcagcagtatggaactgattcctattgagttcgtgctgcccactagccaaaggaaatgcaagagtccggaaacagctctgctacacgtggcaggtcatgggaatgtcgagcagatgaaggcccaggtctggctgcgagcgctggagacgtccgtagccgctgacttctaccacagattgggtccccatcacttcctgcttctgtatcagaaaaagggccaatggtatgagatctatgacaaatatcaagtcgtccagactcttgactgcttacgatactggaaagctacccatagatcccctggtcagatacacttagtacaacgccacccacccagtgaggagagccaagcctttcagcggcagctcaccgcactaattgggtacgacgttacggacgtgagtaatgtgcacgacgatgagctggagttcacgcgccgcggccttgtcaccccaagaatggctgaggtggccagcagggacccgaagttatatgccatgcatccatgggtgacatccaaacccctaccagagtacctctggaagaaaatcgccaacaattgcatttttatagtaatacaccgatccaccaccagccagacaattaaggtttctccggatgacactcctggggccatcctccagagtttttttacgaagatggccaaaaaaaaaagcctaatggacatccctgagtctcagagcgagcaagatttcgtgctgcgggtgtgcggccgggacgagtacctggtgggagagactccaatcaagaactttcagtgggtccgacactgcctgaagaacggtgaagaaatacatgtagtactggatactcctccggaccccgcgctggacgaggtgagaaaagaagaatggccactcgttgatgattgcaccggggtgactgggtatcatgaacaactgaccattcacggaaaggatcacgagagcgtattcaccgtaagtctgtgggactgtgatcgtaagttcagagtgaaaataaggggtattgatattccggtcttaccacgcaacaccgacctgacagtctttgtcgaggccaacatccagcacgggcagcaagttctttgtcagcggcggacctcccctaagccgtttaccgaagaggtactgtggaatgtatggcttgagttcagcatcaagataaaggacctgccaaaaggagccctgctgaaccttcagatctactgtggcaaggctcctgcactcagttccaaagctagcgcagagtctccttccagcgagtccaagggcaaagttcagttactgtactatgtcaatctgcttctgatcgaccacagattcctgcttagacgaggcgagtatgtattacatatgtggcaaatctcaggtaagggggaggaccagggctctttcaatgccgataaattgacaagtgctacaaatcctgacaaagagaattcgatgagtataagcattctcctggacaattactgtcacccaatcgcactgcccaaacatcagcccacgccagacccagaaggagatcgcgttcgtgccgaaatgccaaaccagcttaggaagcagttagaggctatcatagcaactgacccgctgaaccccttaactgccgaggataaggagctgttatggcacttcaggtacgaaagcctcaagcaccccaaggcgtaccctaagttgttcagtagtgtcaagtgggggcaacaggaaattgtcgctaagacctaccagcttctggcccggcgcgaagtctgggatcagagtgcactggacgtgggcctcaccatgcagctgctggactgtaacttcagtgatgaaaatgttagagccatcgcagtgcagaagctcgagagccttgaggacgatgatgttctacattatcttctgcagttagtgcaagccgtcaagttcgaaccgtaccacgactccgctctggcccggtttcttctgaagagaggcctcagaaataagaggattggccatttcctcttttggttcttgcgatcagaaatcgcccaatctagacattatcagcagagattcgctgtcatactggaagcttatctcagaggatgtggcaccgctatgcttcatgatttcacccagcaggttcaggtcatcgagatgttacaaaaggttacactcgacatcaaaagcctctcagccgaaaaatacgatgtaagtagccaggtaatcagccagctgaagcagaagctcgagaacctccagaactctcagctaccagagtcttttagggtcccatatgacccaggcctcaaggctggcgccctagccattgaaaagtgtaaagtgatggcgagcaaaaaaaagccattatggcttgagttcaagtgcgcagatcctactgctctctctaacgagaccattggaatcatcttcaaacacggggatgatcttcggcaggacatgctcattcttcagattctgagaatcatggaaagcatttgggagacggaaagtctggacctatgtctcctaccctacggctgcataagtaccggagacaaaattggaatgatagagattgtgaaagatgctacgacaatcgccaagatacagcagtctaccgtaggcaacaccggggcctttaaagacgaggtcctgaaccattggttgaaggagaagagccccacagaggaaaagttccaggcggcggtggagcgctttgtctactcttgcgcgggctattgtgtagctaccttcgtattggggatcggggatcgccataacgataacattatgattactgagacgggcaacctttttcatatagacttcgggcacatcctcggcaattacaagtcctttctcggaattaacaaggaaagggttccattcgtcctgacacccgacttcttatttgtgatgggtacttccgggaaaaaaacttccccgcacttccagaaatttcaagacatctgtgtcaaggcttaccttgcactgcgtcaccacaccaacctgctgatcattctgttctctatgatgctgatgactggaatgcctcagcttacctctaaggaagacattgaatacatccgggatgcactgacagtaggaaaaaacgaggaggacgccaagaagtacttccttgatcagattgaggtgtgcagggataaaggttggaccgtccaattcaattggttcctccacctggttctcgggatcaaacaaggcgaaaagcactccgcctag

SEQ ID NO: 25578 - DNA, 5061 bp, Artificial Sequence
  Description of Artificial Sequence: Synthetic coding sequence
atggcccagatcagcagcaacagcggcttcaaggagtgccccagcagccacccggaaccaacacgcgccaaggacgttgacaaagaggaagctctgcaaatggaagctgaagctttggctaaactccaaaaagacaggcaggtgactgacaatcagcggggatttgagctatcctcatctactcgaaaaaaggcccaggtatacaataagcaggattacgacctaatggtctttccggaatcagactctcagaaacgggctctggatatagacgtggaaaagctcacccaggcagagttggaaaaactgctgctggacgacagtttcgagaccaagaagactcctgtcctcccagtcacaccaattctctccccctctttctccgctcagctctacttcaggcctacaatccagagaggccaatggccgcccggactaccaggcccctcgacctatgctcttccctctatctaccccagtacttactctaagcaggccgccttccaaaatgggtttaaccctaggatgccaacatttcccagcactgaacctatctatctctctcttccaggccagagcccctacttctcataccccttaacacctgcaacccctttccatccccagggctcactgccaatttatcgacccgtcgtctccacagatatggcaaaactgtttgataaaatcgcctctacatccgagttcctgaagaacggcaaagcccgaactgatctagagatcaccgatagcaaggtgagcaatttgcaggtcagccccaaatcagaagatatttccaaatttgactggctggatcttgacccactctcaaaacctaaggtggataacgtggaggtcctggatcacgaagaggagaaaaatgtgagtagtctcctggctaaagatccctgggatgcagttttactggaagaacgatcgacagccaattgtcacctggagaggaaggtgaatgggaaaagtctatccgtcgctacggtaaccagaagtcagtcgctcaacatacgaaccacccagcttgctaaagcacaaggccacatttctcagaaagatcccaatggcacctcttcacttcctaccggctcgagtctcctacaggaagttgaggttcaaaacgaggaaatggctgcgttttgcaggtctattactaagttgaagacaaagttcccctataccaaccatcggaccaaccccgggtatttgctgtcgccagtgactgcccagcggaatatttgtggagagaatgcctctgtcaaggtctcaatagatatcgaaggctttcagctgccagttactttcacatgtgatgtcagttcaacagttgaaatcatcattatgcaggcgctctgttgggtacatgacgacctcaatcaggtcgatgtaggatcctatgtgttaaaagtgtgcggacaggaggaagttctccaaaacaatcactgcctcgggagtcacgaacacatacagaattgtaggaagtgggacacagagatcaggcttcagctactgaccttcagtgcaatgtgccagaacctcgcccgaactgcggaggatgatgagacaccggtggacctgaacaagcacctgtatcagattgagaaaccctgcaaagaagctatgactcgtcaccctgtcgaggaactgctcgacagttatcacaatcaggtcgaacttgccctgcagatcgaaaatcagcaccgtgctgtcgatcaggtgatcaaggcagtacgtaagatctgttcagccctcgacggtgttgagacactagcgatcaccgagtccgtgaagaaactgaaaagagcagtgaacctcccgcggtcgaagaccgctgacgtgaccagtctctttggtggtgaagatacctctaggtcttctactcggggctctctcaatcctgagaacccagtgcaggtatccatcaaccaactgacagcagccatttatgatctgcttcgcctccacgcaaattcaggcagaagtcctacagactgcgcacagagctcaaaatcagtcaaagaagcttggaccacaacggagcagctccagttcaccatcttcgccgcccacggcatctccagtaactgggtcagcaattatgaaaaatactacttaatctgctctctgagccataacgggaaagatctgttcaagcctattcagtcaaaaaaggtagggacttacaaaaacttcttttacctcatcaagtgggatgagctgatcatttttcctatccagatctcacagcttccgcttgaatctgtcttgcacctgactctctttggcatcctgaaccaatcatcaggctcttcccccgacagcaataaacagcgaaaaggccctgaggcccttgggaaggttagcctgcccctttttgactttaagagatttctcacctgtgggactaaactgctatacctttggacttcaagtcatactaatagcgtgccgggcacagtcaccaagaaaggctatgtgatggagcggattgtgttgcaagttgatttcccttcacccgctttcgacatcatctacaccacaccacaagtggacagatcaatcatacaacagcacaacttagagacactggagaacgacatcaagggcaaactgctggatattctacataaagactcaagccttggcctttctaaagaggacaaggcatttctgtgggaaaagagatactattgctttaagcaccccaactgcctgccaaaaattttagcctctgcgccgaattggaaatgggtaaatctggcaaagacatattcactcctccaccaatggccggcgttataccctctgattgcgctggaattgctcgactctaaatttgccgatcaggaagtacggagtttggccgttacttggatcgaggcgattagcgatgacgaactgacggacctacttccacagttcgttcaggcgctcaaatatgagatttatttgaactccagcttggtgcagtttctcctgagtcgtgcgctgggcaacattcaaatagcacacaatctatactggctgcttaaggacgcgctgcatgatgtgcagttcagcacccggtatgagcatgtgctcggggctctgctgtccgtaggcggaaaacgcctaagggaggaactgttaaaacagacaaagctggtccagttgctggggggagtggcagagaaagtgaggcaggccagcggatcagcaagacaagtggttctgcagagatcgatggagcgcgtccagtcctttttccaaaaaaacaaatgccgattgccactgaaaccgtcattagttgctaaggagctgaatattaaaagctgctcattttttagctccaacgctgtacccctaaaggtgacaatggtgaatgctgaccccatgggagaagagatcaacgtcatgtttaaggttggcgaagacttacggcaagacatgttggccctgcagatgattaagatcatggataagatttggttgaaagaggggctggacctgagaatggtgattttcaagtgcctgtcaactggaagggatagaggtatggtggagcttgttcccgccagcgacacacttcgcaaaatacaggtggagtacggcgtgacaggatcattcaaagataagcccctcgccgagtggctgcgtaaatataacccctccgaagaggagtatgagaaagccagtgaaaactttatttactcgtgtgccggatgttgtgtcgccacgtacgttctcggcatttgtgataggcataatgacaatatcatgctgcggtcaaccggtcacatgttccacatagactttggtaaattccttggacacgcacagatgttcgggagctttaaacgtgatcgagcacccttcgtcctgacatccgatatggcatatgtgatcaacggcggcgaaaaacctacgattcgattccagttgtttgtggatctttgttgtcaggcctataatcttataaggaagcaaaccaatctcttcctaaatctgttgtctttaatgataccatctggcttaccagaattgacatccattcaggacttgaaatatgtaagagacgccctgcagcctcagacaactgacgccgaggctacaatattctttacacggctgatagaatcaagcctggggagtatcgccactaaattcaattttttcattcataatctggcccagctcagattttccggattgccatcaaacgatgagcctatcctgagctttagtcccaagacgtacagcttccgtcaggacgggcgcatcaaagaagtaagtgtgttcacgtatcataaaaagtataatcccgacaagcattatatttacgtcgtgcgaattctgcgtgaaggccagatcgagccttctttcgtattcagaacatttgacgagttccaagagcttcataataagctgtccataatattccccctttggaagctgccaggtttccccaatcggatggtattggggagaactcacatcaaagatgtggcggccaaacgtaagatcgagctgaacagttatctgcagtctctgatgaacgcaagtacggacgtggcggagtgcgatttggtgtgcacatttttccaccccctgcttcgggatgagaaggctgagggtatcgcgaggagtgccgacgctgggtctttcagccccacacccggccagattggcggcgccgtgaaactctcaatctcatatcggaatgggactttattcatcatggtgatgcacattaaggatctggtaacagaagatggcgcggacccaaacccttatgtgaaaacgtacctccttcctgataaccacaaaacctcaaaacggaagactaagatcagtagaaaaaccaggaacccgactttcaatgaaatgctggtgtactctggatactcaaaggaaacattgagacagcgcgagcttcagctcagcgtgttaagcgctgagagtctgagggaaaatttcttcctcggaggtgtgacactgccactcaaagacttcaacctttccaaggagaccgtgaagtggtatcaactcactgccgcaacttacctctag

SEQ ID NO: 25579 - DNA, 393 bp, Artificial Sequence
  Description of Artificial Sequence: Synthetic coding sequence
atggcccagatcagcagcaacagcggcttcaaggagtgccccagcagtcacccagagcctaccagggcaaaagacgtggacaaggaggaggccttgcaaatggaggccgaagcactggccaaactgcaaaaggataggcaagtgaccgacaaccaaaggggctttgaactcagcagctccacccgaaaaaaagcgcaagtctacaataaacaggactacgacctgatggtatttcccgagtcggattcccagaagagagcccttgatattgacgtcgaaaagctcactcaggccgagttggaaaagttattgttagacgactcatttgagacgaagaagactcctgtacttcccgtgacgcccatcctctccccttcctttagcgcccagtag

SEQ ID NO: 25580 - DNA, 1452 bp, Artificial Sequence
  Description of Artificial Sequence: Synthetic coding sequence
atggcccagatcagcagcaacagcggcttcaaggagtgccccagctcccatccagagccaaccagggcaaaagacgtggataaagaggaggccttacagatggaggccgaagctttggcaaagctgcagaaggaccggcaggtgacagacaatcaaagagggttcgaactgtcgagctcaacacgaaagaaggctcaggtatacaataagcaagattacgatttgatggtatttccagagtctgattcgcagaaaagggcactcgacatcgacgtcgaaaagctgacccaggccgagttagagaagctgctcctggatgattccttcgaaaccaagaaaacgcccgtgctgcccgtgacgcccattttgagcccctccttcagcgcccaactgtattttcggcctactatacagcgaggtcagtggccaccagggcttccgggcccatcaacctatgccctgccttctatctacccaagcacttactccaaacaagctgcctttcagaatggatttaatccaagaatgcctacgttcccatctaccgagcccatctacctgtccttgcctgggcagtccccctatttctcatatccactcaccccagccacgcctttccacccgcagggatccctcccgatttaccgcccggtggttagcacggacatggctaagctgttcgacaaaattgcaagtacgtccgagttcttaaagaatgggaaagcaagaactgatctggagattacagatagcaaagtttccaatttacaggttagccccaaatcagaagacatttctaaattcgactggctggacttagaccctctcagcaagcctaaagtggataatgttgaagtgttggaccacgaggaagagaagaacgtgtcgtccctgctcgccaaagacccttgggatgcagtccttcttgaggagcggagcaccgccaactgccacctcgaaagaaaagttaacggtaaaagcctgtccgtggcaacagtgactcgttctcaatcattgaacattcgcaccacacaactcgcaaaagcccaaggccacatctcacagaaggatcccaatggaacaagttccctgcccactggatccagtcttctccaagaggtcgaagtccagaatgaggagatggcggctttctgtcgtagcatcacaaagctgaaaacgaagttcccctacactaatcatcggaccaaccccggatatttgctgagtcccgtgactgcccaacggaatatctgcggggagaatgctagcgttaaagtgagtattgatattgaagggttccagttacctgtcacattcacctgcgacgtgtccagcactgtagagattattatcatgcaggcattatgttgggtgcacgacgatttgaatcaggtggatgtcggcagctatgtgctgaaagtttgcggccaggaggaagttttgcaaaaatag

SEQ ID NO: 25581 - DNA, 3921 bp, Artificial Sequence
  Description of Artificial Sequence: Synthetic coding sequence
atggccgccttctgccggagcatcaccaagctgaagaccaagttcccatacactaatcacaggaccaaccccggctatcttctatcccctgtaacagcccagcggaatatttgcggtgagaatgcgtcagttaaagtgtcaatcgatatcgagggctttcagctgcccgttacttttacttgcgacgttagctctacagtggagatcataataatgcaggccctatgctgggtacatgacgatcttaatcaggtcgacgtggggtcatatgtgctgaaagtatgtggccaggaggaagtgctgcagaacaatcattgtcttgggtcgcacgaacatatccagaattgtcgcaagtgggacacggagataagattgcagttgcttacgtttagtgcaatgtgtcagaacctcgcacgtaccgctgaggatgacgagactccagtggatctgaacaaacacctgtatcaaatagagaaaccttgtaaggaggccatgacaagacatcccgtggaagaactcctggactcttatcacaaccaggtggagctggctctgcaaatcgagaaccagcatcgagctgtggatcaggtgatcaaggccgttaggaaaatctgctctgctcttgatggagttgaaaccttggccatcactgagagcgtgaagaagctgaagcgcgcggtgaacctccctagaagtaagactgctgatgtaacatctttatttggcggcgaggatacgtcgcgttctagcacccggggctcactgaaccccgagaatcccgttcaggtctctatcaatcagctgactgctgccatctatgacctcctcaggttacacgctaattccggaagatccccaacagactgtgcgcaatcatccaaatctgtcaaggaagcatggaccacgacggagcagttacagttcaccatattcgctgcccacggaatttctagtaattgggttagtaactacgaaaagtactatctgatctgttctttgagtcacaatggaaaagacctgtttaagccaatacagtccaaaaaggtgggtacttataaaaactttttctacctaatcaaatgggatgaacttattatttttcccatacaaattagccagctgcccctcgaatcagtgttgcacttaacgctgtttggaatcctgaaccagagttccgggtcttcccctgactccaacaagcaacgtaagggtccagaggctctgggtaaggtctccctgcctctgtttgacttcaaaaggtttctgacttgcggcacgaagctcctatacctgtggacctccagccacaccaactctgttccagggaccgtcactaagaaaggatacgtgatggagagaatcgtgctgcaggtagatttcccatctccagcgttcgatataatctacacaacacctcaggtggatcgcagtatcatccagcaacataacttggagacactggagaatgacattaagggtaagctgttggacattctccataaagacagttcgctcgggctctcgaaggaggacaaggcatttctgtgggaaaagcggtactattgctttaagcatcctaactgcctgcccaaaattctggcatccgcacctaattggaaatgggtgaacctcgccaagacctattctttgttacaccagtggccagcgctgtacccattgatcgctctcgagcttctggatagtaaatttgctgatcaggaagtgcgctcactcgcggtgacttggattgaggccataagcgacgacgagctgactgacctcctgccccagtttgtgcaggccctcaagtacgaaatctatctcaactcctcattggtccaatttctcctctcaagagccctgggtaacattcagatcgctcataatctctattggctgctaaaggacgccttgcacgatgtgcagttcagcactcggtatgagcacgtcctgggcgccttattaagcgttggtggaaaaaggctgcgggaggagctgctgaaacagacgaaactggtgcagttgttgggtggggtggccgagaaagtcaggcaggcctccggctcggcacgtcaagtcgtattgcagcgaagcatggaacgggtgcagagcttcttccagaagaataaatgccggttgcccctaaaaccatcactggtcgcaaaagagctaaatatcaaatcctgttccttcttctcttcaaacgccgtacccctcaaggtaactatggtgaatgcagaccctatgggcgaagaaatcaacgtaatgtttaaggtcggcgaggacctcaggcaggacatgctggcgctgcagatgatcaaaattatggacaagatctggttaaaagagggattggacttgcggatggtcatattcaagtgtctgtcaaccggccgggatagaggcatggtagaactggttcccgctagtgacacacttagaaaaattcaagtggaatacggggtgaccggatctttcaaggacaagccactcgccgagtggctgaggaagtacaacccttccgaggaggagtacgagaaggccagcgagaattttatctactcctgcgctggctgttgcgtggctacttatgtgctcggaatctgtgatcgtcacaatgacaatatcatgctaagatcaactggacacatgtttcatattgactttggcaaattcctcggtcatgcgcagatgttcgggagtttcaaacgagatcgcgcacccttcgttctaactagcgacatggcgtacgttatcaatggcggcgagaaaccgacaatcagattccagttgtttgtggatctatgctgtcaggcctataaccttatccgcaagcagaccaatctgtttctgaacctcctgagcctgatgattccttcaggcctacccgaattgaccagcatacaggatttgaagtacgtgcgtgacgccctgcagccccagaccaccgatgccgaagccaccattttcttcactcggcttatcgagagctccctcggttcaattgcgaccaagttcaacttttttatacataacctggcccagttgcgattttctggtcttcctagcaatgacgagcccattctctcattttctcctaagacctacagttttagacaggacggtcggataaaagaggtgagcgtatttacataccataagaaatacaacccggacaaacactacatttatgtggtccggattctgcgtgaaggacagattgaaccatcgtttgtgttcagaacatttgacgaatttcaggagctccataacaagctgtctattatcttccccttatggaagttgccagggttccctaatagaatggtacttggtcgtacacacatcaaagacgtggcagccaaaagaaaaattgagttaaacagttatctgcaaagccttatgaatgctagtacagatgtcgccgagtgtgatcttgtgtgtacttttttccaccccctgcttagagacgaaaaggcagagggcattgctaggtcggccgacgcgggttccttcagcccaactcctggccaaattgggggcgccgtcaagttgagtatttcataccggaacgggacactcttcatcatggtgatgcatatcaaggatctggtgactgaggatggggctgacccaaatccctatgtcaagacgtatctgctgccagataaccacaaaacatctaaaagaaaaactaagatttcaagaaagactcgaaacccgacctttaacgagatgctggtctacagcggttatagcaaagagacccttcgccaaagggagctgcaactatccgtgctcagcgccgaaagcctaagggagaatttctttttgggcggtgtcactctgcctctgaaagattttaacctgagcaaagagactgtcaaatggtaccaacttacagccgccacatatctctag

SEQ ID NO: 25582 - DNA, 1947 bp, Artificial Sequence
  Description of Artificial Sequence: Synthetic coding sequence
atggcccagatcagcagcaacagcggcttcaaggagtgccccagctcgcatcctgaaccaacccgcgccaaggatgttgataaggaggaggccctacagatggaggcggaggcacttgccaagcttcagaaggatcggcaggtaactgacaatcagcgtggctttgagttgagctcttcgacgcgaaaaaaagcgcaggtatataataaacaggattacgacctgatggtctttccagagagcgatagtcaaaaaagggctctcgatatagatgttgaaaaactgactcaagcagagctggaaaaactcctgctggacgacagctttgagaccaagaagactccggtgctccctgtgacccccatcttatctccaagcttcagcgcgcaactgtactttcgaccaacaatacagcggggccagtggccacccgggcttccgggcccatcaacgtatgccctgccttctatttacccaagcacttattccaagcaagccgcttttcagaacggattcaatcctcgtatgccgacttttcctagtaccgagccaatttacctaagcctgccgggacagtccccatacttcagctaccccctgaccccagctactccattccatccccaggggagcctgccaatttatagaccagtcgttagcaccgacatggccaagttattcgataagatcgcttccacatcagaattcctcaaaaatggcaaagcacgcaccgacttggaaatcaccgattcaaaggtgtcaaacctccaggtttcacctaagagcgaggacattagtaagttcgactggctggatcttgatccactgtcaaagccaaaggtggataatgtagaggtgctggatcacgaggaagagaagaatgtctcgagcctcttagctaaagatccctgggacgctgtgctattagaggagcggtccacagctaactgtcacttggaaaggaaggtcaatggcaagtcgctgtcagtagctacggtgaccaggtcgcagtcactgaatataaggactacacaactggccaaggcccaaggccatatctcccagaaagaccccaatggtaccagtagccttccgactggttcatctctgctgcaagaggtcgaggtgcagaatgaggaaatggccgctttctgccgatcgattaccaagctgaagactaaatttccttatactaatcaccggacgaaccccgggtacctgctgagtccagtgacagcacagcggaacatttgtggcgaaaatgcaagcgtgaaggttagtatcgacatcgagggattccagttaccagtaaccttcacctgcgatgtgagctccaccgtggaaataataatcatgcaggctctgtgttgggtgcacgatgatcttaaccaggtcgacgtgggcagctacgttctcaaagtctgtggtcaggaggaggttcttcagaacaaccattgtctcgggtcccacgagcacatccagaactgcaggaagtgggacacagagatcaggctgcaattactgaccttctccgctatgtgccagaatctggcccggacagcagaagacgacgagacccctgtagaccttaataaacacctgtaccagatcgaaaaaccctgcaaagaggcgatgacaaggcatcccgtggaagagctcctggactcatatcacaatcaggtggagcttgccctccagattgagaaccaacatcgggccgtggatcaggtaattaaggccgtacggaaaatctgttccgccctcgacggcgtcgagaccctggccatcacagaaagcgtcaagaagctcaagagggcagtgaatctaccccgctctaagactgccgatgtgacaagtttgttcggaggcgaggacacatctcgaagctccactagaggatcactcaacccagaaaaccccgttcaggtgagtataaaccagctctag

SEQ ID NO: 25583 - DNA, 2664 bp, Artificial Sequence
  Description of Artificial Sequence: Synthetic coding sequence
atgggcgaggccgagaagttccactacatctacagctgcgacctggatataaacgtccagctcaaaataggatctctggaaggcaaacgagagcagaagtcctacaaggccgtcttggaagatcccatgttaaagttctcgggcctgtaccaagagacatgctctgacttatacgtaacatgccaagtgtttgccgaaggtaaacctttggcccttcccgtgcgaacaagttacaaggccttcagcacgaggtggaactggaatgaatggttgaagctccctgttaagtaccctgatctccctcgaaacgcacaggttgcactgacgatctgggatgtgtacggaccaggcaaagccgtaccagttggagggaccacggtgagcctcttcgggaaatatggcatgttcaggcaaggcatgcacgaccttaaggtatggcctaacgttgaggccgacggctctgagcctaccaaaacacctggccggacgtcttcgactctatccgaggaccagatgtcaaggcttgccaaactcaccaaggcacacaggcaaggacacatggtgaaagtagactggctggataggttaaccttccgcgagatcgaaatgatcaatgagagtgaaaagaggtcctcgaattttatgtacctgatggtggagttcagatgcgtcaagtgcgacgacaaggagtacgggatagtgtattatgaaaaggatggtgacgagtcatccccaatcctcacctcctttgagcttgtcaaggtgccggacccccagatgagcatggaaaatctagtggagtctaagcaccataaacttgccaggtccctgaggagcgggcccagcgatcacgacctcaagcccaatgctgccacgagagaccagctgaacatcatcgtgtcttatccccccaccaagcaattaacatacgaagagcaggacctggtgtggaagttcaggtattacctgaccaaccaagagaaagccctgacaaagttcttgaagtgcgtgaactgggatctaccccaggaagctaaacaagctctggaactgctgggcaagtggaaaccaatggacgtggaggacagcctggaactgcttagctctcactacaccaatccgaccgtgcggaggtatgctgtcgctcgactgagacaagcggatgacgaagacttactcatgtacctgctgcagctggtacaagccctgaaatacgagaacttcgatgacataaagaacggactcgaacccacgaagaaagacagtcagtcctcggtgtcagagaacgtatccaattccgggatcaatagtgcagaaatcgacagttcccagatcattacttcacctctgccatccgtctcttcaccaccgcccgccagcaaaactaaggaggttcccgacggcgagaatcttgaacaggatctctgtactttcttgatcagccgggcatgtaagaattccacactggccaactacctgtactggtacgtgatagtcgagtgcgaggatcaggatactcaacagagggacccgaagacacacgagatgtacctgaacgttatgcgaagattttctcaggccctgctaaagggggacaagtctgtcagggtgatgcggtccctgttggccgcccaacaaactttcgtagataggttggtgcaccttatgaaagccgttcagcgcgagtccggaaatagaaagaagaaaaatgagagattgcaggcactcctgggggacaacgagaagatgaacctgtccgatgtagagcttatccctctgcccctcgagccccaggtgaaaattcgtggtataatccctgaaaccgccactctctttaagtccgctcttatgcccgcccagctgttcttcaagacggaggatggggggaaatatcctgtgatcttcaagcacggcgatgaccttaggcaggaccagctcattctgcaaatcatctctctgatggataagctgcttcgaaaagaaaacctggacctgaaactgacgccctacaaagttctggccacatctaccaagcacggatttatgcagttcattcaatccgtaccagtggctgaggtgctcgacacagagggttctatacagaacttttttagaaagtatgctccatctgaaaatggccctaatgggatttcagctgaggtcatggacacttacgtcaaatcctgtgcagggtattgcgtgatcacatacattttgggggtgggcgatagacacttagacaatttactgctgacaaagaccggcaaattatttcacattgatttcgggtatatcctggggagggaccctaaaccccttccccccccgatgaaactgaataaagagatggtagagggcatggggggcacccagagtgagcaataccaagagttccgaaaacagtgttatactgcctttctgcaccttcggaggtactcaaatcttattctgaacctattctctctcatggtggacgcaaacatccctgacatcgctctggagcctgataagactgttaaaaaggttcaggacaaattccgactggatttgtctgacgaggaagcggtgcactacatgcagtccctgatcgacgaaagcgttcatgcgctgtttgctgcggtggtagaacaaatccacaagttcgctcagtactggaggaaatag

SEQ ID NO: 25584 - DNA, 2475 bp, Artificial Sequence
  Description of Artificial Sequence: Synthetic coding sequence
atgggcgaggccgagaagttccactacatctacagctgcgacctggacatcaacgtgcagttgaaaatctggaatgaatggttgaaattgccagtcaagtacccggacctcccccgcaatgcccaggtggccttaaccatctgggatgtctacgggccaggaaaagccgtgccggtggggggcactaccgtatcgctttttggcaagtatggcatgtttcggcaggggatgcatgatctgaaagtttggcccaatgttgaagctgacggaagcgaaccaaccaaaaccccggggagaacctcatccacactctccgaggatcaaatgagtcgactagccaagctcaccaaggcacatcgccagggacatatggtgaaagtagattggctggacaggttaacatttagagaaatcgagatgatcaacgagtcggaaaaacgctcaagtaattttatgtatctgatggtggaattcagatgtgtgaagtgcgacgacaaggaatatggcatcgtttactatgaaaaagatggtgatgaatcctcccctatcctgacctcttttgaactggtaaaggtcccagacccccaaatgagcatggaaaatctggtagagtccaaacaccacaagcttgcacgctcactgagaagcggcccttcggaccatgatctgaagcctaacgcagccaccagagatcagcttaacatcatcgtgagctatccgccaaccaagcaactgacatacgaggagcaggacttagtgtggaagtttcgatactacctgacaaatcaggaaaaggcactcacgaaatttttgaagtgtgtgaattgggacctaccgcaggaggccaagcaggccctcgagcttttagggaagtggaagcctatggacgtcgaggactctctggaactgctgtcatctcactacactaacccaacagtgcggagatacgccgtcgcgcgcctgcgccaggccgacgacgaggaccttctgatgtacctgctgcagctggtgcaggccctgaagtatgagaactttgatgacatcaaaaatggcctggaacccacaaagaaagattcgcagtcaagcgtgagtgaaaatgttagcaattctggtatcaacagcgccgagatcgactccagccagataattaccagccccctgccttcagtgtctagtcctccaccagcttctaaaacaaaggaagtgcctgacggcgagaaccttgagcaggacttgtgcacatttctcatctctagggcctgcaaaaactctactctcgcgaactatctttattggtatgtaatagtcgaatgcgaggaccaggatacacaacagagagaccctaaaacacatgagatgtacctcaatgtgatgcgaaggttctcccaggcactgctcaagggagataagagcgtgcgtgtgatgcgaagtctgctcgccgcccaacaaaccttcgtggacagacttgttcatctgatgaaagcagtacagcgagagagtggaaaccgcaagaagaagaatgagcgtttacaagccctgctgggggacaatgaaaaaatgaatctgagtgacgtggagttaatcccgctgccactggaaccccaagtaaagataagaggcatcataccagaaacagcaacactgttcaagtccgctttgatgccagcccagctgttcttcaagacagaagacggcggcaagtacccagtgatcttcaagcatggggatgatctgcgacaggatcagctcattctacagattattagcctcatggataagcttctacgaaaagaaaacctcgacctcaaattgaccccttataaggtgttggccaccagcaccaagcatggcttcatgcagtttattcagtcagtgcccgtcgcggaggtcttggatacagaggggtccattcagaacttttttcgcaagtacgctcccagtgagaatggtccaaacggaatctctgcagaggttatggatacctatgtcaagtcgtgtgctggatactgtgtgataacctatatcttaggtgtaggagaccggcacctggataacctcttgcttacaaagacggggaagctgtttcacattgacttcggatacatcctagggcgggacccaaaaccgctgcctccccccatgaagctgaataaagaaatggttgagggcatggggggaacccagtcagaacagtatcaggagttccgcaaacaatgctataccgcgtttctccatctccggcgatactcaaacctcatcctcaaccttttctctctgatggtagatgctaatatccccgatatcgctctagaaccagataagaccgtgaaaaaggtgcaggataagtttaggcttgatctgagtgatgaagaggccgtgcactacatgcagagtcttattgacgagtcagttcatgccctttttgcagccgttgttgagcagatccataaattcgcgcaatattggaggaagtag

SEQ ID NO: 25585 - DNA, 2175 bp, Artificial Sequence
  Description of Artificial Sequence: Synthetic coding sequence
atgagcgccgagggctaccagtaccgggccctgtacgactacaagaaggagcgggaggaagacattgatcttcatctaggcgatatcctaacagtaaacaaaggaagtctggtggccctgggattttccgatggacaagaggcacgccccgaagagatcggatggctgaatggctataacgaaactacaggggagcgtggcgacttccctggaacctacgtggagtatatcggacgaaagaagatttctccccccacccccaagccgcgcccccctcgaccgcttcctgtggctccaggttcctctaaaaccgaggcagacgtcgaacagcaagccctcactctgcctgatcttgctgagcagttcgcgccccctgatatcgcccctcctctactgattaaactagtagaggctattgaaaaaaaaggtctggagtgcagcactctctatcgaactcagagttccagcaacctggccgaacttcgtcagctgctcgactgcgacactccgtcggttgacctggagatgatagatgtccatgtactggctgatgcattcaaacggtacctgttggatcttcccaaccccgtgatcccggctgctgtatacagcgaaatgatatctcttgcaccagaggtgcaaagttcagaggaatacatccagctacttaaaaagctcatccggagtcccagtattcctcaccaatactggctcaccttgcagtatcttctcaagcactttttcaagttatctcaaacgtccagcaagaatctgctgaacgctcgcgtgctgtcagaaatattctccccgatgttatttagattctctgctgcaagctccgataataccgagaacctgattaaggtaatcgaaatattaatctccaccgaatggaacgagagacagccagcgcctgctctgccgcccaaaccccctaagccaactaccgtggcaaataatggcatgaacaataatatgagtcttcaggacgccgagtggtactggggggatatctctcgcgaggaggtgaacgagaaattacgagatactgctgatggcacatttctggtccgggatgccagcaccaagatgcatggggattatacactgacactgaggaagggagggaataataaactgatcaaaatctttcacagagacgggaagtatggctttagcgacccactgaccttctcctccgtggttgagctgatcaatcattaccgcaatgagagcctggctcagtacaatcctaagcttgatgtgaaactgctatatcctgtttccaagtatcagcaggatcaagttgtgaaggaggataatattgaggccgtcggcaagaagctgcatgagtacaacacccagttccaggagaaatccagggagtatgacagactgtacgaggagtacactcgcacaagccaggaaatccagatgaaaaggaccgctattgaggcattcaacgagaccatcaaaattttcgaggagcagtgccagacacaggagaggtactcaaaagaatatatcgaaaagtttaaaagggaggggaatgaaaaagagatacagcggatcatgcacaactatgataaacttaaatcacgcataagtgaaatcatagattcacgaagacgcttggaagaggacctcaaaaagcaggccgctgaatatcgtgaaatcgacaagaggatgaattctattaagcctgatctgatccagctccgcaaaacccgcgaccagtatttgatgtggctgacgcagaagggtgtgagacaaaagaaattgaatgagtggctgggaaatgagaatactgaggaccagtattctctggttgaagatgatgaagatttgccacatcatgacgaaaagacatggaacgtgggctcaagcaacaggaataaagcggaaaatcttctcagggggaaaagagacggaacttttcttgtccgggagagcagtaagcagggatgctacgcttgcagcgtcgttgtcgatggcgaagtcaagcattgtgtaattaacaagacggcaacagggtacggtttcgccgagccctataacttgtacagctccctcaaagagctcgtgctgcattaccagcataccagcctggtgcagcataatgactcactaaatgtcaccctggcttacccagtatacgctcagcaacgacgctag

SEQ ID NO: 25586 - DNA, 1275 bp, Artificial Sequence
  Description of Artificial Sequence: Synthetic coding sequence
atgcacaacctgcagaccctgccccccaagccccccaagcccaccacagttgccaacaacggcatgaataataacatgagcctacaggacgcagagtggtattggggcgacatctcaagagaggaggtgaacgagaagctgagggatacagccgacgggactttcctggtcagagatgccagcactaagatgcacggtgattacaccctgaccctcagaaagggcggaaataacaaactgatcaaaattttccacagagacgggaagtacggcttctccgacccacttactttttccagtgtggttgagctgatcaatcactacagaaacgaaagtctcgctcagtacaatccaaagctggatgtcaaactcctctaccccgtgagtaaatatcagcaagatcaggtcgtgaaggaagacaatatcgaggctgtcgggaaaaagctccacgagtacaatacgcaattccaggaaaaatctcgcgagtatgaccgactgtacgaggagtatacgcggaccagtcaggaaattcagatgaagcggaccgccattgaagccttcaacgaaacaatcaagatcttcgaggagcagtgccagacgcaagagagatatagtaaggagtatattgaaaaattcaaacgggaaggaaatgaaaaggagatccaacgcatcatgcataactacgacaagctgaagagtaggataagtgaaattatcgattcccgccgacgcctggaggaggatttgaaaaaacaggctgccgagtatagggagatcgacaaacgaatgaactcgatcaaacctgacctgattcagttgagaaaaaccagggaccagtatctcatgtggctaacacaaaagggcgtgaggcaaaagaagctaaacgagtggctgggcaatgagaacacggaggatcaatacagcctggtagaagatgacgaagatctccctcaccacgacgagaaaacatggaatgtaggcagctctaacaggaataaagccgaaaatttgctgagggggaagagggatggaaccttcctcgtcagggaaagctctaaacaaggctgctacgcctgttctgtggtggtcgacggtgaggtgaagcactgtgtaattaacaagacagcaactggctacggcttcgcagagccttacaatctgtatagctcactcaaggagctggttcttcattatcagcacactagtctagtccaacataatgactctttaaacgtgacactcgcctatccagtgtacgcacaacagagaagatag

SEQ ID NO: 25587 - DNA, 1365 bp, Artificial Sequence
  Description of Artificial Sequence: Synthetic coding sequence
atgtacaacaccgtgtggaacatggaggacctggacctggagtacgccaaaaccgacatcaattgcggaacagaccttatgttttatatcgaaatggatccgcccgcattgccacccaagccgccgaagccaactactgtggcgaacaacgggatgaataacaacatgagtctgcaggacgccgaatggtactggggggacatcagtagagaagaggtcaatgagaagctacgcgacaccgccgatgggacattcctggtgcgggatgccagcactaagatgcacggagactatacattaaccctgagaaagggcgggaataataagctgatcaagatctttcacagggacggtaaatacggcttcagtgatccactcaccttctcctctgttgtggagctgatcaatcactataggaacgagtcccttgcccagtataatccaaagcttgacgttaagctgctgtacccagtgtctaaatatcagcaggaccaagtggtaaaagaagataacattgaggcggtcggcaaaaagctccacgagtataacacacagtttcaggaaaagtctagggaatacgaccgcctgtatgaggaatacaccaggaccagtcaggagatacagatgaaacggacggctatcgaggcttttaatgaaacgattaaaatctttgaagaacaatgccagacgcaggagagatactccaaagaatacatagaaaagttcaagcgagaaggaaatgagaaagaaatccaacggattatgcacaactacgataaactgaagagcaggatttccgaaatcattgattcccggcggcgattggaagaagaccttaagaagcaggccgcggagtaccgcgagattgacaagcgaatgaactccatcaaaccagacttgatccagctgcgcaaaaccagagaccaatacctcatgtggctgacccagaaaggcgtgcgacagaagaagctgaacgagtggcttggcaatgaaaacaccgaggatcagtactcattggtggaagacgacgaagacctgccacatcacgacgagaaaacatggaatgtcggcagctcaaatcgtaacaaggctgagaaccttcttagggggaagagagatggcacattcctcgtaagagagtctagtaagcaggggtgctacgcgtgctccgtggtggtcgacggagaggtgaagcactgtgtcatcaataaaaccgcaaccggatatggttttgctgagccgtacaacttgtactcttctctcaaggagcttgtcctgcactatcagcatacatcgcttgttcagcacaatgactcgttaaacgtgacactcgcgtaccctgtctacgcgcaacaaaggcggtag

SEQ ID NO: 25588 - DNA, 2199 bp, Artificial Sequence
  Description of Artificial Sequence: Synthetic coding sequence
atgagcgccgagggctaccagtaccgggccctgtacgactacaagaaggagagagaggaggatattgacctgcatctgggtgatatcctgactgtgaacaagggaagtctggtggctctggggttttctgatggtcaggaggcccgacctgaagagattggttggctgaatggatataatgaaaccactggggaacgaggggattttccaggaacttacgtcgagtatataggaagaaaaaagatatctcctcctactccgaagcccagaccaccccggcccctacctgttgccccagggtcaagcaagacggaggccgatgtggaacaacaggccctgaccttgcccgatctagcagaacagttcgcccctcctgacatcgcccctcccttacttataaaactggtggaggcgatcgagaaaaaaggtctggaatgttccacactgtatcgtactcagagctcaagcaacctggcggagttacgccagttgcttgattgcgacaccccctcagttgacctggagatgatcgatgtgcacgtgcttgccgatgcattcaaaaggtatctgctggatctgccaaatccagtgattccggccgccgtgtatagcgagatgatcagtttggctcctgaagtacaaagctctgaggaatatatccagctgctgaagaagcttatccgcagcccgagcattccacatcaatactggctcacactgcaataccttctcaaacactttttcaagttgagtcagacttcatcaaagaaccttctgaacgccagggtcctatctgaaatcttcagccctatgctgtttagattctctgctgcttcctcagacaataccgaaaacttaattaaggtcatcgaaatactgattagtacagaatggaatgagagacagcctgcccccgcccttccacccaaaccgcctaagccgactacagtggctaacaacgggatgaacaacaatatgtccctgcaggacgctgaatggtactggggcgacatatctcgggaggaagtgaacgaaaaacttagggacacagctgatggtacctttctggttcgcgacgccagcactaaaatgcacggggattacacccttaccctacgaaaaggagggaataacaaactcattaagatctttcatcgggacggtaagtatgggttctccgatcctttgacgtttagctcagtggtggaactgataaaccactaccgtaacgaaagcctggcccaatataatccaaagctggatgtgaaactgttgtatccagttagcaaatatcagcaggaccaagtagtgaaggaggacaacatagaggctgtcggaaagaaactgcacgagtataacacgcagttccaggaaaagtcccgggagtacgatcgtctgtacgaggagtacaccaggactagccaggagatccagatgaagaggactgccattgaggcttttaacgagactatcaaaatattcgaagagcagtgccaaactcaggaaaggtactcaaaagaatacattgagaaatttaagcgcgaagggaacgaaaaggaaatacagaggatcatgcacaattatgataagctgaagtctaggatctcagaaattatcgactcacggcgcaggctagaggaggacctgaaaaagcaggcagcagagtatcgtgagatcgacaagcggatgaacagcatcaagccagaccttatccaactgcggaagaccagggaccagtatctcatgtggcttacacagaagggagtacggcagaagaagctgaacgagtggctaggtaatgagaacaccgaggagaacttcctgtcctgtttgccttcacaatactctttagttgaagacgatgaagatctacctcaccatgatgagaagacctggaacgtggggagttctaacaggaataaagctgagaaccttctgaggggaaaacgggacggcacgttcctcgttcgggagtcaagtaaacagggctgctacgcgtgcagcgtggtggttgacggcgaagttaaacattgtgtgattaacaagaccgcgaccgggtatgggtttgcagagccctacaatctgtattcttctctgaaggagttggtgcttcactaccagcacacctcattggtacaacataatgacagcctgaatgtgaccttggcgtatcctgtgtacgcgcagcaacggcggtag

SEQ ID NO: 25589 - DNA, 2175 bp, Artificial Sequence
  Description of Artificial Sequence: Synthetic coding sequence
atgagcgccgagggctaccagtaccgggccctgtacgactacaagaaggagagggaggaagacattgacctgcatttgggggacatcctgacagtgaacaagggctcacttgtggcactgggattctcagacgggcaagaagcccgccccgaggagatcggatggcttaatggctataatgagacaaccggagagcgtggtgattttcctggcacctacgtggagtatatcggtcggaaaaaaatctcccctcccacccctaaacctcgaccacctaggccactgccagtcgcgccagggtcatctaaaactgaagcggacgtggaacaacaggccctaactctgcccgatctcgcagagcagttcgctcctccggacatcgcaccacctcttctgataaaactcgtggaagcgatcgaaaagaaaggacttgaatgctccacactatacaggactcagtccagctccaacctcgctgaactgagacagctgctcgactgtgataccccaagcgttgatttggagatgatcgatgtccacgtgcttgccgacgcctttaagcgctaccttttggacctacccaatcctgtgatacctgcggcagtttattccgagatgattagtctggctcctgaagtgcagtcctcggaagaatacatacagcttctcaaaaagctcatccggtcaccctcaatcccacaccagtattggctgacacttcagtatctgctgaagcacttttttaaactttcacagacctcctctaagaacttacttaatgcacgggtcctgagcgagattttttccccaatgctctttcgattctcggctgccagtagcgataatacggaaaatctgatcaaggtaatcgaaatattgatttctaccgagtggaacgagagacagcccgcgcctgcccttccccccaagcctcctaaacctactactgttgccaataatgggatgaacaacaacatgtcgctccaggacgctgaatggtattggggtgatatttcccgcgaagaagttaacgaaaagctgcgcgacacagcggacggcacattcctggtacgcgacgccagtactaaaatgcacggcgattataccttgacactccgcaaggggggcaataacaagttaatcaaaatctttcaccgagacggtaagtacgggttctcagatcccctgaccttctctagcgtagtggaattgatcaaccattaccgaaacgaatcactggcccagtataaccccaagctagatgtcaaacttttgtaccctgtgagtaaataccagcaggatcaagtggtcaaagaagacaacatagaggccgtcggcaaaaaactgcacgagtacaatacacagtttcaggaaaaatctcgggaatatgatcgtctgtacgaggagtacacccggacgtcccaggagattcaaatgaagcggactgcgattgaggcctttaacgaaactattaaaatcttcgaggaacaatgccagacacaagaacgctactcaaaagagtatatagagaaatttaagagggaagggaatgagaaggagatccagcggattatgcataattacgataaattgaaatctcggatctcagagattatcgacagtcgcaggaggctggaagaggatttgaaaaaacaggccgctgaataccgcgagatagataagaggatgaacagcattaaacccgatcttatccagcttcgaaaaacaagggaccaatatttgatgtggctaacccagaagggtgttagacagaagaagcttaacgagtggcttggcaacgaaaataccgaggaccagtattctcttgtggaggacgatgaagatcttccacaccacgatgagaaaacttggaatgtgggcagcagtaatcgtaacaaggctgagaacctactccgtggcaagcgtgacggcacatttttggtcagggagtcttcgaaacagggctgttatgcgtgctcggtcgttgtcgatggggaagtcaagcactgcgtgatcaacaagacagcaacgggatacggctttgctgaaccgtacaacctttattcatcccttaaagaacttgttctgcactatcagcatacctcattagtccagcacaatgactcacttaacgtgacactggcctaccctgtctatgcacagcagaggcgctag

SEQ ID NO: 25590 - DNA, 414 bp, Artificial Sequence
  Description of Artificial Sequence: Synthetic coding sequence
atgcacggcgactacaccctgaccctgcggaagggcggcaacaacaaactaatcaaaattttccatcgagacggaaagtacggattctctgacccactgactttcagctccgtagtggagcttattaaccactatcggaacgaatccctggctcaatataatcccaaattagacgtgaagctcctttatcctgtgtccaagtatcagcaggatcaagtcgtgaaagaagacaatatcgaagcagtcggcaaaaaattgcacgagtataatactcagtttcaggagaagtcccgagaatacgaccgattatacgaggagtatactcggacttcccaagagatacaaatgaagagaaccgccattgaagctttcaacgaaaccattaagatttttgaggagcaatgccagacttag

SEQ ID NO: 25591 - DNA, 2175 bp, Artificial Sequence
  Description of Artificial Sequence: Synthetic coding sequence
atgagcgccgagggctaccagtaccgggccctgtacgactacaagaaggagcgggaggaggatatcgacctgcatctgggggatattcttaccgttaacaagggaagtttagtggccctagggttctctgacggtcaggaagcacgacccgaggagatcggatggctgaacggatacaacgagaccacgggcgaacggggcgatttccccggaacgtacgtggaatacatcggtcggaagaagatcagtccgcccaccccgaagcctcgaccgccccgacccctacccgtcgcaccgggctcaagtaaaacagaggcagacgttgagcagcaggccctaacactgcctgatcttgcagagcagttcgcacccccggacatagcgccacctctgctgatcaaattagtcgaggcaattgagaagaaggggctggagtgtagtactctctatagaacacagtcatctagcaacctggcagagctgaggcagctgctggactgcgataccccctctgtcgatctggagatgatcgatgtgcacgtcctggctgatgcattcaaacgctatctacttgatcttccgaatcccgtcattcccgcagccgtgtactcggaaatgatctccctggctcccgaagtccagtcttccgaggagtacattcagttactgaaaaaactgatcaggagccccagcataccccatcaatactggctgacgctgcaatacctgctgaagcacttttttaaactgtcccagacctcaagtaaaaatctgctgaacgcccgagtcctgagcgagattttttcaccaatgctgttcaggttcagtgccgcgagctccgacaatacagaaaatctcattaaggtgatagaaattttgatcagcaccgagtggaatgagcgccagcccgctccggccctgccacctaagccaccgaaaccaacaactgttgccaacaatggcatgaacaacaatatgtcccttcaagatgccgagtggtactggggtgacattagccgagaagaggtaaatgagaagctccgtgacacggccgatggtacctttcttgtcagagatgcctccacaaagatgcatggtgattataccctgacactgaggaagggagggaataacaaattaataaagatatttcaccgcgacgggaagtatgggttctccgaccctctgactttctcctccgttgtagagttaatcaaccattacagaaacgagagcctggcacaatataacccgaaactcgacgtgaagctcctgtaccccgttagcaagtaccaacaggaccaagttgtaaaggaagacaatattgaagcagtggggaagaagctccatgaatataacacccagttccaggaaaagtcccgagagtatgatcggctctatgaggaatatacaagaacctcacaggagatacagatgaagcgcaccgccattgaggcattcaatgaaactattaagatttttgaagagcagtgccaaacccaggaaagatatagtaaggaatacatcgaaaagttcaagagggagggaaacgaaaaggaaatccaacggattatgcacaattatgacaaattgaaatcaaggatctctgagatcatcgacagccggcggcggcttgaagaggatcttaaaaagcaggctgcagaatacagagagattgacaagagaatgaatagcataaaacctgatctgattcagctcagaaaaacccgagatcaataccttatgtggctgactcagaagggggttcggcagaagaagctgaatgagtggctgggtaacgagaacacggaggatcaatactcgttagtggaggatgacgaggatctaccccatcacgacgagaagacatggaacgtggggtcgagcaaccggaacaaggcagagaacctcctcagggggaagagggacggcacctttctcgtgagggagtcctcaaagcagggttgttacgcttgcagtgtcgtcgtcgacggtgaagtcaagcactgtgtgatcaacaagacggccactggctacggttttgccgagccctacaatctgtactcctcgctgaaagagcttgtgctgcattaccaacacacatcccttgtgcagcataacgacagcctgaacgtgactctagcttatcccgtctatgcccagcaacgtcggtag

SEQ ID NO: 25592 - DNA, 1224 bp, Artificial Sequence
  Description of Artificial Sequence: Synthetic coding sequence
atgctgttcgacaaggtgaaggccttcagcgtgcagctggacggcgctacagccggcgtggagcccgtcttctccggagggcaggcagtcgcaggccgggtcctactggagctgtcctctgccgctcgcgttggagctctcaggctccgggctcgaggtagggcacacgttcactggaccgagagcagaagtgctgggtctagtacggcctatactcagagctactcagaaagggtggaggtggtgtctcacagagctaccctgctcgctccagatacaggggaaactaccactctgccgcccgggcgccatgaatttctgttctcttttcaattaccgccaacactagttacctcctttgaaggcaaacatggctcggttagatattgcatcaaagccactctgcatcgcccatgggtgcccgctaggcgcgcaagaaaagtgtttactgtgatcgaaccagtagatatcaatacgcctgctctcttagccccccaggctggcgcacgagaaaaagtcgcgcgctcatggtactgtaacagaggtctggtgtccttatctgccaagatcgaccgcaagggctacacccccggggaggtgattcccgtttttgcggagatcgataatggctcgacccgcccggtgttaccaagagctgctgtggtgcagacccagactttcatggctcggggcgctcggaaacagaagagagccgtcgtggcatctctggccggagaaccagtggggcccggacagcgggccctgtggcagggccgcgcactacggatcccccccgtggggccaagtatacttcactgtagagtgctgcatgtagattacgctctcaaggtctgcgttgacatccctggcacttccaaactcttgctcgagctcccacttgtgattggcaccatcccgttgcatcctttcggttcacgcagctctagcgttgggagtcacgcgtccttcctgctcgactggcgtctgggtgctctccccgaaaggcccgaggctccacccgagtacagtgaagtcgttgccgacaccgaagaagccgcgctcggtcagagccccttccctctgccccaagaccctgatatgagtctggaggggccattcttcgcttatattcaagaattccgatacaggccgcctcctctgtactctgaagaagaccccaaccctctgctgggcgacatgcgacctaggtgtatgacttgttag

SEQ ID NO: 25593 - DNA, 1386 bp, Artificial Sequence
  Description of Artificial Sequence: Synthetic coding sequence
atgtacaacaccgtgtggagcatggaccgggacgacgccgactggagggaagtgatgatgccatattctacagaactcatattctatattgagatggatccgccagctcttccaccaaagcctccaaaaccaatgacttctgcagtccccaatggaatgaaggactcatccgtcagcctgcaggatgccgagtggtactggggcgacatttctcgcgaagaagtgaatgacaagttgagggacatgcccgacgggacctttctggtgagggacgccagcacgaagatgcagggtgactatacactgacgctccggaaagggggtaacaacaagctgattaaaatttaccaccgcgatggcaagtacggattctcagacccacttacctttaattccgtggtagagctgatcaaccactatcaccatgagtctctggcacagtataaccccaagctggacgtcaaactcatgtacccagtttccaggtatcagcaagaccagttggttaaagaggacaatattgatgctgtgggcaaaaaactgcaggaataccattcccagtatcaggagaaaagtaaagaatacgacaggctttacgaagagtacaccagaacgtctcaggagatccagatgaaaaggacagccatagaagcattcaatgagactattaagatctttgaagaacagtgtcatactcaggagcaacactcaaaagagtatatcgaacgttttcggcgcgaaggcaatgagaaggaaatcgaacgcatcatgatgaattatgacaagctgaaatcacgactaggggagatccatgatagcaagatgcgcctggagcaggacctcaagaaccaggctctggacaacagggaaattgataaaaaaatgaattccatcaaacccgatctgatacagctacggaaaatcagagatcagcatctcgtgtggctcaatcataaaggagttagacaaaagcggctcaacgtatggctgggaattaaaaacgaagacgcagatgaaaactactttattaatgaagaagacgaaaaccttccccactatgacgagaaaacctggtttgtggaagacattaacagagtccaggccgaagaccttctttatggcaagccagacggtgccttcttgatcagggaaagttcaaagaaggggtgttacgcgtgttctgtcgtggccgatggcgaagtgaaacactgcgttatctacagtaccgccaggggctatggcttcgctgaaccatataacctgtatagcagtctgaaagaactcgtgctgcattaccaacaaacctccttggtccagcacaatgattcactgaatgtccgcctcgcatacccggtgcatgctcagatgcctagtttgtgccgatag

SEQ ID NO: 25594 - DNA, 1101 bp, Artificial Sequence
  Description of Artificial Sequence: Synthetic coding sequence
atgtacaacaccgtgtggagcatggaccgggacgacgccgactggcgtgaagtgatgatgccctacagcaccgagcttatcttctacatcgagatggatcctccagccgctgaagttaatgataagctccgggatatgcccgatggcacattcctggtgcgggatgcttcaacaaagatgcagggtgactacacattaacattgcgtaagggcgggaataataaactcatcaaaatttatcacagagatgggaagtatggcttctccgacccactcacattcaactccgtggtggagctaattaatcattaccaccatgagtccctggctcagtataatccgaagctggacgtaaaactgatgtatccagtgagccggtatcaacaggatcagttagtaaaagaggacaatattgacgcggtgggcaagaaactgcaggaatatcactcacaatatcaggagaaaagcaaggaatatgataggttgtatgaagaatataccagaacctcacaggagatccagatgaagagaactgcaatcgaggcattcaacgagaccattaaaattttcgaagaacaatgccacacccaggagcagcattctaaagaatacatcgagcggtttaggagagaaggcaacgaaaaggaaatcgaaaggtggttaaatcacaagggggtgcggcagaagcggcttaatgtgtggttggggattaagaatgaggacgccgatgagaattatttcattaacgaggaggatgagaacctgcctcactacgacgaaaaaacctggttcgtcgaggacattaatagggttcaggctgaagacttactgtacgggaaaccagacggcgcctttttgatacgggaatcttccaagaaggggtgttatgcatgttccgtggttgcggacggcgaggtcaaacactgtgtcatttatagtactgcaagaggctatggctttgccgagccttacaatctgtacagctcacttaaagagcttgtgctgcactaccagcagacaagcctcgtccaacataatgactccctgaatgtgcgcttggcataccctgtgcatgcccagatgcccagcctgtgcaggtag

SEQ ID NO: 25595 - DNA, 1209 bp, Artificial Sequence
  Description of Artificial Sequence: Synthetic coding sequence
atgtacaacaccgtgtggagcatggaccgggacgacgccgactggcgagaggtgatgatgccatacagtaccgagctcatcttttatattgaaatggatcctccggctcttccccccaagccaccgaaacctatgacgtccgctgtaccgaacggtatgaaggacagctccgtctccttgcaggacgcagagtggtattggggtgacatttcccgagaagaagtcaacgacaagctgagagatatgccagacgggaccttcctggtgcgagacgccagcactaagatgcaaggcgactacacactgacgctcaggaaggggggaaataataaactgatcaagatctaccaccgagatggtaagtacgggtttagcgatcccctcacatttaattccgtcgtggaactcattaatcactatcatcacgaaagcctggcccagtacaatcccaagctggatgtaaaactgatgtacccagtttctcgttatcagcaggaccagctagtgaaggaggacaatattgacgcggtaggaaagaaattgcaagagtatcattcccagtaccaggagaagagcaaggagtatgacaggttgtatgaggagtatacccggacgagccaggagatacagatgaagcgaactgcaatcgaagctttcaatgaaaccataaagatctttgaggaacagtgccatacacaggagcagcactctaaggagtacattgagcggttccggagagagggcaacgaaaaagaaattgagaggtggttgaatcacaagggtgtcagacaaaaacgtcttaatgtctggctgggaatcaagaacgaggatgctgacgagaattactttattaacgaagaagatgaaaatctccctcattatgatgagaagacgtggttcgtggaggacattaatcgggtgcaggctgaagacttactgtatgggaagcccgatggtgcttttctgatcagagagagttcaaagaagggatgttacgcctgctcagtggtggcagacggagaagtcaagcattgtgtaatttactcgaccgcccgaggttacgggtttgcggaaccctacaatctctacagctctcttaaagaactcgtgctacattatcagcagacctccctggtgcagcataacgacagccttaacgtgagactggcctaccctgtacatgcccaaatgccatccctgtgcagatag

SEQ ID NO: 25596 - DNA, 1386 bp, Artificial Sequence
  Description of Artificial Sequence: Synthetic coding sequence
atgtacaacaccgtgtggagcatggaccgggacgacgccgactggcgtgaggtgatgatgccgtattccactgaacttatattctacattgaaatggatccccccgcattgccgccaaagcccccaaaacccatgacctctgcagttcccaacggtatgaaggactcatcagtgagtcttcaggatgctgaatggtattggggtgacatctcacgggaagaggtcaatgacaagctgcgcgatatgcccgacggcactttcttagtgagagacgctagcactaaaatgcaaggtgactacaccctcactctgcggaagggcggtaacaataagcttatcaagatctatcaccgagacggcaagtatggattcagtgaccccctcacgttcaactccgttgtggagctgatcaaccattaccaccatgagtcactggcccaatacaatccaaagctggacgtaaaactgatgtacccagtgagccgctaccagcaagaccagctggtgaaggaggacaatatcgacgctgtaggtaagaaactccaggagtaccatagccaatatcaggagaaatccaaggaatatgatagactctacgaggaatatacgcggacatcccaggagattcaaatgaagagaaccgcaatagaagcattcaatgagaccatcaagatattcgaagagcagtgtcatacacaagaacagcactctaaggaatatatcgagcgattcaggagagaaggcaatgaaaaggaaatagaacgcatcatgatgaattacgacaagctgaagtccaggctgggagaaatccatgacagtaagatgcggctggaacaggatttaaaaaatcaggccctggataaccgtgagattgataagaaaatgaatagtatcaagcccgacctgatccaactcaggaagatacgagaccagcatctcgtgtggcttaatcataagggtgtcagacaaaagcgattaaacgtgtggctaggaattaaaaacgaagacgctgacgaaaactacttcatcaatgaagaggatgaaaatttgccccactatgatgaaaagacatggtttgtcgaagatatcaatcgggttcaggccgaggaccttctttacggcaaaccggacggggcctttttaatccgcgaaagcagtaaaaagggttgttacgcatgttctgtcgttgccgacggcgaggtgaaacattgtgtgatctacagcacggctagaggttacggcttcgccgaaccatacaacttatattctagcctcaaagaacttgtactgcactatcaacagacgtcactggtgcaacacaacgattcgctcaacgtgaggcttgcctatccagtgcacgcgcagatgccttcactgtgccgatag

SEQ ID NO: 25597 - DNA, 1386 bp, Artificial Sequence
  Description of Artificial Sequence: Synthetic coding sequence
atgtacaacaccgtgtggagcatggaccgggacgacgccgactggagggaagtcatgatgccgtacagcaccgaattaatcttctacatcgagatggatccccctgcattgcctcccaaaccccctaagcctatgacctcggcagttcccaacggcatgaaagacagtagtgtgagtctgcaggatgctgaatggtactggggggatatctccagggaggaagttaatgacaaactccgcgatatgcctgatggtactttcctcgtgcgcgacgcctccacaaagatgcagggagactatacactgactctgcgaaaaggcgggaacaacaagctcatcaagatttaccacagggatggcaagtatggattctccgaccccttaaccttcaacagcgtagtggagcttatcaatcactatcaccacgagtccctcgcgcaatataaccctaaactggacgtaaagcttatgtaccccgtcagtagataccaacaggatcaactggtcaaggaggataatatagatgccgtaggaaagaagttgcaagagtatcactctcaataccaggagaaatcaaaagaatatgatcggctctatgaagaatatacgcgaacctcacaggagatccagatgaaacgaaccgctattgaggcctttaacgaaactattaagatttttgaagaacagtgccatacacaggaacagcattccaaggaatatatcgaaaggtttcgcagggagggcaacgagaaggagattgaaaggatcatgatgaattatgacaagcttaaaagccggcttggtgaaatccacgatagcaagatgcgactagagcaggatttgaagaaccaagcgcttgacaatcgagaaatcgataagaagatgaatagtatcaagccggatctgatccagcttcggaagataagggaccaacacctggtgtggttgaatcataagggcgttaggcagaaacgcctcaatgtgtggctggggatcaagaatgaggacgctgacgaaaactacttcattaacgaggaagatgagaacctgccccactatgatgagaagacatggtttgtggaagacattaacagggtgcaggctgaagaccttctttatggcaagcctgacggggccttcttgatccgcgaatcctccaagaagggatgctatgcctgttccgtggtggcagacggcgaagtgaaacactgtgttatctattctacggcccgcgggtatggttttgctgaaccatacaatctctattcttcacttaaggagctagtgctgcactaccaacaaacatcactcgtgcaacataacgatagcctgaatgtcaggttagcatatccggttcacgcccaaatgccctccttgtgtcgctag

SEQ ID NO: 25598 - DNA, 1209 bp, Artificial Sequence
  Description of Artificial Sequence: Synthetic coding sequence
atgtacaacaccgtgtggagcatggaccgggacgacgccgactggcgggaagtgatgatgccttattctactgagttgatcttctacattgaaatggacccccctgcgttgccgcccaagcccccaaaaccaatgacatcagcagtcccaaacggcatgaaggactcgtctgtctctcttcaggacgcagagtggtactggggggacattagccgtgaggaagtaaacgacaagctgcgagatatgcctgatggaactttcttggtgcgcgatgcaagtacaaagatgcaaggcgattatacacttaccctgcgcaaggggggaaacaacaagcttatcaagatataccacagagacggaaagtatggctttagcgacccgctaacctttaacagcgtggttgagctgatcaatcactatcatcatgagtccttggcacagtataaccctaagcttgacgttaaacttatgtaccccgttagcagatatcagcaagaccagctcgttaaggaagacaatatcgacgccgtgggcaagaagctgcaagagtaccactcccagtatcaggagaaatcaaaagagtacgaccggctatacgaagagtacacaagaacaagccaagagattcaaatgaagcgcaccgcgatcgaggcctttaacgagaccattaaaatctttgaggaacaatgtcacacccaagaacagcatagtaaagaatatatcgagagatttcgtagggaagggaacgagaaggagattgagcggtggctcaaccacaaaggggttcgacagaagcggttgaacgtctggttgggtatcaagaatgaagacgccgatgaaaactacttcattaatgaagaagatgagaacctccctcattacgatgagaagacttggtttgtagaggacattaaccgcgtgcaggccgaggacctgctctacggaaaacctgacggtgcttttctcattagagagtcctctaagaaagggtgctacgcatgtagcgttgtagccgatggagaggtcaagcactgtgtgatctattctactgccaggggctacggcttcgctgaaccttataacctctatagctcactgaaagagctggtccttcactaccagcagactagtctcgtgcagcataatgacagtttgaacgtccgcctggcttacccagtgcacgcacagatgccttctctctgtcgctag

SEQ ID NO: 25599 - DNA, 621 bp, Artificial Sequence
  Description of Artificial Sequence: Synthetic coding sequence
atgtacaacaccgtgtggagcatggaccgggacgacgccgactggcgcgaagtgatgatgccatacagcaccgagcttatcttttacattgagatggatcctccagcccttccacctaagcccccaaagcctatgactagcgccgtccccaacgggatgaaggatagctccgtatcccttcaggatgcagagtggtactggggtgatatatcgcgggaagaagtgaacgataaactgagagacatgccagacggaaccttcctcgtgagagatgcaagtaccaagatgcagggggattatacacttaccctcagaaagggggggaataacaaactcatcaagatctaccacagggacggaaagtacgggttcagcgatcctctgacattcaattctgtggtggaacttatcaaccactaccatcacgagagcctggcccagtacaatccgaaactcgatgttaaacttatgtatcctgtgagtcgataccagcaggaccagctggttaaggaggacaatatcgatgcagttgggaaaaagttacaagaatatcacagtcagtatcaggaaaaatctaaggaatatgatcgcctctatgaggaatatacccgtactagttag

SEQ ID NO: 25600 - DNA, 1524 bp, Artificial Sequence
  Description of Artificial Sequence: Synthetic coding sequence
atgggccccagccggctggtgcggggcccccggccccagggcatgcgcagcccctatcggcggcctggcatgggttggcctcgcccgcggtttccccgtatgtttaaatgctctcgcagaaggtaccagcagggcctgcgtggccgcacggcttcttctgcagctatcaaccctgctacccgcgcaatgggaattaacaatacccatacagataccaccatagtgtggatatttccgccacaagcgttgccccctaagccgcctaagccgatgacctcagccgtaccaaacgggatgaaagatagcagtgtctccttacaggatgcagagtggtattggggcgatattagtcgggaggaggtcaatgacaaactgagggatatgcccgacggaaccttccttgtaagggatgcaagtacgaagatgcagggtgactataccctcactctcagaaagggagggaacaataagctcataaagatctatcatagagatgggaagtatggctttagcgatcccctgacctttaactcagtggtggaactgataaaccactaccaccacgagagcttggcccagtataatcctaagctcgacgtgaagcttatgtaccccgtaagtaggtatcagcaagatcagttagtaaaggaagataatatcgacgctgtgggtaagaaactacaggagtatcattcccaataccaggaaaagtccaaggagtatgatcggctctacgaagaatatacaagaactagccaagaaattcagatgaagaggacagctatcgaggccttcaacgagacaatcaaaatctttgaagagcagtgtcatactcaagagcagcacagcaaagaatacatcgagcgattcagacgtgagggtaatgaaaaagaaatcgaaagaattatgatgaactacgacaaactcaagtccaggctgggagagatacacgacagtaaaatgagactggaacaggacctcaagaaccaggcactcgacaacagggaaatcgacaagaagatgaatagcatcaagccagacctaatccagctgagaaagatccgggatcaacacctggtctggctaaatcacaaaggcgtccgacagaagaggctgaatgtttggttaggaatcaaaaacgaggatgccgacgagaattactttattaacgaagaggatgaaaacctgcctcactatgatgagaaaacatggtttgtggaagacataaatagggtacaggccgaagatctgctgtacggaaagcctgacggggccttcctaataagggagtcatccaaaaaggggtgctatgcttgttcggtggtcgccgacggggaggtcaaacactgtgtgatctacagtaccgctcggggctacgggttcgcagagccatacaacctgtattcaagcctgaaggagctggtgctgcactatcagcagaccagccttgtgcagcacaacgattcattgaacgtacggctggcttacccagtccatgcacaaatgcctagcctgtgcagatag

SEQ ID NO: 25601 - DNA, 2643 bp, Artificial Sequence
  Description of Artificial Sequence: Synthetic coding sequence
atgcagcccggcgccaccacctgcaccgaggaccggatccagcacgccctcgagcgttgcctccacggactatctctgagtcgccgcagcacctcatggagtgccggcctctgtctgaactgctggagtctgcaggagttggtgagcagggatcctggccacttcctcatcttactcgagcagattttgcagaaaaccagggaggtgcaggagaaagggacatacgatctactgactcccctggccctgttgttctatagcaccgtgctatgcacgcctcacttcccgcccgattctgacttactgttaaaggccgcttcgacctatcaccgtttcctcacctggcctgttccctattgtagcatttgtcaggagcttctgacgttcattgacgccgaactgaaggcacctggcatatcttaccagagactggttagggccgagcagggacttcccatccgatcccacaggtccagtactgtgaccgtactgctcctgaatcccgtcgaagtccaagccgagtttctggctgtagcgaataagctctctacacctggacactccccccactctgcatacactacactgttactgcacgcatttcaagctactttcggggcccactgcgatgtgcccggactgcattgcagactccaggcgaaaaccttggcagagctggaagatatatttactgaaactgcggaggcccaagagctagcctcaggcatcggggacgctgcagaggcgcggcgctggttacgaactaagttgcaggcagtgggggagaaggctggattcccaggtgtgctggacaccgccaaaccagggaagttacataccattcccatacctgtggctcgttgctacacctacagctggagtcaggacagcttcgacatactccaggagattcttctcaaagaacaggagctgctgcaacctggaattctcggggatgatgaagaggaggaggaagaagaagaggaagtggaagaggacttagagacagacgggcattgtgcggagagagatagtctgctgtctacatcctccctggcaagccacgatagtacgctcagccttgcatcatcgcaggctagcggcccagccctcagccggcatttgctgacatcttttgtcagcggcctgtcagacgggatggatagtggttatgtcgaagacagcgaggagtcatcgagtgaatggccctggcggcggggctcccaggaacggagaggccatagaagacccggccagaagtttattcgcatctacaagctgttcaagagcacaagtcagctcgtacttcgcagggattcccgatcgttagagggaagcagtgatactgccctgcccctgcggcgcgccggctccctatgcagccctctcgatgaacccgtatcccctcccagccgcgcacaaagatcccggtctctgccccaacccaagctgggcacccaactccctagttggctgctggctccggctagccggcctcagagacgtagacccttcctgtcaggcgacgaggaccctaaggcttccactcttcgggtggtggtttttggctctgaccgtataagcggaaaggtcgcccgggcctacagcaacctgcgccgcttggaaaacaatcgaccactattgactagatttttcaaactgcaatttttctatgtgccggtgaaacgtagccacggaacatcccctggtgcgtgcccacctccaaggtcccagacccccagtccacctaccgacagcccgcgccacgcttcccctggcgaattaggaacaactccatgggaagagtccactaacgacatttctcactacctgggtatgcttgatccttggtacgaaagaaatgtgctgggtctgatgcatctcccacccgaagtcttgtgtcagcagtcactgaaggcagaggctcaggccctggaggggagcccaactcagctgcccattttagccgatatgctcctgtattactgtcgatttgctgcacggcccgtgctccttcaggtttatcagactgagttgacattcattactggcgaaaagactactgaaatcttcatccacagtctcgagcttggtcactctgccgctactagagctatcaaagcatccggccccggtagtaagaggctcggaattgacggtgacagggaggcagtgccgcttactttacagattatctactctaagggtgccatctcaggtaggagccgttggtctaacctggaaaaagtctgcacatctgtcaacctgaacaaggcatgccggaaacaggaagaactcgattcaagtatggaagcactgaccctcaatctcacagaagtggtgaagcggcagaactcgaagtcaaagaaagggtttaaccagatatccacaagccagatcaaggtggacaaggtacagatcatcggaagtaatagctgcccctttgccgtctgcttagaccaggacgagagaaagatccttcaatctgtggtgcgctgcgaggttagcccatgctataaaccagagaagagtgatctgagctctccccctcagaccccaccggatctgcctgcacaggccgcccctgatctatgctctttactctgtctcccaattatgactttcagtggtgcattgccatag

SEQ ID NO: 25602 - DNA, 2643 bp, Artificial Sequence
  Description of Artificial Sequence: Synthetic coding sequence
atgcagcccggcgccaccacctgcaccgaggaccggatccagcacgcacttgaacgctgccttcacggactgtctttgtccagaaggtccaccagctggtccgcaggcctgtgtctgaactgctggagcctccaggaactggttagccgagatcccggacatttcctgattctgctagaacagatcttacagaagacaagggaggtgcaggagaaaggaacctacgacttactgacccctttggctcttctcttttacagcaccgttctctgtacccctcacttcccccctgacagtgacctgctgctgaaggccgccagcacctatcatcggttcctaacgtggcccgtgccttattgtagcatatgtcaggagctgctcacttttattgacgcggagctaaaggcgccaggaattagttatcaaaggttggttagagcagagcagggactgcccatcagatctcacagatcttctaccgtcaccgtgttgttgctgaatccagtggaagttcaggcagagtttctggcagttgctaacaaactgtccacaccagggcactcaccacattcagcctacacaactttacttctccatgcctttcaggcaacatttggtgcccattgtgatgtacctgggttgcactgccggctacaggcaaaaacactggcggaactagaggatattttcacagagacggctgaagcccaggaactggcctcaggcataggcgacgccgccgaggcaaggaggtggttgagaaccaagctgcaagctgtcggagaaaaagctggttttcctggagtactagacactgcgaaacctgggaagttgcataccattcccataccagtcgcccgctgctatacctattcctggtcccaagattctttcgatatattacaggaaattctcctgaaagaacaggaattattgcagcccgggatcttaggtgatgacgaggaggaggaagaggaagaggaggaggtagaggaggacctggaaactgatggacactgcgcagagcgggattcactgctgtccacctcctcactggccagccatgactctacactgtctctggcatcgtctcaggcaagcggacctgccctgtcacgacatctgctcacgtcgtttgtgagcggcctatctgacggcatggacagtgggtatgtggaggactcagaggaaagctcttcggagtggccatggaggaggggcagtcaggaacgcaggggccaccgcaggccagggcagaaatttatccggatttataaacttttcaagtctacatcacagttggtgctccggagagacagtagatcgcttgaaggatcaagcgacacggcactgccactccggcgggccggatccctatgttctccactcgacgaacctgtgagtcctccttcacgggcacagagaagcagatccctgccacagcccaagcttggcacacagctcccatcatggctgttagcacccgccagtcggccccaacggcgacgcccatttttaagtggtgacgaggacccaaaggcctctacactccgtgtagttgtatttggctccgaccgcattagcggaaaggtggcccgggcctatagtaatcttcgtcgtctggagaataatagacccctgctgacaaggttctttaagctgcagttcttctatgtacccgtaaagagatcacatggaacatcacctggagcgtgtccaccgcccaggtcccagactccatcacccccgacggatagccctcgccatgcttcacccggtgagctcggtactacaccatgggaggagtcaacaaacgacataagccattatcttggaatgctcgatccatggtatgaacgcaacgtactgggcctaatgcatcttccaccagaagtgctgtgccagcagtctttaaaggcagaggcacaggctttggaaggctccccaactcagctcccaattctggccgatatgctgctgtattactgccgattcgcagcgcgacccgtgctcctgcaggtgtaccagacggaactgacgttcatcaccggagaaaagactacggagatctttatccattccctggagctgggacattcagccgctacgagggcaattaaggcctctggtcctgggagtaagcggctgggcatcgacggcgatcgcgaagcagtcccacttaccctgcaaatcatttatagcaaaggggccatttccgggcggagtcgatggtcgaacctcgagaaggtgtgtaccagtgttaacttgaataaggcctgtcgtaagcaagaggagctggactcctccatggaagcgcttactttaaacctgacagaggtagttaagcggcagaattctaagtcgaagaaagggttcaaccaaataagcactagccaaataaaagtcgataaggttcagatcatcggcagcaattcatgccctttcgcagtgtgcctcgatcaggatgagcgaaagatcctgcagtctgtggtgcgttgcgaagtgtccccatgttacaagcctgaaaagtctgatctgtcaagccctccacaaaccccacctgacctgcctgcacaggctgcgcccgatctgtgttcactactctgcctacccatcatgaccttctccggagcccttccttag

SEQ ID NO: 25603 - DNA, 447 bp, Artificial Sequence
  Description of Artificial Sequence: Synthetic coding sequence
atgaagctgctggtgctggccgtgctgctgaccgtggccgccgccgactctggcattagtcctagagcagtgtggcagttcaggaagatgatcaaatgtgtgattcccgggagtgatccattcctcgagtacaataactatggatgttattgcggcctgggggggtctggtaccccagttgacgaactcgataagtgctgccagacacatgataattgctatgaccaagcgaagaagctcgatagctgcaaatttctcttggacaacccttacacgcacacctattcctactcatgctcaggctctgcaattacatgttcatctaagaacaaggagtgcgaagcctttatttgcaattgcgacagaaacgctgccatctgtttctctaaggccccatacaacaaggcacataaaaatcttgacacaaagaaatactgccaaagctag

SEQ ID NO: 25604 - DNA, 435 bp, Artificial Sequence
  Description of Artificial Sequence: Synthetic coding sequence
atgaagaccctgctgctgctggccgtgatcatgatcttcggcctgctccaggcccatggcaatttggtcaatttccaccgtatgatcaagcttactaccggcaaagaggctgctctctcttacggtttttatgggtgccactgtggtgtgggcgggaggggcagtcccaaagatgccaccgatagatgttgcgtcacccacgattgctgttataagagactcgaaaagagagggtgtgggactaagttcctgtcgtataaattttccaacagtgggagccgcatcacttgcgccaaacaggacagctgcagaagccagctgtgtgaatgtgataaggctgccgctacctgttttgcgcggaataaaaccacatacaacaaaaaatatcagtattactctaacaaacactgtcgtggctccacgccccggtgttag

SEQ ID NO: 25605 - DNA, 435 bp, Artificial Sequence
  Description of Artificial Sequence: Synthetic coding sequence
atgaagaccctgctgctgctggccgtgatcatgatcttcggcctgcttcaagcacacggtaatctggtcaatttccaccgaatgattaagctgacgacagggaaggaggcggctctgagttacggcttttatggatgtcattgtggagtcggcggacggggaagtcctaaggacgcaacagatcgttgctgcgtgacacatgactgttgctataaacgcctcgagaaaagggggtgtggaacaaagtttttatcatacaagttctctaactccggatcacggatcacatgcgcaaaacaggactcttgtaggtcacagctgtgtgagtgtgacaaagccgccgctacatgcttcgcaagaaacaagacaacctataataaaaagtaccagtattatagcaacaaacactgcagagggagtactccaagatgttag

SEQ ID NO: 25606 - DNA, 438 bp, Artificial Sequence
  Description of Artificial Sequence: Synthetic coding sequence
atggagctggccctgctgtgcggcctggtggtgatggccggcgtgattcctatacagggaggtattctcaaccttaataaaatggttaagcaagttacagggaaaatgcccatcttgtcctattggccatatggttgccactgcggtctcggtggcagagggcagccaaaggacgcaactgactggtgttgccagacccacgattgctgctatgaccatctcaaaacacaggggtgtagtatctacaaagactactaccggtataacttctcacagggcaatatccattgtagcgacaaggggagctggtgtgaacagcagctctgtgcctgcgataaggaagttgccttctgtctcaagagaaacctggatacctaccagaagcgccttcggttttattggcggccccactgccggggccagactcctggatgttag

SEQ ID NO: 25607 - DNA, 429 bp, Artificial Sequence
  Description of Artificial Sequence: Synthetic coding sequence
atgaagagcccccacgtgctggtgttcctgtgcctgctggtggccttggtgaccggcaatcttgtccagtttggagtcatgattgagaagatgactggcaaatccgccctgcaatacaacgattacgggtgttattgcggcataggtggaagtcactggcccgtagatcaaaccgactggtgttgtcacgcccacgattgttgctacgggagactggaaaagctgggttgtgagccgaagttggagaagtacctgtttagtgtctcggagcgcggcatcttctgtgcgggaagaaccacttgccagaggttgacctgcgagtgcgataagcgagccgctctgtgttttcggcgaaacttgggcacatataaccggaaatatgcccattaccccaataaactgtgtacaggccctaccccaccttgctag

SEQ ID NO: 25608 - DNA, 636 bp, Artificial Sequence
  Description of Artificial Sequence: Synthetic coding sequence
atggccgacggcgccaaggccaaccccaagggcttcaagaagaaggtgctcgatcgatgtttcagcggatggcgcggccctcgattcggtgcgtcatgcccctcaaggactagtaggtccagcttgggcatgaaaaagttcttcactgtggccattcttgcagggagtgtgctctcgaccgcccacggatcacttttgaaccttaaagctatggtggaagccgtaacaggacggtcagccattttgtcttttgtgggatacggttgttattgcgggctagggggccgcggccagccaaaagacgaggtggactggtgctgtcacgcccacgactgctgctaccaagagctgttcgatcaggggtgccacccatatgtagatcattacgaccatactattgagaataataccgagattgtatgtagtgacctaaataaaacagagtgtgataagcaaacctgtatgtgcgataagaatatggtgctttgtctcatgaatcagacctatagggaggaatatcgtggtttcctgaacgtctattgtcagggaccaacccctaattgtagcatttacgagcctccacccgaagaagttacctgtagccatcagtccccagctcctcctgcaccaccttag

SEQ ID NO: 25609 - DNA, 936 bp, Artificial Sequence
  Description of Artificial Sequence: Synthetic coding sequence
atgcccgccccccgggccccccgggccctggccgccgccgcccccgcatccggaaaagcaaagcttactcatcccgggaaagctatccttgcaggcggtctggccggcggcattgaaatctgtattaccttccccaccgagtatgtgaagacacagttacagctagacgagaggtctcaccctccccgctaccgcggcatcggggactgcgtgagacagacagtccgatcccacggggtgttgggactttacaggggactctcaagtctcctctacggctccattcctaaggccgccgtccgcttcggtatgttcgaattcctgtctaatcacatgcgagacgcccaaggtcgactggattcaactaggggtctgctgtgtgggttaggtgccggcgtcgcagaagccgtggtggtggtgtgtcccatggagactattaaggttaaattcattcacgatcagactagccctaacccaaaatatagaggtttcttccacggcgttcgggagatcgtccgggagcagggcctaaagggcacgtatcagggtctgacagcaacagtgctgaagcaggggtccaatcaggctatcagattcttcgtgatgacctccctgcggaactggtatagaggcgataatcctaataaacccatgaaccccttgatcaccggcgtttttggcgcaatcgccggagccgcttcggtcttcggcaacacgccactggatgtgataaaaacccggatgcaggggttggaggcccataagtacagaaacacctgggattgcggcctccagatcctgaagaaagaggggcttaaagcattctataaaggaacggtcccgcgtctgggacgtgtgtgccttgacgtcgctatcgtgttcgtcatttacgatgaggtggtcaagctgttgaataaagtctggaagaccgattag

SEQ ID NO: 25610 - DNA, 2250 bp, Artificial Sequence
  Description of Artificial Sequence: Synthetic coding sequence
atgagcttcatcgacccctaccagcacatcatcgtggagcaccagtacagccacaagtttaccgtcgtggttctacgtgctacgaaggttacgaagggggccttcggcgacatgttggacacacccgatccttatgtcgaactttttattagcactactccggactctaggaaacggacacgccactttaataatgacattaacccggtctggaacgaaaccttcgagtttattctggatcccaatcaggaaaacgtgctggagatcaccttgatggacgcaaactatgtaatggatgaaactctcgggaccgcaaccttcaccgtgagctctatgaaggtgggagaaaagaaagaagtccccttcatcttcaaccaggtgacagaaatggtacttgaaatgtctctggaggtgtgctcatgccccgatcttcggttcagtatggctttgtgcgaccaagagaaaacatttaggcagcagagaaaggagcacattagagagtctatgaaaaaacttctcggaccgaagaattccgagggtttacacagcgctcgggatgtgccagtggtggcgatcctgggaagcggtgggggattcagggccatggtgggcttctccggcgtaatgaaagctctgtacgaaagtggaatcttggactgtgccacatacgtggccgggctgagtggcagcacatggtacatgagcaccttatacagccatcctgacttccctgagaaaggtccagaggagataaatgaggaactgatgaagaacgtgtcacataatcccctgctgctgctcaccccacagaaagtgaaaaggtatgtggaatccctgtggaaaaaaaagagctcggggcaacccgtcaccttcactgatatcttcgggatgctgataggcgagacactgatccacaatagaatgaataccactctgtcttccctgaaagagaaggtgaacacagcccaatgtcccttgcccctgtttacttgtctccacgtgaagcccgatgtgtcggaactcatgttcgccgactgggtggagttcagtccgtacgaaatcgggatggccaagtatggcaccttcatggcacccgaccttttcggatccaagtttttcatgggaaccgtggtgaagaagtacgaagaaaaccccctccacttcctgatgggtgtctgggggtcagctttctcgatcctgtttaaccgtgtgttgggagtttccgggagtcagagtagagggtcaaccatggaagaggagcttgagaacatcactacgaagcacatcgtgtcgaacgatagtagcgactccgacgacgaatcccacgaaccgaaagggactgaaaacgaagacgccggatctgattaccagagcgacaaccaggcgtcctggatccacagaatgatcatggccttggtgagcgattccgctctgtttaatacacgcgaagggcgggccggtaaagttcataacttcatgctgggactcaatttgaatacgtcgtatcccctgagccccctcagcgacttcgcaactcaggacagctttgacgatgacgaactggatgcagccgtggcagaccctgatgagtttgagaggatttatgaacctctcgacgtcaagagcaagaagattcacgtggtggattctggcctcacattcaatctgccatatccactgatcctgaggccacagagaggcgtggatctgataataagttttgacttctcagctagacccagcgattcttcccctcccttcaaggagctcttgctggccgagaaatgggccaagatgaacaagctgccatttccaaaaattgacccttatgtgttcgatcgagaaggcctgaaagagtgttacgtgttcaagccaaaaaacccagatatggagaaagactgccctaccataatccactttgtgctcgccaacattaactttagaaagtaccgggccccgggggtcccccgggagactgaggaggaaaaggagatcgccgacttcgatatcttcgatgatcccgaatctccatttagcaccttcaacttccagtaccccaatcaggcgttcaaaaggcttcatgatcttatgcattttaatactctcaataatatcgatgtgattaaagaagcaatggtagaatctatcgagtaccggcggcaaaatccgtcaagatgttcggtgagcctttctaacgttgaggctaggaggttctttaacaaggaattcctctctaagcctaaagcttag

SEQ ID NO: 25611 - DNA, 150 bp, Artificial Sequence
  Description of Artificial Sequence: Synthetic coding sequence
atgagcttcatcgacccctaccagcacatcatcgtggagcaccagtatagtcacaaatttaccgtggtagtgctgagggcgactaaagttaccaaaggcgccttcggggacatgcccaaagtgactaagggggcgttcggagacatgtag

SEQ ID NO: 25612 - DNA, 2070 bp, Artificial Sequence
  Description of Artificial Sequence: Synthetic coding sequence
atgagcttcatcgacccctaccagcacatcatcgtggagcaccagtatagccacaaattcaccgtggtggtcctgcgagctactaaagtcaccaaaggggcctttggcgatatgctggatacaccagatccatacgtggagctgttcatctctacgacccccgactcacggaaaagaacccgacattttaacaatgacattaatcctgtctggaacgagacattcgaattcatcctggaccccaaccaggaaaacgtgctggagataactcttatggatgcaaactacgttatggacgaaacgcttggtaccgcaaccttcaccgtgtctagtatgaaggtaggagagaagaaggaggtaccatttatattcaaccaggtgccagtggtggcaattttgggctctggtggaggatttagggcaatggtgggcttcagcggcgtgatgaaggcgctgtatgaatctggtatcctagattgcgccacctacgtcgccggtttatctgggtcaacctggtatatgagtaccctatatagtcatcccgattttccagagaagggccctgaggagattaacgaggagctgatgaaaaacgtttcacataaccccttgttgcttctgacccctcaaaaagtgaagcggtacgtggagtctctgtggaagaaaaagtcatcagggcagcctgtcaccttcactgacatatttggcatgttaattggggaaacacttatccacaacagaatgaataccaccctgagcagcctgaaggagaaagtgaacacggcacagtgcccactcccgctctttacgtgcttgcacgtgaaaccggatgtatccgagttgatgttcgccgactgggtcgaattctcaccatacgagatcggcatggctaagtatggaacattcatggcccccgacctcttcggctccaagttctttatgggcaccgttgttaagaaatacgaggaaaatccacttcattttctcatgggcgtctggggaagtgcattctcaatcttgtttaatcgggtgctgggtgttagtgggtcgcagagtcgtgggagtactatggaggaagagttagaaaacataacaacaaagcatattgtgagcaacgacagctctgactccgacgatgagtcgcacgagcccaaaggcaccgagaacgaggatgccggttcggactatcagtcagacaatcaggcgtcatggatacaccggatgataatggccctcgtttctgatagtgcactctttaacactcgggaaggacgggctggcaaagtgcacaactttatgctgggactgaatctcaacacctcctatcctctttcacccctaagcgactttgccacccaggatagttttgacgatgacgagttagatgctgcggtcgccgatccggatgaatttgagagaatctacgaaccattggacgtgaagtctaagaaaatccacgtggttgattccggccttacgtttaatttgccatatccactgatccttcgcccgcagagaggggtcgacttaatcatttccttcgacttcagcgcccgaccctcagattctagccctcctttcaaggagctgctgctggcggaaaaatgggccaaaatgaataaactgccatttccgaagatcgacccttacgtttttgaccgggaggggttgaaggagtgttatgtattcaagcccaaaaatcctgatatggaaaaagattgccccactatcatccactttgtactggccaatatcaatttccgaaaatacagagctccaggggttcccagggagaccgaggaagagaaggagatcgccgatttcgatatttttgacgaccccgagagtccgttttccacattcaattttcagtatcccaaccaagcctttaagcggctacacgacctcatgcatttcaataccctgaacaacatagatgtgatcaaagaagcaatggtggagtcaatcgaatatcgtagacagaacccttccaggtgttcggtgagcctgagtaatgttgaggctcggcgcttcttcaataaggagtttttgtctaagccaaaggcttag

SEQ ID NO: 25613 - DNA, 2346 bp, Artificial Sequence
  Description of Artificial Sequence: Synthetic coding sequence
atggccgtggccgaggtgagccggacctgcctgctgaccgtgcgggtgctgcaggcccacaggctgccatccaaggacctcgtcactcccagcgattgttatgttaccctctggttaccaacagcttgcagtcatcggctgcaaaccaggacagtcaagaattccagtagcccagtgtggaatcaatcatttcacttcaggatccaccggcaactgaaaaacgttatggagctcaaggtgttcgaccaagacctcgttaccggcgacgaccctgtattatccgtgctgtttgacgccggtacccttcgggccggcgagtttcgcagagagagcttctcgctgagtccgcagggtgaaggaagattggaagtggaatttcgtctccagtcactcgccgatcgcggcgaatggctggtgtccaatggagtcttagtggcacgggagcttagttgtttgcatgttcagctggaagaaacaggcgaccagaagagctcagaacacagggtgcagctggtggttcccggctcctgtgaaggaccacaagaagcttctgtgggaactggcactttcagatttcactgtcctgcctgctgggagcaggagctcagtattcggttgcaggacgccccagaagaacaactcaaggcccccctttccgcacttccctccgggcaagtggtcagactggtcttcccaacctcacaagaacccttgatgcgcgtggagctgaagaaggaggctggactgcgcgagcttgccgtgaggctggggtttggcccgtgtgccgaggagcaggcgtttctttcccgcaggaagcaagttgtagcagcagctttacggcaggccttacaattggatggcgacctgcaggaggatgaaattcccgtggtcgcgatcatggccactggaggtgggatcagagcgatgaccagtctgtatggacaactcgcaggacttaaggaactggggctgctcgattgtgtcagctatataacgggtgctagtgggtcaacatgggcactggcgaatctgtacgaagatcctgaatggtcgcagaaggacttggctggacctactgagctgcttaagacccaagtgacaaagaacaaactcggggtgttagctccatctcagctgcaacgttatcgccaagagctcgccgagagggctaggttggggtacccatcttgtttcaccaacctgtgggctttgatcaacgaagccctgttacatgacgaacctcacgatcataaactgagcgatcagcgagaagccctctcccacggtcagaaccccctccccatctactgcgcattaaatacaaaggggcagtcattgaccaccttcgagttcggagaatggtgcgagttttccccctacgaagtcggcttcccaaagtacggggcttttattccatcagagctttttggttctgagttttttatggggcaactaatgaagagactacctgagtcacgtatctgcttccttgaaggaatttggagcaatctctacgccgcgaacttacaagatagtctttattgggcaagcgaaccttcgcaattctgggatcggtgggtgcgcaatcaggcaaacctggataaggaacaagtgcctctgctcaagatcgaggagcctccctcgacagccggcagaattgctgaattttttacagatctcttgacatggaggccgctggcacaggctacccataacttccttcggggattgcatttccataaggattacttccagcacccacactttagtacgtggaaggccactacactcgacggactgccaaatcagctgacgccctccgaacctcacctctgtcttctggacgtgggctacctgatcaatacatcttgtctaccgctcctgcagcccacccgggatgtggatcttatcctttcactggactataacctgcatggtgcgttccagcagctccagctcttgggccgattttgccaggagcagggcattccctttccgcccatttccccatcgcctgaagagcagctgcaacctcgagagtgtcacacttttagcgaccctacttgccctggcgcccctgctgtgcttcattttcccctcgtatccgactcgttccgggagtattcagcccctggtgtgcgccgtacccccgaggaggctgctgcgggtgaagtcaatctcagctccagcgatagtccctaccattatactaaggtgacttacagccaggaggacgtcgacaagcttcttcacttgacccactataatgtctgtaacaatcaggaacagttattggaagcactcaggcaggctgtgcagaggcggcggcagcggaggccccactag

SEQ ID NO: 25614 - DNA, 417 bp, Artificial Sequence
  Description of Artificial Sequence: Synthetic coding sequence
atgaagggcctgctgcccctggcctggttcctggcctgcagcgtgccggccgtccagggcggccttctggacctgaagtccatgattgaaaaggtgactggtaaaaatgccctgaccaactacggattctacggatgttactgcggctggggcggccgggggacacctaaggatgggaccgactggtgctgctgggcacatgaccactgttacggaaggctggaagaaaagggctgtaacatccgtacccaatcttataagtatcggttcgcctggggcgttgttacctgcgaacccggccctttctgccatgtaaatctgtgcgcttgcgacaggaagctggtctactgcttgaagcgtaacctgcggtcctataatcctcagtaccagtatttccccaatattctatgcagctag

SEQ ID NO: 25615 - DNA, 2421 bp, Artificial Sequence
  Description of Artificial Sequence: Synthetic coding sequence
atgcagttcttcggccggctggtgaacaccttcagcggcgtgaccaatctgttctctaatccctttcgggtaaaggaagtggccgtagccgattacacatccagcgaccgcgtgagagaggagggtcagctcatccttttccaaaatactccaaaccgcacttgggactgcgttcttgtgaatccgcgaaactcacagtcggggttccgcctgtttcaactcgagttagaagctgacgctctggttaactttcatcagtatagttcccagttgctgccattctacgaatcgtccccccaggttttacataccgaggtgctccagcacctgactgatcttataaggaatcaccctagctggtcagtggcacacctggcagtggagctgggtatccgcgagtgtttccaccatagtagaataatatcgtgtgcgaactgtgccgagaatgaggaggggtgtacccctctgcacttggcctgccgaaagggcgacggggaaattctggtcgagttggtacagtactgccacacacagatggatgtgaccgattacaaaggcgagacagtgttccactatgccgtacagggcgataactcccaggttctgcagctgctaggcagaaacgccgtcgctgggctaaatcaggttaataaccagggtctcacgccgctccatctggcctgtcagctgggcaagcaggaaatggttcgagtcctcctcctctgtaatgcccggtgcaatatcatggggccaaatggttaccctatccatagcgccatgaagttttcacaaaagggatgcgctgagatgatcatctccatggacagtagtcagatacacagcaaagacccaaggtatggcgcctctcccctgcactgggcaaaaaatgccgaaatggccaggatgctactcaagagaggttgcaacgtgaactctacaagctctgcaggaaacactgccttacatgtggctgtcatgcgcaaccgcttcgactgcgctatagtgttgctgacccacggggccaacgccgacgcacgtggggagcatgggaataccccactgcatctggctatgagcaaggacaacgtggaaatgatcaaggcactgatcgtgttcggggccgaggtcgatacccccaatgactttggtgaaactcctacctttctcgcgtctaagatcggacgacttgttacgcgcaaggctattctgacccttctgaggacagtgggagcggagtattgtttccctcctatccacggagtgcccgccgaacagggctccgccgctcctcatcacccattttccctggagcgggcccagcctcctcccatctcgttgaataatctcgaattgcaagacttgatgcacatctcaagagccagaaaacctgctttcatcctgggttccatgcgcgatgaaaaacggactcacgaccatctgctctgtctcgacgggggaggcgtgaaggggctgatcataattcagctcctgatcgctatcgaaaaggcctcaggcgtcgccaccaaggacctattcgactgggtggctggtacctctacgggtgggatcctcgcattggcgatactccacagtaaatcaatggcatacatgaggggtatgtactttcggatgaaagatgaagtctttaggggtagtcggccttacgaatcaggacccctggaagagtttttgaaacgtgagttcggggaacataccaaaatgaccgacgttcggaaacctaaggtgatgctgacgggtaccctgagtgaccgccagccagctgaactacatctcttccgaaattacgatgcacccgaaaccgtcagggaacccaggtttaatcagaatgtgaatctgcgcccacctgcccagccaagcgaccagctcgtgtggcgcgccgcacgcagctccggcgcggctcccacgtacttcaggccaaatggccgtttcttggatgggggattattggcaaataatcccacccttgacgccatgacagagatccatgaatacaaccaagatctcattaggaaaggccaggccaataaggttaagaagctcagcattgttgtgagtctcggaaccggtcggtctcctcaagttccagtcacatgcgtcgatgtattcagaccatccaatccctgggagctggcgaaaactgtctttggagccaaagagttaggcaaaatggtcgtggactgctgcacggacccagatgggcgggcagtggatcgggccagggcatggtgcgaaatggtgggaatacagtactttagacttaacccccagcttgggacggatataatgctggacgaggtttcagacactgtcttagtgaacgcgctgtgggaaacagaagtatacatttacgagcaccgagaagagttccagaagctgattcagctcctcctgtcgccttag

SEQ ID NO: 25616 - DNA, 1284 bp, Artificial Sequence
  Description of Artificial Sequence: Synthetic coding sequence
atgcagttcttcggccggctggtgaacaccttcagcggcgtgaccaacctctttagcaacccctttcgggttaaggaggtagccgtcgctgattacacctcctccgacagggtgagggaagagggacaactgattttgttccagaacacgcccaatcggacgtgggactgtgtcctggtaaatccacggaattcccagagcggctttagatgcgcaaattgtgccgaaaacgaggaaggatgtacgccgctgcaccttgcgtgtcgcaagggcgatggcgagattctcgttgagctagttcagtactgccatacacaaatggacgtcactgattacaaaggcgagaccgtttttcattacgccgtgcagggagacaatagtcaggtcctgcagctccttggccggaatgctgtggctggtctgaatcaggtcaacaatcagggattgacccctttgcacctggcttgtcaattaggcaagcaggaaatggtgcgtgtgctattactttgcaatgcccgatgcaatattatgggcccaaatggatacccaatccattctgcgatgaagttttcacagaagggatgtgccgagatgattatctctatggacagttcccagattcatagcaaagacccacgatacggcgcatcccccctgcactgggctaagaacgctgagatggctaggatgcttctgaagcgaggctgtaacgtgaattctacttcgtctgccggaaacacagcgctccatgtggccgtcatgcgcaacaggttcgactgtgccatcgtgctcctaactcatggagctaacgctgacgcgcgtggggagcacggaaatacgccccttcacttggccatgagcaaagacaacgtggaaatgatcaaagccctgatcgtgttcggagcggaagtggatacacccaacgatttcggcgaaacaccaacattccttgcttctaaaatcggcaggctcgttacccggaaggccatcctcaccctcctcagaacagtgggagcggagtattgctttccgcccatccatggggtacctgccgaacagggcagtgccgccccccatcaccctttttccttagagagggcccaacctcccccgatcagtttaaataatctgggctcccacccatctcaggccggctggtgggcctggggcgccgccagcgacggcaccacgggaagccatgcacatctgacaggtcctgaagcttccgttcaccccggattacatgaggggcgggaggcagaccgtcagaatatggagtcgtag

SEQ ID NO: 25617 - DNA, 2259 bp, Artificial Sequence
  Description of Artificial Sequence: Synthetic coding sequence
atgcagttcttcggccggctggtgaacaccttcagcggcgtgaccaaccttttttccaaccccttcagagtgaaagaggttgccgtggcggattatacaagtagcgatcgtgtgagagaagagggccagctcatcctttttcagaacacaccgaatcgaacatgggattgcgtactggtaaaccccaggaatagtcagtccggcttccggctgttccagctggaactagaggcggatgcattggttaacttccaccagtatagctctcagctgctccccttctatgaatcttctccacaggtgcttcacactgaggtactgcagcatttaaccgatctcataagaaaccatccctcttggagcgtggcccacctcgccgtggaactgggcattcgcgaatgcttccaccattcacggataatttcctgcgctaattgcgctgaaaacgaagaagggtgcaccccgctacatctggcttgcaggaagggtgacggggagattctcgtggaacttgtacagtattgtcacacccagatggacgtcaccgattacaaaggagagaccgttttccattatgccgtgcagggagataattcacaggtcctgcagctgctcggccggaacgccgtggccgggcttaatcaggtcaataaccagggccttacacctcttcatctcgcatgtcaattaggaaaacaggagatggtaagagtcctgcttctttgtaacgctcggtgtaatattatgggccctaatgggtatcccatacatagcgcgatgaaatttagccagaaaggctgcgctgagatgattatcagcatggatagttcgcagatccactcgaaagacccaaggtacggcgcgagccccctgcactgggctaaaaacgcggaaatggctcgaatgttgttaaaacgcgggtgtaacgtcaatagcaccagctctgccgggaacacggctttacacgtggctgtcatgcgcaacaggttcgactgcgccattgtcttgttaacgcacggagccaatgcagatgcacgcggggagcatgggaacactcctctgcacctcgcaatgagtaaggataatgtggaaatgatcaaagcgcttatagtttttggcgcagaggtagatacacccaatgatttcggcgagacaccgaccttcctggcttccaagataggacgtcagctgcaagacctgatgcatatttcacgagcccgaaagccggctttcattctggggtcaatgcgtgacgaaaagcggacacacgaccatttgctatgtctggatggaggaggggtaaaagggttgattatcatccagctccttatcgccatcgaaaaagcttcaggagtggctacgaaggatctgtttgattgggtcgccggtaccagtaccggcggcatcctcgccctcgctatcttgcatagtaaatccatggcctatatgaggggcatgtacttcaggatgaaggacgaagtcttcagggggtctcgaccttacgaatccggacccttagaagaatttttgaaacgcgagttcggagagcacacaaagatgacggatgtgcggaagccaaaggtaatgttaaccggaactctctcagatcgccagccagcagaacttcatctcttcagaaactatgatgcccctgagacagtccgcgaacctcgttttaatcaaaatgtcaaccttcggccacctgcccagccttccgaccaactcgtgtggcgggcagccagaagtagcggcgcagctcctacctactttcgacccaacgggcggttcctggacggtggattattggcgaataacccgacactggatgccatgaccgagatccacgagtataatcaggatctcatccgcaaagggcaggcgaacaaagtgaaaaaactatctatcgtcgtgtcattggggaccggaagaagccctcaggtacccgtcacttgtgtggatgtctttcgaccctcaaatccgtgggagctcgcgaaaacagtgttcggagccaaagagctgggcaagatggtggttgactgctgtaccgacccggatggacgtgcggtggatcgggcccgtgcatggtgtgaaatggtggggatccagtactttcggttaaacccacagttgggaaccgatatcatgcttgatgaagtctcagatacggtcctggtaaacgccttgtgggagactgaagtatacatatatgaacatcgcgaggagttccagaagttgattcagctgcttctgagtccgtag

SEQ ID NO: 25618 - DNA, 1440 bp, Artificial Sequence
  Description of Artificial Sequence: Synthetic coding sequence
atgcagttcttcggccggctggtgaacaccttcagcggcgtgaccaacctgtttagcaatccttttcgagtaaaagaggttgccgtagccgactacacatcctcagatagagtgagggaggagggccagctcatactgtttcaaaacactcccaaccgcacctgggactgcgtgctcgtgaaccctcgaaattctcaaagtggctttcggctgttccaattagaattggaagctgatgcgctggtaaacttccaccagtactcctcccagcttctacctttctatgaaagctctccccaggtgctacatacggaagtgttacaacatcttaccgatctgatcagaaatcacccgtcttggagcgtggcccatctggccgtcgaactgggtatcagggaatgttttcatcactctagaattattagctgtgccaattgcgctgaaaacgaggaggggtgcacccccctacacttggcctgcagaaagggcgacggtgagatcctagtagaactggttcaatactgccacacacagatggacgtcaccgactacaagggagaaacagtattccactatgccgtgcaaggcgacaactcacaggtgctgcaactcctgggtcgcaatgcagtggccgggttgaatcaggtgaacaatcagggattgactcctctccatctcgcctgtcaactcggaaaacaagagatggtgagagtgctcctcttgtgtaatgcccggtgcaacataatgggtcccaacgggtaccccatccacagcgctatgaagttttcccagaaaggttgcgccgaaatgatcatttcaatggactcttctcagattcactctaaagacccacggtacggtgcatcgcccctccactgggctaaaaatgccgaaatggcccggatgctgctgaaacggggttgtaacgtgaacagcaccagtagcgccggaaacacagcattgcatgttgcagtgatgcgcaatagatttgattgtgctattgttttactgacgcacggtgccaatgccgacgcccgtggagagcatggaaacacacctctccatctggccatgtctaaggataacgtggaaatgataaaggcactcattgtgtttggcgccgaggtcgacacgcctaacgatttcggtgaaacccctactttcctcgcttctaaaatcggcagactggtaacaagaaaagcgatcttgacccttctgcgtaccgttggcgcggagtattgctttccacctattcacggcgtgcctgccgaacagggatcagcagcaccccatcatcccttttccctcgaacgcgctcagcctccccccatcagccttaataatctggagctccaggatctcatgcatatctctcgtgctcggaaacccgcctttattctaggcagcatgcgcgatgagaagcgtacagacagaacctag

SEQ ID NO: 25619 - DNA, 2259 bp, Artificial Sequence
  Description of Artificial Sequence: Synthetic coding sequence
atgcagttcttcggccggctggtgaacaccttcagcggcgtgaccaatttatttagtaacccctttcgggtgaaggaagtggccgtagccgattataccagtagtgaccgggtgcgggaagagggacaacttattctctttcagaacacgcccaaccgcacgtgggactgcgtcctcgtcaatccaaggaatagtcaatcagggttcagactgtttcagttagagctggaggccgacgcgcttgtgaacttccaccaatatagctcccagctcctgcctttctacgagagcagcccacaggttcttcacaccgaagtgcttcagcacctgactgatctgattcgcaaccacccgtcttggtctgtagcccacttagctgttgaactgggcattcgggaatgtttccaccactccaggatcatctcttgcgcaaactgcgcggagaacgaggagggctgcacacctctgcatctggcgtgtcggaaaggcgatggggagatcctagtcgagctggtgcagtactgccatactcagatggatgttacagattacaagggagaaaccgtgtttcactacgccgtgcagggtgacaatagtcaggtcctgcaactcctcggccgcaatgctgttgcaggcctcaaccaggtaaacaaccagggactcactcccttacacctggcctgtcagctagggaaacaggaaatggtcagggtcctattactttgtaacgccaggtgtaacattatgggcccgaatgggtacccgatccatagtgccatgaagttttcccagaagggctgcgcagaaatgattatcagtatggactccagccagatacactccaaggatccccgctatggagcctcccctctgcactgggcaaaaaacgccgagatggccagaatgctccttaagcggggatgcaatgtcaattccaccagttcggcagggaacacggccctccacgtcgcagtcatgcggaacagatttgactgcgctatcgttctattaacgcacggggctaacgccgatgcgcggggggagcacggaaatacgcccttgcacctggcgatgagtaaggacaatgtggaaatgatcaaagcgttaattgtgttcggcgccgaggttgatacgcctaacgacttcggtgagactccaaccttcctagcctcaaagattggtaggcagttgcaggacttgatgcatatctcacgggctagaaaacctgcttttattctcggaagcatgcgtgacgaaaagcggacccacgaccacttactgtgcctcgacgggggcggcgtcaagggcctgataatcattcagctactgattgccatcgaaaaggccagcggtgttgccaccaaggacctctttgactgggtcgccggaacaagtacaggcgggattctagctctggctatactccattccaagtctatggcgtatatgcggggaatgtactttcgaatgaaagacgaagtgtttagaggcagccggccatatgaaagcggacctcttgaggaatttttgaagcgtgaatttggcgagcacactaagatgacggacgtgagaaaaccaaaagtgatgctgaccggaacactcagcgaccgacagccggccgaattacacctattccgcaattatgacgcccctgaaaccgtgcgcgaaccacgtttcaatcagaacgtgaacttacgcccgcccgcacagccatcggatcaattggtgtggagagcagctcggtccagcggggctgccccaacatatttcagacccaatgggagattcctggatgggggcctgctcgcaaataaccccaccctggacgctatgaccgaaatacatgagtacaatcaagacctaatacggaagggccaagcaaataaagtaaaaaaactgtcgattgtggtgtccctaggcacaggcagaagtccccaagttcctgtgacatgcgtggacgtgttccgaccttccaacccttgggagttggctaagaccgtattcggcgccaaggagctgggtaaaatggtagtggattgttgcaccgaccccgacggccgcgccgtggaccgtgctcgcgcttggtgtgaaatggtgggtatccagtattttcgcctgaatccccagctcgggactgatattatgttggacgaagtctccgacacagtactggttaatgcgctctgggagaccgaagtctatatttacgagcacagagaggagtttcagaagctaatccagttgctactgtcgccctag

SEQ ID NO: 25620 - DNA, 2004 bp, Artificial Sequence
  Description of Artificial Sequence: Synthetic coding sequence
atgcagttcttcggccggctggtgaacaccttcagcggcgtgaccaacctgtttagcaacccatttagagtcaaggaggttgcggttgcagactatacttctagtgatcgcgtgagggaggagggccaactgatcctgttccaaaatacaccaaaccgcacctgggactgtgttttggtcaaccctaggaactcccagagcggattccgactttttcagctggaactggaggctgacgcactggtgaattttcaccagtactctagccagctaggtaaacaggaaatggtcagagtgttattactatgcaatgcccggtgtaatattatggggcctaatggctatcccatccattcggccatgaaattcagccaaaaaggttgcgcggaaatgatcatatcaatggactcctcccaaattcactcaaaagacccacgatatggtgcaagtccattgcattgggccaagaacgctgaaatggctagaatgcttttgaaaaggggctgcaacgtgaacagtacttcgtctgccgggaacacagcccttcatgtagccgtgatgaggaatagatttgattgtgccatagtcctactgacgcacggggccaacgcagacgcacgcggtgaacacggtaatacccccctccatttggcaatgtccaaagataatgtcgaaatgataaaggctctcatcgtcttcggggccgaagtggacactccgaacgacttcggtgagacacccactttcctggcctccaagattggccggctggtgactaggaaagctatcttgacgcttctccggaccgtcggcgcagaatactgtttccctcccatccacggtgtgccggccgagcaggggtctgcagccccacaccatcccttcagtctggaaagggcccagccacctcctatttccctgaacaacctggaactgcaggatctgatgcacataagtcgcgcccggaagccggcgtttatacttggcagtatgcgggatgagaagcgcacccatgatcaccttctgtgcctggacggcgggggcgtgaagggtctcattatcattcaactgctgatagctatagaaaaggcatccggcgtggcgaccaaagacctctttgactgggttgcaggaacgtccacaggtggaattctcgctctggcgattctacattcaaaatcaatggcatatatgaggggaatgtactttcggatgaaggatgaagtctttcgaggttctcgcccctacgagagcggaccactagaggagtttctcaagcgtgagttcggggagcacacaaaaatgacagatgtcaggaagcctaaagtaatgctcaccggaacactctcagaccgtcagcctgccgaactccacttgtttcgcaactatgacgccccagaaacagtacgtgagccaagattcaatcagaatgttaatttacgacctcccgcacagccaagcgaccagctggtctggagagcggctagaagttccggcgccgcaccaacttattttcgccccaacgggagattcttagatggcggactgctggctaataacccaaccctggacgcaatgacagaaatccatgaatacaaccaggacctgatcagaaaaggccaagctaacaaagtgaagaagttgtccatcgtagttagcctgggaacgggcaggtctccacaggtgcccgttacttgcgtggacgtgttcagaccatctaatccatgggaactagccaagacagtgttcggggcaaaagaactcgggaaaatggtggtggactgctgcaccgacccagacggacgggccgtggatcgggctcgtgcatggtgcgagatggtaggtatccagtattttcgactaaacccccagttaggcaccgacatcatgctcgacgaggtgagcgacacagtcctagtcaatgccctctgggaaacagaagtctatatttacgaacacagagaggagtttcagaagctgattcagttgctgctctcaccatag

SEQ ID NO: 25621 - DNA, 501 bp, Artificial Sequence
  Description of Artificial Sequence: Synthetic coding sequence
atgcagttcttcggccggctggtgaacaccttcagcggcgtgaccaatctgtttagcaacccttttcgagtgaaggaggtagcagttgccgactacacatcctccgatcgcgtgcgggaggaaggacagctgatcttgttccagaacacccccaacaggacctgggattgtgtcttggtcaatcccagaaatagccagtcgggctttaggtgtgcaaattgcgcagagaatgaggaaggatgcactccacttcatctcgcctgtaggaagggcgatggggaaatcctggtcgaattagtgcagtactgccatacacagatggatgttacagattacaaaggtgaaaccgtttttcattatgcggtacagggggacaactcgcaagtgttgcagctgttaggaaggaacgcagtcgctggactgaaccaagtcaataaccagggtctcacaccactgcacttagcatgccagctcggcaaacaagagatggtcagagtatag

SEQ ID NO: 25622 - DNA, 1299 bp, Artificial Sequence
  Description of Artificial Sequence: Synthetic coding sequence
atgcagttcttcggccggctggtgaacaccttcagcggcgtgaccaaccttttctcgaatcccttccgcgtgaaggaagtggctgttgccgattacacctcatcagatagagtgcgcgaggaaggccagctgattctgtttcagaatacgccaaataggacctgggactgcgttctggtgaatccccggaactcccagagcggcttccgattgttccagcttgagttggaggctgatgcactggtaaattttcaccaatactccagccaactccttccattctatgagagctctcctcaggtgcttcacaccgaggtcctgcagcacttaaccgatttgattcgcaaccatcccagctggtccgtagcccacttagccgtcgaactcggcatccgtgagtgtttccatcactccagaatcatccgcgttcgctcagctcatcaggtgcccggcctgtgggagctcattagtacgcaccacgaaatagagttcagccaaccgccccaggctgtgcctatcgcgagaagaaccaggcgtgccgcccacccatgcacctggcctgcagcaagagtaatggggagaagctggtggagttggtgcagcacagctacgctgcgttggatgtcgcctaccactcgggagcggccatcaagcatcatgctgtcccgcgtgacaatcctacgttgctgcaggtgtgccgaaatgataattagcatggatagcagccagatccactccaaagacccccgctatggggcttcgccactgcactgggcgaaaaatgccgaaatggcccggatgctacttaagaggggctgtaacgtcaattctacctcctccgcgggtaacacagcacttcacgtggcagtgatgagaaatagattcgattgcgccatagtcctgcttacacacggcgctaacgctgacgccaggggagaacacggtaatacccctctgcatctagctatgagcaaagacaacgtggaaatgattaaggctttgattgtcttcggggcggaggttgacacccctaacgactttggcgagacgcctaccttcctggcctctaagatcggcaggctagtgacgcgcaaggcaattctgaccttactgcggaccgtaggagccgaatactgctttcctcctatccatggagtgccagctgagcaggggagtgctgccccccaccaccctttttcactcgaacgggcacagcctccaccaatctctctcaacaatttgggatcccaccctagccaggcaggatggtgggcctggggggctgcctcagacggttag

SEQ ID NO: 25623 - DNA, 243 bp, Artificial Sequence
  Description of Artificial Sequence: Synthetic coding sequence
atgcagttcttcggccggctggtgaacaccttcagcggcgtgaccaatctgttctctaatcccttccgtgtgaaggaggttgccgtggctgattatacttcctccgatagagtccgagaggaggggcagctaatactttttcagaacacgcctaatcgaacttgggattgtgtccttgttaatccccgaaattcccaatctggcttcaggctgtttcaactcgaactcgaagccgacgcttag

SEQ ID NO: 25624 - DNA, 498 bp, Artificial Sequence
  Description of Artificial Sequence: Synthetic coding sequence
atgggccccctgcccgtgtgcctgcccatcatgctgctgctgctgttgccctccttgcttctgctccttctccttcctggacctggcagtggcgaagccagtaggatattgcgcgtccaccgacggggcattctggaactggcaggaaccgtaggctgcgtggggcctagaacacctatcgcatacatgaagtatggatgtttctgcggactggggggacatggtcagccgagagatgcaattgattggtgttgtcacggccacgactgttgttacacgagggctgaggaggcgggctgtagtccaaagaccgaaaggtactcatggcagtgtgttaatcagtccgtgctttgcggccctgccgagaataagtgtcaggagctcctgtgcaagtgtgatcaggagatagccaactgccttgctcaaactgagtataatctgaaatacctattctaccctcagttcctctgcgagcccgattctccgaagtgcgattag

SEQ ID NO: 25625 - DNA, 498 bp, Artificial Sequence
  Description of Artificial Sequence: Synthetic coding sequence
atgggccccctgcccgtgtgcctgcccatcatgctgctgctgctgcttccttctctgcttttgttactgcttctgcccgggccagggtccggcgaggcctcccgcatcctacgagtgcataggcgcgggatactcgagttagccggcaccgttggctgtgtgggaccaaggactccgattgcctatatgaagtacggctgcttttgcggtctcggaggtcatggccagccgagagatgctattgattggtgctgtcacgggcacgactgttgctatactagggccgaggaggccggctgctcaccaaaaacggagcgatactcctggcagtgcgtcaatcagagtgtactgtgtggtcccgcggagaataaatgccaggaattgctttgcaaatgtgatcaagagatcgcgaactgtctggcccagactgaatataacctgaagtacctgttttatccccagtttctgtgcgaacccgatagtcctaaatgcgattag

SEQ ID NO: 25626 - DNA, 570 bp, Artificial Sequence
  Description of Artificial Sequence: Synthetic coding sequence
atggccctgctgagccggcccgccctgaccctgctgctgctgctgatggctgcagtggtccggtgtcaggagcaagcgcagaccacggactggcgcgccaccttaaaaacaatccgcaatggagtgcataagatagatacttatctgaatgcagctctggatctcttgggcggtgaagatggcttatgccagtacaagtgttcggacggctctaagccatttccaaggtatggctacaaaccctctcctcccaatgggtgtggctctcccctgttcggcgtccacttgaatattggaatcccctccctcacgaaatgctgtaatcaacacgaccgctgttatgaaacttgtggaaagtcaaagaatgactgtgacgaggagtttcagtactgcttatctaaaatttgtcgcgatgtgcaaaaaacgctcggtttgacccagcacgttcaagcgtgtgaaactactgtagagctgttgttcgactccgtgatccatctcgggtgcaagccgtacctggattcacagagagctgcatgccggtgtcattatgaggaaaaaaccgatctgtag

SEQ ID NO: 25627 - DNA, 213 bp, Artificial Sequence
  Description of Artificial Sequence: Synthetic coding sequence
atggccctgctgagccggcccgccctgaccctgctgctgctgctgatggctgcggttgtccgatgtcaggaacaggcacagacaaccgattggcgggccaccctgaagactatcagaaacggggtacataagatagatacatatctgaacgccgccctcgacctcttgggaggcgaagatggactttgtcagtataaatgctccgatgcctag

SEQ ID NO: 25628 - DNA, 588 bp, Artificial Sequence
  Description of Artificial Sequence: Synthetic coding sequence
atgaagctggccagcggcttcctggtgctgtggctgagcctgggcggaggcctggctcagagcgacacaagtcccgacaccgaggagtcctactccgattggggcttgcgtcacctgagggggagctttgaaagcgtgaatagctactttgacagtttcctggaactgctgggtgggaaaaatggcgtgtgtcagtacagatgtcgctacgggaaggctcccatgccgagacctggttacaagccccaggagcctaacggatgcgggtcttattttctaggccttaaagttcctgagagtatggacctgggcatccctgcaatgacaaagtgttgtaaccagctggatgtttgctacgacacttgcggggctaataagtatagatgtgacgccaagtttcgttggtgtctgcactctatctgttcggatctcaagagatctctgggctttgtatcaaaggtggaggccgcttgtgactctctcgttgacacagttttcaacactgtttggacacttggttgcaggcccttcatgaattcccagagagccgcttgcatctgcgcagaggaagaaaaggaagaactgtag

SEQ ID NO: 25629 - DNA, 3876 bp, Artificial Sequence
  Description of Artificial Sequence: Synthetic coding sequence
atggccggcgccgccagcccctgcgccaacggctgcggccccggcgctccaagtgatgctgaggtactccacctctgtagatcacttgaagtcggcactgttatgacgctcttctactctaagaaaagccaaaggccagaaagaaagacattccaggtgaagttggagacacggcaaattacctggtccagaggcgccgacaaaatcgagggggccatcgacattcgtgagataaaagaaatccgccccggaaagacttctcgagacttcgatcgctaccaggaagatcccgcctttagacccgatcagagccactgctttgttattctctacggcatggaattccggctgaagactctgtccctccaggctacttctgaggatgaggtgaatatgtggatcaaggggctgacctggctgatggaggacaccctacaggctcccactccgctgcagattgagagatggttgcggaagcaattctactcagtcgatcggaacagagaggacagaatcagcgctaaagacctgaagaacatgctgtctcaggttaattatcgcgtgcccaacatgcgctttttgcgggagcggctgaccgatctggagcagagaagtggagatataacatacggtcagttcgctcaactgtacagatccttgatgtactcggctcaaaaaaccatggacctgccgtttctggaggcttctactctgagagccggggagcgtcctgaactgtgtagagtgagtcttcctgagtttcaacaatttcttctggactatcagggcgagttgtgggcggtggatcgccttcaggtccaggaatttatgctcagcttcctcagagacccactcagagaaatcgaagagccctatttcttcctggatgagtttgtcactttcttgttcagtaaagagaattccgtgtggaactcccagctggatgccgtctgtccagataccatgaacaatcccctgagtcattattggattagctcatctcacaacacctaccttactggagaccagttttcaagtgaaagcagccttgaggcatacgcacgctgcctccgcatggggtgcagatgcattgaactggattgttgggatgggccggatggaatgcctgttatctatcacggacacaccctgactaccaagataaaattcagcgacgtattgcatactatcaaagagcacgcatttgtagccagcgaatacccagtgatactgtcaatagaggaccactgctccattgcacaacagcgcaatatggctcaatacttcaagaaggtactgggcgacaccctcttaactaagcccgtggagatatctgcggacgggctcccatctcctaaccaactgaaacggaaaatcctgattaagcataaaaagctcgccgagggcagcgcatatgaagaagtgccaaccagcatgatgtatagcgaaaacgatatcagtaattccatcaaaaacggaatattatacttggaggaccccgttaaccacgaatggtacccacattatttcgtgctaacctcatctaaaatctattatagcgaggagacctccagtgatcaggggaacgaggatgaggaggagcctaaagaagtgagctcatctaccgaactccactccaacgagaagtggtttcacggaaagctgggtgccggccgggacggaaggcacatagccgaaaggctcctgaccgagtattgtatcgagacaggggcacctgatggatcctttctggtgagagagagcgaaacttttgtgggcgactacaccttgagtttctggcgcaacgggaaggtccagcactgtaggatccactcacgccaagatgctggaaccccgaagttcttcctgactgataacctggtttttgatagtctctatgatttgatcacacattaccagcaggtgcctctgcgctgtaatgagttcgagatgcggttatcagagccagtgccccaaacaaacgctcatgaatccaaagagtggtaccacgcttccctgacccgggcacaggcagagcacatgctcatgcgggtccctcgcgatggtgctttcctcgtacgcaaaaggaacgagcccaactcctacgcgattagtttccgtgccgaggggaaaatcaaacactgccgggtgcagcaagagggacaaactgtgatgctggggaactccgaatttgacagtctggtggatctgatctcgtactatgaaaagcaccctctttatcggaagatgaaactcaggtatccaatcaacgaggaagccctcgaaaagattggaacggcagagcccgactatggagccctttatgagggcagaaaccctggcttttacgttgaggccaacccgatgccgaccttcaagtgcgcagtaaaggcattgtttgattataaagcccaacgggaagacgagctaacattcataaagtccgcgataatccaaaacgtggaaaaacaggagggaggatggtggcggggggactacgggggcaaaaaacaactctggtttccatcgaattatgtggaagaaatggtcaatccagtagccctcgagcccgaacgcgagcacctggatgaaaactctcctctcggtgatttactcagaggcgtgcttgacgttccagcatgtcagatagccattagacctgagggcaagaataatagactttttgtcttcagtatttctatggcttctgtggcacattggtcccttgatgtggccgctgattctcaggaggagctgcaggactgggtcaaaaaaatcagagaggtggcccaaactgctgacgccaggctcactgagggtaaaatcatggaacgccgcaaaaagatcgccctcgaactgtcggaactggtggtttactgcaggcccgtccctttcgacgaggaaaagatagggactgagagagcatgctacagggatatgtcatccttcccagaaactaaggcagaaaagtacgtaaacaaggcaaaaggaaaaaagttcttacagtacaacagacttcagttatcccgaatttatccaaaggggcagcggttggattcctctaattatgacccacttcctatgtggatctgcggcagccagctggtcgcacttaattttcagaccccggataagccaatgcagatgaatcaagcattatttatgacagggcgacattgtgggtatgtgcttcagccatctacgatgcgtgacgaggcattcgatcccttcgataagtcatctctcaggggcctggagccttgcgccattagtatagaagtactaggtgcaaggcacctgcccaagaacggaaggggcatcgtctgtccattcgtcgagattgaggtggcaggcgcggaatacgactccacaaaacaaaagacggagttcgtggtcgataacggacttaatcccgtctggccagccaagccgttccatttccagatcagcaatcctgaattcgccttcctgaggttcgtagtttatgaagaggacatgttctccgatcagaatttccttgcgcaagctaccttccctgtgaaggggctcaagacgggctaccgcgctgtgcccctaaagaataattattccgaagatcttgagttagcgtcactcctcatcaagattgatattttccctgctaagcaggaaaacggagatctgtctcccttttccggcacaagcctgcgggagcgggggagtgatgcaagtggccaactgttccatggccgcgctcgggagggcagcttcgaaagtaggtatcagcagccatttgaggacttccgcatttcacaagaacatcttgcagaccacttcgattctcgcgagcgtagagccccccggcgaaccagggtgaacggggataatcgcctttag

SEQ ID NO: 25630 - DNA, 3873 bp, Artificial Sequence
  Description of Artificial Sequence: Synthetic coding sequence
atggccggcgccgccagcccctgcgccaacggctgcggccccggcgctccgagcgacgcagaagtgctgcacctttgcagaagcctggaagtcggtactgtgatgactctgttctacagtaaaaaatcccagagacccgagagaaagacattccaggtgaagctcgagactcgacaaattacctggtccagaggagcagataagatcgaaggggcgatcgatatacgcgagatcaaggaaatcagacctggaaaaactagccgcgactttgaccggtaccaagaagacccggcctttcgccctgatcagtctcattgtttcgtgattctgtatgggatggagttccggcttaagacactgagtctgcaggccacctccgaagatgaagtgaatatgtggatcaagggcctgacatggctgatggaggatactctgcaggcgcctactccattgcagatcgaacggtggctgaggaagcagttttattcagtggaccgaaatcgtgaagataggatctcagcaaaggacctgaagaatatgctatcccaggtgaactaccgggttcccaatatgcgctttttgagagaaagacttaccgacctcgagcagaggagcggggacatcacttacggacagttcgcccagctgtaccggtcccttatgtacagtgctcagaaaactatggacctgccttttcttgaggcttcaactctacgggccggggaacgcccggaactgtgtagagtgagtcttccagagtttcagcagttcttgttggattatcaaggagaattgtgggccgtcgaccgtctccaagtacaggaattcatgctgagctttctccgagacccactccgcgaaattgaggagccatactttttccttgatgagttcgtcactttcttgttcagcaaagaaaattcggtctggaactcccaactggacgccgtttgccccgacactatgaataatcccctatctcattactggatttcctcctctcacaacacctacttgaccggggaccagtttagttccgagtcaagcctggaggcttacgcccggtgcctaagaatggggtgccgttgcattgagctggattgttgggacggccctgatggcatgcctgtaatatatcacggtcacacgctcacaacaaagatcaaattctcagacgtgttgcacacaattaaagagcacgctttcgtggctagcgagtacccggtcatcctatcgattgaagaccattgcagcatagcccagcagcgtaatatggcgcagtatttcaagaaagttcttggagacaccctcctgacgaagccagtggaaatatccgcagacggactgccctctccaaaccagcttaagcggaaaatcctgattaagcataagaaactcgccgagggttctgcttacgaggaagtcccaactagcatgatgtattcggagaatgatatttcaaactctattaaaaacggcatcttgtatctggaggatcctgtgaatcacgaatggtacccccactatttcgtcctcacaagctcaaaaatctattattccgaagagacctctagtgatcaaggcaacgaggacgaggaggaaccgaaggaggtatcttcctcaaccgaactgcatagtaatgaaaagtggttccacggaaaactaggggcagggcgagatggtcggcatatcgctgagagattattgacagagtactgcattgagactggagccccagatgggtcattcctggtgagagaatccgagacttttgtgggcgattacaccctgagcttttggcggaacggaaaggtgcaacactgcaggatccatagccggcaagacgcaggaacaccgaagttcttccttacggataatctggtgtttgatagtctgtatgatctgattacccattaccagcaggtgccactccgctgtaatgagtttgagatgcgcctgtccgagccggtgccccagaccaacgcccacgagtcgaaagagtggtaccatgcatcactgacccgggcccaagctgagcacatgctgatgagggtgccaagggacggcgccttcctggtccggaagagaaacgaacccaattcgtacgccatctcctttagagccgagggaaagattaagcactgcagggttcagcaggagggacagactgtgatgcttggcaactccgagttcgactctcttgtggatctaattagctattacgagaagcatcccctgtatcgaaagatgaagctccgatatcctatcaacgaggaagcactagagaagatcggcacagctgagcccgattacggcgcgctttacgaaggaagaaaccctggattctatgttgaggcaaatcctatgccaacttttaaatgcgccgtgaaggccttattcgactacaaagcccaacgagaagatgaactaaccttcatcaagtccgcaataatccaaaacgtcgaaaaacaagaggggggatggtggcgcggtgattatggtgggaagaagcagctgtggttcccatccaactatgtggaggaaatggtcaacccagttgctctggagcctgaaagagagcacttggacgaaaactccccacttggggacctgctgcggggagtgctggacgttcccgcctgtcagatagcgattaggcctgaaggtaagaacaacagactcttcgtgttttccatcagcatggcctcagtggcacactggtctctggacgtcgctgccgattcccaggaggaactgcaagactgggtaaagaagattagagaggtagcccagacggcggacgcaaggctcacggagggtaaaatcatggagcgacgcaagaaaatagccctggagttatctgaactggtggtgtattgccgtccagttccttttgatgaggagaaaatcggaactgagcgagcttgttacagggacatgagctctttccctgaaactaaggcagagaagtatgtcaacaaagccaaaggaaagaagttcctgcagtataaccggctacagctaagcagaatctatcctaagggtcagcggttagattcaagtaactacgatcctctgcccatgtggatttgcgggagccagttggtagctttgaactttcagacgcctgataaaccaatgcaaatgaatcaggcactgttcatgacaggacgccactgcggatatgtgctccagccttcaaccatgagggatgaggcattcgatcccttcgacaagagctctctccgaggcctagagccatgcgctatctctatcgaggtcctcggggcccgccacctcccaaagaacggtagagggattgtatgtcccttcgttgaaatcgaagttgctggcgctgagtacgacagtacgaagcagaagaccgagtttgtcgttgacaacggtttgaatcccgtgtggcccgctaagcccttccactttcagatctccaatcccgagttcgcttttctgcggttcgtcgtgtacgaagaggacatgttctccgaccaaaactttctcgcacaggcgactttccctgtcaaaggcctgaagacgggataccgcgcagttcctttaaaaaataactattctgaggacctcgagttggccagtctgctgattaagattgatattttcccagcaaaagagaacggcgatttgagccctttctcaggcacaagcctccgcgaacgggggtccgatgcctccgggcagttgtttcacggaagggctcgtgaggggtcctttgaatccaggtatcaacaaccattcgaagatttccggatcagccaggaacatctggcggaccacttcgactcacgcgagcgcagagccccccggcggacaagggtgaacggggataatagactttag

SEQ ID NO: 25631 - DNA, 3876 bp, Artificial Sequence
  Description of Artificial Sequence: Synthetic coding sequence
atggccggcgccgccagcccctgcgccaacggctgcggccccggcgctccgagtgatgccgaggtgctccatctgtgtagatcgctggaggtgggcaccgtgatgacgttattttactcgaagaaatctcaaagacctgagcgtaagaccttccaggtcaaattggaaacccggcagataacctggagtaggggagcggacaaaattgaaggtgcaattgatatccgggagatcaaagagatccgacctggaaagacctctcgtgacttcgacaggtatcaggaggaccccgccttccgcccggaccagtctcactgcttcgtgatcctatatggcatggagtttagactgaagaccctatccttacaggcaaccagtgaggacgaagttaatatgtggatcaagggcctgacgtggctgatggaggataccctgcaagcccctaccccacttcagatcgaaagatggctccggaagcagttctactccgtggaccggaacagggaggaccggatctctgcaaaagatttgaagaatatgctgagtcaggtcaattatagagtccccaatatgagattcctgcgtgagcgcctcacagatctggaacagcggtcaggtgatataacctatggccagtttgcgcaactctaccgctccctcatgtatagcgcccagaagacaatggatcttcccttcctggaggcatctactctccgcgcaggggaaaggcccgaactctgtcgcgtttccctacccgaatttcagcaatttctgctcgactaccagggggaactgtgggctgtggatagactgcaggtccaggagtttatgttgtcctttcttagagatcccctgagggagatagaggagccatactttttcctagacgagtttgtcacctttcttttcagcaaggaaaattccgtctggaatagccagctcgatgccgtctgcccagacactatgaataatcccctcagtcactactggatcagttcctcacacaacacatacctgactggcgatcagttcagttccgagagctccctggaagcttacgcccggtgtctaagaatgggatgcaggtgtatcgagctggactgctgggacgggcccgatgggatgcctgtcatctatcacggccacaccctgactaccaagatcaaattctctgacgtgctgcacacgattaaagaacacgctttcgtcgcaagcgagtatcctgttatcttatctatcgaggaccattgttcaatcgctcaacaacgaaacatggcacaatattttaagaaagtattaggggatactctcctcacaaagccagtcgaaatttctgctgacggactcccttctccaaaccagcttaaacgtaagattcttataaaacacaagaaactggctgagggaagcgcatatgaggaagtgcccacatccatgatgtacagcgaaaatgacattagtaattccattaagaacggaatcctgtacctcgaggacccagttaatcacgagtggtatcctcattatttcgtattgacctcgagcaagatctactattctgaggaaacgagttctgatcagggaaatgaagacgaggaagaacccaaggaggtgagcagtagcactgaattgcatagcaatgagaaatggtttcacggtaaactcggggccggacgtgacggccgacatattgccgagcgccttttaacagaatactgtattgaaaccggagcccctgacggcagcttcttggtcagggagtcagagacattcgttggagactataccttatctttctggcggaacggaaaggtccagcactgtagaatccacagtagacaagacgccggtactcccaagttctttttgaccgacaatcttgtcttcgattccctctacgaccttataactcactaccagcaggtgccgctccgctgtaatgaattcgaaatgaggttgagcgaacctgttcctcagaccaacgcacacgagagcaaagaatggtatcacgcatcactgacccgcgcccaggctgaacacatgctgatgcgggtcccccgggatggtgcttttctggttcgcaagaggaatgagcctaacagctatgccatcagctttagagccgagggaaaaattaaacactgtcgtgtgcagcaggagggccagacagtgatgttaggaaattccgaatttgactcgctggtggatttaatatcttactatgagaaacacccactatacagaaagatgaagctccgatacccaataaacgaagaggctctggagaagataggaactgcagagcccgattacggtgctctctatgaggggcgaaaccccggcttttacgtggaagcaaatcccatgcctaccttcaaatgcgccgttaaggcactttttgactacaaagcacagcgcgaagatgagctgacattcataaaatccgcaatcatccagaacgttgagaaacaggaaggaggttggtggcgaggagactacggggggaagaaacagctgtggttcccttccaattacgtcgaggagatggtcaacccggttgcactggaacccgaaagagaacacttggacgagaactcgccactgggagacctcctgcgcggagtcctggacgtgcccgcctgtcagattgccataagaccggaaggaaagaacaaccggctgttcgtgttcagcattagcatggcctcagtcgcccactggtcgctcgacgtggccgcggattcccaggaggagctgcaggattgggtgaaaaagattcgggaagtggcccagacagccgatgcccgtttgacggaaggaaaaataatggagcggcggaagaaaattgccctggagttaagtgagctggttgtctactgccgtccagttcctttcgatgaggagaagatcgggacagaaagggcatgctaccgcgatatgtctagctttccagaaacgaaggccgaaaagtatgtcaataaggcaaaagggaaaaagttcctgcagtacaataggcttcagctgagccggatataccccaagggacagcggttggattcttcaaactatgacccactgcctatgtggatttgcggatcgcagctggtcgccctcaacttccaaactcccgacaaacctatgcaaatgaaccaggccttgttcatgaccggccgtcattgcgggtatgtgcttcagccgagcacaatgcgagacgaagcctttgacccatttgataagagtagcctgcggggcttggaaccatgcgcaattagtattgaggtgctgggtgccaggcacctgcctaagaacggcagagggatcgtctgtccttttgtcgaaatagaggtcgcgggcgcggaatacgattcgaccaagcagaagacagagtttgtggttgataatggtctgaaccccgtctggccagccaagccatttcacttccagatctccaatccagaatttgcctttctgagattcgtcgtgtacgaggaggacatgttttcagatcaaaatttcctagcccaggctacgttcccagtcaaaggcttgaagaccgggtaccgggccgtgcctctgaagaacaattacagtgaggacctcgaactggccagtcttctcattaaaatagacatctttccggctaagcaggagaacggagacttgagccctttcagcggtaccagtttgcgggaacgagggtctgacgcttccggacagctttttcacgggagagccagggaagggtcctttgagtcaagataccagcagcccttcgaagatttcaggatcagccaggaacacctggccgatcacttcgacagcagagagcggagggcccctcggcgaacccgtgtgaacggggacaaccgactctag

SEQ ID NO: 25632 - DNA, 3798 bp, Artificial Sequence
  Description of Artificial Sequence: Synthetic coding sequence
atgagcaccaccgtgaacgtggacagcctggccgagtacgagaagagccagatcaagcgcgctctggaactgggcacggtgatgacagtcttttcctttcggaaatccacaccggaacgccgtacagtacaagtgattatggaaaccaggcaagttgcctggagcaaaactgctgacaagatcgagggcttcctggacataatggaaattaaggaaatcaggcctggcaagaatagcaaagattttgagcgggcaaaggctgttcgtcagaaggaggactgctgctttacaatattatatggaactcagttcgtcctctcgactctctccctggccgccgacagcaaggaggatgcagtgaactggctcagtggtctcaagatcctgcatcaagaggctatgaatgctagcacccccacaataattgagagctggctgcgaaaacaaatttactctgtggatcaaactagacggaactctatcagtctcagagagttaaagacgatcctgcctttgataaactttaaagtgtcaagcgccaagtttctcaaagacaagtttgtggaaattggggcacacaaagatgagctgtctttcgagcagtttcatttgttttataagaaactgatgttcgagcagcagaagtcaatacttgatgagtttaagaaggattcctccgtttttatcctgggtaacacggataggcccgatgcatctgctgtgtacctccatgattttcagcggtttctcatccacgaacagcaggaacactgggcgcaggatctcaataaggtcagggagagaatgaccaagtttatcgatgacaccatgagggagaccgcagagccctttctattcgtggacgagttcctcacttatctttttagtcgggagaatagcatatgggacgaaaaatatgacgcagtggacatgcaagacatgaacaacccactctctcattactggatcagcagtagccataacacctacctcacgggtgaccaacttcgctcggagtcctcgccagaggcttatatccgttgtctgcgtatgggctgtagatgcatcgaattagactgttgggatggaccggatggaaagcctgtgatctatcacggatggactcgaaccactaagattaaattcgacgacgttgttcaggcaataaaggaccacgccttcgtgacgtccagcttccctgtgatattaagcatcgaggagcattgctctgttgaacaacagagacatatggcaaaggctttcaaggaagtgtttggagatctgctgctgactaaacctactgaggcctccgcagatcagctgccctctccaagccagctccgggagaaaattattattaaacacaagaagctgggaccccgcggtgacgtggacgttaacatggaggacaaaaaggatgaacacaaacagcagggtgagctctacatgtgggactccatcgatcagaagtggacgcgccattattgcgctattgccgacgctaagttaagtttctctgatgacatcgaacagacaatggaagaggaagtgcctcaagatataccccccactgagctgcattttggcgagaagtggtttcacaaaaaagtggaaaaaagaacctcagccgagaaactcctccaggagtactgtatggagaccggaggtaaggatggaacttttctggtgcgggaatctgagactttccctaacgactacaccctgagcttttggagaagcggtagagtccagcactgtagaatccgctccacaatggagggtggtaccctgaagtactatctgactgataacctcactttcagctctatttacgctctcatccaacactatcgggagacccacctgaggtgcgcagaattcgagttgcgcttgaccgatccggtgcctaaccccaatccacatgaatcgaagccctggtactacgattccctcagccgcggtgaggcagaagatatgttaatgagaatacccagagacggcgcatttctgattagaaagcgggaagggagtgatagctatgccatcacttttcgcgctagagggaaagttaaacattgtaggatcaaccgcgacggccggcacttcgtcctgggaaccagcgcatattttgagagcctggtggagcttgtgtcctactatgagaagcattccctctatagaaagatgcggctgcggtacccggtcactcctgagcttctagaaaggtataatatggagcgggacattaactcgctgtatgatgttagtcgaatgtatgtagatccctccgagattaacccttccatgccacagaggacagttaaagcactgtatgattataaagctaagaggagcgacgagctcagtttctgccggggagccctgatccataacgtgtccaaagagccaggcgggtggtggaagggtgattacgggacgcggattcagcagtacttcccaagcaattatgtggaggatatcagcacagcagatttcgaagaactcgagaaacagattatcgaggacaaccctctgggcagcctttgccgtggcatcctagacctcaatacatataatgtcgtgaaagcccctcaaggcaagaaccagaaatcattcgtgtttatactcgaacccaagcagcagggtgatccacccgttgagtttgctacagaccgcgtcgaagaattattcgagtggttccagtctatacgggaaatcacctggaaaatcgacacaaaggaaaataatatgaagtactgggagaagaatcaatctatagctattgaactcagcgatctggtggtgtattgtaagcccacctcgaagaccaaagacaatctggagaacccagatttcagggagatacggagcttcgttgaaacgaaagctgactcaattatccgccagaaacccgtggacctgctcaaatacaatcagaagggtctgacccgcgtgtaccctaagggacagagagtggattcatccaattacgaccctttccggctctggctatgcggctcgcagatggttgccctgaacttccagaccgcagataagtatatgcagatgaatcacgccttattctcactgaacggacgcaccggttacgtgttacaaccagaatctatgaggaccgaaaagtacgacccaatgcccccagaaagtcagcggaaaatcctgatgaccctgactgtgaaagtgttgggggcccgacacctgcccaagctgggaaggagcattgcttgtccctttgtggaagtggagatttgcggtgcagagtatgataacaataagtttaagacaacggtggtgaacgataacggcctcagccccatctgggcccctacacaggaaaaggtgacgtttgagatatacgaccccaacttggcattcctgcgctttgtggtctacgaagaagacatgttttccgaccccaactttttggcgcacgctacatatccgatcaaagccgtaaaatctgggttccggagtgtacctttgaagaatggctatagcgaggacatcgaacttgcatcacttttggtgttctgcgagatgcgcccggtcctggaatctgaagaggagctctatagtagctgcaggcaacttaggcgccgccaggaagagctcaacaaccagctttttctgtacgatactcaccagaatctcaggaacgctaatagggatgcgctagtaaaagagttctcagtgaatgagaaccagctgcaactgtatcaagagaagtgtaacaaacgcctgcgcgagaaaagggtgtcaaattctaaattttacagctag

SEQ ID NO: 25633 - DNA, 2916 bp, Artificial Sequence
  Description of Artificial Sequence: Synthetic coding sequence
atgagcctgaagaacgagccccgggtgaacaccagcgccctgcagaagatcgccgccgacatgtcaaatattatagagaacctcgatactcgcgagttgcacttcgaaggggaggaggtagactacgatgtgagcccatctgacccaaagattcaggaggtctatattcccttctccgccatttacaacacacaggggttcaaggagcccaatatccagacgtatttgtctggctgtccgattaaggcccaagtcctcgaagtggaaaggtttacatccacaacgcgggtgcccagtatcaacttatatacaattgaactgactcacggggaatttaaatggcaggtaaaaagaaagtttaagcacttccaggagttccatcgcgagctgctcaagtacaaagcgttcatccggattcccatcccaactagaaggcacactttcaggcgtcaaaacgtgcgcgaggagcccagagagatgcctagtctgcctcgctcaagcgagaacatgataagggaggagcaattcctaggacgtagaaaacagttggaggactacctgacaaagattctaaagatgccgatgtacagaaattaccacgccacgaccgagtttctggatatctcacagctctccttcatacatgacttgggaccgaagggcatagaggggatgattatgaagcggagtggcggccatagaatccccggacttaactgctgtggtcagggccgcgcttgctacagatggtcaaagagatggctgattgtgaaggactcgttcctcctttatatgaagcccgactctggcgcaatcgctttcgtattgctggtcgataaagagttcaagattaaagtgggcaaaaaagagaccgagactaaatatggcattcggatagataaccttagccggactctcatacttaagtgcaattcatatcggcacgctcgttggtggggcggcgccatcgaggagtttatccaaaagcatggcacgaatttcctcaaggatcatcggttcggctcgtacgcagctatccaggagaatgccctggccaagtggtacgtgaatgctaaggggtactttgaggatgtcgctaacgccatggaggaagctaacgaagaaatattcatcacagactggtggctgagccccgaaatcttcttgaagagacccgttgttgaggggaacagatggcggttagattgcattctgaaacgcaaggcacagcaaggagtccgcatctttatcatgctgtacaaggaagtcgaactcgccttgggtataaattccgagtacaccaagcggaccctgatgaggctccatcctaacattaaggtgatgaggcaccccgatcatgtttccagtaccgtgtacctgtgggcccaccatgaaaagcttgtcattatcgatcagtcagtggcattcgtcggagggattgaccttgcttatggccgctgggacgacaacgaacaccggctcacggatgtcgggagtgtgaaacgggtaactagtgggccttctttgggatcccttccccccgcggccatggaaagcatggagagtctcagattaaaagataaaaacgagccggtgcagaatctacccattcagaagtccatcgatgacgttgattccaaactgaagggcattggcaagcctcgaaagttcagtaagttctctctgtacaagcaacttcataggcatcatctgcacgatgctgattcaatttcaagcatcgactccaccagcagctattttaaccactatagatctcaccataacttaattcatggcctgaagccgcacttcaagctcttccacccctcttcggaaagcgagcagggattgacacgtccacatgccgatacgggaagcatcaggtcactgcagacgggcgttggcgagctgcacggtgaaacgcgcttctggcacggcaaggactactgcaactttgtatttaaagactgggtccagctagacaaaccattcgctgacttcatcgacaggtattcgacccccaggatgccgtggcatgatattgcgtcagctgtgcatggtaaggcagccagggacgtcgctagacacttcattcagagatggaatttcactaaaatcatgaagagcaagtaccgaagcctctcataccctttcctgctgccaaagagccaaaccacggctcacgagctgcgctaccaggtccctggctccgtccacgccaatgtgcagctgctccgatcggccgccgactggagtgctggaatcaaataccacgaggagtctattcatgcagcctacgtacacgtgatcgagaattccaggcactacatttacatagagaaccaattctttatctcttgtgccgacgataaagtggtctttaacaagataggcgatgcaatcgcccagaggatcttaaaagcacaccgtgaaaaccagaagtatcgcgtttacgttgtcatcccactactccccggattcgagggggatatttccactggcgggggaaatgccttacaggccattatgcattttaattaccggaccatgtgccgcggtgagaactcgattctcgggcagctgaaagcagaactagggaatcagtggattaactatatctctttttgtgggctgcgcacacacgccgagttggagggcaatcttgtaaccgaactcatatacgtccactcgaagttgttaatcgccgacgataatacggttattataggctctgctaacattaacgaccggagtatgctggggaagagagattcggaaatggccgtcattgtgcaggataccgagactgtaccatctgtcatggacggaaaagaatatcaggccggtcggtttgcccgagggcttcggttgcagtgttttagatctaagatgacacccggggtggaagacccctag

SEQ ID NO: 25634 - DNA, 1794 bp, Artificial Sequence
  Description of Artificial Sequence: Synthetic coding sequence
atgagcctgaagaacgagccccgggtgaacaccagcgccctgcagaagattgctgctgacatgagtaatatcatcgaaaacctcgataccagagagctgcactttgagggcgaagaagtcgactatgacgtgtcaccgtccgacccaaagatccaggaggtctacattccattcagcgcgatctataacacccaaggattcaaggaacctaatatacagacatacctcagcggttgccccataaaggcgcaggtgctcgaagttgaacggttcacatcgacgaccagggtgcccagcataaatctgtacaccattgagttgactcatggggaattcaaatggcaggtcaagaggaaattcaaacattttcaagaatttcaccgtgagctgttgaagtataaggctttcattagaattcctataccaacacgaaggcacaccttcaggagacaaaatgtgagggaagaaccacgtgaaatgccaagcttaccgcggagctctgaaaatatgattcgcgaggaacagttcctaggaaggcggaagcaactggaagactacctgacgaagattctgaagatgccaatgtataggaactaccatgctactaccgaatttctggatatcagccagctttccttcattcatgacctcgggccgaaggggatcgaagggatgatcatgaagagaagtgggggccataggattccaggtctgaactgctgtggtcaagggagggcctgctaccgatggagcaaacgatggctcatcgtgaaggacagctttctcctgtatatgaagcctgactctggtgcaatcgcttttgtgttacttgttgacaaggaattcaaaatcaaagtggggaagaaggagacagaaaccaaatacggcattagaatcgataacctctctaggacattaatcctgaaatgcaactcatatagacatgccagatggtggggcggggccatcgaggaatttattcaaaaacatggcactaatttcttgaaggaccaccggtttgggtcgtatgccgcaatccaggagaatgccctggccaaatggtatgtgaacgcaaagggatattttgaggacgtggccaacgccatggaggaggctaatgaggagatctttattactgattggtggttgtcccccgagattttcctaaagcgtcctgtagtcgaaggaaatcgatggaggcttgactgcatcctcaaacggaaggcccagcaaggtgtgcggatcttcatcatgctctataaagaggtagaactcgcccttggcattaattcagagtacactaagagaacactcatgcgtctgcaccctaacatcaaggttatgcggcaccctgaccacgtgagctcaacggtctacttgtgggctcaccacgaaaaactggtgatcatagaccaaagcgtcgcattcgtcggtgggatcgacctggcttacggacggtgggacgataacgagcaccgcttgacggatgttggttcagtgaagagagtgacttctggtccgtcactgggctctctccccattcctgggccttcagtggtctaccgccaggtttgggagtcctgcatgggaaaacctgatagtggcatggaacgcacaacggctatcagttcgtccaaaaccgggttcaacctcatcaacctgttgctaatctccctgacaggaacgcccaggcccggatgccctggaatgacactgccccttcagagcaccggaagacgccttgtgatgtggcacgttacttcttcctcagctggaacttcccagaaactgtag

SEQ ID NO: 25635 - DNA, 3225 bp, Artificial Sequence
  Description of Artificial Sequence: Synthetic coding sequence
atgagcctgaagaacgagccccgggtgaacaccagcgccctgcagaagatcgccgcggacatgtctaatatcatagagaacttagacacgcgagagcttcatttcgagggcgaagaggttgactacgacgtctccccttctgatccgaagatccaggaggtttatatccctttctcagcaatatataacacgcagggcttcaaggaaccgaatatccagacttatctaagtggatgcccaataaaggcccaggttttagaggttgagcggtttacttctacaacacgcgtgcctagcatcaacctctataccatcgagttaacccacggcgaatttaaatggcaagttaagaggaagttcaaacattttcaggagtttcatagggagctgctgaaatacaaagctttcattaggattccaatcccaactagacgccataccttcaggcggcagaacgtccgggaagaacctagagaaatgccatccctgccccggagcagtgagaatatgatcagggaggaacagttcctcggcagaaggaaacagctggaagactatctgactaaaattctcaaaatgccaatgtataggaactatcacgctaccactgaattcctagacatttctcagttgtcatttatccacgacttagggcctaagggtattgaagggatgatcatgaaacgaagtggcggccataggattccaggacttaattgttgcggccagggacgagcatgctataggtggtcaaagcgttggctaatcgtgaaagattcctttctgctgtacatgaagccagattccggggcgatcgccttcgttttactggtcgacaaagagttcaaaatcaaagtggggaaaaaagaaaccgaaacaaaatacggaatccggatcgacaacttgtctagaacacttatcctcaagtgtaacagctaccgccacgcgcgatggtgggggggggccattgaggaattcatacagaaacacggcacaaacttcttgaaggatcaccggttcgggagctacgctgcgatccaagagaatgcactagctaagtggtacgtgaacgctaagggatacttcgaagatgtggcaaacgccatggaggaggcgaatgaggagatctttattactgattggtggctctcacctgaaatttttctcaagagacccgtggtggagggaaaccgatggcgactcgactgcattctcaagcgtaaagcccagcaaggcgttagaattttcatcatgctgtacaaagaagtggagcttgcactgggtatcaatagtgaatacacaaaaagaacactgatgcgtctgcaccctaatattaaagttatgcggcatccagatcatgtatcgagcactgtgtacctatgggctcaccatgagaagctggtgatcatagaccaaagcgtggccttcgtgggaggcatcgacctcgcgtatggtagatgggatgataacgagcaccgtctcaccgacgtgggatcagtgaaaagggtaacaagtgggccaagcctgggaagcctcccccccgcggccatggagtctatggagtcacttcggttaaaagataaaaatgagccagtacagaatttgcctattcagaagagtatagacgacgtggattctaagctgaaaggaattgggaagcctcggaagtttagcaaattttcactgtataagcagttgcatcgccaccatctgcatgatgcggattccataagctcgatcgactcaacatccagctacttcaatcactacagatctcaccataaccttatccacgggctgaaacctcatttcaagctgtttcatccttcctccgagtctgagcaagggttgactagaccgcacgcagacacgggctccatccgatcccttcagacaggagtgggggagctgcatggagagacccgcttttggcatggtaaggactactgtaatttcgtgtttaaagattgggtacaactcgacaaacctttcgccgactttatcgacaggtacagtactccaagaatgccatggcacgatatcgccagcgcagtgcatggtaaggcagccagagacgtggctcgccattttattcagcgatggaactttacgaagatcatgaagagcaagtaccgctccctgtcatatccatttctcctgcctaaaagccagactaccgctcacgaattaagataccaggttccaggctccgtgcatgccaatgtgcaactactgcgcagcgccgccgactggtctgctgggatcaagtaccacgaagagtccatacacgctgcttacgtacacgtgattgagaacagccgtcactatatctatattgagaaccaattcttcatctcgtgtgccgacgacaaggtggtgtttaataaaataggagatgccatcgcccagcggatcctgaaggcccacagagagaatcaaaagtacagagtgtacgtcgttattcctttgctacccggatttgaaggcgacatcagtacaggcggaggcaatgccttacaagccattatgcacttcaattaccggacaatgtgccgaggggagaactcgatactgggccaactgaaagccgaattgggcaaccagtggatcaactatatttccttctgtggattgaggacacacgccgaactcgagggtaacctggtgacggaactgatttacgtgcactccaagttgttgatcgccgacgacaatacggttatcatcggctcagccaatattaacgacagatcaatgttaggcaagcgagattctgagatggcagtgatcgttcaggataccgagacagtgccgagtgtcatggacggtaaagaatatcaggccgggaggttcgcccgaggcctgaggctccagtgtttccgggtggtcctcgggtacctggatgatccttccgaagatatccaggatccggtgtctgataagttttttaaggaagtctgggtttccacagcagctagaaatgctactatctacgataaggtcttccggtgtctgcctaatgatgaggtacataatctgattcagctcagggactttatcaataagccagtgttggcgaaggaggacccgattagagccgaagaagaactgaaaaaaatccgcggatttttagttcagtttcctttttatttcctcagcgaggagagcctgttacctagtgtgggcactaaagaggcaatcgtgcccatggaggtgtggacatag

SEQ ID NO: 25636 - DNA, 3111 bp, Artificial Sequence
  Description of Artificial Sequence: Synthetic coding sequence
atgagcctgaagaacgagccccgggtgaacaccagcgccctgcagaagatcgccgccgacatgtccaatatcatagaaaacctggacacaagggagctgcactttgaaggcgaggaggtggactacgacgtgagcccctctgaccctaaaattcaggaagtctacatccccttctctgccatttataacacacaggggtttaaagaaccgaacattcagacctacctatcaggttgtccaatcaaggctcaggtcttagaggtggagagattcacttcgactactagagtgccttcaatcaatctctatacaatcgagttaacacacggtgagtttaagtggcaagtgaagagaaagtttaagcactttcaggaatttcatcgagaactcctcaaatacaaagctttcattaggatacccattccgacgcggaggcataccttccggcgtcagaatgtccgggaagaaccacgggaaatgccttcattaccccgctcttctgagaacatgatcagggaagagcagttcctcgggcggaggaaacagttggaggactacctgacgaagatcctgaagatgcccatgtatcgtaactatcacgccactacggaattcctggacatctcccagctgagtttcatccatgacctcgggccgaagggaattgagggtatgattatgaaacgcagcggaggccacagaatccctgggctgaattgttgcggacagggtcgggcctgttatcggtggtctaaaagatggctgattgtgaaagatagctttctgctgtacatgaagcctgactctggcgccattgcattcgttctgctcgtcgacaaggaatttaagataaaggtcggcaagaaagaaacagagacaaaatacggcatcaggattgacaacctcagtcgcactttgattctgaagtgcaacagctatcgacacgcaaggtggtggggcggcgcaatagaagaatttatccagaaacacggtacaaattttttaaaggatcatcggttcgggagctatgccgcaattcaggagaatgccctggcgaagtggtatgttaacgctaaaggttactttgaggatgtggccaatgccatggaagaagcgaatgaagaaatcttcattaccgactggtggctgtcccctgaaatcttcctgaagagacccgtcgttgaagggaatcggtggaggcttgattgcatactcaagcggaaggcccaacaaggggtaaggatctttatcatgctctacaaagaggtggaacttgcccttgggatcaacagtgaatacactaagcggaccctgatgcgccttcatccaaatatcaaagtgatgaggcatccagatcatgtctcatcaacagtttatctgtgggcccaccatgaaaaattagtcatcattgaccagagcgtggctttcgtcggcggaatagatttggcatatggtcgatgggacgacaacgagcaccggttaacagatgtaggctcagtgaagcgcgtaaccagcggccccagcctggggtcgctgcctcccgcagccatggagagcatggagtctctgagactaaaggacaaaaacgagccagtccaaaatctgcccattcaaaagagtatcgacgacgtggacagcaaactgaagggcatcggcaagccccgtaagttttctaagttttccctctacaagcaactgcatcgtcatcacctgcacgacgccgatagcatttcctcaattgactcaacttctaatacgggctcgattcggtcactgcagacaggagtgggggaacttcacggcgaaacacgcttctggcacggcaaggactactgcaacttcgtgttcaaggattgggttcagttggacaaacctttcgccgactttatcgatagatattcaaccccgagaatgccttggcacgatatcgccagtgccgtacacggaaaggccgcgagagacgtagctcgccacttcattcagcgctggaatttcaccaagatcatgaaatcaaagtatcgaagcctgtcttatccttttcttctcccaaagtcccagacaaccgctcacgagctccgttatcaggttcctggaagcgtccatgccaatgtccagctgttacggtccgctgctgactggtcagctggtattaaataccacgaggagagcatccacgcagcctatgtgcacgttatagagaacagccggcactatatttatatcgaaaaccagttcttcatttcatgcgccgacgacaaggttgtgttcaataaaataggcgacgccatcgcccagagaattctaaaagcccacagggagaaccagaaataccgtgtgtacgtcgtgattcctctgctgcccggcttcgaaggagacatctcaactggcggcgggaacgcactgcaggctattatgcactttaactaccgcaccatgtgtagaggagaaaactctatcctggggcaactgaaagccgaattaggcaaccagtggataaattatatctctttttgtggcttaaggacccacgcagagctcgagggaaaccttgtaaccgaattaatctatgtgcactcaaagctgttaatcgcagacgacaataccgtgatcatcgggagcgctaatattaatgataggagcatgctgggcaaacgggattctgagatggctgtaatagttcaggacaccgagacggtccctagcgtaatggacggcaaggagtaccaggcgggccgttttgcacgcggcctgcgactgcagtgtttccgcgttgtgctggggtacttggatgatccttccgaggatatacaggaccccgtaagtgacaagttctttaaggaggtatgggtgtccactgcggccaggaatgccacaatttacgataaggtgtttagatgtctgcccaatgatgaagtacacaacctgattcagctcagggattttatcaacaaaccggttctggcgaaagaagacccaatcagggctgaggaagaattaaaaaaaatcaggggattccttgtccagttcccattctactttctttcagaggagtcccttttaccctccgtcggaaccaaggaagctatcgtgccaatggaggtctggacatag

SEQ ID NO: 25637 - DNA, 429 bp, Artificial Sequence
  Description of Artificial Sequence: Synthetic coding sequence
atgagcctgaagaacgagccccgggtgaacaccagcgccctgcagaaaatcgccgcagatatgtccaacattatcgagaacctggatacacgagagctgcattttgagggcgaggaagtagattacgacgtttcgccatcggatcccaaaattcaggaggtctatattccgtttagcgccatctacaatacgcagggattcaaagagccgaacatacagacatacctgtctgggtgtcctattaaggcccaggtgctggaagtcgagcgttttaccagcacaactagagtaccatctatcaatctgtacacaatcgagttaacccatggagagtttaaatggcaggtgaaacgaaagtttaagcactttcaggagttccatcgtgaactcctcaagtacaaagctttcattaggatccctataccctag

SEQ ID NO: 25638 - DNA, 2580 bp, Artificial Sequence
  Description of Artificial Sequence: Synthetic coding sequence
atgtacagcggcgccggccccgccctggccccccccgcccccccccctccaattcagggctatgcatttaaacccccgccccgcccagacttcggtacttctgggcgaactataaagctccaggccaactttttcgagatggacattcccaaaatagacatttatcattacgaactcgacattaagcccgaaaaatgcccccgccgcgtgaatcgagagattgttgaacacatggtgcagcattttaagactcaaattttcggagatcgtaagccagtctttgatggccgcaagaatctatacacagccatgcctttgcctatcgggagagataaagtcgaactcgaggtgacattacctggcgagggcaaggatagaatttttaaggtctccattaagtgggtgtcgtgcgttagtctgcaggcgttacacgacgcactgtcagggagactccccagcgtcccctttgagactatccaggctctcgatgtcgtgatgcggcacctgccatcaatgcggtacacccccgtggggcgctccttttttacagctagtgaggggtgttccaaccccctgggagggggacgtgaagtctggtttggttttcaccagtcagtccgccccagtctctggaaaatgatgctgaacattgacgtgagtgctaccgcattctacaaagctcagcccgtcatagagtttgtgtgcgaagtgctcgatttcaagagcatagaggagcagcagaaacccctgactgactcccagagggtgaagttcacaaaggaaatcaaaggattgaaggtggaaatcacacactgcggtcagatgaaaagaaaataccgcgtgtgcaacgtaaccaggcggcctgcctctcaccagacgttccctttacaacaagagtccgggcagacagttgagtgcaccgtggcccagtatttcaaggataggcacaagctcgtcttgagatacccccatctcccttgtttacaagttggccaggaacaaaaacacacatacctcccattggaagtatgcaacatcgtcgccggccagaggtgcatcaagaagctgactgataatcagacttccacgatgattcgtgctaccgctcgatccgccccagaccgccaggaggagatctcaaaactgatgagatctgcatccttcaatacagatccgtatgtcagagagtttggtattatggtgaaggacgaaatgacagatgtgacgggccgtgttcttcagcctccctcaatcctatacggcggtagaaataaggccatagctacccccgtgcagggggtgtgggatatgagaaacaagcagtttcacaccggaattgaaattaaagtgtgggcgatcgcttgcttcgcacctcagagacagtgtacagaagtccacttaaagagcttcaccgaacagctgagaaagatcagcagagatgccggcatgccaattcaaggacagccctgtttttgcaaatatgcccagggagctgatagtgtggaaccaatgttccggcacctgaaaaatacctatgctggacttcagctggtggtcgtgattctgccaggcaagactccagtgtacgctgaggttaagcgtgtgggcgacaccgtcctaggaatggcaactcagtgtgtgcagatgaagaacgtccaaagaaccacaccccagacactttcaaatctttgcttgaaaattaacgtcaaactgggtggagtgaacaatattttgttaccccagggaagacccccggtcttccagcagcccgtcatctttttaggggcagacgttacccatccaccagcaggggacggtaaaaagccctccatagccgccgtagtgggtagcatggatgcccacccaaaccgatactgtgcaacagtaagggttcaacagcaccgccaagaaatcattcaggatttggcagccatggtcagggaacttttaatccagttttacaaaagtactcgctttaagcctactagaatcatcttctatagggacggggtgtcagagggccagtttcaacaggtcttgcatcacgagctgttagccatacgggaggcttgtattaagctcgagaaagactatcagcccggcatcacattcatcgtggttcaaaaacggcatcacacacgactgttttgtactgataagaatgagcgggtcggcaagtctggcaacattccggcagggacaaccgtagacacaaaaatcacgcaccccaccgagttcgatttctatctgtgttcccatgcaggcatacaagggacgagcagaccgtcccactatcatgtactgtgggacgacaatagattcagctcagacgagttgcaaatcctgacctatcagctgtgtcacacatatgtgcgatgcacacgaagcgtttccatccccgccccggcctattatgcccacctggtcgcctttcgggctcggtatcatctggtggacaaggagcatgatagcgcggaaggatcccatacatccgggcagtctaatggccgcgaccaccaggccctagccaaggctgtgcaagttcaccaggatacgctccgcacaatgtacttcgcatag

SEQ ID NO: 25639 - DNA, 1926 bp, Artificial Sequence
  Description of Artificial Sequence: Synthetic coding sequence
atgctgagcggcatcgaggccgccgccggcgagtacgaggacagcgaactgcgctgcagggttgctgtggaagagctaagccccggaggccagccaaggcgacggcaggccttgcggacagccgagctgtcattgggccgcaatgaaaggagagaactgatgttgcgactgcaagcgcccgggcccgctggcagacccaggtgcttccccctcagagccgcccgattgttcactaggttcgccgaagccggacggtcaacattgaggctccccgcgcacgacacacccggcgctggcgccgtgcagctgctcctgagcgactgtccacccgatcgacttcgacggtttctccggactctccgcctgaagttggccgccgcaccggggccgggaccagcaagtgcccgcgctcaactgctcgggccccgtcctagagactttgttaccataagtccagtgcagcctgaggagcgcaggttacgggcagctacaagagtgccggacaccacactcgtaaagaggccagtggagccacaagctggggcggagcctagcaccgaagccccccgttggccgttgcccgttaagcgtctcagccttccgtcaacaaagccccagctgtcagaagaacaggccgcagtactcagggcggtcttaaagggtcagagcattttttttaccggctctgccgggactggaaaatcatacctattgaagagaattcttggctctttgcctcccacgggcaccgttgcaaccgcatctacgggagtggccgcctgccacattgggggtacgacactacacgcttttgcaggcatcggatctggacaggctccactcgcccagtgtgttgctctagctcagagacccggagtgaggcagggatggctgaactgccagcgattggtgatagacgagatatccatggtagaggccgacctattcgacaagctggaggccgtggcccgagccgttagacagcaaaacaaaccctttggaggaatccagttgatcatttgtggggatttcctgcagctccctccagtgacaaagggatcgcaaccgccacggttctgcttccagtccaaaagttggaaacgttgcgtcccagtgaccctggagcttaccaaggtgtggcgccaagcggaccaaacttttatttccttactgcaggcagtaagactaggcagatgtagcgatgaggtgaccagacagctgcaggcaaccgcctcccacaaggtgggtcgcgatgggattgtcgctactagattgtgcacgcatcaggatgatgtggctctgacgaatgagaggcgcctacaggaactgcctggcaaggtgcacagattcgaagctatggactcgaaccctgagctcgcaagcaccctcgatgctcagtgccctgtaagccagcttcttcaactcaagctcggggcacaagtgatgctagttaagaatctgtcagtctcccgcggactagtgaacggtgccagaggcgttgtggtgggcttcgaggccgaaggtagaggcctacctcaggtaaggtttctctgtggggtgacggaggtgattcacgccgaccgttggactgtacaagctactggcgggcagctgctgtcccgtcagcaactgcccctccagctggcttgggcaatgtcaattcacaagtcccagggtatgaccctcgattgtgttgagattagcttaggtagggtctttgcctctgggcaggcttatgtggccctaagtagagcccgcagcttgcaaggcctgagagtgttggactttgaccctatggctgtacgctgcgaccctagggtgcttcatttttacgccactctgcgtaggggaaggtctctgagtctcgagagtccggatgacgacgaggccgcaagcgatcaggagaatatggatcccatattgtag

SEQ ID NO: 25640 - DNA, 2124 bp, Artificial Sequence
  Description of Artificial Sequence: Synthetic coding sequence
atgctgagcggcatcgaggccgccgccggcgagtacgaggacagcgaactgcgctgtagagtggccgtggaagagctgtctcctgggggtcaaccgcgacggaggcaggctttgaggacagccgagctaagcctgggcagaaacgaaaggcgagagctcatgctgagactccaagccccaggccccgctggacgaccacgctgttttccgttacgcgccgcaaggctgttcacccgtttcgctgaggccggtaggtctactctccggttacccgctcacgatacccccggtgccggcgctgttcaactactgctgtcagactgtcctcctgacaggctccggaggtttctgaggactcttcggctgaaactggctgcagctccaggaccaggccctgcaagcgccagggcacagcttcttggaccacgacccagggattttgtgacaatctcacccgtccaacccgaggagagaaggctgcgggccgctacccgtgtacctgatactacgctcgttaaaaggccggtagaaccacaagctggtgccgagccatccaccgaggctccgaggtggcccctcccagttaaacgattgtctctgcctagcaccaagccacagctgagcgaagaacaagctgccgtcttacgggccgtgttgaagggccaatcaattttctttaccgggagcgccggcacaggcaaatcttacctcctgaaacgcatcctaggctccttgccaccaactggtaccgttgccactgccagcacaggagtcgccgcgtgtcacatcggaggcacgactctgcatgcctttgctgggattggatctgggcaggccccactggcgcagtgtgtcgcgctggcccaacggcccggcgtccgccagggatggctgaattgtcagaggctggtgatagatgaaattagcatggtggaagcggatctgtttgataaactagaggccgttgccagggccgtgcgccaacaaaacaagccattcggagggatacagcttattatttgtggcgactttctgcagctaccgcccgtgacgaaaggtagccagcctccacggttttgctttcagtctaaatcttggaaacgatgcgtcccggtgacattagagctgaccaaggtttggcggcaggccgatcagaccttcatttctttactgcaggcagtgaggctcggacggtgtagtgacgaggtgacacggcagttacaagctactgctagccacaaggtaggacgagacggcatagtcgctacccgactttgcacccaccaggacgacgtggccctgacgaacgagcgcagactgcaggaattgcccgggaaagtgcacaggttcgaagccatggactccaatccggaactggcctctacactagacgcccaatgccccgtgagccaactgctccagctcaagctgggcgcccaggtgatgctcgtgaaaaacctgagcgtgtctcggggcctcgtgaacggcgccaggggtgtggtagtcggtttcgaagctgaaggaagaggactgccacaggttcggttcttgtgcggcgtcaccgaagtgatccacgccgaccggtggaccgtgcaggcgacaggtggacaactgctctcacgtcaacagctacccctacaactcgcttgggccatgagtatacataagtcccagggcatgacccttgactgtgttgaaatttctcttggaagagttttcgcgtccggtcaggcttacgtggcacttagtagagctaggtcgttgcaggggctgagggtgctggattttgatcctatggccgtgcgttgcgaccccagggtcctgcatttctatgccaccctccgccgaggcagaagcctctccctggccgccgaagggcgaggtaatgaagataggtgttccggtagtagcatcagagccctggggggcgattggtgggggctccggctcggcgccgccagtaaacagcggaccgagctgcgatgtgttagtactgctaggccaagcttggcacaaccaagaacaaacactctccagtcgttaaccaaggaacataagcttcaaaacgtacatccttatttcaagctgctgttccagggtatcaattctgtctgggggcactag

SEQ ID NO: 25641 - DNA, 1926 bp, Artificial Sequence
  Description of Artificial Sequence: Synthetic coding sequence
atgctgagcggcatcgaggccgccgccggcgagtacgaggacagcgagctccgatgtagggtggctgtggaggagctgtcaccaggtgggcaacctcgtaggaggcaggccctgagaaccgcggaattgtctcttgggagaaatgaaaggcgcgaactgatgctaagattacaggcccccggcccagctggccggcctaggtgtttccctctgcgggcggctaggctgtttacccgttttgccgaggcaggccggtctaccctgcggttacctgcccacgacacacctggtgcaggggctgtacagctccttctgtcagattgcccaccggacaggctccgccgatttcttcgtacccttaggctcaaactagccgccgctcccgggccaggcccggcctcagctcgcgcacagctgctcgggcctagaccccgtgatttcgtgacgatctcccccgtgcagccggaggaacgaagactgcgggctgccacaagggtgcctgacaccaccctggttaagagacctgttgaaccccaggcaggcgccgagccatcaactgaggcacctcgatggcccttgcctgtcaagcgtctgtcactgccaagcactaaacctcaacttagcgaagagcaagctgctgtactgcgggccgtgttgaaggggcagagcatcttcttcactggttccgctggcacgggcaagagctacctcttaaaacgcatcctgggctcacttccccctactggcaccgtggccacggcaagcactggagtagccgcctgtcacataggcggcacgacactccatgcattcgccggtataggttctggccaggctcccctcgctcagtgtgtggcacttgcacagcgtccaggtgtaaggcagggctggctcaactgccaacgattggttatcgatgaaatctccatggtagaagcggatctgttcgataaacttgaagctgtggcccgtgccgtccgccagcaaaacaagccatttggggggatccagctgatcatttgcggcgactttcttcagttaccaccagtcacgaaagggtcccaaccacccaggttttgctttcagtctaaatcatggaagcgctgcgtgccagtcacactggagctgaccaaggtgtggcggcaggcagatcagactttcatatctttgttacaggcagttaggctggggaggtgcagcgacgaggtcaccaggcaacttcaggccactgcgagccataaggttggaagagatggtatcgtcgccacaaggctatgcacacatcaggatgatgtagcactaacaaatgaaaggagactgcaggagctgcccggaaaggtgcaccggtttgaagctatggacagcaatcctgaactagccagcaccctggatgctcagtgcccagtgagtcagctgttacagctgaaattgggtgctcaagtcatgctggttaagaatctctccgtctcacggggactggtgaacggcgctaggggcgttgtagtcgggttcgaggctgagggtagaggactgccccaggtgagattcctgtgtggggtgaccgaagtgatccacgccgataggtggaccgttcaagctacaggagggcagctgctgagcagacagcagttgccgttgcagctggcttgggccatgagcattcataagagtcagggtatgacactcgactgcgtggaaatttcactaggaagagtctttgcctccggacaagcctatgttgcactcagccgcgccaggtctttgcaagggctgcgtgtcctggactttgatcctatggcggtacggtgtgatccaagggtgttacacttctacgctactctccggagaggaagatccctttccctggaaagtcctgatgacgacgaggcagctagcgaccaggagaatatggaccctatactctag

SEQ ID NO: 25642 - DNA, 801 bp, Artificial Sequence
  Description of Artificial Sequence: Synthetic coding sequence
atgctgagcggcatcgaggccgccgccggcgagtacgaggacagcgaactgaggtgccgagtggccgtggaggagctgtcacccgggggccagcctagaaggcggcaggccctccgcaccgccgagctgtctctaggaaggaatgagcggagagagctgatgctcaggcttcaggctccaggacctgctggacgcccaagatgctttcccttgagggctgccaggctgttcacgaggttcgctgaagccggtcggagcacccttaggctgcccgcgcatgatacccctggagccggggctgttcagctgcttttgtcagactgcccgcctgataggctccggcgtttcttgaggacccttaggctgaaattggctgccgctcctggccctggccccgcttccgccagagctcagctgctcggaccccggccaagggatttcgttacaatcagtccagttcaaccggaagagagaagactgagagctgccacacgcgtgcccgatacgacactcgttaagcgccctgtggagcctcaggctggagctgagccatctactgaagcaccaaggtggccgctgcccgtgaaacgactgtccctgccaagcacaaagcctcagctctccgaagagcaggcagctgtgttgcgagccgttcttaagggccagtctatattcttcactgggagcgctggctccgggggaagagaagaggtaggcggccagtggtggggaggtatagaggagcagggtgatctgtctaattttgcacccgtgcaggagcagggcagtcacatctgctag

SEQ ID NO: 25643 - DNA, 987 bp, Artificial Sequence
  Description of Artificial Sequence: Synthetic coding sequence
atgagcatgctggccgagcggcggcggaagcagaagtgggccgtggacccgcagaatacagcctggtcaaacgacgactcaaaatttggacaacggatgcttgagaagatgggctggagtaagggcaagggactcggggctcaggaacagggagcaaccgatcatataaaagtccaagtgaaaaataatcacttaggcctaggagccactatcaacaatgaagacaactggatcgctcaccaggacgatttcaatcaactgctagcagaactgaatacatgtcacggccaagagacaaccgactcctctgataagaaggagaaaaagagtttttccctggaagagaaaagtaagatctcgaagaatagagtccactatatgaaattcacgaaaggaaaggatctcagtagccggtctaaaactgatcttgattgcatcttcggcaagcgacagagcaagaagactcccgagggcgacgccagtccaagtacccctgaggagaatgagactacaacaacaagtgcctttacaatccaggaatactttgcaaagaggatggccgccttgaaaaataagccacaagttccagtgcctggcagcgacatttcagagactcaggttgagaggaaaaggggaaaaaagcggaacaaggaagctacggggaaagatgttgagtcctaccttcaacccaaggcgaagagacacactgaagggaaacccgaacgagctgaagcccaggaaagggtcgccaagaaaaaaagcgctcccgctgaagagcagctccggggcccttgctgggatcaaagctcaaaagcctcagcgcaagatgctggcgaccacgtacaaccaccagaaggaagagattttactctcaaacctaaaaaacgcaggggaaagaagaagctccagaaacctgtcgagatcgcagaagacgccactctggaggaaaccctcgttaaaaagaaaaaaaaaaaggacagcaagtag

SEQ ID NO: 25644 - DNA, 519 bp, Artificial Sequence
  Description of Artificial Sequence: Synthetic coding sequence
atgctggccgagcggcggcggaagcagaagtgggccgtggacccccagaacactgcttggtccaacgacgacagtaagtttggccagagaatgctagaaaagatgggatggagcaaagggaagggcctgggcgctcaggaacagggagctaccgatcacatcaaggtacaagttaaaaataaccacttaggcctgggggctaccattaacaacgaggataattggattgcccaccaagatgacttcaatcagctccttgccgagctgaacacgtgtcatggccaggagacaacagactcctctgataaaaaggagaagaagagtttctccctagaagagaaaagcaagatatccaagaatcgcgttcattacatgaagttcacaaagggcaggtgtcagtcattgcatagccgcggcgaaaggaaccacgacaaccaaagacttcaccatcccggagtcttatgtcaggcagatggcagcacagaggagcaggcgccggggagttcaagtcgcgtttag

SEQ ID NO: 25645 - DNA, 525 bp, Artificial Sequence
  Description of Artificial Sequence: Synthetic coding sequence
atgagcatgctggccgagcggcggcggaagcagaagtgggccgtggaccctcaaaacactgcgtggtcgaatgatgactctaaattcggtcaaaggatgcttgaaaaaatgggctggtccaaaggaaaggggcttggcgcgcaggaacaaggcgctaccgaccatattaaggtccaggttaagaacaaccaccttggactgggtgccactatcaataatgaagacaattggattgcgcaccaggatgattttaaccagctgctggcggaactgaacacttgtcacgggcaagaaactactgatagtagcgataaaaaggaaaagaaatcctttagcctggaagagaagtctaagattagcaagaaccgggtgcactatatgaaattcacaaagggtagatgccagagtctccactcccgcggggagcggaatcacgataatcaacggctgcaccatcccggggtgttgtgtcaggcagatggcagcaccgaggagcaagctcctggttcctctagtagggtgtag

SEQ ID NO: 25646 - DNA, 972 bp, Artificial Sequence
  Description of Artificial Sequence: Synthetic coding sequence
atgcccgtgcacagccggggcgacaagaaggagaccaaccaccacgacgagatggaagtggattacgctgaaaatgaagggagctctagtgaggacgaggacacagagtctagctcagtttccgaggacggggactcaagtgaaatggatgatgaagattgcgagaggagaagaatggagtgtctcgacgagatgtccaatctggaaaagcaattcacagatcttaaagatcagttgtacaaagaaaggcttagtcaggtggatgcaaagcttcaagaggtcattgccgggaaagcccctgagtatttagaacccctggccaccctccaggagaatatgcagatacgcaccaaggtggctgggatctatcgggaactctgccttgagtcagtgaagaacaaatacgaatgcgaaatccaggcctcgcgccagcactgcgagagcgagaagttattgttatatgacaccgtgcagtcagaactggaggagaagattagacggttagaggaggatcgccatagcattgatatcacatctgagctgtggaatgatgaattgcagagcaggaaaaaacgtaaagatccgtttagtcccgataaaaagaaaccagtagtcgtttcgggaccctacatcgtttatatgctgcaggaccttgacatactggaggactggacaaccattaggaaagccatggccacgctggggccccatcgggtcaaaaccgagccgccagtgaagctggaaaaacatctccattcagcacggtccgaagaggggcgactttactatgacggagaatggtacatcagaggacagacaatctgcatcgacaagaaagacgagtgtccaaccagtgccgtgattactacaattaaccacgatgaagtttggtttaaaagacctgatggcagcaaaagcaagctctacatctcccagctgcagaaagggaagtattcaataaaacactcttag

SEQ ID NO: 25647 - DNA, 666 bp, Artificial Sequence
  Description of Artificial Sequence: Synthetic coding sequence
atgcccgtgatgcggctgttcccctgcttcctgcagctgctggccggactggctttaccggccgtccccccccagcagtgggctctcagcgcaggaaacggcagctccgaagtggaagtagttccttttcaggaggtgtggggcaggtcttactgtcgagccctggaaagactcgtggatgttgtgtctgagtacccgtcagaggtggagcacatgttttcccctagttgcgtatccctgcttcgatgcacaggctgctgtggcgatgagaatctgcactgtgtgcccgtggagactgctaacgtgacaatgcaactattgaaaatacgaagcggtgatagaccaagctatgtcgagcttactttctcccagcacgtccggtgcgagtgcaggcattctcctggccggcagagtccagatatgcccggggacttcagagctgatgctccctcgttcctaccgccccgtcgatctctgcccatgctttttagaatggagtgggggtgtgctctgaccggcagccaaagtgcagtgtggccgtcctcccctgtcccagaggagattccccggatgcaccccgggagaaacggaaagaagcagcagagaaaaccattacgggagaagatgaaacctgaacggtgcggagatgccgtccctagacgatag

SEQ ID NO: 25648 - DNA, 450 bp, Artificial Sequence
  Description of Artificial Sequence: Synthetic coding sequence
atgcccgtgatgcggctgttcccctgcttcctgcagctgctggccgggctggctctacctgccgtgccgccccagcaatgggcgctctccgccgggaacggttcttccgaagtggaggtggtgcccttccaggaggtttggggtcgcagttactgtcgggcactcgagcgacttgtggatgttgtatccgaatacccctccgaggtcgaacacatgttctccccgtcatgtgtttctctgctgcggtgtacggggtgctgtggagacgaaaatctccattgtgtgccggttgaaaccgccaatgtaaccatgcagctgctaaaaataagaagcggggacaggccctcatatgtcgagcttacttttagccagcatgtgaggtgtgagtgcagacccttacgggagaaaatgaagccagagaggtgcggggacgcagttcctagaagatag

SEQ ID NO: 25649 - DNA, 513 bp, Artificial Sequence
  Description of Artificial Sequence: Synthetic coding sequence
atgcccgtgatgcggctgttcccctgcttcctgcagctgctggccgggctggccctgccggccgtccctcctcagcagtgggccttaagcgcgggaaatggctccagcgaggtcgaggttgtcccatttcaggaggtatggggcaggtcctattgcagagctttggagcggttggtagatgtggtttcggaatacccatccgaagttgaacacatgtttagtccgtcctgtgtatcgctgctgcgatgcactggatgctgcggagatgagaacttgcactgtgtccccgtcgaaacggcaaacgtgaccatgcagctccttaagatccgcagtggtgatagacccagttatgtcgaacttactttcagccagcacgtgaggtgtgaatgtaggcccctcagagagaagatgaaacccgagcgcaggcggccaaagggccggggcaaaagacggagagaaaagcaaagaccaaccgattgccatctgtgcggtgacgcagtcccacggaggtag

SEQ ID NO: 25650 - DNA, 477 bp, Artificial Sequence
  Description of Artificial Sequence: Synthetic coding sequence
atggccctggaggtgctgatgctgctggccgtgctgatctggaccggggcggaaaaccttcatgtgaaaattagctgctccctggattggctaatggtctctgttatcccagttgccgagtctagaaatctgtatatctttgccgacgaactgcacctggggatggggtgtcccgcaaaccgaattcacacctatgtatacgagtttatttaccttgtcagagattgtgggattcggactagggtagtctctgaggaaaccttgctcttccagacagagctgtacttcacaccccgcaatatcgaccacgacccccaggagatacatctggaatgttccacttcacgcaagtccgtgtggcttacacctgtgagcacggagaatgagattaagctcgacccgagcccctttatcgcggattttcagacaacagcagaagagctcggcttgctcagcagctcccccaaccttctatag

SEQ ID NO: 25651 - DNA, 1188 bp, Artificial Sequence
  Description of Artificial Sequence: Synthetic coding sequence
atgcgggccctgctggcccggctgctgctgtgcgtgctggtggtgtcggactccaagggcagcaacgagctacaccaagtaccgtataagtccaaaacctgctacgaaggcaatggacacttttaccgtggcaaagcttcgactgacaccatgggcagaccatgtctcccatggaacagcgcaaccgtgcttcagcagacttatcatgcccataggagtgacgcactccagctgggactggggaagcataattattgcaggaaccccgataatcggcgtcgaccttggtgttacgttcaagttggactgaagctgttagtccaagagtgcatggtacacgactgcgctgacggcaagaaacccagtagtccaccggaggagttgaagttccaatgcggacagaagaccctcaggccccgattcaagataataggcggcgaatttacaacaatcgaaaatcagccctggttcgctgccatctatcggcgccacagaggaggctccgttacttatgtatgcggggggtcactgatctcaccttgttgggttatctcagccacacattgcttcatcgactatcctaagaaggaggactacattgtctacctgggtcgttctcgcctgaacagcaacacccagggggagatgaagttcgaggtggagaacctgatcctgcataaggactactctgctgatacattggcccaccataacgatattgccctcctcaaaattaggtctaaagagggaaggtgtgcccaaccaagtcgaaccatccagacaatctgtttaccatcaatgtataatgatcctcaattcggcacttcctgcgaaatcactggctttggaaaagagaactcgaccgactatctctatccagagcagttgaagatgactgtggtgaaacttatatcccaccgggaatgccagcagccacactattacggatctgaggtgactacaaaaatgctgtgtgctgctgacccgcagtggaaaacagattcatgccagggggactctggtggaccactcgtgtgcagcttgcaggggagaatgaccctgaccggcattgtgagttggggccgcggatgtgcccttaaagacaaaccgggagtttatactagggtgagtcatttccttccctggattagatcccataccaaagaggagaatggcctcgccctctag

SEQ ID NO: 25652 - DNA, 1188 bp, Artificial Sequence
  Description of Artificial Sequence: Synthetic coding sequence
atgcgggccctgctggcccggctgctgctgtgcgtgctggtggtgtcagacagcaagggatctaatgagcttcatcaggtcccctataagagcaagacctgttatgaaggtaatggccatttctatcgcgggaaggcctctactgataccatgggacgcccctgcctgccgtggaactcggccactgtgctacagcagacataccatgcacaccggagtgatgcgctgcagctggggttaggtaaacataactactgtaggaatccagataacaggagaaggccatggtgttatgtgcaagtggggctgaagctcctggtccaggagtgcatggtgcacgattgcgccgatggaaagaagccttcttctcctcctgaggagcttaagtttcagtgtgggcaaaaaacactgcggcctcgttttaagatcattggtggggagtttacaaccatcgaaaaccaaccctggtttgcggccatttataggcgtcaccgggggggatcagtgacatatgtctgcggtggctctctcatcagcccatgctgggtaatctctgctacacattgtttcattgactacccaaaaaaggaagattacattgtataccttggtcgcagtagactgaattcaaacactcaaggagagatgaagttcgaggtggagaatctgatactacacaaagactacagtgccgacaccctggctcaccataacgacatcgcactcctgaaaattagaagtaaagagggacggtgtgcacagcctagcagaacgatccagacgatctgtctgccttccatgtataacgacccacagttcggcactagttgtgaaatcacagggttcggaaaagagaactcaacggactacctttatcctgagcagctcaaaatgacagtcgtgaagctaatttcgcaccgtgagtgtcagcagccccactattatggttccgaagtgaccacgaaaatgctctgtgcggccgatccacagtggaaaacagactcctgtcagggcgacagcggagggcctttggtgtgtagtctgcagggccgaatgactctgacaggcatcgttagctggggcaggggctgcgcgctgaaagataagccaggcgtgtacactcgcgtttcccatttcctgccatggataaggagtcacacaaaggaggagaatggactggcactgtag

SEQ ID NO: 25653 - DNA, 1296 bp, Artificial Sequence
  Description of Artificial Sequence: Synthetic coding sequence
atgcgggccctgctggcccggctgctgctgtgcgtgctggtggtgagcgactctaagggttccaatgagctgcaccaggtgcctagcaattgtgactgtctcaatggcgggacatgtgtaagtaacaagtatttctccaatatccattggtgcaattgcccgaaaaagttcgggggccaacactgtgaaatcgataaatccaagacgtgttacgagggcaacggacacttttataggggcaaggccagtacagataccatggggagaccttgcctgccatggaatagtgcaaccgtcttacagcagacataccatgcccaccgatctgacgcgcttcagctaggactcggaaagcataattactgccgcaatcccgataaccggagacgaccatggtgctacgtacaggtaggactaaaactcctcgtacaggagtgtatggtgcatgattgcgccgacggtaagaagcctagcagtcctccagaagaactcaagtttcagtgcggccagaagaccctgcggccgcggtttaagatcatcgggggagagttcactaccatcgaaaatcagccctggtttgccgccatctatcgacgccatagagggggctctgttacctacgtctgcggcgggtccctgatctccccctgctgggtgatcagcgccactcactgtttcattgactatccaaagaaggaggattacattgtctaccttggaagatccagactgaactccaatactcaaggtgagatgaagttcgaggtggaaaacctcatcctgcataaagattacagcgcggacacactggcacatcacaacgacatagcactcctgaagattcggtccaaggaaggccgctgcgcccagccaagcagaacaattcaaacgatttgcctgccgtccatgtacaatgacccacagttcgggacctcttgtgagattaccggatttgggaaagagaactcaaccgattacctttaccccgagcagcttaaaatgaccgtggttaaattaattagtcaccgtgagtgccaacagccacactattacggcagcgaagtgacaaccaagatgttgtgtgccgcagatcctcaatggaagactgacagctgtcagggcgatagcggaggccccttggtctgctctcttcagggcaggatgacactgactggcatagtgagctgggggcgaggatgcgctttgaaggacaagcccggggtttacacccgagtgtctcactttctcccttggattcgaagtcacactaaggaggagaatgggctggctctgtag

SEQ ID NO: 25654 - DNA, 1245 bp, Artificial Sequence
  Description of Artificial Sequence: Synthetic coding sequence
atggtgttccacctgcggacccggtacgagcaggccaactgcgactgtctgaatggagggacatgcgtgtctaacaagtatttttcaaacatccactggtgcaattgccccaagaaatttgggggccagcactgtgagattgataagtctaaaacctgttatgaaggaaatgggcacttctatcgaggcaaggcctcgaccgatactatggggcggccgtgcttgccctggaacagcgccacggttctgcagcagacctatcacgcccaccgaagtgacgctctccagttgggactggggaaacacaattattgccggaatcctgataaccgaagaagaccttggtgctatgtgcaggttggacttaaactcctggtccaggagtgcatggtacacgactgcgctgatggaaagaaaccgagctccccgcctgaggaactgaaatttcagtgtggacaaaaaaccctgaggccacgctttaaaattatcgggggtgagttcacgaccattgagaaccagccgtggtttgccgctatttaccgccggcatagaggagggtccgtgacctatgtttgtgggggtagtctgatttccccgtgttgggttattagtgccactcactgcttcattgattaccccaagaaagaggattatatcgtgtacctgggccgatcccgccttaactccaacacacaaggggaaatgaagttcgaggtcgaaaacttgatcctacacaaagactactctgccgataccttagctcaccacaacgatattgcgcttcttaaaatccggtccaaagaaggtcggtgtgcccagccttctcgcactatccaaactatttgcctccccagtatgtacaacgatccccagttcgggacgagctgcgagattacgggtttcggaaaagaaaatagcaccgattatctgtacccagaacagttaaaaatgaccgtggttaagctcatttcgcacagagagtgtcagcagccccactattatgggagcgaggtcactactaagatgctgtgtgcagccgatccacagtggaaaacagattcatgccagggcgattccggaggaccacttgtctgtagcttgcaaggtcgaatgactctcacaggtatcgtcagttggggccggggttgcgcccttaaagataaacccggggtatacacccgtgtgtcacacttcctgccttggatccgctctcatacaaaagaagagaacgggctggctttatag

SEQ ID NO: 25655 - DNA, 3984 bp, Artificial Sequence
  Description of Artificial Sequence: Synthetic coding sequence
atggaggcccccctgcagaccggcatggtgctgggcgtgatgatcggcgctggagtggctgtcgtagtgacggcagtcctgatattactggtagtgaggaggctgcgcgtacctaagactccggctccagacgggcctcgctatcggtttaggaagagagataaggtgttattttatggccgtaaaattatgagaaaagttagccagagtacaagctcactcgttgacactagtgttagcgccacgtccagacctcggatgcgaaagaagttgaaaatgttgaatatcgctaaaaaaatcctgaggattcagaaagaaacgcctaccttacagagaaaggagcccccccccgctgtcctcgaagcggacctgactgagggtgacctggctaacagtcatttgccatctgaagtcctgtacatgctcaagaacgtcagagtcctgggccactttgaaaaacctctttttcttgagctgtgtaggcacatggtgtttcaaagactcggtcagggcgattacgtttttcgtcctgggcagcccgacgcctctatatatgtggtgcaggacggattgctagagttgtgcctgccaggacccgacggtaaggaatgtgttgtaaaggaagtggttcccggtgattcggtcaattcattactatcaatcctcgacgtgatcacaggacaccagcatccccagcgaaccgtgagtgccagggcagcccgtgactccactgttctgcgtctgcctgttgaagcattcagcgccgtgttcacaaaatatcccgagtctcttgtcagggtcgtgcagatcataatggtgagactccagcgagtcaccttcctcgctcttcataactatctcggactcacaaacgagctgttctcgcacgagattcagcctctcaggctatttccgagccccggattgcctacccgaacctcaccagtgcggggcagcaagaggatggtctctacatccgctactgacgagccacgcgagaccccagggaggccgcccgacccgacaggagccccactacctgggccaactggggatccagtaaaacccacaagtctcgagaccccgtccgccccgttgctttcacggtgtgtgtctatgcctggcgacatttcaggactgcagggtggcccgcgtagtgatttcgatatggcgtacgagaggggccgaatcagcgtgagtctccaggaagaagctagcggtggctccctggctgcacccgcccggaccccgacacaggagccgcgggagcagcccgcgggggcatgtgaatactcatattgcgaagatgaatcggccactggtgggtgtccgtttggtccttatcaaggaaggcagacctctagcatctttgaggcagcgaaacaggaactcgcgaagttgatgcgcatagaggacccaagcctgttgaacagccgggttctcctgcatcatgcaaaagccggcacaatcattgcccggcagggtgaccaggacgtatcattacattttgtattgtggggctgtttacacgtctaccaacgcatgatagataaagcagaggatgtgtgtcttttcgtagcccagcctggcgagctggtgggacagttagctgtgctgaccggggagcctctgatctttactctcagagcccagcgcgactgcacatttctcagaatttccaagtctgacttttatgaaatcatgcgagctcagccgtcggtcgttctttctgctgcccacactgtagccgctagaatgagtccttttgtgaggcagatggactttgccatcgactggacagctgtcgaggcaggtagagccctgtacagacagggggacaggagcgactgtacttacattgttctcaacggcaggctcagatccgtaattcagagagggtccggcaaaaaagagttagtcggggagtacggtcgaggcgatttgatcggagtggtggaggctttgaccaggcagcctagagccaccactgtgcatgctgtgcgtgacacggaactggcaaaactacccgaaggtacactcggtcacattaagagaagataccctcaggtcgtaacacgactgatccatctcctcagccagaagatcctgggaaacctccaacagctccagggccccttccctgctggtagcgggctgggcgttcccccccactctgagttgacaaatccagcttccaatctggccaccgtcgccatacttcccgtgtgcgcagaggtgccaatggttgcattcactctggagttgcagcatgccctgcaggcgattggccccaccctcctgctcaacagcgacattattagggcccggctcggagcatccgcacttgacagcattcaggagttccggttgagtggctggcttgcccagcaagaagatgcccaccgcatcgtcctctaccagacagacgcctcattaacaccctggaccgtcaggtgcttacggcaagccgactgcatcctcatagtgggacttggcgaccaagaacccacactgggtcagctggagcagatgctcgagaacaccgcagtgcgcgcactaaagcagctggtgctgcttcaccgggaggaaggggcaggcccgacgcggaccgtggaatggcttaatatgcgttcatggtgcagcgggcatctgcacctgcgatgtccccggcgcctatttagtagacgatcacccgccaagctccatgagttatacgagaaagtcttttcgaggcgcgcagaccgccactcggacttctccaggcttgcgcgtgtccttactggaaacacaatcgcactcgtacttggcgggggaggggctcgaggttgttctcacattggcgtcctgaaagcgttggaggaagccggggtacctgtggacttggttggcggtactagtattggaagtttcattggggccttatacgccgaggaacgttcggcctcacgcacaaagcagagggccagagaatgggcgaaatcgatgacatccgttcttgagcccgtgctggatctgacctaccctgtcacgagcatgttcacaggatcagctttcaacagatccattcaccgggtgttccaagacaaacaaatcgaagatctatggctcccatacttcaatgtgactaccgacattacggcttcggctatgcgcgtccataaggatgggagcttatggaggtacgtccgggcaagcatgactctctccggctacctacccccgttgtgcgaccccaaagatggccatctgcttatggacgggggatatatcaacaatcttcccgcagatattgcgcggtctatgggggcaaagaccgtgatcgcgatagatgtgggatctcaagacgaaactgatctctccacctacggcgatagcctatcgggctggtggctgctttggaagcggctaaacccctgggccgataaggtcaaggtgcccgacatggcagagatccagtctcgactcgcctatgtctcatgtgtgcggcagcttgaggtggtgaagtcgagcagctactgtgaatacctcaggcctccgattgattgtttcaagaccatggatttcggtaaatttgaccagatctatgacgtggggtatcaatatggaaaggccgtgttcgggggttggagtcgtggaaacgtgattgagaagatgctgaccgataggcgcagcaccgatctcaatgaatcaagaagggcagatgtgcttgcttttccctcctctggttttaccgacctggctgagattgtctctcgcattgagcctcccacttcatacgtttctgatggatgtgcagatggcgaggaaagcgactgtctgacagagtatgaagaggatgctggcccggattgtagcagggacgagggaggcagtcctgaaggagcatccccctccacagcaagcgagatggaggaagagaagagcatcctgaggcagagacgatgtttaccccaggagcccccgggcagcgccactgacgcgtag

SEQ ID NO: 25656 - DNA, 846 bp, Artificial Sequence
  Description of Artificial Sequence: Synthetic coding sequence
atgggccacccccccctgctgcccctgctgctgctgctgcacacctgcgtaccggcaagttggggtttgcgctgtatgcagtgtaaaactaatggagactgtagagtcgaagagtgcgcacttgggcaagacctgtgtaggactactattgtgcggctgtgggaggagggggaagaacttgaactggtcgaaaagtcatgcacacattcggagaagactaataggacactgagctaccgaaccgggctgaaaatcacttcactgacagaagtggtgtgcggccttgatttgtgcaatcagggtaattcaggtcgggccgttacatacagcagatcaaggtacctcgagtgtatctcttgtggtagcagtgatatgagctgtgaacgtggcagacatcagagcctgcaatgtcggagccccgaggagcagtgcctcgatgtggtgacccactggattcaggagggcgaggaaggccggcccaaagacgaccgacacttgcgagggtgcggctatttacctgggtgtccaggatcaaatggatttcacaacaacgacacctttcattttctgaagtgctgtaacacgaccaaatgtaatgagggtccgatccttgagctggaaaacctgccccagaacggcaggcagtgttacagctgtaagggtaactcgacccacggctgttcctctgaggagactttcctgattgattgccggggccccatgaatcagtgcttagtggccaccgggacccacgagcgctcactttggggttcctggctcccctgcaagagtaccacagctctgcgccccccctgttgtgaggaggcacaggccacacacgtctag

SEQ ID NO: 25657 - DNA, 1008 bp, Artificial Sequence
  Description of Artificial Sequence: Synthetic coding sequence
atgggccacccccccctgctgcccctgctgctgctgctgcacacctgtgtgccagcatcatggggcttacgatgcatgcagtgtaagacaaacggcgactgccgcgtcgaagaatgcgccctgggtcaggacctctgtcggacgaccatcgtacggttgtgggaagagggggaagagttagaacttgtcgagaagtcatgtacacacagcgagaaaaccaaccggaccctgagctaccgcaccgggcttaagatcacgtctttaacagaagtcgtctgcggactcgatctgtgtaaccaaggaaactctggacgcgctgtgacttactccaggagtaggtacctcgagtgtatttcatgcgggtcttcagatatgagttgcgaacgcggccgtcaccagagcctgcagtgtcgctcacccgaggagcaatgccttgatgttgttacccattggatacaagagggtgaagagggaaggccgaaggacgaccgacacttgagaggctgcggctatttgcccggatgtcctggctccaacggcttccacaataatgacactttccatttcttgaagtgctgcaacaccaccaagtgtaatgaagggccgattctggagctggagaatctccctcaaaatggccgccagtgttatagctgcaagggcaatagcactcatggctgctcgtcagaagagacttttctcattgactgccgggggccgatgaaccaatgtctggtcgctaccggtacccacgagcctaagaaccagagctacatggtgcgggggtgcgcgacagccagcatgtgccaacatgcacacctgggagacgctttctcaatgaatcatattgacgtttcctgctgtaccaagagcggatgcaatcaccctgacctcgacgtgcagtatcgcagcggcgccgcaccccagcctgggcctgcccacctttcacttacaataaccctgctgatgacagctcgactctggggcgggaccctgctgtggacctag

SEQ ID NO: 25658 - DNA, 1038 bp, Artificial Sequence
  Description of Artificial Sequence: Synthetic coding sequence
atgagcctgttcggcctgctgctgctgaccagcgccctggccggccagagacagggcacccaggccgaaagtaatttatccagtaaattccagttctccagtaacaaagagcagaatggcgtccaagacccgcaacacgaacggatcatcacagtcagtaccaacggaagtattcacagtccgcgatttccgcatacctacccacgcaataccgtgctggtgtggagactggtggccgtagaggagaacgtgtggatccagctgacattcgatgagcggtttgggttggaggatccagaagacgatatttgtaaatatgattttgtggaggtggaagagcccagcgacgggactattctcggccggtggtgcggatctggcaccgtcccaggaaagcagatcagtaagggaaaccaaatcagaataagatttgttagtgacgagtattttcctagtgagccaggattttgtattcactataatatcgttatgccccagtttaccgaggctgtctcccctagtgtcctacccccctctgcattgcctctcgacttgcttaataatgcaataacagctttttccaccctcgaggatctgatcaggtacttggaacctgaacggtggcagctggatctcgaggatctctacaggcctacctggcagctgttagggaaggctttcgtgtttggacggaaatcaagggtggtcgatcttaacctgcttactgaggaggtccgcctttactcctgtacacccagaaatttttccgtgagtatccgtgaggaattaaagaggaccgatacaatcttctggcccggatgcctcctggttaagagatgcggcggcaactgtgcctgctgtttacacaattgtaacgagtgccaatgcgttccatctaaggtgacgaaaaagtaccacgaggtgctgcagctgcgacctaagaccggtgtgcggggacttcacaagtctttgacggacgtcgccctagaacatcacgaagaatgcgattgcgtgtgccgcggaagcaccggtggatag

SEQ ID NO: 25659 - DNA, 549 bp, Artificial Sequence
  Description of Artificial Sequence: Synthetic coding sequence
atgccccagttcaccgaggccgtgagccccagcgtgctgcccccctctgccctgccgctggaccttcttaataatgccataaccgcatttagcacgcttgaggacctgatccgatatctggaacccgagcgctggcagctcgacctggaagacttatatcgccccacctggcagctcttgggaaaagccttcgtgtttgggaggaaatcccgggtggtagatcttaaccttctgaccgaggaggtccggctgtacagctgtactcccagaaacttctccgtatcaattagagaggaactaaagaggactgacacaatattttggccgggatgcctgttggtgaagcgttgtggagggaactgcgcctgctgcctgcacaattgcaatgagtgtcagtgcgtgccctctaaggtgactaaaaagtatcatgaggtcctacagctgaggccgaaaaccggggttagaggccttcacaagtccctgaccgacgtggctctggagcaccacgaggaatgtgattgtgtttgtagaggttctaccggcgggtag

SEQ ID NO: 25660 - DNA, 573 bp, Artificial Sequence
  Description of Artificial Sequence: Synthetic coding sequence
atgatgcagtacacctggctgctgaccaagcagttcaccgaggccgtgagtccaagcgtcctccctcccagcgcacttcccctggatctgctgaacaacgctattacagctttctccacactggaggacctgattagatacttagagcccgaaagatggcagctggacctcgaggatttatatcgcccgacgtggcaactgctgggcaaggcatttgtctttggccggaagtcacgcgtggtggacttaaatctgttgaccgaggaggtgaggctttacagttgcactccccgcaatttttcagtgtctatccgggaggagctgaaacgcacagacactattttttggccaggctgtctcctggtcaaacgttgtgggggcaattgcgcgtgttgcttacacaactgtaatgaatgtcagtgcgttccatccaaagtcaccaaaaagtatcatgaggtcctccagctccgacctaaaaccggagtgcgcgggttacacaagagcctgacagacgtggccctcgaacaccacgaagagtgtgattgtgtctgccgcggcagcaccggaggttag

SEQ ID NO: 25661 - DNA, 504 bp, Artificial Sequence
  Description of Artificial Sequence: Synthetic coding sequence
atgagcctgttcggcctgctgctgctgaccagcgccctggccggccagcgtcagggcactcaagccgagtccaatctttctagtaaatttcaattcagctcaaacaaggagcagaacggagtgcaagatccccagcacgagcgaattattactgtgtccaccaacgggtccattcattctccgagattcccccacacatatcctcggaacactgtgctggtttggcggctcgtggcagtggaagaaaatgtgtggatccagttgaccttcgatgaacgctttggcctcgaggacccggaagatgacatatgcaagtacgatttcgttgaggtagaggagccatctgatggaacaattctcggacgatggtgtgggagtggcacggtcccagggaaacagatttccaagggaaaccagattagaattaggttcgtgtcggacgaatattttcctagtgagccttctaatcggggagggaagataattcagcttcacaccagttag

SEQ ID NO: 25662 - DNA, 2217 bp, Artificial Sequence
  Description of Artificial Sequence: Synthetic coding sequence
atgcagccccggtgggcccagggcgccaccatgtggctgggcgtgctgctaaccttgctcctgtgctcaagtctggaagggcaggagaattcgttcactattaacagcgtggatatgaagagcctccctgactggacggtccaaaacggcaagaacctgactctccagtgcttcgctgacgtgtcaacgaccagccacgtcaaaccccagcatcagatgctattttataaggatgacgtactgttttacaatatctctagcatgaagtcaaccgagtcatacttcatccctgaggtccgcatttacgattcagggacatacaagtgcacagttatcgtgaataacaaagagaagaccacagcagaatatcaggtcctggtggagggtgtgccttctcctcgggttacgctggacaaaaaggaggctattcaaggaggaatcgtgcgagtcaattgtagtgtcccagaggaaaaggctccaattcattttactattgaaaaactggagttaaatgaaaaaatggttaagcttaaacgggaaaaaaacagccgagaccaaaactttgtgatcctggaattcccagtggaggagcaggaccgcgtgctctcatttcgatgccaagccagaatcatatctggcattcacatgcagacaagcgaaagtaccaagtcagagttggtcactgtgaccgaatctttctccacccccaaattccatatctcccctaccggaatgatcatggaaggggctcagttacatatcaagtgtacaatccaggtcacccacctggcccaagagttcccagaaattataatccaaaaagataaagctattgtcgctcacaaccgtcacggtaacaaagcagtctacagtgtgatggccatggtcgaacattcggggaattacacttgcaaggtggaatcgagcaggataagcaaggtatcttcaatcgtggtgaatattacagaacttttctctaaaccagaactcgaatcgagttttacgcacctagatcaaggcgagcgcttaaatctgtcttgtagtatacctggcgccccccccgctaacttcactatccagaaggaggatacaatcgtttcccagacacaggactttaccaaaatagccagtaaatctgactccggtacgtacatttgtacggcaggtatcgataaagtcgtaaaaaagtcaaacaccgtacagatagtggtgtgcgagatgttatcacagcccagaatatcctatgatgctcaattcgaagtgatcaagggacagacaatcgaagtgagatgcgagagcatttctggaacactgcctataagctaccagctcctgaagacatctaaggtgctggaaaacagcaccaaaaattccaatgacccagccgttttcaaagataacccgactgaagatgtcgaataccagtgcgtcgcggacaattgtcactcgcacgcaaagatgttgtctgaggtcctgcgcgtaaaagtaattgctcctgtggatgaagtccagatttctatcctttccagcaaagttgttgagagcggggaggacattgtgctccaatgcgcagtgaatgaagggagtggccctataacatacaagttctacagggagaaggaggggaagccattttaccaaatgacttccaacgcaacccaggcattctggactaaacagaaggccagcaaagaacaggagggggagtattattgtaccgctttcaatagagcaaaccacgcaagcagcgtgccgcgatctaaaattctgactgtgcgcgtaattctcgctccatggaagaaaggcctgattgctgtcgtgatcataggagtcataattgcactgctgatcatcgccgctaagtgttactttctgcgcaaagcgaaggctaaacagatgccagtggagatgtccagacctgccgttccattgctgaactcaaacaatgaaaaaatgagcgatcccaacatggaggccaattctcattatggccacaatgacgacgttagaaaccatgctatgaaacctattaatgataataaagagccactcaattccgacgtccagtacactgaggtgcaggtgtcatccgctgagtcccataaagatcttggtaagaaggacacagaaacagtgtactctgaggtccgaaaggccgtcccggatgctgtggaatctcgctattcccgtacagagggatccctagatggcacctag

SEQ ID NO: 25663 - DNA, 636 bp, Artificial Sequence
  Description of Artificial Sequence: Synthetic coding sequence
atgcggaccctggcctgcctgctgctgctgggctgcggctacctggcacatgtcttggccgaggaggccgaaattcctcgcgaggtaatcgagcggttagctagaagccagatccactcgatccgtgacctccagagactgctcgaaatcgactccgtgggttctgaagactcactcgatactagccttcgggcccacggtgttcacgcaacaaagcatgtccctgaaaaaagacccctacccatccgcagaaagcggtccatagaggaggctgtaccagccgtgtgcaagaccagaaccgtgatatacgagatccccagatcccaggtggaccccacttccgcgaatttcctcatttggccaccttgcgtcgaagttaagaggtgcactggttgttgcaatacgagttctgtgaaatgccaacccagtagagttcatcatcggagtgtcaaggttgccaaagtcgagtatgtgagaaaaaaacctaagctcaaagaagtacaggtacggcttgaagagcaccttgaatgtgcctgtgctactacttcactcaaccccgattaccgagaagaagacaccggcaggcctcgagaatcaggaaaaaaaaggaaaaggaagcgactgaagccaacatag

SEQ ID NO: 25664 - DNA, 591 bp, Artificial Sequence
  Description of Artificial Sequence: Synthetic coding sequence
atgcggaccctggcctgcctgctgctgctgggctgcggctacctggcccatgtgctggcagaagaggccgaaattccgcgtgaagtcatagaacggctggcgcggtcccaaattcattccatccgggaccttcagcgactgcttgaaattgattccgtgggcagtgaggactcccttgacacttctttgcgcgcgcacggggtgcacgctaccaagcacgtaccagagaaacggcccctccctattcggcggaaacgcagcatcgaagaggcagtgcccgccgtgtgcaagaccaggacagttatctacgaaataccccgaagccaggtggacccaacatcagcaaacttcctgatctggccaccatgtgttgaggtcaaacgttgcacgggctgttgcaacacgtcctccgtaaaatgtcagccctctcgtgtgcaccatagaagcgtgaaggtcgccaaagttgaatacgtgcgaaaaaaaccgaagctgaaagaagtccaggtcaggctcgaagaacacctggaatgcgcttgcgccactacgtcacttaatcctgattacagagaggaggataccgatgttcggtag

SEQ ID NO: 25665 - DNA, 162 bp, Artificial Sequence
  Description of Artificial Sequence: Synthetic coding sequence
atgcggaccctggcctgcctgctgctgctgggctgcggctacctggcacacgtgttagctgaagaagcagagatccctcgtgaggttatcgagcgcctagccagaagtcagatacattcgatcagggacctgcaacgcctgctcgagatcgattcagtttag

SEQ ID NO: 25666 - DNA, 3270 bp, Artificial Sequence
  Description of Artificial Sequence: Synthetic coding sequence
atgggcaccagccaccccgccttcctggtgctgggctgcctgctgaccggtctgtccctcatcttatgccagctgtctttacccagcattctgcctaacgagaacgaaaaggtggtacaattgaactcgtctttctcattacgatgtttcggggagtcagaagtgtcgtggcagtaccccatgtccgaggaggagtcatcagacgttgagatcagaaacgaggaaaacaactcaggcctgtttgtgaccgttcttgaggtgagctctgcctctgctgcacacactggactgtatacgtgttattacaaccatacacaaacagaagagaatgagcttgagggcagacatatctatatttatgtgcccgatccagatgtggcttttgtcccactgggaatgaccgactatctcgtcattgtcgaggacgatgatagcgctataatcccctgccggacgactgaccctgagaccccagtgactctccacaactcggagggcgtcgtgccagcctcctatgattctcggcaggggtttaatggtaccttcacagtgggaccatatatctgtgaagcaaccgtgaagggtaagaaattccagacaatcccttttaatgtctacgctcttaaggccacttctgagttggatctcgagatggaagcactcaaaacagtctataaatccggtgagactatcgtggttacatgtgcagtgttcaacaatgaagtagtggacctgcagtggacttatcccggggaagtgaagggcaagggaatcaccatgctcgaggaaatcaaagtaccatcgataaagcttgtttatacactgactgtgccagaagcaacagtcaaggatagtggtgattacgaatgcgcagctagacaagcaacgagagaagtgaaagaaatgaaaaaggtcacaatctcggtccacgaaaagggctttatcgagatcaagccaaccttctcccagctggaagcggtgaatctgcatgaggtaaagcattttgtcgtagaagtacgggcttatccacctccccgcatatcttggcttaagaacaatctgacgctgattgaaaacttgacagaaatcaccacagatgttgagaaaatccaagaaatcagatataggtctaagctgaaattaatacgggcaaaggaggaagacagcggtcactataccatagtggctcagaatgaagatgccgtgaaaagctacaccttcgagctgcttacccaggtaccgagttccattctggatctggtagatgaccatcatggcagcaccgggggccagactgtaagatgcaccgccgagggaacacctctccctgatattgagtggatgatctgtaaagatatcaagaagtgcaacaatgagacaagttggactattttggcaaacaacgtgtccaacatcatcacagaaattcactcacgagatcgttcaacagtggagggccgtgtgactttcgctaaggtcgaagagactattgcagtccggtgtctggccaagaatttattaggcgcggaaaacagagagctgaagctcgtggctcccaccctgagatctgaactcaccgtcgccgccgctgtgctggtcttgctagtgatcgtgatcatatcactgatagttctcgtcgtcatctggaagcagaagcctcgatatgagatccgctggcgagtcatcgaaagcataagccccgacggccatgagtatatctatgtggatcccatgcagttaccctatgatagtaggtgggagttccctcgtgatgggttggtcctcgggagagttctgggcagcggcgcctttgggaaagtggtggagggaaccgcatatggcttatccaggagccaacccgtgatgaaagttgcagttaaaatgctgaaacccactgcccggagcagtgaaaagcaggcgttgatgagcgagctcaagattatgacacacttggggccacacttgaacatagtaaatctgctgggtgcctgcactaagtccggacccatttacatcatcactgagtactgcttttatggggatttagtcaactacctgcacaaaaatagagactcttttctaagccaccacccagagaaaccgaagaaagaattagacattttcggtctgaacccggcagatgaatccacaagatcttacgtgatccttagttttgagaataatggcgattatatggatatgaagcaggcggatactactcagtatgtgcccatgctggagcgaaaagaggttagcaaatactcagatatccagaggtctctgtatgacagacccgcctcctataagaagaagagcatgctcgatagcgaggtaaagaacttgctctccgacgacaactctgagggcctaactttgttggacctgctgtcattcacatatcaggtggcgcggggaatggaattccttgcgtccaaaaactgcgtgcatcgagatctggctgcccgaaacgtcctcctagctcaaggcaagatcgtgaaaatttgcgacttcggtctggcccgggacatcatgcacgattctaactatgtttccaaaggaagcacattcttacccgtgaaatggatggcgcccgagtcaatcttcgacaatctttacactactcttagcgacgtttggagctatggcatcttgctctgggaaatctttagcttgggcggcacaccctacccaggaatgatggtcgatagcacattttacaacaagattaaaagcggctacaggatggccaagcctgaccatgctacgagcgaggtttacgaaatcatggtcaagtgctggaatagcgaaccagagaagcgaccctccttctatcatttgtcagaaatagttgagaacctgcttcccggtcaatacaagaagtcctatgagaagatccacctggatttcctgaagtcagatcaccctgctgtggccagaatgagagtggatagcgacaacgcttacatcggggtgacctataagaatgaagaagataaactaaaagattgggagggcggattggatgaacagcggttgagcgcggattccggatatattattcctctccctgacatcgatcctgtcccagaagaagaggatctcggaaaaagaaatagacatagcagccagacaagcgaagagtcagcaatcgaaacagggtctagctcaagcacatttatcaaaagagaggacgaaacaatcgaagatatcgatatgatggatgacattggaattgattccagcgacctcgtcgaggacagtttcttgtag

SEQ ID NO: 25667 - DNA, 480 bp, Artificial Sequence
  Description of Artificial Sequence: Synthetic coding sequence
atgggcaccagccaccccgccttcctggtgctgggctgcctgctgactggtctttccttgatcctgtgccagctgtccctgccttcaatactcccaaacgagaacgagaaagtagtacagctcaattcctccttctcactccgctgtttcggcgagtcagaagtctcatggcagtatccgatgtccgaagaggagagttctgatgttgagattagaaacgaggagaacaacagtggactgtttgtgaccgttctggaggtgagtagcgcatccgctgctcataccggcttgtatacatgttattataaccacactcagactgaagaaaatgagcttgaagggaggcacatttacatttacgtgcctgatccagatgttgcatttgtaccacttggcatgacagactatcttgtcatcgtggaggatgatgactctgcaattatcccttgtagaaccactgacccagaaacaccagtgtag

SEQ ID NO: 25668 - DNA, 477 bp, Artificial Sequence
  Description of Artificial Sequence: Synthetic coding sequence
atgggcaccagccaccccgccttcctggtgctgggctgcctgctgacgggcctctcactgattctgtgccagctttcgcttcctagtatccttccaaacgagaatgagaaggtggtgcagctgaacagctcctttagtcttcgatgtttcggggagtcagaggtttcctggcagtaccctatgagtgaggaggaaagtagcgacgtggagatccgcaatgaggagaataacagtggcctctttgttactgtcctggaggtctcttccgcctctgcagctcacacaggactgtacacatgctactataaccacacccagaccgaagagaatgaattagaaggcagacatatatatatctacgtccccgacccagacgtcgcctttgttccgctcggaatgacagactaccttgtgatagtggaagatgacgattccgctatcataccttgtaggacgacagatcctgagacaccctag

SEQ ID NO: 25669 - DNA, 657 bp, Artificial Sequence
  Description of Artificial Sequence: Synthetic coding sequence
atgggcaccagccaccccgccttcctggtgctgggctgcctgctgacaggcctcagcctgatcctgtgtcagttatccctcccgtcaattttgcctaacgaaaacgagaaggttgtccagttgaattcatccttttcacttaggtgctttggagagtctgaagtgtcttggcagtacccgatgagcgaagaggagagttctgacgtggaaattcgcaacgaggaaaacaattcaggcctgttcgtaaccgtcctcgaggtgtcctctgcttcagcggctcatactggcctctatacatgttattataaccacacacagaccgaggaaaacgaacttgaaggcagacacatctacatctacgtcccagatcccgatgttgcctttgttccactaggcatgacagattacctggtgattgtagaagacgatgattctgcgatcataccctgtcgcaccaccgaccctgaaacacccgtgacactccataattcagagggtgttgttccagctagctatgattcccggcaggggtttaacggaacctttactgtcggcccatatatttgcgaagccaccgtcaaaggaaaaaagttccagaccatcccctttaatgtctacgcgcttaaaggtacttgtatcatctccttcctgctttag

SEQ ID NO: 25670 - DNA, 465 bp, Artificial Sequence
  Description of Artificial Sequence: Synthetic coding sequence
atgggcaccagccaccccgccttcctggtgctgggctgcctgctgacaggcctctccctaatcctgtgccaactatcactcccgagcatcctccccaatgagaatgaaaaggttgtacaactgaatagttcgttctccctacgatgtttcggggagagtgaggtctcatggcagtatccaatgtccgaagaggagtcatctgatgtcgagatcagaaatgaggaaaacaattctggactattcgtcaccgtacttgaagtcagcagcgccagtgccgcacatacaggattgtatacgtgctactacaatcatacccagactgaagaaaacgagctcgagggacgccacatctatatttatgtacctgatcccgacgtcgcatttgtgccgttaggtatgactgattacctggtgatagtagaggatgacgactctgcaatcatcccatgcagaaccacagattag

SEQ ID NO: 25671 - DNA, 3321 bp, Artificial Sequence
  Description of Artificial Sequence: Synthetic coding sequence
atgcggctgcccggcgccatgcccgccctggccctgaagggcgagctgctcctgctttcactcttacttcttctcgagcctcagatcagccagggactggttgttactccacccggaccagaactggttctgaatgtgtcttcaacatttgtcctgacctgtagtggctcagcacccgttgtgtgggagcggatgtcccaggagcccccccaggagatggccaaggcacaggatggcacattcagtagcgtactgacactaacaaacttaactgggttggacaccggagaatatttctgtactcacaacgattcaagagggctagaaactgacgaacggaagcgcctgtatatcttcgtcccggatcccacggttggatttttaccaaacgacgctgaagagctgttcatctttttgactgagattaccgaaatcactattccttgcagggttaccgatccacaactggttgtgaccctgcacgaaaagaagggcgacgtggccttgccagttccatacgaccatcagcggggatttagcggtatctttgaagataggagttacatttgtaagacaacaattggcgatagagaagtggactccgacgcatattacgtgtatcgcctgcaggtatcctcaattaacgtgtccgtcaacgcagttcagacggtggtccgccagggcgaaaacataaccctcatgtgtatcgtcattggaaacgaggtggtgaacttcgaatggacatacccaagaaaggaatctgggcggctggtggagccagtgactgactttctgctggacatgccttaccacatcaggagcatcctccacatccccagcgcagagctggaggacagcggaacttatacctgcaatgtaaccgaaagcgtgaatgatcatcaggatgagaaggctattaacattactgtcgtcgaatcggggtatgttagattactcggcgaggtcggcacgctccaatttgcagagctacatcgaagcagaactttgcaggtcgtgttcgaagcatacccacctcctaccgtgctgtggtttaaggacaaccggactctaggcgactcaagtgccggagagattgccctatccactcggaacgtgtctgagacacggtatgtgtcagagcttaccctcgtcagagtcaaagttgcggaggctggccattatacaatgcgggccttccacgaggacgcggaggtacagctctcctttcagctgcagataaacgtgcctgtacgggtcttggagctgtctgaatctcacccagacagtggtgaacagaccgttagatgtcgtggccggggtatgccccaacccaatatcatctggagtgcctgtagagacctgaagcgctgtccaagggagctcccacctaccctcctgggcaactcttcggaagaagagtctcaactcgaaacgaacgtgacctattgggaggaggaacaggagtttgaagtcgtaagcactttgcggctccagcacgtggatcgaccgttgtccgtccggtgcactcttcggaacgcggttggccaagatacccaagaggtgatcgttgtcccacattccctcccgtttaaggtggtagtcatctcagccattttggcgttggttgtcctgactattatctctctgatcatcctgataatgctgtggcagaagaagccccgatatgagattagatggaaggtgattgagagtgtaagttctgacggacacgagtacatctatgtggaccccatgcagttgccatacgatagcacctgggagctgcccagagatcaactggtgcttggaaggactctcggtagtggggctttcgggcaggtggtggaagctactgcgcacggtctgagccattcccaggcgaccatgaaggttgccgtaaaaatgctgaaaagcaccgcgcgcagcagcgaaaagcaggctctcatgagcgagttaaaaattatgtcccatctcggtcctcatcttaacgtcgtgaacttgctgggagcttgcaccaagggaggtcccatttacatcataacagaatactgccgatacggtgatctcgtggactatctccatcgcaacaagcacacatttctacagcaccattctgataagcgaagacccccatccgccgaactctacagtaatgctctccccgtgggtctgccactgccttcacacgtaagcctcaccggcgagagcgatggtggttacatggacatgtctaaagatgagtccgtggattacgttcccatgctggacatgaagggcgacgtaaaatatgccgatatcgagagtagcaactacatggcaccatacgataattatgtcccctcggcgccagaaaggacatgcagggctactcttatcaatgaatctcccgtgctgtcatatatggatctggttggcttctcctaccaggtagccaacggcatggagtttcttgccagcaaaaactgcgtccacagagacctagccgcaagaaacgtactgatttgtgaggggaagctcgttaagatttgtgattttggcctggcacgtgacattatgcgcgactctaactatatctccaaaggctccacattcctaccacttaaatggatggcaccggagtctatcttcaacagcctgtacaccacactttccgatgtgtggagctttggaattctgctttgggaaatcttcaccttggggggcaccccatatcccgaattgcccatgaatgaacagttttacaacgccatcaagcgtggatacaggatggctcaaccggctcatgcttcggatgaaatctacgagatcatgcaaaaatgttgggaagaaaaatttgaaatccgcccaccattctctcagctcgtcctgcttctggagcgactgttgggggaaggctacaagaagaagtaccagcaggtcgatgaagaattcctgcggtccgatcatcctgccatcctcaggtcacaagctcggttgcctggctttcacggacttcgctcacctctggacaccagctctgtgctttataccgctgtgcaaccaaatgagggagacaacgattacatcatcccacttccagatcccaagcccgaagtcgccgatgagggtccactggaggggtctcctagcctagcctcttccacccttaacgaggtgaatacaagtagtactatttcatgcgattcccccctggagccccaagatgaacccgaacccgaaccgcagctcgagctgcaggtggagcctgagccggagctggaacaactccctgactctggctgtcccgctcctagggcagaagccgaagactccttcctttag

SEQ ID NO: 25672 - DNA, 525 bp, Artificial Sequence
  Description of Artificial Sequence: Synthetic coding sequence
atgcggctgcccggcgccatgcccgccctggccctgaagggcgagttgcttttgctgtccttgctgctgctattggaacctcagatttcccagggcttggtggttacccccccgggtcccgaactggtcctcaacgtcagttctacttttgtactgacctgctctggaagtgctcctgtggtgtgggagcgcatgtcacaggagcctccacaagaaatggcgaaagctcaggatgggacgttcagtagtgtgctgaccctgaccaatctgacgggcctggatacaggcgagtacttctgtacgcacaacgacagcagaggactcgaaacagacgagcgcaagcgtctctacatctttgtaccagaccccactgtgggtttcctgcctaacgatgccgaggaactgttcatctttctgactgaaattacagaaataacgattccttgccgggtcactgaccctcagctggtggttacactccatgagaagaaaggggatgtggcacttcctgtgccatatgattag

SEQ ID NO: 25673 - DNA, 2331 bp, Artificial Sequence
  Description of Artificial Sequence: Synthetic coding sequence
gccgccagcgagcccgacaccgccggcagcgtgcggggcctgcccaccgcacactgccctgtggtggacaaccgcactttgggagacagctcagctggcgagatagccctcagcacccggaacgtgtcagagactcgctatgtgtccgagctcaccttggttcgtgtcaaggttgccgaggctggacattatacaatgcgggcgttccacgaagatgctgaggttcaactttccttccagctgcagatcaatgttccggttcgcgttttggagctgtctgaatctcatcccgattctggtgagcagacagtccgatgccgcgggcgcggtatgccacagccgaacataatatggagcgcctgccgtgatcttaagcggtgcccccgtgaactcccccctactcttctgggcaattcctcagaagaagagtctcagctggaaaccaatgttacgtattgggaagaggagcaggaattcgaggtggtgagcacccttagattgcagcatgtcgaccgcccgctatctgttcgttgcacccttcgaaacgccgttggccaggacacacaggaggtgatcgtggtgcctcactctcttccattcaaggttgtagtgatctccgctattctggccctggtcgtgctcacaatcatttccctgattattctgatcatgttgtggcagaaaaaaccccgctacgaaataaggtggaaggtaatcgagtcagtgagcagtgacggacacgaatatatctacgttgaccctatgcagctgccttacgattcaacctgggagttgccacgcgatcaactagttctagggaggacgctgggcagcggagcatttggccaggtggtggaagctacagcacatggcctgagtcatagccaggctaccatgaaggtggcagtcaaaatgctcaagtctactgctaggtcttccgagaagcaggcactcatgtctgaactcaagattatgtctcacttgggtccccatttgaatgttgtcaacctgttgggggcatgcacgaaaggtgggccaatctacattattactgagtactgccgatatggtgacttagtggattatcttcaccgaaataagcatacattcctgcagcatcactctgacaaacggcggccgccttcagccgagctatattccaacgccttacccgtggggctgccccttccctcccacgtgtcactgacgggggagagtgatggtggatacatggatatgtcaaaggacgagagtgtcgactacgtacccatgctggacatgaaaggggacgtgaagtacgcagacattgagtcaagtaactatatggccccctatgataattatgtcccttctgcacccgaacgcacttgccgcgccacactgatcaatgaatctcccgtgctctcatacatggatctcgtgggcttctcataccaagtcgccaatggcatggaattccttgcttcaaagaactgtgtccatcgggatctcgccgcccggaatgttctcatctgcgaaggcaagttagtcaagatctgtgactttggactggctcgcgatatcatgagagatagcaactacatctcaaaaggtagtacattcctcccgctgaagtggatggcccccgaatccatcttcaattccctgtatacgaccctgtcagacgtttggagctttggcatattgctgtgggagattttcaccttaggaggaactccttaccctgagctccctatgaacgagcagttttacaatgctataaaacgaggctaccgcatggcacagccggcccatgctagcgatgaaatctacgaaatcatgcagaagtgctgggaggaaaagtttgagatccgtccgcccttcagtcagctggtgctcctactcgagcgcttgttgggtgaagggtataagaagaagtaccagcaggtggacgaggagttccttaggtctgaccatccggccatcctgcggagccaggctagattgcctggttttcatggcctccgtagtccccttgatacttcatcagttctgtacactgcggtacagccgaatgagggcgataacgattatatcatccctctgccagacccaaagcctgaagtcgcagacgaaggcccgttggagggatctccatccttggcctcctctacgctgaacgaagtcaatacctcctcgaccatttcctgtgatagtccgcttgaaccacaagacgaaccagagccagaaccccagctcgagctccaggtggaaccagagccggagctagagcaactgccggattcagggtgcccggctccacgagcagaggcggaggattcttttttatag

SEQ ID NO: 25674 - DNA, 891 bp, Artificial Sequence
  Description of Artificial Sequence: Synthetic coding sequence
atgggcctgagccacagcaagacccacctgcgggtgatcaaggtggcccctttgcagaataaagaagtggaaactccttccgcgggcagagtcgattttgccttcaatcagaatctggaggaaaagactagttactcactagccagacttcaagatcagaataaggctcttgagggccagctgccacctttgcaggaaaattggtacggccgatatagcactgccagtcgagatatgtatttcgacatccccctagaacaccgagaaaccagtatcatcaagcgccatcctccgcagcgacttcagaagctggagcctatagatcttccgagggtcattactagcggccgcctgcttagccagagagaggctcgcactatgcacaaggcaaagcaggtccttgagaagaagatgcagacacccatgtatactagtgaaaaccgacagtacttacataaaatgcaggtcctggagatgatccgcaaacgtcaagaagcacagatggagctaaagaagagtttacacggcgaagccaggattaacaagcaaagcccccgagaccacaaagcgaagaagacgctgcagtctactccgcgaaacgacgatcatgacctgttaactatgctacccgatgagattctaaaccgcggacccgggaacagtaaaaacaccgagttcctgaaacaccaagctgtgaacaattattgcccctggaagatcggtaagatggagacttggctgcatgaacaagaggcacaaggtcagctgctctgggattcctcgtcaagcgatagcgacgaacaaggaaaggacgaaaagaagccacgagcgctcgtacgtactcggaccgagcgtattcccttattcgacgaattctttgaccaggaatag

SEQ ID NO: 25675 - DNA, 1734 bp, Artificial Sequence
  Description of Artificial Sequence: Synthetic coding sequence
atgcccgagggcgcccagggcctgagcctgagcaagcccagcccctcactcggctgcggacggagaggagaagtgtgtgattgcgggaccgtttgcgagacacggacagctcctgctgctccgactatggccagtccgcggggtagcggatccagtacgagcctttccaccgtcgggagcgagggcgatcccgcacctggtcctacccccgcttgttctgcatcacgacctgaacctctgccggggccccctattagactgcatctctcacccgtaggcattcccggcagcgctcgcccaagccgcctggaaagggtagccagagaaatagttgagaccgagagggcatatgtgcgcgatctccgatcaatagtcgaggattacctgggacccctgctggacggtggggtgctaggtcttagtgtcgagcaagttggaactttgtttgccaacatcgaggacatttatgaatttagttcagaacttttggaagatctggaaaattcttcgagcgcgggcggaatcgctgaatgttttgtccagaggagtgaggatttcgacatttacaccctctactgtatgaattacccatctagcctcgccctgctgcgcgagctttccctgtctccaccagccgctctgtggctgcaggagcgacaggcgcagttgcggcactcactgcccctccaatcgtttcttttgaagcccgtccagagaatactcaagtaccatttactgctgcaagaactgggcaagcactgggcagaaggcccaggaaccggaggccgagagatggtcgaagaagctatcgtatcaatgacggctgtggcctggtacattaatgatatgaaacgcaagcaggagcacgccgcacgccttcaggaagtgcagcggcgtctaggcgggtggacgggccccgaactgtctgccttcggcgaactcgtgctcgagggagccttccggggcggggggggaggcggcccacgtttgagggggggtgaacgtctgctgtttcttttttcccgcatgttgctggtggccaagaggcgtggcctggaatacacatataaggggcatattttttgctgtaatctcagtgtgtcggagagccctagggatcctctcggcttcaaggtgtccgacttgacaattcctaaacaccgtcacctcctgcaggcaaagaaccaggaggagaagagactctggatccactgcctgcagcgcctcttcttcgagaatcaccctgcatcgattccagctaaggctaagcaagttctgctggaaaattctctgcattgcgctccgaagtctaaaccggtgctcgagccactgaccccccccctaggctcccctagaccacgcgacgctcggtcatttactcccggtcgccgcaacacggctccctctccaggtcccagtgttatccgcaggggccgccggcagtcagagcctgtgaaagatccctacgttatgtttccgcaaaacgccaaacctggttttaagcacgccggaagtgaaggtgaactgtacccccctgagtcccagcctcctgtgtccgggtcagcccctccggaggacttagaagacgcggggccccctactttagatccaagcggcacaagcatcaccgaggagatccttgaattgctgaaccagcggggcctccgcgaccccggggagagcatgggactacatagggcccagggcgcccctgatgcaccctttcacatgtag

SEQ ID NO: 25676 - DNA, 4161 bp, Artificial Sequence
  Description of Artificial Sequence: Synthetic coding sequence
atgcccgagggcgcccagggcctgagcctgagcaagcccagcccctcacttggatgtggcaggcggggcgaagtgtgcgattgtgggactgtgtgcgaaaccagaacagctcctgcggctcccaccatggccagcccgcggggttctggttcttcgacatctctgagtaccgttgggagcgaaggcgatccagcacccggtccaacacccgcatgttccgccagtcggcccgagcctctccccgggccccccattcggctccacttgagccctgtgggcatccccggatccgcaaggccctctcgattggaacgggtagctagagagattgtcgagacagaacgggcatatgtgagggacttgcggagtattgtggaggactatttaggaccacttctcgacggcggcgttctgggacttagtgtggagcaggtcggcacactgtttgcaaacatcgaagacatctatgaattctcctccgaactgctggaggacctggaaaattcttcctccgcagggggcattgctgaatgttttgttcagaggtctgaagattttgacatctacaccttatactgtatgaactaccccagcagtcttgccctgctgcgcgaactctctctcagccctccggcagctctttggctgcaggagagacaagctcaactacggcatagtctgcctttgcagtcattcctgctgaagccagtgcagagaatcctaaaataccacctcctactccaggagctcgggaagcactgggcagaaggccctgggactggcggacgcgagatggtggaggaagccatagtaagtatgaccgcagtggcttggtatattaacgatatgaagagaaagcaggaacatgccgctcgacttcaggaggtccaacggcgcctaggcggatggacagggccggaactgtcggcttttggagaactggtgctcgagggagcgttccgaggaggaggaggtggtggacctagattgcgaggaggagaacgcctgctgtttctgttcagcaggatgctgttggtcgcaaagcgcagagggctggagtacacctacaaaggccacatcttctgctgcaatttgagcgtttccgaaagtcctcgcgaccctctgggcttcaaagtctctgatcttacaatccccaagcatcgccacttattgcaggctaaaaaccaggaggaaaagcgcctgtggattcactgtttgcagcggctattcttcgagaatcaccccgctagcattccggcaaaggccaagcaagtcctgttggaaaactctctccattgtgcccctaagagcaaaccagttctggaacccctgacccccccgctcggctcacctcgccctagggacgctaggagctttacccctggacgacgtaacactgcgccttcacctggacccagcgtgatacgaagggggcgccgccagtcagagccagtgaaggacccctacgtgatgtttccccagaacgcgaagcccggattcaaacacgccgggtctgagggcgagctgtatcctccagaatcacaacctcccgtgtccggcagcgctccccctgaagaccttgaggatgccggaccgcccacccttgacccgagcgggacatcgatcacggaggagatcctcgagttgctcaaccagagaggcctgagagatccgggccccagtacacatgatatccctaagttccccggcgactcccaagtgccgggcgatagtgagactctcacctttcaggctctgcccagcagagattccagcgaggaagaagaggaggaagaggaggggttagagatggacgaaaggggcccaagtccactgcacgtgctcgagggcctcgaatcctctatagctgctgagatgccatcgatcccctgtttgacgaagatcccggatgtgcctaatctaccggagatcccctcccggtgcgaaattccagagggatcccgcctaccaagcctcagtgacatttcagacgtcttcgagatgccttgcctacccgctatcccctccgtccccaacacccccagcctgagctcaacacctaccctctcttgcgactcgtggctccaggggcctctccaagagccagccgaggcacccgctacacgacgggagcttttttctggatcaaaccccggcaagcttggagaaccccccagtggagggaaggccggtcctgaggaggacgaagagggcgtctctttcacagacttccagccacaagacgttactcagcatcagggtttcccagatgagcttgcctttaggagctgtagtgagattcgctccgcctggcaggctctcgagcaaggtcaactagcacgccctgggtttccagagcctctgctgatcctggaggattctgacttgggcggtgatagtggttcgggtaaggccggggcgccctcaagcgagaggaccgcaagtagggtgagagagttggctcggctctattctgaacggatacaacagatgcagcgggctgaaaccagagcttctgccaacgcccccaggcggaggccccgcgttctggcccagccgcaaccttcaccctgcctgccacaggaacaggctgaacccggcctgctgccggctttcggacacgtgttggtttgcgagctggctttccctctgacgtgcgcgcaggaatctgttccattgggtccagctgtctgggtgcaggctgccataccgctgtccaagcaaggaggatcccccgacggacaggggctgcacgtatctaacttaccaaaacaagatctaccagggatccacgtgagcgcagctacactattgccagaacaggggggctctaggcatgtgcaggcccctgctgccaccccgctgccaaaacaggaaggacctttgcacctgcaagtgcctgccttaactacttttagcgaccagggccacccagaaatccaggtgcccgccaccacccccttaccagagcatcggtcacatatggtgatacctgcaccaagcacggctttttgccccgaacaaggacactgcgctgatatacacgttccgactacccccgcactcccgaaagagatttgtagcgactttactgtgagtgtgaccacacctgttcccaaacaagaaggtcatttagactcagagagccctacaaatatccccctcaccaagcaagggggaagccgggacgtccaagggcccgaccccgtctgctctcagcccatccagcctttgagttggcacggttcatcactggacccccagggaccaggggatacactgccgcctttaccatgtcacttgccagacctgcagattcccggaacttcaccattgcctgcccatggaagtcatctggatcaccgcattcctgctaacgcccctctgagcctctcccaggagttgcctgatacgcaggtgccagcgacaactcctctacccctacctcaggtgttgaccgacatatgggtacaggccttgcctacatctcctaagcagggctctcttcccgatatccagggtcccgcagccgctccccccctgcctgagcccagcctaactgacactcaggtgcagaagctgactccatctctcgaacagaaaagtctcattgatgcccacgttcccgccgcaacccccctgcctgagcgcggtggctctctcgatatacagggcctgagccccacccccgtgcagactacgatggttctgtccaagccggggggttcactggcatcgcatgttgcacgcctcgagtcaagcgatctgactccccctcactccccccccccctccagcagacaactgctcgggcccaacgccgccgccctttcaagatatttggctgccagctacatctctcaatccctcgccaggagacaggggcccggaggtggggctcccgctgcgtcacgtggatcctggtcctccgcccctacgtccagggcttcctctccccccccacagccacagcctcctccaccccctgcccggcggctatcctatgccactaccgtgaacatccatgtagggggcggcggccgtctgcgccctgccaaggctcaggtgaggctcaatcaccccgccctgttggcgagcactcaggagtctatgggcctgcatcgtgcccagggagccccagacgcgccgtttcatatgtag

SEQ ID NO: 25677 - DNA, 1734 bp, Artificial Sequence
  Description of Artificial Sequence: Synthetic coding sequence
atgcccgagggcgcccagggcctgagcctgagcaagcccagccccagtcttggctgcggccggcgtggagaggtgtgcgattgtggcacggtatgtgagacaaggacagctcctgccgcacctactatggcttctccccggggatctgggagcagcacatctctgagtaccgttggatccgagggagaccctgcacccggccctacccctgcctgctcagcttcccgccctgagcctttacccgggcctcccatccgcctccatttgtccccagttggaattcccggctccgccagaccatcaagactggagagagtagctagggagatcgttgaaaccgaaagggcctacgtgcgggatctgcggagtatcgtcgaggactatcttgggccactactggacggaggcgtccttggtctgtctgtagagcaggtgggtactctgtttgcaaacatagaagatatctacgaattctcctccgagctgctggaggacttggagaattctagctcagccggcggaatagcagagtgctttgtgcagcggagcgaggatttcgacatttataccctgtactgcatgaattacccgagctccttggccctcctgcgggaacttagcctttctccccctgcagccttatggctccaagagagacaggcccaactacgacattcactccctctccaatccttcctgctcaaacccgtgcagagaatcctaaaatatcacctgcttctgcaggagctcgggaagcattgggccgaaggcccaggtaccgggggacgagaaatggtggaggaagctatagttagcatgaccgccgtagcctggtacatcaatgatatgaagcggaaacaggaacacgccgctcggctgcaggaagtgcagaggaggctgggaggctggaccgggcccgaactatccgcattcggcgagcttgtactggagggagctttcagagggggcggggggggtggtcctagattacgaggtggggagaggctactgtttctgttttctcggatgctgttggtggcgaaacggagaggattagaatacacttacaagggtcacattttctgctgtaacctgagcgtctcagaaagcccacgagacccacttggttttaaggtgtccgacctcacaattcctaagcatcggcatcttctgcaggccaaaaaccaagaagagaagcgcctctggattcattgcctacaaaggctcttctttgagaaccaccctgcaagtatacccgcaaaggctaagcaggtcctgctcgaaaattctctgcattgtgctcccaaatctaaacccgtactggagcctctcacgcctccactaggttcaccgaggccaagagacgcaagatcattcacacctggtagaaggaacactgcaccgagtcccggaccgtcagtcattcgcaggggacgcagacagtctgagccggtgaaagacccatacgtgatgtttccgcagaatgccaagcccggcttcaaacatgcaggctctgaaggcgagctgtacccaccggaatctcagcctcctgttagtggttccgcaccgccagaagacctcgaggacgccggtcctcctacactagacccctccggcacaagcattactgaagaaatcctcgaattactaaatcagaggggattgcgggatcccggtgagtcaatgggactccatagagcgcagggcgcccctgatgccccattccatatgtag

SEQ ID NO: 25678 - DNA, 4074 bp, Artificial Sequence
  Description of Artificial Sequence: Synthetic coding sequence
atgcccgagggcgcccagggcctgagcctgagcaagcccagccccagcttaggttgtgggcgtaggggagaagtgtgtgactgcgggactgtgtgcgagacccggactgccccagccgcacctaccatggccagtccgcgggggtcaggctcgtctactagtcttagcacagtgggaagtgagggggatccggcccccggaccaactccagcttgctctgcatctcggccagaacctctacctggtccacctatccgtttgcacctatctccagtgggtatccctggctcagcgagaccctctcgtctggaacgagtggccagggaaattgtggagacggaaagagcttatgtgagagatctcagatccattgttgaagactacctaggaccactcctggatggcggcgtactcggattgtcagttgaacaggtgggcaccctattcgctaacatcgaagacatctacgaattcagcagtgagctgttagaagacctggagaactcatcgtctgccgggggcatcgccgagtgcttcgtgcagaggagtgaagacttcgatatatacactctgtattgcatgaattatccatcatcattggcgctgctcagggagttgagcctgtccccacccgccgctctatggctgcaggaaagacaggcccagctgagacactctctgcctctccagagctttctgcttaagcccgtgcagcgaattctcaaataccacctgcttctacaggagctgggcaagcactgggctgagggcccaggcaccggcggcagggaaatggtggaagaggccattgtttccatgacggccgtggcctggtacatcaatgatatgaaacgaaagcaggagcacgcggcgagactgcaggaggtacaacggcgtctcggaggctggacaggaccagaattgagcgctttcggtgagttggtgctcgagggagcattccgaggcggaggcggtgggggccctcgactcagggggggcgagcggctgctatttctcttcagtaggatgctcctggtggctaagcgacggggtctggagtacacctataagggtcatattttctgctgcaatctctccgtcagcgagtccccgagagatcccctcggtttcaaggtaagtgacctcaccatccccaagcatcgccatctgctccaggccaagaaccaggaagagaagcgactctggattcactgccttcagcggctgttcttcgagaaccaccctgcgagcattcctgcgaaggccaaacaggtattgttggagaactccctgcattgcgcccctaaatcaaagccagtgctggagccgctgacacctcctctcggctcccctaggcccagagacgccagatcttttaccccgggaagacggaacacagcaaaacccggcttcaagcatgcaggttcagagggggagctgtacccaccagaaagccagccacccgtttctgggagtgccccccctgaagatctcgaggatgcaggccctccgaccctcgacccaagcgggactagcatcacagaggaaatcctggaactcctcaatcagagaggcctgcgcgatcccgggccaagcactcacgacatccctaagtttcccggcgatagccaagtgcccggtgactccgagacactgaccttccaggctttaccaagccgagactcctccgaagaggaagaggaggaagaagagggtctggaaatggacgagaggggcccgtcccccctgcatgttctcgaagggttggagtcaagtatcgctgcagaaatgccgtcaatcccctgcttaacaaagatcccagacgtgcctaatctcccagaaatcccatctcgctgtgaaatacctgagggctcacgcctgccctctctgagcgatatcagtgatgtcttcgagatgccatgtcttcccgcaattcctagcgtgcccaacacaccctccctgtcttcgactcctaccctcagctgtgatagctggctgcagggccctctccaagagcccgccgaagcaccagccacgcgacgggaactgttttccggcagtaatcctggaaagctgggagagcccccttcaggggggaaagctggccccgaggaggatgaggagggcgtatcctttacggatttccaaccgcaggatgtcacgcagcaccaaggctttccggacgaacttgctttccgctcttgtagcgagattagaagcgcatggcaagccctggagcaggggcagcttgcgaggcctggattccctgagccccttctcattctagaagactctgatctgggaggtgactctggcagcggaaaagcaggggccccatcaagtgaacgcaccgcgtcgagagtgcgagaactggctcgcctgtattccgagcggattcagcagatgcagcgcgctgagacccgcgcgtctgctaacgccccaagacggaggcccagagtgctggcccaaccacagccttctccttgtttaccacaggagcaggccgaaccgggcctgctgcctgcattcggacatgttctcgtgtgcgaattagcttttccactcacttgtgcacaagaatccgtgccacttggacctgccgtctgggtgcaagcggctatcccactcagcaagcagggtgggtctcccgacgggcagggcttgcacgtaagcaatctgcctaaacaggacctccctggcattcacgtgtctgctgccacacttctgcccgagcagggcggctcaagacacgtgcaggccccagcagcaacacccctgcccaagcaagaagggccgctacacttacaggtgcccgcactgaccactttctctgatcagggccatcctgagatccaggtgccagcaactactccgctgccagaacaccgttcacatatggtgattcctgcgcctagcaccgccttctgccccgagcagggacattgcgctgacatacatgttcctacaacaccggccctccccaaagaaatctgctcggattttacagtctcagtgacaacccccgtgcccaagcaagagggacacctcgattcagagtcgccaacgaatattcccctcaccaagcaaggggggtcccgggacgtacaggggcccgacccagtttgttcacagccgatacagccactctcttggcacgggtcttctctggacccgcaagggcctggcgataccctgcctcctctgccatgtcacctgccggacttgcagatcccaggcacttcgcctctccccgcccacggctctcatttagatcaccgtattccggccaacgcgccattgtctttgagccaggagcttcctgacacacaagtgcctgcaacaacccctctcccactcccccaagtgctgaccgacatctgggtgcaggccctgccaacatcacccaaacagggcagtctccctgatatccagggccccgccgctgcaccaccattaccagaaccgagcctaactgatacccaggtacaaaagctcacacccagccttgaacaaaagagtcttattgacgcccatgtgccagctgcaacaccgctcccagaaaggggagggtctctggacattcagggtctctctccgactcccgttcaaaccacgatggtcttaagtaaacccggtggctccctcgcttcccacgtggcgcgcctggagtctagcgacctgacacctcctcactctccccctccaagcagtcgccagctgctggggcctaacgcagccgctttatccagatacctcgccgcctcatacattagtcaaagcctggcacggagacagggtccaggagggggtgcccctgcagcttcaaggggcagctggtccagcgccccaacctccagggccagcagtccccctccccaaccccagccaccccctccacctgctagaagactttcgtatgcaacgaccgtgaacattcatgtaggggggggaggtaggctccggcccgccaaagcgcaggtcagactgaatcacccagcattgcttgcatccacacaagagtccatgggtctgcaccgtgcccagggggcgccagatgctccattccacatgtag

SEQ ID NO: 25679 - DNA, 597 bp, Artificial Sequence
  Description of Artificial Sequence: Synthetic coding sequence
atgcccgagggcgcccagggcctgagcctgagcaagcccagcccctctctcgggtgcggccggcggggcgaggtttgcgactgcggcacagtctgcgaaacccggaccgccgccccagctgcccctacgatggcctcgccgcggggcagtggaagctctaccagcttgagcacagtcggctctgaaggcgaccctgcccccggaccaaccccagcatgtagtgcatcccggcctgagcctctcccgggcccccctattcgcctgcatctatcacccgtgggcatcccagggtctgctcgcccttcacggctggaacgggttgcccgcgagatcgtcgagaccgaacgtgcctacgtccgggacctgaggtccatcgtggaggactacctgggcccacttctggatgggggtgttctgggccttagcgtggagcaggttggaaccctgtttgccaatattgaggacatctatgagtttagctccgagctgctggaggaccttgagaactcctcttctgccgggggcatcgctgagtgttttgtgcagcgctccgaggacttcgatatttacactctctattgcatgaattacccgtag

SEQ ID NO: 25680 - DNA, 3714 bp, Artificial Sequence
  Description of Artificial Sequence: Synthetic coding sequence
atgcccgagggcgcccagggcctgagcctgagcaagcccagccccagcctgggctgcgggcgtcgcggggaagtctgcgactgtggcactgtctgcgagacccggaccggctctgcccgcccctccagactagagcgcgttgcccgggagatcgtggaaaccgagagggcatacgtgagggacctgagatctatcgtcgaggactacctcggcccactgctggacggaggagtattgggcctgagcgttgaacaggtgggcaccctgttcgcgaacatagaggatatttatgagttctcctccgagctcttggaggacctggagaacagttcgtcagccggaggcatcgcagaatgcttcgtacagcgatcagaagactttgacatctacacactgtattgcatgaactaccctagctccctcgccctgcttcgcgaactctccctctcaccacctgccgctctgtggcttcaagaacgccaggcacaactgcgccattctctccctttgcagagctttctgctgaagcccgtacaaaggattctgaagtaccacctgctgctgcaggagcttggtaaacactgggccgaggggccaggcactggtggccgggaaatggtcgaggaagccattgtgagtatgaccgccgtggcatggtacatcaacgacatgaaacgtaagcaggagcatgcagcacgactgcaggaagtccagcgtaggctggggggatggactgggcctgagttaagtgcgtttggcgagctcgtcctggagggagctttccggggcggcgggggaggaggacccaggctgcgtgggggagagagacttttgttcctattttcacgtatgctgttagtggcaaagcggcgcggactcgaatacacctacaaggggcacattttctgttgtaacctcagcgtatcagaatcccccagggaccccctggggttcaaggttagcgacctgaccatacccaagcacagacacttactgcaggctaagaatcaagaggagaagcgtctctggatccattgcctgcagcggctgttttttgagaaccatcctgcctctattcccgcgaaagcaaaacaagtgttgctggagaacagcttgcattgtgctcctaagagtaagcctgttttagagccactcacacctcccctcggctctccacgtccacgcgatgctcgaagcttcacaccaggaaggcgaaatactgctccatctcccggtccttccgtcatccgtagaggtagacgccagtccgaaccagtaaaggacccttacgtgatgtttccacagaacgctaagccgggttttaaacatgcgggcagtgaaggcgagctctatccaccagagagccagccccccgtgagcggctccgcccctccagaagacctcgaggacgccgggccccctaccctcgacccgtctggcactagtataactgaggaaatcctcgagctgctcaatcagaggggcctcagggatcctggcccaagcacccacgacatacccaaatttccaggcgactctcaggtcccgggagatagcgaaacgctgacatttcaggcgctcccgagtagggattctagcgaagaggaggaggaggaggaggagggcctcgagatggacgaacggggaccatcacccctgcacgtcctagaagggctggagagtagcattgctgctgagatgccgtccataccatgcctgaccaagattccggatgtccccaatctcccagaaatacctagtcgctgcgagatccctgaaggttcccgcctgccatcactgagcgacattagcgacgtctttgaaatgccatgcctgccggccatcccaagcgtgcctaataccccatccctgtcatccacaccaactctctcatgtgattcttggttgcaggggccgcttcaggagccggctgaggcccccgctacccggagagagctcttttctggctctaaccccggcaagctgggggaacctcccagtggagggaaagcgggccccgaagaggatgaggaaggcgtctcttttacggactttcagccccaagatgtcactcaacatcagggctttcctgacgaattggcatttcgctcttgctctgagatccggtcggcctggcaagctttagagcagggacaactagctagaccaggctttccagagcctcttttgatcctggaggactccgacctgggtggcgatagcggaagtggcaaggcaggcgccccgtcaagtgaacgtacagcttctagagtgagggaactggctagactgtactccgagaggattcagcaaatgcagcgcgctgagacaagagccagcgcgaatgctccacggaggcgccccagggttctggcccagcctcagccatccccttgtctgcctcaggaacaagctgagcctgggcttctgccagcgttcgggcacgtgctggtttgtgaactggccttccctctgacctgtgcccaggaatctgtgcctcttgggccagctgtgtgggtgcaagcagctatcccccttagcaagcaaggtgggtcgcccgatggccagggactacatgtttccaatctccccaagcaagatcttcctggtatccatgtctcagcggccaccctcctgccagagcagggcggtagccgccacgtgcaggccccggcagctacccctctcccaaagcaggaggggcctctgcacctccaggtccccgcccttaccacattctcagaccagggccatccggagatccaggtacccgcaaccacaccccttcctgagcatcggtcccacatggtgattcccgccccctccactgcattctgccccgaacaggggcactgtgctgacatccacgttcctactactccagctctgccaaaggagatatgcagtgatttcacagtttccgtcacgacccctgtcccaaaacaggaaggccaccttgatagcgaatccccaactaacatccctctcacgaagcagggaggaagtcgggacgttcagggacccgatcctgtgtgctctcagccaattcaacccctgtcgtggcatgggtccagtttggacccacaagggcctggagacaccttaccaccgctgccttgccatctcccagacttgcagatacctggaacatccccactgcccgcccatggctcccatttagatcatagaatcccagccaacgcccctctctctctgagccaggagctccccgacactcaagtgcccgcgactaccccgttgcccctcccacaggtgctgaccgatatctgggtgcaggcactgcctacctcgccgaagcagggcagtctccccgatattcagggaccagccgcagcgccccccctccccgaacccagtcttaccgacacacaggtccagaagctaaccccaagtctggaacagaagtcactgattgatgcacatgtccctgctgccactcccctaccagagcgcggcggaagcctggacatccaggggctaagtcccacgcccgtgcagacaaccatggtcttgagcaaaccaggcggttctctcgcttcccacgttgcgcgcaatctgtgggcttttaccggcccgcgtgggctcctcatgccacccagcacatgtgagcccggtcacgaggcaagcctgaaacaaggctttcagccagacgcaatcgacccacagaaccttacatggaagtcaaggcactag

SEQ ID NO: 25681 - DNA, 1128 bp, Artificial Sequence
  Description of Artificial Sequence: Synthetic coding sequence
atgatgaagaagaacaacagcgccaagcggggcccccaggacggcaatcaacaaccagctccccccgaaaaagttgggtgggtccgcaagttctgcggcaagggcatttttcgtgagatctggaaaaacaggtatgtcgtgctgaagggagatcagctgtatatctccgagaaagaggttaaagacgagaaaaatattcaagaagtgttcgacctatccgattacgaaaaatgcgaggagttgagaaaatccaagtcccgatcaaagaagaaccatagcaagttcactctagcccactccaaacagcctggcaataccgccccaaatctcatcttcctggcagtcagtcctgaggagaaggaatcctggatcaacgcacttaactctgccattactcgggctaagaatagaattctggacgaagccagcacctcaacaagtgacggcatgctaacactggatttaattcaggaagaagatccaagtcctgaagagcccacatcttgtgcggaatccttccgagtggatcttgataagagcgtcgctcagttggccggatcaagaaggcgagcagactccgacaggatccagcccagcgccgatagggcttcttctctgtccaggccatgggaaaagaccgacaaaggggcaacctacacacctcaggcaccgaagaaattgacaccgactgagaagggacggtgcgctagtttggaagagatcctctcccagagggatgctgccagcgctcggacccttcaattacgtgcggaggagcctcccacaccagcgctccctaatcctggccagctgagccgcattcaagacctggtggctaggaagttagaggaaacccaggaattgttggccgaggtgcagggtctgggcgacggcaagcgaaaagctaaagaccccccccgaagcccgccggacagcgaatcagagcagctgctgctggaaactgaacggctgcttggggaggcaagtagtaattggagtcaggcaaagcgtgtacttcaagaagttagagaactccgcgatctgtacagacagatggacctgcaaacaccagattcacatctcagacagacaacaccacattcgcagtacagaaaatccttgatgtag

SEQ ID NO: 25682 - DNA, 1230 bp, Artificial Sequence
  Description of Artificial Sequence: Synthetic coding sequence
atgatgaagaagaacaacagcgccaagcggggcccccaggacggcaaccagcagccagcacccccagaaaaggtgggctgggtccgaaaattctgcggcaagggtatcttccgggagatatggaaaaatcgctacgtggttctcaagggcgaccagctgtatataagcgagaaagaggttaaggacgaaaaaaacattcaggaggtcttcgatctttccgattacgaaaagtgcgaagagttaaggaaatccaaatcccggtcaaagaagaaccatagcaaatttaccctggcccacagcaaacagcccggcaacacagcccccaacctgatctttctcgccgtgtctcccgaggaaaaggagtcctggatcaatgcattgaattcggctattacccgtgcaaagaatcgaatcttggatgaagtcacagtggaggaggattcctaccttgctcaccccactcgggaccgggcaaaaattcagcactccaggagacctcccactagagggcacctcatggccgtggctagcacctctacatctgatggaatgttgactctcgatctcattcaggaagaagatccatcgcctgaggaacctacctcttgtgccgagagcttccgcgttgacctggataaatctgtggcacagctcgcaggctcccgaagaagagcagactccgatagaatccagcctagcgctgatcgggccagttccctctcccgcccgtgggagaaaaccgacaagggagcgacatacacgccccaggcccccaaaaaactcacccctacggaaaagggtcgctgcgcctctctagaagagattctatcacagagggacgcagcatcagcccgtactctgcagctccgagccgaagaaccccccaccccagcactgcctaaccctggacagctcagcagaatccaggacctggtagcccgaaaactggaagaaacccaagagctgcttgccgaggtgcaaggtctgggggatggcaaacgcaaggctaaagacccaccaaggtccccacccgattcagaaagtgagcaattgctcctggaaacagagcgtctgttaggggaggcgtccagcaactggtctcaagccaagcgcgtcctccaagaggttcgggagcttcgggacctgtacaggcagatggatctccaaacgcctgattcgcatctccgacagacaactccccacagtcagtacaggaaaagccttatgtag

SEQ ID NO: 25683 - DNA, 681 bp, Artificial Sequence
  Description of Artificial Sequence: Synthetic coding sequence
atgctgaccctggacctgatccaggaggaggaccccagccccgaggagcctacatcctgcgcagagagttttagggtcgacctggacaagagcgttgctcagctggccggcagtagaagacgcgctgatagtgatcgcattcagccatccgctgatcgggcttcaagcctctctcggccatgggagaaaaccgataaaggcgcgacttacacgccacaggcacccaagaaactgacccccaccgaaaagggccgttgcgctagcctcgaagagatattgagtcaacgcgatgccgctagtgccagaacacttcagctgcgggccgaagaaccccctacaccggccttgcccaaccctggtcagttgtcaaggatccaggatttggttgccaggaagctggaggagacgcaggagctgctggctgaggttcaagggttgggtgatggcaaaaggaaggctaaagatccccctaggtctcctcctgattccgagtccgagcagctcctgctcgaaacggaaagactcctaggggaggcctctagtaactggagccaggcaaaaagagtactccaggaggttagggagttgagagacctgtatagacagatggaccttcagacccctgactcccatcttcggcaaactacgccacactcacagtatagaaagagtctgatgtag

SEQ ID NO: 25684 - DNA, 675 bp, Artificial Sequence
  Description of Artificial Sequence: Synthetic coding sequence
atgcccagcaccctgcccagccccgagccccggaccgtgagctggatgtccacgagtcttcaagtgactgtcgaagaagactcctatttagctcaccctacaagagaccgcgccaagatccagcactcacgccgccctccaacccgggggcatctaatggcagtggcttccaccagtacttccgatggaatgcttactctcgacctgatccaagaggaagaccccagtccagaagagcccaccagttgcgctgagagtttccgggtcgacctggacaaatctgttgctcaactcgctggctccaggaggcgcgctgattcagatagaatccagcccagcgctgatcgtgcatctagccttagtagaccttgggagaagacggacaaaggagctacctacaccccccaagcaccaaagaaactgacacctaccgaaaaaggccggtgcgcctcactggaggaaatacttagccagcgtgacgccgcttctgccaggacactgcagttacgggccgaagagcccccgacgcctgccctgcccaatcctgggcagctgtcccgaattcaggacttggtcgcccgcaaactggaggaaacacaggagctgctagccgaggtgcaggggctcggcgatggaaaaagaaaagctaaggaccccccaagaagccctccatag

SEQ ID NO: 25685 - DNA, 384 bp, Artificial Sequence
  Description of Artificial Sequence: Synthetic coding sequence
atgaccgccgccgccaccgccaccgtgctgaaggagggcgtgctggaaaagagatcaggtggcttactgcagctctggaagcgtaagcgctgcgttctcacagagagaggacttcagctgttcgaggccaaaggtacgggcggacgcccaaaggagctcagtttcgccagaattaaagcagtggagtgtgtggaaagtactggaagacatatttatttcactttggtcacagaagggggaggagaaatcgacttccggtgtccactggaggaccctggctggaacgctcagatcacgctgggtctggtcaagttcaaaaaccagcaagctatccagacagtgagggcgcgccagtctctcggcactgggaccttggtctcctag

SEQ ID NO: 25686 - DNA, 384 bp, Artificial Sequence
  Description of Artificial Sequence: Synthetic coding sequence
atgaccgccgccgccaccgccaccgtgctgaaggagggcgtgctggagaaacgcagcggggggttgctccagctgtggaaaagaaagcgttgtgtgctgactgaacgtggattacagctcttcgaggcgaagggcacaggtggtaggccaaaggaactgagctttgcacggatcaaggctgttgagtgtgtcgagagcacaggcaggcatatctacttcacacttgtgacggaaggagggggcgagatcgacttccgatgcccactcgaagatcctggttggaacgcacagatcactctgggtctcgttaaatttaaaaaccagcaggctattcagactgtgcgggcccggcagtcactcggcaccggaaccctggtgagctag

SEQ ID NO: 25687 - DNA, 1710 bp, Artificial Sequence
  Description of Artificial Sequence: Synthetic coding sequence
atgagcttcggcatcctgaagcccgacctgcggatcgtgttcgtgcacaacaaggcagtgatttggcagaaaagccgtgtctctgatcacaagatggcgcttatgagcgtgttgggaactgcagtgatgaacaatatggagtccttccagtatcactctgaagaatcacagatttacctttccggttttctcccaaagtgcgacgcagaccactcatttacctcacttagtacccctgaaaggtcctttatcttcattaatagtagaccggttcatcagaaagacattctgaagcttattcggcaccattataacctgaagtgtcttaaagagtccacaaggctgtatccagtgttcttcctcaagattgatgtgcccaccgctgatgtggacgtgaatctcacacccgataaatcccaggtgctgctgcaaaataaggagtctgtcctgattgccttagaaaacttgatgacaacatgttacggaccgttgccctcgacaaacagctacgaaaataataagaccgatgtctcggccgccgatattgtgctgagtaaaaccgcagaaaccgacgtgctgtttaataaggttgagagtagcggcaaaaactactcaaacgttgatacctctgttataccttttcagaacgacatgcataatgacgaaagtggtaaaaacacagatgactgccttaaccatcagatctctattggagacttcgggtacgggcactgctcctcagagattagcaacatagataagaacacgaagaatgcatttcaggacatatccatgtccaacgtttcatgggagaactcccagactgaatactccaagacatgctttattagctccgtcaagcacacgcagtccgagaatggaaataaggatcacatcgatgaatccggcgagaatgaagaggaagccggactcgagaatagttcagaaatcagtgcagatgaatggtcgcgtggaaacatcttgaagaattccgtcggtgagaacattgagccagtgaaaattctggtgcccgaaaagtcactgccctgtaaagtcagcaataacaactaccctatccccgagcagatgaacctgaacgaggatagctgcaataagaaatctaacgtaatagataataaatcgggtaaagtgaccgcctatgaccttctgtccaatagggtgatcaaaaagccaatgtccgcaagtgcactgttcgtgcaggaccatagaccacagtttctgatcgaaaaccctaaaacatccctggaagatgccactttgcagatcgaggagctgtggaagacactcagtgaggaggagaaactcaagtacgaggaaaaggctacaaaagatctggagcgatacaattctcaaatgaaaagggctatcgagcaagagagtcaaatgtcactgaaggacggaaggaaaaagatcaagcccacctcagcttggaacctcgcccaaaaacacaagcttaaaacctccttaagcaatcagcctaagctagacgagctgctgcagtctcagatcgaaaagaggaggagccagaatattaagatggtgcagattccgttctccatgaagaatctgaagatcaatttcaaaaagcaaaataaagttgatctagaggagaaggatgaaccttgcttgatccataaccttcgcttcccagatgcctggctgatgacctctaagaccgaaagcttctag

SEQ ID NO: 25688 - DNA, 2271 bp, Artificial Sequence
  Description of Artificial Sequence: Synthetic coding sequence
atgagcttcggcatcctgaagcccgacctgcggatcgtgttcgtgcacaacaaagcagtgatttggcaaaagtcacgagtgtccgaccataaaatggctctgatgagtgtcttaggaacggccgtgatgaataacatggagtcttttcaatatcatagcgaagaaagccagatctacctcagcgggtttttgcctaagtgcgacgccgaccacagcttcaccagcctgagcacgcctgaacgtagcttcatatttatcaattcaagacccgtgcaccagaaggatatccttaagctgattcgccaccattacaatctgaagtgcctgaaggaaagcactagactttaccctgtcttctttcttaaaatcgacgtcccaacagctgatgtagatgtgaacttgacaccggataaaagtcaagtgctactccagaacaaagagagtgtgcttatcgctctagaaaatctgatgacaacgtgctatggccccctcccaagtacaaatagctacgaaaacaataagaccgacgtatctgcagcggacatagtgctgagtaagaccgccgaaactgacgtgctgtttaataaggtggaatcatctggcaaaaactattcaaacgtcgatacaagtgtgattcctttccagaatgacatgcataacgatgagagcgggaagaacactgatgattgcttgaatcaccagataagtattggcgattttggctacggtcattgcagctctgaaatctcaaacattgataagaataccaagaacgcatttcaagatatcagtatgtcaaacgtgtcgtgggaaaacagccagaccgaatattccaagacatgtttcatcagtagcgtcaagcatacccagtccgagaatggtaacaaagaccacatcgatgaaagtggagagaacgaggaagaagctggcctggagaactcctctgagatcagcgccgacgaatggtctcggggtaacatcctgaaaaatagcgttggcgaaaacatcgaacccgtaaagattttggtaccggaaaaatccttgccttgtaaagtgagtaacaacaactaccctattcctgaacagatgaatcttaatgaggattcctgtaacaagaagtcaaacgtgatagataacaaatccggaaaggtaacggcctatgatctgctctccaatcgcgttataaaaaagcccatgtcagcgtccgctctgtttgtgcaggaccatcgtcctcaatttctgattgagaacccgaagacttctttagaggatgccactcttcagatagaagagttgtggaagactttgagtgaggaggagaaactgaaatatgaggagaaggccacaaaggatcttgaaaggtataacagccagatgaagagagcaatcgaacaggaaagtcagatgagccttaaggacggacggaagaagattaagccaacgagcgcatggaacttggcccaaaagcacaaactgaagacaagcctgagtaatcagccaaaactcgacgaattgctgcagagtcagattgaaaagcgaaggtctcagaatattaaaatggtgcagatccccttttctatgaaaaatttaaaaattaactttaagaagcagaataaagtggacctcgaagagaaggatgagccgtgtctgatacacaacctgagattccctgatgcgtggctgatgacatcgaagaccgaagtgatgcttctgaatccttatcgtgttgaggaagctctcttgttcaaaaggctgctcgagaatcacaagctccccgctgaaccactggagaagcccattatgctgaccgagtcccttttcaacggctcccattatctggatgtactttacaagatgacggccgacgaccagcgatatagtggtagtacgtacttgtcagatccacggttaaccgctaatggattcaagattaaattaattcctggggtgtccataacggaaaattaccttgagatcgaaggcatggcgaactgtcttcccttttacggggtggctgacttgaaggagatcctgaatgccatcctgaatagaaacgcgaaagaggtgtatgagtgtcgtcctcgtaaggtcataagctatctggagggcgaggctgtgaggctcagcaggcaactccccatgtacctctccaaggaagatatccaggatatcatttatagaatgaagcaccaatttggcaacgagattaaggaatgcgtgcatggcaggcctttcttccatcatttgacatacctgcccgagactacatag

SEQ ID NO: 25689 - DNA, 222 bp, Artificial Sequence
  Description of Artificial Sequence: Synthetic coding sequence
atgaagcagctgcccgccgccaccgtgcggctgctgagcagcagccagattataaccagcgtcgtcagcgtcgtaaaagaactgatagagaatagtctcgacgcaggtgcgaccagtgtagacgtgaagctcgaaaactacggttttgacaaaattgaagtgcgggacaatggagaggggatcaaagctgtggacgcgcccgtgatggcaatgaaatattag

SEQ ID NO: 25690 - DNA, 585 bp, Artificial Sequence
  Description of Artificial Sequence: Synthetic coding sequence
atgaagcagctgcccgccgccaccgtgcggctgctgagcagcagccagataattacttccgttgtgtctgtcgtcaaggagctcattgagaattccctagatgcaggcgcgacatcagttgacgtaaagcttgaaaattacggctttgacaagatcgaagttcgcgacaacggcgaggggatcaaggccgtggacgccccagtgatggctatgaaatactacacctcaaaaatcaattcccacgaggacctggaaaacctcacaacctatggctttcgaggagaggcactgggctcaatttgttgcatcgctgaagtgctgatcactaccagaactgcagccgataatttcagcacacagtacgtactggatggttctgggcacattctgtcccaaaaaccttctcacctaggacagggaacaacagttactgctctccggttatttaaaaatctgcccgtgagaaaacagttttattccacagcaaaaaaatgcaaagatgaaatcaagaagatccaggatctgctgatgagctttgggatcctgaagcctgatctgcgcatcgtgttcgtacataataaatag

SEQ ID NO: 25691 - DNA, 2271 bp, Artificial Sequence
  Description of Artificial Sequence: Synthetic coding sequence
atgagcttcggcatcctgaagcccgacctgcggatcgtgttcgtgcataataaggccgtgatctggcagaaaagcagagtgtccgatcacaagatggccctgatgtctgttctgggcacggccgtcatgaacaatatggagagctttcagtaccactctgaggagagccagatatatctgtctggtttcttgcctaagtgtgatgccgatcacagctttacctccttatcgactcctgagaggtcttttatattcataaattccaggccagtgcaccagaaggacattcttaagcttatccgtcaccactataatctgaagtgtctgaaagagtccacacgtctgtaccccgttttcttcctgaagatcgatgtgccgactgcagatgtagatgtgaatctgacccccgacaaatctcaggtgttgttacaaaataaagagagtgtgctcatcgctttggagaacttgatgacaacctgctacgggcctctgccatcaaccaactcgtatgagaataacaagaccgacgtgagcgccgctgatatagtcctgagtaagaccgctgagacagacgtcctgttcaacaaagtagagtcgagcggcaagaattactcaaatgtggatacgtcagttatcccgtttcagaacgacatgcacaatgatgaatctggaaagaatactgatgattgcctgaaccatcagattagcataggagactttggatacggtcattgttcatctgaaatcagcaatatcgacaagaataccaagaacgcctttcaagatatttccatgtctaatgtcagctgggagaactcacaaaccgagtattccaaaacatgtttcatttcatctgtaaagcacacccagtccgaaaatggaaataaagatcacattgacgaatccggagagaatgaggaagaggccggactggagaatagctcggaaatatccgccgacgaatggtcccgaggtaatatcctcaaaaacagcgtgggtgagaatattgaacccgtgaagatcctggtccccgaaaagtcactcccatgtaaagtttctaataataactacccaatccccgagcagatgaacctgaacgaagattcctgcaacaaaaagagtaatgttatcgataataaaagcggaaaagttaccgcttacgatctcctgtccaatagagtaataaagaagcctatgtccgcctccgccctttttgtgcaggatcatcgcccgcagttcctgattgaaaaccccaagacttcccttgaggacgccactctgcaaattgaagaactttggaaaacactgtcagaggaggagaagcttaagtatgaggaaaaggctactaaggacctcgaaagatataattcccagatgaagcgggcaatagagcaggagagccagatgtctttaaaagacggccgaaagaagattaagcctacaagcgcgtggaatcttgcccagaaacataagctgaagacttcgctgagtaatcaacctaagctggacgagctcctgcagtcacagattgagaaaagacggagccagaacatcaaaatggtccaaatcccattcagcatgaaaaacctgaagattaacttcaagaaacagaacaaggtggacctcgaagagaaggatgagccttgtctgatccacaacctgcgcttcccagatgcgtggttgatgacatctaagacagaagtaatgctcctgaatccttatcgggtcgaggaagcactactgttcaaaaggctgttggagaaccataagcttcccgccgagccccttgaaaaaccaatcatgttgacggaatctttgtttaatggaagtcactacctagatgtcctttacaaaatgactgctgatgaccagagatatagtggcagtacatatctttccgacccccgcctaaccgctaatgggtttaaaattaaactgatccctggcgttagtatcacagagaattatttggaaattgagggaatggccaactgcttaccattttacggagttgcagatctaaaagaaattctaaacgcaattcttaatcgcaatgctaaggaggtttacgagtgccgtcctcgtaaagtcatttcctacctggagggagaggccgtgcggctctctagacagttacctatgtacctttctaaggaagacatccaagacattatttaccgaatgaagcaccagttcggcaacgagataaaagagtgtgtacacggacgccccttctttcaccacctcacttacctgcccgagacaacttag

SEQ ID NO: 25692 - DNA, 2799 bp, Artificial Sequence
  Description of Artificial Sequence: Synthetic coding sequence
atgaagcagctgcccgccgccaccgtgcggctgctgagcagcagccaaattataacatcagttgtttcagttgttaaggagctgatagagaatagtctcgacgctggtgcgaccagtgttgatgtaaaactcgagaactacggctttgacaaaattgaagtacgggataatggcgaaggcatcaaagctgtcgatgcgcccgttatggcaatgaagtattatacttccaagatcaactcccatgaagatctggaaaatctcacgacctacggttttcggggcgaggccctgggctccatctgttgtattgcagaggtgctcatcactacaagaacagctgcagataatttttcaactcaatacgtccttgatggatccggccatatcctgtcccaaaagccatcgcacttagggcaaggtaccactgtgaccgccctgcgactctttaagaatttgcctgtgagaaaacaattctactctacggctaagaagtgcaaggacgaaattaagaagatccaggacttgttaatgagcttcggcatcctgaagccggacctgcgcatagtgtttgtgcacaataaagccgtgatctggcagaagagccgcgtcagtgaccataagatggccctcatgtccgttctggggacggccgtaatgaataatatggaaagtttccagtaccattcggaggagtctcagatctatctgtcagggttccttccaaaatgcgacgccgaccatagttttaccagcctgagcacaccagagagaagtttcatcttcattaattcccgtccggtacaccaaaaggacatcttgaagctgattaggcatcattataatctcaaatgccttaaggagagcacccggctgtatcctgtctttttcttaaagattgatgtccccacggctgatgttgatgtcaaccttactcctgacaagagccaggtacttcttcagaacaaagaaagtgtattgattgctctggagaatcttatgactacatgttatggcccattgcctagtaccaattcatatgaaaataataagactgacgttagcgcagcggatattgttctttccaaaaccgccgagaccgatgtgctgtttaacaaggtggaatcctctggaaagaactactctaatgtggacacgtctgtaatcccattccagaacgacatgcacaacgacgagagcggcaaaaataccgatgactgtctgaaccaccagatcagtatcggagactttggctatggacactgctcctctgaaattagcaacattgataagaacacgaaaaatgcttttcaggacatatccatgagcaacgtctcttgggagaactcccaaaccgaatattctaaaacatgttttatttcctcagttaagcacactcagtcggaaaacggtaacaaggatcatatagatgaatccggagaaaatgaagaagaggcaggcctggagaattccagtgaaatttcggccgacgagtggtcacgcggcaatattttgaaaaacagtgtcggagaaaacatagagcccgtgaaaatacttgttcccgagaagagcctgccctgtaaggtctctaataataattacccaatccccgagcagatgaacttaaatgaggacagctgtaacaagaagtcaaatgtcatcgacaacaagtccgggaaggtgaccgcatacgacctcttgtccaaccgtgtcattaagaagcctatgtctgcctcagcgctgttcgtccaggaccaccgcccacaattcctaattgaaaatccaaaaacaagcctcgaagacgctacattgcagatagaagaactgtggaaaacgctttccgaggaggagaagctgaaatatgaggagaaagcaactaaggatctggagagatataacagccagatgaaacgggctattgagcaggaaagtcagatgagcttgaaagatggcaggaagaagattaagccgacatccgcttggaatctggcgcaaaagcacaagttgaagacctccttatccaatcagcctaagctggatgagctgctgcagagccagatcgaaaagcgccgttcacagaacatcaagatggttcagattccgttttcaatgaaaaatttgaagattaatttcaaaaagcaaaacaaggtggacctggaagagaaagacgaaccttgcctgatccataacctgcgtttcccagatgcctggcttatgactagtaaaaccgaagtcatgctgctgaatccctatagggtggaagaggctttgctgtttaaacgcctgctcgaaaatcacaagcttcccgccgagccattagagaagcctattatgctgaccgaatcattgtttaacggcagccactatcttgacgtgttatacaagatgaccgctgacgaccaacggtactctgggtccacctatttgtcagaccccagactgaccgctaatggattcaagatcaagctgataccaggcgtctccatcactgaaaactatctggagatcgagggaatggccaattgtctgcccttctatggcgtggctgacctgaaggagattctcaacgccatcttgaaccgaaacgccaaagaggtatacgagtgcaggccaaggaaagtcatctcatatttggagggcgaagctgtacggctcagtcgccagctcccaatgtacctttccaaagaagacatccaggacattatttaccgaatgaaacatcagttcggaaacgaaatcaaagagtgtgtccatgggagacccttcttccatcatctgacctacctgcccgagaccacgtag

SEQ ID NO: 25693 - DNA, 135 bp, Artificial Sequence
  Description of Artificial Sequence: Synthetic coding sequence
atgaagcagctgcccgccgccaccgtgcggctgctgagcagcagccaaatcattacctcagttgtatctgtggtgaaggagctcatcgagaattccctagatgccggtgccacctccgttgatgtgaagctatag

SEQ ID NO: 25694 - DNA, 2313 bp, Artificial Sequence
  Description of Artificial Sequence: Synthetic coding sequence
atgaagcagctgcccgccgccaccgtgcggctgctgagcagcagccagatcatcacctccgttgtgagcgtggtgaaggagttgatcgagaattctctcgacgcaggagccacatccgttgacgtgaagcttgaaaattacggattcgacaaaattgaagtgcgcgataacggagagggcatcaaggccgttgacgcccctgttatggctatgaagtactatacttccaagatcaattctcacgaagacctggagaacctgaccacctacgggtttcgcggcgaggccctggggagcatctgttgcattgccgaggtgttgataactacccgtacagcggccgataatttctcaacgcagtatgtgcttgacggatcagggcacatcctatcccaaaaaccgtcccacctcgggcagggcaccactgtgactgcccttcgcctatttaaaaatctgcctgttcgaaagcaattctacagtacagccaaaaagtgcaaagacgaaataaaaaagatacaggatcttctcatgagcttcggtattctcaaaccagacctgagaatcgtattcgtgcataacaaggcggtgatctggcagaagtccagagtgtcagatcataagatggctctaatgtcagtgctgggcacagccgtgatgaacaacatggagtccttccagtaccactccgaggagagccagatctacctgtctgggtttctaccaaagtgcgacgccgaccactcatttacctctctgtctactccagaacggtctttcatctttattaattctcgcccagtgcatcagaaggatattctcaagttaatccggcaccactataacctgaagtgtttgaaggaaagcacgcggctctatccagtgttctttttgaaaattgacgtgcctacagccgacgtagatgtcaacctcaccccagataagtcacaggtactcctgcagaataaggagtcagtgctaatcgctcttgagaacctcatgactacctgttacggcccgctgccgagcacgaattcttatgagaataataagaccgacgtctccgccgcggacatagttttgtccaagacagctgaaaccgacgtgcttttcaacaaagtggaaagtagtggtaaaaattacagtaatgtcgatacttcagtgattcctttccaaaatgacatgcacaacgacgaatctgggaaaaacactgacgactgtttgaaccaccagataagcatcggcgacttcggatatggacactgcagctccgaaattagcaatattgacaagaataccaagaatgcttttcaggacatatcaatgtccaacgtgtcctgggagaactcccagacggagtattcgaagacctgtttcatttctagcgtcaagcatactcaaagtgaaaacgggaataaagaccatattgatgagtctggggagaacgaagaagaagccggcctagagaattcctccgaaatatcggctgacgaatggagccgcggaaacattttgaagaactcagtcggggaaaacatcgagccagttaagatcttggtcccggaaaagagcctcccttgtaaggtgagtaataataactatccaattcctgagcagatgaacctcaacgaagatagctgtaataaaaagtcaaatgtgatcgacaataagagcgggaaagtgactgcatatgaccttcttagtaatagggtgattaaaaaacctatgagcgcctccgctctgtttgtccaggaccatcggccacaatttctcattgaaaaccctaagacctctctggaggatgccacccttcagatagaggagctgtggaaaacgctctcagaggaggagaaactgaatttgtttaacggtagccactatctggacgtgctctataagatgacagcggatgatcaacgatactctggatcgacctatcttagcgatccccggttaacagcgaacgggttcaagatcaagctgattccaggcgttagcattacagagaactaccttgaaatcgagggcatggcgaattgtctgcctttttatggcgttgccgatctgaaggagattctgaacgctattctcaatcggaatgcaaaggaggtatacgaatgccgtcctcgaaaggtgatttcctatctggaaggggaggccgtgcggctgtcccggcagctgcctatgtacctctccaaggaggacatccaggacatcatctataggatgaaacatcagttcggaaatgaaataaaggagtgcgtgcacggaaggccattcttccatcacctgacctacttgccagaaacaacctag

SEQ ID NO: 25695 - DNA, 2682 bp, Artificial Sequence
  Description of Artificial Sequence: Synthetic coding sequence
atgaagcagctgcccgccgccaccgtgcggctgctgagcagcagccaaataatcactagtgtcgtgtcagtggtgaaagagctcattgaaaactctcttgacgccggggccacaagcgtggatgtgaagctagaaaattacggtttcgataagattgaagtgcgcgacaatggagagggaatcaaagcggtagatgcccctgtgatggctatgaaatattacacaagcaaaattaacagccatgaggatctcgagaacctgactacctatgggttccgcggagaggcgctgggatcgatttgctgtattgcagaggtactgatcaccacaaggacggccgcagacaacttttctacgcagtacgtattggatgggtcggggcacatcctcagccagaagccatctcatctggggcaaggtaccaccgtcactgccctgagactgttcaagaacctaccggtcagaaagcaattctacagcacagcgaaaaagtgtaaggatgagatcaaaaagattcaagatctcctgatgtcatttgggatcttgaaacctgacctaagaattgtgttcgttcataataaaatctacctcagtgggtttctccctaaatgtgacgccgaccactcttttacatccttgtctactcctgagcgttcttttatattcatcaatagccgccctgtgcatcagaaagatatcttgaagcttatccgtcatcattataacctgaagtgtctcaaggagagcacacggctgtacccagttttctttttaaaaattgatgtccctaccgcggatgtggacgtcaatcttacacctgataaatcgcaggtgctcctgcagaataaagagtctgtgttgattgctctggagaacctgatgactacatgctacggacctctgccatcaacaaacagctacgaaaacaacaagacagatgtatccgctgctgacatagtgctgagcaaaacagccgaaacagacgttctttttaacaaggtcgagtcatctggaaaaaactattcaaatgtcgacacgtcagttattcctttccagaatgatatgcataacgacgagtccggtaaaaacaccgatgactgtctgaaccaccagatatccataggcgattttggctacgggcattgctccagcgagatttctaacattgataaaaacacaaaaaatgcctttcaggatatctccatgagcaacgtaagttgggaaaattcacagacggagtattcaaagacctgcttcatctcaagcgtgaagcacacccagagtgaaaacggtaataaagatcatattgatgagagcggcgaaaacgaagaagaagctgggttggagaacagttctgaaatcagtgccgatgaatggtctcggggtaacatattgaaaaattctgtgggcgaaaatattgagcccgttaaaatcctagttcccgagaaatcgctgccctgcaaggtgtctaataacaactatcctatacccgagcaaatgaatttgaacgaagatagttgtaataagaaatcaaacgtgatcgataataagagtgggaaggtcacggcgtacgatttactgagcaatagggtcattaagaagcccatgagtgcctcagccttgtttgtgcaagaccacagaccacagttcctgatcgagaatcctaagacatccttagaagacgctacccttcagatcgaggaactttggaaaacactatccgaggaggaaaaactcaaatacgaagaaaaagcgaccaaagatctggagcgttacaacagtcagatgaaacgggccattgaacaggagtcacagatgagcctgaaggatggacggaaaaaaataaagccaaccagcgcttggaacctggcccagaagcataagctcaaaacctctctctctaaccaacctaaactagatgaactgcttcagtcacaaatagaaaagcgacgctctcaaaacattaaaatggtccagatccccttctccatgaagaacctgaagattaactttaagaaacaaaataaggtggacttggaagaaaaggatgagccttgcctgatccacaacctccgcttccctgacgcctggctgatgacctcaaaaaccgaggtgatgctactgaacccatatcgcgttgaggaggccctgcttttcaaacggcttctcgaaaaccacaagctccccgctgagcctctcgaaaagcctatcatgcttaccgaaagcctttttaatggctctcactaccttgatgtgctttacaagatgactgctgacgaccaacgttactctggatccacatacctctctgaccctaggctgactgctaacggtttcaagatcaaactgatccctggagtgtcaataacagaaaactatctggaaatagagggtatggcaaattgtttgcccttctatggagtagcagatctgaaagaaatcctgaacgccattttgaaccgcaacgcaaaggaggtctatgagtgccgcccacgaaaagtcatctcgtatctagagggagaggccgtgaggttaagccgccagctgcccatgtatctcagtaaagaggatattcaagatatcatctatcgtatgaaacatcagtttggcaatgagatcaaagaatgtgttcatgggagaccttttttccaccacttgacctacctgccagagacaacatag

SEQ ID NO: 25696 - DNA, 2589 bp, Artificial Sequence
  Description of Artificial Sequence: Synthetic coding sequence
atggagcgggccgagagcagcagcaccgagcccgccaaggccatcaaaccgatcgacagaaagtccgttcaccagatttgctccggccaggtcgtcttaagcttgtcgaccgcagttaaggaattggtagaaaactccctcgatgcgggcgccactaatatcgaccttaagttgaaagactacggggttgatctgatcgaggtgtcagataatggttgtggagtggaggaggagaacttcgaggggttgactctcaagcaccatactagtaaaattcaggagttcgctgacttgacgcaggttgagaccttcgggttccggggggaggctctttcatcactgtgtgctctgtccgatgtgacgatcagcacgtgtcatgcgtctgcgaaagtgggcacaagactgatgtttgatcataacggcaaaatcattcagaaaactccataccctaggcctaggggaacaactgtgagcgtccagcagctctttagcaccctcccagtgcggcataaagagtttcaaaggaacattaagaaagagtacgcaaagatggtccaggtattgcatgcatactgtatcatcagtgctgggataagggtgagctgcaccaatcaactcggccagggcaaacggcagccagtcgtatgtaccggagggtctcctagcattaaggaaaatatcgggtcagtttttgggcagaagcagctccagtcactaattccatttgtccagctgcctcccagtgattcagtgtgcgaggagtacggcctctcttgctccgatgctcttcacaacctattctacatttctgggtttatatctcaatgtactcatggtgtgggccggtcctccaccgataggcagttctttttcataaaccgcagaccttgtgatccagcaaaggtgtgtcgcctggtcaacgaggtctaccacatgtacaatagacatcaatacccgtttgttgtgctgaacatctccgtggactcagaatgcgtggacattaacgtaacccccgataagcggcagattttgctgcaggaagaaaaactccttctcgcggtgctgaagaccagcctgatcggcatgttcgactctgacgtgaacaagctgaatgtctcacagcaaccacttttggacgtagaggggaatcttatcaagatgcacgctgccgatttagaaaagcccatggtggaaaaacaggaccagagcccatccctacggaccggagaggaaaagaaggacgttagcatcagtcgcctcagggaggccttcagcctccgccacacaacggagaataaaccccactcccctaaaactccggagccccgtagatctccactgggccagaaacgtgggatgctctcatcctctacctctggtgcaattagcgataagggtgttctgagacctcaaaaagaggccgtaagcagctcccacggaccatccgaccccaccgatagggcagaagtggaaaaggactccggccatggcagcaccagtgtagactccgaaggtttctccattcccgacactggtagtcactgtagtagcgagtacgccgccagtagccctggggacagaggatcacaagaacatgtggacagtcaagagaaagcgcccaaaaccgacgactccttttctgatgtcgattgtcactctaatcaggaagatacggggtgtaaatttcgggttctaccccagcctaccaatctcgccactcctaacacaaaacgcttcaaaaaggaggaaatactaagtagctctgacatctgccagaaactggtcaatacgcaggatatgtccgcctcacaggtagatgtggctgtgaagattaacaagaaagtcgtgcctttagatttttctatgtcatcacttgccaagcggatcaaacaactacatcacgaagctcagcagtccgagggcgaacagaattatcgaaaattccgcgcaaaaatctgccccggcgagaaccaggccgctgaggacgaactccgtaaggaaatttccaaaacgatgttcgcagaaatggaaatcatcggccagtttaacttaggctttataatcactaagctgaacgaggacattttcattgtggaccagcacgccaccgatgagaaatacaatttcgaaatgctgcagcagcatactgtcctgcagggacaacgcctgattgcccctcagacgcttaatcttacggctgttaacgaggccgtgcttatcgaaaatctggagattttcagaaagaacggctttgatttcgtcattgatgagaatgctccagtgaccgagagagcaaaattgatatctttgcccaccagcaagaattggacattcggacctcaggacgttgacgaacttattttcatgctgtcagattctccaggggtcatgtgtagaccttctcgggtgaaacagatgttcgcctcccgagcctgtagaaagtcagttatgatcggtactgcgttgaacacatcagagatgaagaaattaatcacacacatgggcgagatggatcatccctggaactgccctcacggaaggcccacaatgcgacatattgcaaaccttggcgtgatcagccagaactag

SEQ ID NO: 25697 - DNA, 1386 bp, Artificial Sequence
  Description of Artificial Sequence: Synthetic coding sequence
atggagcgggccgagagcagcagcaccgagcccgccaaggccatcaaacctattgacaggaagtccgtgcatcagatttgctcaggccaggttgttttgtctctctctactgcggttaaggaacttgtggagaactccctggatgcaggcgccaccaacatagacctaaaactgaaagattacggggttgatctgatagaggtgtccgacaacggatgtggcgtcgaagaagagaattttgaagggctcaccttgaagcaccacacttcgaagatacaggagttcgcagacttgacgcaggtggagacgtttggatttcgcggggaagccctgtcgagcttatgtgcgctgtcagacgtgaccatttcaacatgtcacgcgtctgccaaggttggaacacggcttatgttcgatcataatgggaagatcatccaaaaaaccccctacccaagaccacgtggtacaaccgtaagcgtccagcagctcttctccaccctccctgttcggcacaaggaattccagagaaatattaaaaaagagtatgcgaaaatggttcaggtactgcatgcctactgcatcatcagtgccggtatccgggtgtcgtgcaccaatcagctgggccaaggcaaacgccaaccagtggtttgtacgggcggctcccccagcattaaagagaatatcggctccgtctttgggcaaaaacagctacagagccttattccctttgttcagctgcctccctccgattccgtttgcgaggagtacgggctgtcctgctccgatgccctgcataatctcttttataagaccatgtttgcagagatggagataattggccagtttaatctgggcttcattattaccaagctaaatgaggatattttcatcgtggatcaacatgctaccgacgagaaatacaattttgagatgcttcagcagcacactgtgttgcaaggccaaaggctcatagcaccacagacccttaacctgaccgcagtgaacgaagccgtactgattgaaaacctggagatattccgaaagaacggattcgatttcgttatcgatgagaacgcacctgtaacagagcgagccaaactgatctccctgcctacaagcaagaattggacgttcgggccacaagatgtcgacgagctgatatttatgctcagtgattcaccgggagtcatgtgtcgaccctcaagggtgaagcagatgttcgcctctcgagcctgcagaaaaagtgtgatgattggtacggctctcaacacatccgagatgaagaaactcataactcacatgggagagatggaccacccgtggaattgtcctcacgggaggcccaccatgcgccacatcgcaaatcttggtgtaattagtcagaactag

SEQ ID NO: 25698 - DNA, 2448 bp, Artificial Sequence
  Description of Artificial Sequence: Synthetic coding sequence
atggagcgggccgagagcagccggagcaagctgaaggactacggcgttgacctcatcgaggtgtccgacaacggatgcggcgtggaggaggagaattttgaaggtctgactctgaagcatcatacttcgaagatccaagaatttgcagatctgactcaggtggaaacattcgggttcagaggtgaagctttgagtagcctgtgtgcactctccgatgtgacaataagtacatgccacgcctcggcaaaggtgggaactcgcctcatgttcgaccataacgggaaaatcattcagaagacgccgtacccgcgaccgcggggaacaaccgtctccgtgcagcagctgttctctacgcttccagtccgccataaggaattccagcggaacatcaagaaagagtacgccaagatggtccaagtgctccatgcctattgcatcatcagtgcaggcatccgggtttcctgtacgaatcaactgggccaaggcaaacggcagccggtggtctgtactggcggctccccttcaatcaaagagaacattggctcagttttcggacagaagcagttgcagtcattgatcccatttgtgcaattgcctccatctgattcggtttgtgaggagtatggactgagttgcagtgatgcattacataacctcttctacatctcaggtttcatatcacagtgcacacacggtgttggaagaagttccaccgatcgccagttcttttttataaacagaaggccgtgtgatcccgcgaaagtctgccgcctcgtgaatgaggtgtaccacatgtacaatcggcaccagtatccattcgtagtacttaatataagtgtcgattccgaatgcgtcgatattaatgttacacccgataaaaggcagatactccttcaagaggaaaaactgcttcttgcagtccttaagacatctctgattggaatgtttgattcagatgtgaacaagctgaacgtgtctcagcagccgctgctcgatgtggaaggtaacctgatcaaaatgcacgcagccgatttggagaagcctatggttgagaaacaagaccaaagccccagtctaagaacaggcgaggaaaagaaagacgtgagtatttcacgattgcgcgaggcattttcattaagacacacgactgaaaacaagccgcactctcctaagacgccggaacccaggcgcagcccacttgggcagaaaaggggcatgttatcctccagtacatcaggcgcaatcagtgataaaggtgtcctacggccccaaaaggaggctgtttccagtagccacggacccagcgaccccactgatcgcgctgaagtcgaaaaagacagcggccacggcagcacttccgtggactccgagggattcagcataccagacaccggttcgcattgctcctcggagtacgctgcttcgagcccaggcgatcgtgggtcccaagaacatgtcgacagtcaggagaaagccccgaagacagatgacagctttagcgatgtggattgccattcgaaccaagaagacaccggctgtaagttcagagttctccctcagccaacgaatctcgcaacccctaatacaaaaagatttaagaaggaggaaatcttatctagctcagatatatgtcagaagcttgtgaatacacaggatatgtcagcatcgcaggtcgacgtggcagtcaagattaacaagaaggtggtgccactggacttttccatgtcttccctggcgaagaggatcaagcagctccaccatgaggcccaacagtctgaaggcgagcagaactatcgcaaattcagggccaagatctgccctggggagaaccaggcggcagaagatgaattgcggaaagaaataagcaaaaccatgtttgccgagatggagataatcggccagtttaacctaggatttatcataactaaacttaacgaagacatttttatcgtggaccaacatgcaactgacgagaagtataactttgaaatgttgcagcagcacaccgtgctccaaggacagaggctaatcgcgcctcaaaccctcaatctgactgctgtgaacgaagctgtccttatcgaaaatctggagatatttaggaagaatggattcgacttcgttatcgacgagaatgccccagtcacggaaagagctaagcttatttctctacccacctccaaaaattggacctttgggccccaggacgttgacgagctaattttcatgttgtctgactcccctggcgtgatgtgcagaccctcccgcgtcaaacagatgttcgcatctcgtgcatgtcgaaagtctgtgatgatcggcacggctctaaacacttcagaaatgaagaaactgatcacccatatgggcgaaatggaccacccctggaactgcccacacggccgccccacaatgcggcacatcgccaacctgggcgtgatcagccaaaattag

SEQ ID NO: 25699 - DNA, 1719 bp, Artificial Sequence
  Description of Artificial Sequence: Synthetic coding sequence
atggagcgggccgagagcagcagcaccgagcccgccaaggccatcaagccaatcgacaggaaatccgtgcaccaaatctgctccggacaggtggtgctatctctctctacggccgtcaaggagctggtggagaacagcctcgacgccggagccaccaacatcgacttgaagctcaaagattatggtgttgacctgatcgaggtgtctgataatggctgtggggtggaggaagagaactttgaagggctgacactaaaacatcatactagtaagatacaggaatttgcagacttaactcaagtcgaaactttcggattccgtggtgaggcactgagtagtctctgtgctctcagtgacgttaccattagcacttgtcacgccagcgcaaaggttggcactagacttatgtttgaccacaacggcaagatcattcagaaaactccgtacccccgcccacggggcactaccgtgagtgtgcagcagttattttcgaccttgccagtgcgtcataaggagttccagcggaacattaagaaggagtatgctaaaatggtacaggttctgcatgcttattgtattatatccgctggcatccgagtatcctgcaccaaccaattaggtcagggcaagcgtcaacccgtggtgtgcacaggcggctccccctccataaaagagaacatcggctccgtgttcggacaaaaacaattgcaatccctgattccattcgttcagttgcccccttccgactcggtatgtgaagagtatggattgtcctgttctgacgcactgcacaacctgttttatatctcgggctttattagccaatgcacgcatggggtaggcaggagcagtactgaccgccagtttttctttattaaccgtagaccctgtgatccagctaaagtctgcaggctggtgaatgaagtgtatcacatgtataatcggcaccagtacccatttgtcgtcctgaacatttcagtggattcagagtgtgtcgatataaacgtcactcccgacaagaggcagatccttctccaagaagagaaacttctattggcagtcttaaaaactagtttgataggaatgttcgactccgatgttaacaagcttaatgtgagccagcagccgctgctcgacgtagagggcaacctcatcaagatgcatgctgcagatctggagaagcccatggttgaaaaacaggaccagagtccatccctgcgtacaggagaggaaaagaaagacgtgtcaatctcccgccttcgggaggcattctcgcttcggcacaccacagaaaacaaacctcatagtcctaagaccccggaacccagacgttcccccctgggccaaaaaagaggcatgctaagctccagcacatcgggggccatctcagataaaggggtgcttcggccccagaaggaagccgtctcaagttcccacggtccttccgacccgacagaccgcgccgaggttgagaaggattctgggcacggctctacgtccgtggattccgaagggtttagcataccagacactggctcccattgttcgagcgaatacgcagcctcttctcctggggaccgtgggagccaagagcacgtggattcacaagagaaagcacccaagacggacgacagcttctcagacgtcgactgtcacagtaaccaggaagataccggtcttaagaccggaccgtccgatccccgcacttctatgaactag

SEQ ID NO: 25700 - DNA, 2271 bp, Artificial Sequence
  Description of Artificial Sequence: Synthetic coding sequence
atgtggggccggcggcggaagctgcggcggctgaacgacgtgaccatttccacatgccatgcctcagcgaaagtcggcacccggctcatgttcgaccacaatggaaaaatcatacaaaagactccctatccaagaccaagaggaaccacagtctccgtacaacagcttttcagcacgcttccagtaagacacaaggaatttcagaggaatataaagaaagagtacgccaagatggtacaggtgttgcatgcttactgtataatttccgctgggatcagggtatcttgcactaaccagttaggtcagggcaagcggcagcccgtggtgtgtaccgggggaagtccaagtataaaggagaacatcggatcggtcttcggacaaaaacagttacagtctctgatcccatttgtgcagctgccgccttccgattccgtttgcgaagaatatggattgagttgtagcgacgcccttcacaacctgttttacattagtggctttatctcccagtgcacacatggcgtgggccggtccagtactgaccgccaatttttttttattaatcgccgcccatgcgaccctgccaaggtgtgcaggctggtgaatgaggtataccatatgtataaccgacatcaatacccattcgttgtgctaaatatctccgtggactctgagtgcgtagacattaacgtgacgcccgataagcgccaaattttgctgcaggaagagaagctactcctggccgtgctgaagaccagcctgattgggatgttcgactccgacgtcaataaattaaacgtgtcgcaacagcccctcctggacgtagaaggcaacctgattaaaatgcacgccgccgatctggagaagcccatggtggaaaagcaggatcagtcccctagtctccgcacaggagaagagaaaaaagacgtctccatctctagactccgcgaagccttctcacttcgccacacaacagagaacaaaccacacagcccaaagactcccgagcccagaaggtctcctctaggccagaaaagaggtatgctgtctagctcaacctcaggcgccattagtgataagggggtgttacgcccacagaaggaggcagtctccagtagtcacggcccctctgacccaactgacagggctgaggtggagaaggatagcggccacggctctacatctgtggatagcgaaggcttttccattcccgatactgggagccactgctcaagtgaatatgctgctagctcacccggtgatcgtggatcccaagagcatgttgattcacaggagaaggctcccaagacagacgacagcttctccgacgttgattgtcactccaatcaggaggatacgggatgtaaattccgggtgctgccacagccaacaaatctcgccacacctaacacaaagagattcaagaaggaggaaatcctgagctcaagcgacatctgccagaagctggtgaacacccaggacatgtcggcctctcaggtggatgtggctgttaagattaataagaaagtcgtgccactcgatttcagtatgagctccctcgcgaagaggataaagcagctccaccacgaggctcagcagtcagaaggtgaacagaactaccggaagttccgcgccaagatatgcccaggcgaaaatcaagcagcggaggatgagctgcgcaaagagatcagtaaaacaatgttcgccgagatggaaattatcggccagttcaacctcgggtttataataacaaaactgaacgaagacattttcattgttgaccaacatgccactgacgagaagtacaattttgagatgctgcagcagcacacggttctccaagggcagagactcatcgctccccagactctgaaccttacagcagtcaacgaggccgtgcttatcgagaatctggagatttttagaaaaaatgggtttgacttcgtaatagatgagaacgcccctgtcacagagcgggcgaaactgataagcctaccaacgagcaagaattggactttcgggcctcaggatgtcgatgagctcatcttcatgctatccgacagccccggcgtaatgtgccggccgtccagggtcaaacagatgttcgccagccgggcgtgtaggaaatctgttatgattgggactgcattgaatacttcagagatgaaaaagctgatcacacacatgggggaaatggatcatccatggaactgccctcacggaaggccgaccatgcggcacatcgccaatttaggggtcatctcacagaactag

SEQ ID NO: 25701 - DNA, 1812 bp, Artificial Sequence
  Description of Artificial Sequence: Synthetic coding sequence
atgagcgccgccgtgaccgccggcaagctggcccgggcccccgccgaccccggaaaggccggagtgccaggtgtggccgctcctggagcccctgccgcagcccccccagccaaagagatcccagaagttctagttgacccccggtcgcggcgtcggtatgttagaggacgcttcctaggaaagggagggtttgcgaaatgtttcgaaatctccgacgcagacacaaaggaggtgtttgctggtaaaatcgttccaaaatcattacttctcaaacctcaccagagagaaaagatgagcatggaaatttctatccaccgctcactcgcgcaccagcatgtcgtggggtttcacggcttctttgaagacaacgacttcgtcttcgttgtgttagaactgtgccgaagacgctcactgctggaactgcataagagacgaaaagctctgacagagcctgaagcacgctactacttgcggcaaatcgttctaggatgccagtacttacatcgtaaccgggtcatccacagggatctaaaacttggtaacctgtttctcaatgaggacctcgaggttaagatcggggactttggtctggcgaccaaagtcgaatatgatggcgagcgtaaaaagaccctctgcggtacaccaaactacattgctccagaagtgctgagtaagaaaggtcattcctttgaagtagatgtctggtccatcgggtgcatcatgtatacccttcttgtcggaaagccacctttcgaaacttcctgtctgaaagagacgtatcttcggatcaaaaaaaatgaatactccatcccaaaacacatcaatccagtggctgcgagcctcatccagaaaatgctgcagaccgaccccactgcaagaccaaccatcaatgaactattgaacgatgagttcttcacatctggctacatccccgctcgactgcccataacttgtctcacaatacccccgcgcttctccattgctccttctagtcttgacccatcaaaccggaagcccttgacagttctaaacaaggggctggagaacccattgcccgaaagacccagagagaaagaggagcccgtggttagggagaccggtgaagtggttgactgccacctatcggatatgctgcagcagctccatagtgtcaatgcttctaagccatccgaaagagggcttgtgcggcaagaagaagcggaggacccggcctgtattccaatattttgggtcagcaaatgggtggattatagcgataagtatggcctcgggtaccagttatgtgataacagtgtgggcgtgctgttcaatgacagtacccggcttatcctgtataatgacggggattctctccagtacatagagagggacggcactgagtcctatctgaccgtttcttcccatcccaatagcctcatgaagaagataactctgctgaagtattttcgcaactacatgtctgagcatctgctcaaagctggcgctaatataactccccgggagggggatgagttggctcgcctgccgtatctacgaacctggttccggacccgaagcgctattattttacacttgtcaaatgggtctgtccagatcaactttttccaggatcatacaaagttaatcctgtgtccgcttatggccgccgttacctatattgatgaaaagagggatttccgaacttacaggctctcgctgctggaagagtatggctgctgcaaggagcttgcgagtaggctgcggtacgcccgtacaatggtcgacaagctgctaagcagtcgctccgcaagtaatcggctgaaggcctcctag

SEQ ID NO: 25702 - DNA, 744 bp, Artificial Sequence
  Description of Artificial Sequence: Synthetic coding sequence
atgagcgccgccgtgaccgccggcaagctggcccgggcccccgccgacccaggtaaggctggggtgccaggtgttgctgctcctggcgcacctgccgccgctcctcctgctaaagaaatcccagaggttctggtggatccccgctcgagaaggcgctatgtgcgagggagattcctgggcaagggaggttttgctaagtgttttgaaatcagcgatgccgacacaaaggaagtgtttgccggcaagattgtgccaaagagccttcttctgaaaccccaccaacgtgaaaagatgtcaatggaaatctcaattcataggtccctggctcaccagcatgtggttgggttccacggtttctttgaggacaacgattttgttttcgtggtgctggagctctgccggcgccgcagtttattagagctgcataagcgacgaaaggcattaacagagcccgaggctcggtattaccttaggcaaatcgtgctcggatgccagtacttacatcgtaaccgagtgattcatcgcgacctcaagttgggaaatctgtttctgaatgaagatctggaggtgaaaattggagattttgggctcgctaccaaggtcgaatatgacggcgaaagaaagaaaacattgtgcgggacaccaaactacatcgcacccgccgtgccatgtttgcaatgcgcccctcaaccccggtggctggggcgggccgctagctccctgcaggtaggggtcgccgtatag

SEQ ID NO: 25703 - DNA, 1521 bp, Artificial Sequence
  Description of Artificial Sequence: Synthetic coding sequence
atgagcatggagatcagcatccaccggagcctggcccaccagcacgtggtcgggttccacgggtttttcgaggacaatgactttgtatttgttgtgttagagctgtgtcgccggaggagtttgctggagctccataaacgcaggaaggctttaaccgagcccgaggccagatattatctccgccagatcgtgcttggctgtcagtatttacatcgaaatagggtgattcatcgggacctcaaacttggtaatctgtttttgaacgaggatctcgaagtgaaaatcggtgattttggactggctaccaaggtggagtatgatggcgaaagaaagaagactttatgtggaacaccgaactatattgctccagaagtcctgagcaaaaaagggcactccttcgaggtggacgtatggagtatcggctgtataatgtacacacttctggtcgggaagccgcctttcgaaacctcctgcttgaaagagacatatctaaggattaaaaagaatgaatactcaatcccaaagcacattaatcctgttgcagcctctctgattcagaagatgttgcagacagaccctactgccaggcctaccataaatgaactgcttaacgacgaattttttacctctggctacataccggcccgtcttccgatcacttgtttaactattcccccccgattttcgattgctccctcgtcactcgacccctcaaatcggaaacccttaaccgttctgaacaagggtctggaaaacccactgcccgagagaccacgggaaaaagaggagccagtagtcagagagaccggggaggtggtggactgtcacttgtccgacatgcttcagcagcttcactcagttaacgcaagcaagccaagcgagcggggcctcgtccggcaagaagaagcggaagaccccgcctgtatccccattttctgggtctctaaatgggtggactatagcgataaatacggcctgggatatcagttgtgtgacaactcagtaggcgtgcttttcaatgattccacccgtcttatcttatacaacgatggggattccctccagtacattgagagggacggcactgagagctatttaactgtgtctagccatcctaatagtcttatgaaaaaaataaccctactgaagtattttcggaactatatgtctgagcaccttctgaaagcaggagcaaatatcacaccccgggagggcgacgaattagcacgactgccctatctccgcacgtggttccgtaccagatctgccatcattctgcatttatctaacggaagcgtccagattaacttctttcaagatcacacaaagctgattttgtgcccgttgatggccgcagtcacatacatcgatgagaaacgggacttccgaacataccggctgtccctgcttgaggagtatggctgctgtaaggagttggcttcacggctgcgctacgcaagaaccatggtggataagctgttgtccagcaggtctgcttccaatcgcttgaaggccagctag

SEQ ID NO: 25704 - DNA, 1941 bp, Artificial Sequence
  Description of Artificial Sequence: Synthetic coding sequence
atggagcccgccgccggcttcctgagcccccggcccttccagcgggcggctgcggcacctgcgccgccagcaggcccggggccccctccttccgccctaagagggccagagttggagatgctagctgggctgcccacatctgatccgggaagattgatcacagacccaagatccgggagaacctacctcaaagggaggttgttgggtaaagggggcttcgcacgttgttatgaggctaccgacaccgaaacaggctccgcatacgcggtgaaagtgattccacagtccagagtagctaagccacatcagcgagagaaaattctgaatgaaatcgagttgcatagagacctgcaacaccgccatatcgtgcgattctcgcaccatttcgaggatgccgacaatatctacatttttcttgaactatgctccaggaaatcactggcacacatatggaaagccagacacaccctcctggagcctgaggtgagatactatcttcggcaaatcctctccggactcaaatatttgcaccagcgtggcatcctgcacagagacctcaagctcggtaatttttttatcactgagaacatggaactcaaggtgggagacttcggcttggctgcaaggttggagccaccggagcagcgcaagaaaactatctgcggcacccccaattacgttgcaccagaggtcctgctgaggcaaggccacggccctgaggctgatgtgtggagcttgggatgtgtaatgtacactttgctttgcggaagcccaccattcgaaaccgctgacctaaaggagacctatagatgtatcaagcaggtgcactacaccctcccagcatcactgagcctgcctgcaagacaactcttagccgccatcctccgcgcaagtcccagggaccggcctagcatcgatcagattctccggcatgacttcttcaccaaggggtacacgccggatcggcttccaatctcatcttgtgtaaccgtaccagacctgactccgccaaatcctgccaggtctcttttcgcaaaggtgaccaagagcctgtttggtcggaagaaaaaaagtaaaaatcatgcccaggaaagagatgaggtgtccgggctagtctccgggttgatgaggacatccgtggggcaccaggacgccaggcccgaggcaccggctgcaagcggaccagcccctgtgagcctggttgagacagcacccgaggattctagccctcgcggaacactggcatcctctggggatggcttcgaggagggcctgaccgtagccacagtggtcgaatctgccctgtgcgcactgaggaattgtatcgcgtttatgccccctgccgagcagaatcctgctcccctggctcaacccgaaccgctggtttgggtaagtaaatgggtggactacagcaacaaattcggcttcggttaccagttgtcatcaagacgggttgcggtgttgtttaatgatggtacccacatggcattgtcagccaaccgcaagaccgtacattataaccctacttccaccaaacacttctccttcagcgtgggggctgtgccccgtgcactgcaaccacaactgggtattctgcgctactttgcaagttacatggaacagcaccttatgaaggggggggacctcccaagcgtggaagaggttgaggtcccagcccctccactgttgctgcagtgggtgaagacggatcaagccctgctcatgctgttctctgatggcactgtgcaagttaacttttacggcgatcataccaagctgatcttgtctggatgggaacccctgctggtaaccttcgtcgcccggaacagatccgcatgcacctacctcgccagccaccttagacagctcggatgttcaccagatctgcggcagcgactacgctacgctcttaggcttctgagagatcgttccccggcttag

SEQ ID NO: 25705 - DNA, 1866 bp, Artificial Sequence
  Description of Artificial Sequence: Synthetic coding sequence
agccggcagcggcacgcccggcccggccccggcggcaccgagaagcctgggcctcggtgcgacgcccccgctgcctggtccctgcctcctgtctcatgcctccgtacttacctgaagggtaggctattggggaagggcgggttcgctcggtgctatgaagcgacagataccgaaaccgggtcagcctacgcggtaaaggtgataccccagtcgagagtggcgaaacctcatcaacgcgaaaagatcctgaacgagatagaactccatcgtgacctgcagcatagacatatcgtgcgcttctctcaccacttcgaggacgccgataatatatatatctttctagaattatgctcacggaagtctctggcacatatttggaaggctcgccacacacttctggaaccagaagtgcgatattacctgaggcagatccttagtggacttaagtacctccatcagcggggcatattacaccgagaccttaagctgggaaactttttcatcactgagaacatggagctgaaagtgggcgactttggattggccgccagattggagcctcccgagcaaagaaaaaagactatttgtgggacccctaactacgtggcccctgaggtgttgctaaggcagggacacggaccagaagcagacgtttggtctcttggttgcgttatgtacactctcctttgcggctcgccccccttcgaaacggcagacctcaaagaaacttacaggtgtattaagcaggtgcattatacgttgccagcttccttatctctgccagcaagacagctgctcgcggccatactgcgtgccagtcccagggataggccttcaattgaccaaatactcaggcacgacttctttactaagggatacacccctgaccgcctccccatcagcagctgtgttaccgttcccgatctaaccccccccaaccctgcacggagcctgtttgccaaagtcacgaagagtctattcgggaggaaaaagaagagtaagaaccacgcgcaagagcgcgacgaggtgagcgggctggtatccggactgatgaggactagcgtggggcaccaggacgcccgaccagaagctcctgcagcctcaggacctgcacctgtgtcattggtagagaccgcacccgaggattcatctccgcgcggcacattggccagctccggtgatggatttgaagagggactgaccgtggctactgtggttgagtccgccctgtgcgcactgcgcaactgcatcgcattcatgccgccagccgagcagaaccccgcccctctcgcgcagccagagccattggtctgggtgagtaaatgggtagactactccaataagttcggtttcggctaccagctgagctcccgccgcgtcgccgtcctgtttaatgacgggactcacatggcactttcagcaaacaggaaaacagtgcactataatccaacctcaaccaagcattttagcttcagcgttggagctgtgccgagggccctgcagccccagttgggaattttgcggtatttcgcatcctatatggagcagcatctaatgaaggggggggacctcccatccgtggaggaagttgaggtgccagccccacctttattgttgcaatgggttaagactgaccaggctttgctaatgctctttagcgacggcaccgtgcaagttaacttttatggcgatcataccaaactgatactgtcaggatgggagcccttactagtgactttcgttgcaagaaatcgctctgcttgtacatatctggctagccacctccgacagctcggctgctcacccgatcttcggcagaggttaagatatgcccttcggctgctgagggacaggagtcctgcctag

SEQ ID NO: 25706 - DNA, 2913 bp, Artificial Sequence
  Description of Artificial Sequence: Synthetic coding sequence
atggccacctgcatcggcgagaagatcgaggacttcaaggtgggcaacctccttggaaaaggatcttttgcgggagtctatcgcgccgaaagcatccacactggattggaggttgccatcaaaatgattgataaaaaggcaatgtataaggctggcatggtccagcgcgtgcaaaacgaggtaaaaatccactgtcagctcaagcacccaagcattctggaactttacaattactttgaggatagcaactatgtctatcttgtcctcgaaatgtgtcataatggtgagatgaataggtatcttaagaatcgagtgaagcctttttctgagaatgaagcccgtcatttcatgcaccaaattatcaccgggatgttgtatctgcactctcacggcatactgcatcgcgatctcacattgtctaatctcctcctgacccggaacatgaacatcaaaatcgcagatttcggcctggccacccagctgaaaatgccacacgaaaagcactacactttatgcggaacacccaattacatcagccctgagattgctacccggagtgcccacggtctggaatccgatgtttggtccctgggctgtatgttctacaccttgttgatcggtcgcccaccgtttgacacagacacggtgaagaacacactgaataaggtcgtcctggctgactacgagatgccatccttcttgtctatcgaggcaaaggacctgatccatcagctgcttaggagaaaccctgctgataggctgtccttgagctcagtgctggaccatccttttatgagcagaaactccagcaccaaatccaaggacttaggtactgttgaggactctatcgacagtggccatgctaccatcagcaccgccattacggcatctagttctacgagtatttccggctctcttttcgacaagcgacgcttattaattggccaacctctgccgaataagatgaccgtttttcccaagaacaagagcagtaccgacttttcttccagcggcgatggaaacagtttctatactcagtggggtaaccaggaaaccagtaactccggacgagggcgggtgattcaggacgctgaagagcggccccacagcagataccttcggagggcctattcctctgatcgctcaggcacatccaactcccagtcacaggccaaaacttacacaatggagaggtgccattctgctgaaatgctgtcagtttccaaacgaagcggagggggcgagaacgaggagcgctattcaccaactgacaacaacgctaacatttttaacttcttcaaagaaaaaaccagctcctcgtcaggtagcttcgaacgccccgataataatcaggcactgtccaaccatctgtgccctggcaagactccgttcccattcgctgatccaacgccccagacagagactgttcagcaatggttcggaaatctgcagatcaatgcccacttgcggaagacgactgagtacgactcaattagcccaaatagagactttcaaggacaccccgacctgcagaaagatacctcaaagaacgcctggaccgacaccaaggtcaaaaaaaactctgacgccagcgataacgcccactccgtaaaacagcagaatacaatgaagtacatgaccgcactgcattccaaaccagaaatcattcagcaggagtgtgtctttggtagcgatcccctttcagaacagagcaagacgcggggtatggaacccccctgggggtaccagaacaggacgctacgttctatcaccagccccctggtggctcacagactgaagccaatccgacagaaaactaagaaagccgtagtctctatcctcgattcagaggaggtgtgtgttgagctagtaaaggaatacgccagccaggaatatgtcaaggaggtactccagatctcctctgacggcaacaccatcaccatctattacccgaacgggggccgcggcttcccacttgccgatcgaccgccctctcccacggataacatctcaaggtattccttcgacaacttgcctgaaaaatactggcgcaagtaccagtatgccagtaggttcgttcagctggttcggtcaaaatctcccaaaattacctatttcactaggtatgcaaagtgcattctgatggagaattctccgggggccgattttgaagtgtggttttacgatggagtcaaaattcacaagacagaagatttcatacaagtgattgaaaagaccgggaagagttataccctcaagtccgaaagtgaggtgaattccctaaaggaagagatcaagatgtatatggaccacgcaaatgaaggacaccgcatttgtctggccctggagagcatcatcagcgaagaagagagaaaaactcggagcgctcctttctttccaattatcatcggcaggaaacccggttctacgagcagtccaaaagccctgagccctcccccaagtgtcgactccaattaccccactcgcgaacgggcaagcttcaacaggatggttatgcattccgccgcatcccccacacaagcaccaatccttaatccttctatggtgacaaacgaaggactcggactcacaaccaccgcgtctggcacggacatatcttccaattctctcaaagactgtctgcctaagtccgcccagctgctgaagtctgtattcgtgaagaacgtcgggtgggcaacccagttgacctctggagccgtgtgggttcagttcaatgacgggagccagttagttgtgcaagccggggtgtcatccatcagttatacctctccgaatggccagacgactagatacggggagaacgagaaactaccagactatattaagcaaaagctgcagtgcttgtcatccatactcttgatgttcagtaaccccacacctaactttcattag

SEQ ID NO: 25707 - DNA, 2817 bp, Artificial Sequence
  Description of Artificial Sequence: Synthetic coding sequence
atggccacctgcatcggcgagaagatcgaggacttcaaggtgggcaatctgctcggaaagggcagctttgcgggcgtgtatcgcgccgagtctattcacaccggcttagaggtcgctattaagatgctttataattattttgaagatagcaattatgtttacctggtcctggagatgtgtcataacggcgagatgaacaggtacttaaaaaaccgggtgaagccattcagtgagaacgaagcgaggcatttcatgcaccagattattacaggtatgctatatctgcatagtcatggaatcttacacagagatctcaccctgtcaaacctgcttctaactcgcaacatgaacattaaaattgcagactttggactagcaacacaactaaagatgccccacgagaagcactacactctgtgcgggaccccaaactacattagcccagagatcgctacacggtccgcacacggactggaaagtgatgtgtggagtctgggttgcatgttttatactctactgatcgggcgacccccctttgatactgacactgtaaagaacaccctgaataaggtcgttctcgccgattatgagatgccctctttcttgtctatagaggccaaggacctcatccaccaactgctgcgcaggaatccggctgatcgtctttcactgagttctgttctcgatcacccttttatgtcccggaatagcagtactaagagcaaagacctgggcacagtggaggacagcattgattcaggacacgcgaccatttccaccgctatcacagcctcaagcagtacctctatctccggatcactatttgataaaagacggctccttatcggtcagcccctcccgaacaaaatgaccgtgtttcctaagaataagagttcaaccgacttctccagctccggggatggcaactccttctatactcaatggggtaaccaagaaacctcaaattcgggtagagggagagttatccaagatgccgaggagaggccccatagtcggtacctgcggagggcctactcaagcgaccgctccggcaccagcaattcgcagtcccaggccaaaacctacactatggagaggtgtcattctgctgaaatgctgagcgtatcaaaaagatctggcggtggggaaaatgaagagaggtattcccctacagacaacaacgccaacatttttaacttcttcaaggagaagaccagtagtagtagcggctcctttgagagaccagataataaccaggccctgtccaaccacttgtgtccaggcaagactcctttcccgttcgccgaccccactccacagaccgagactgtccaacagtggttcgggaatttacagatcaacgcccacttaagaaaaactacagagtatgatagcattagcccaaacagagattttcaggggcatccggatctgcagaaggacactagtaagaacgcctggactgatacaaaggttaagaagaactcagacgctagtgataatgcccacagcgtgaaacagcaaaacacgatgaagtacatgacggcactccattcgaagccagagataattcaacaggagtgcgtctttggaagtgatcctctcagcgaacaatccaaaaccagagggatggagcctccctggggatatcagaaccgcacgctgcgcagtatcacatcaccactggtggctcaccggctgaaaccgatccgtcaaaaaactaagaaagcggtcgttagcatcctcgattcagaagaagtgtgcgtcgaattggttaaggagtatgcatctcaggagtatgtgaaagaagtcctacagatatctagcgacgggaacaccatcacaatttactatccgaacggcgggagggggttccctcttgctgacagacctccctcaccaacagataacatttcgagatattcatttgacaatctccctgaaaagtattggcggaagtatcagtacgcctcgaggtttgttcagctagttagaagcaaatctccgaagatcacctatttcacgcgctacgcaaagtgcattctcatggagaatagtcccggcgcagattttgaggtatggttctatgatggtgtaaaaatccataagacggaggattttatccaagtgatagaaaaaaccggaaagagctacactctgaaatccgaatctgaagtaaacagtctgaaggaggaaataaaaatgtatatggatcatgccaacgaaggacaccgtatctgtctagctctggagtccattatttcagaagaggaacggaagaccagatctgctccattcttccccataattattggaaggaagccagggtctacgtcttcccctaaggcccttagcccaccaccaagcgtggactccaattatccaactagggagcgcgcgtccttcaacagaatggtcatgcattcagccgctagtccaacccaggcacctattttaaatcccagtatggtgaccaacgagggactgggcctgacaacaaccgctagcggaaccgacatttcctccaactctctgaaagactgcctccctaaaagcgcacagttgcttaagtctgtattcgttaagaatgtggggtgggctacacagttgacttccggcgctgtttgggtccagtttaacgacggcagtcagctggtggtccaggctggagtgagcagcatatcctacacgagccctaacgggcagacgacccgttacggagagaatgagaagctccccgattatatcaaacagaagctgcagtgtctatccagcatcctacttatgtttagtaacccaacacctaattttcattag

SEQ ID NO: 25708 - DNA, 2790 bp, Artificial Sequence
  Description of Artificial Sequence: Synthetic coding sequence
atgatcgacaagaaggccatgtacaaggccggcatggtgcagcgggtgcagaacgaagtcaagatccattgtcagctgaagcacccgtctatcctcgaactttacaactatttcgaggacagcaactacgtatatctagtgctagagatgtgtcacaacggcgaaatgaatagatacttgaaaaatcgagtgaaaccctttagcgagaacgaagccagacacttcatgcatcagatcataaccggtatgctgtatcttcactcgcacggcatcctgcacagggatcttactctgtccaatctgctcctcacccgcaatatgaatatcaagattgctgacttcgggcttgctactcagctaaaaatgccacacgagaagcattataccttatgtggcacaccaaactacattagtcctgagattgcaacaagatccgcacacggacttgaatccgacgtttggtccctcggctgcatgttttataccctacttatcggtcgccccccttttgacacagacactgttaagaataccctgaataaggttgtcttggccgattatgagatgccatcgttcctgtccatcgaggctaaggacctaattcatcagttgctccgccggaatccagcagaccggctgtccctaagctccgttcttgatcatccattcatgtcccgcaacagcagcaccaagtctaaagatctggggactgttgaggatagcattgattctggccatgccactatctctaccgccatcaccgcatcttcttcaacaagcatctcaggatccctctttgacaagcgaagacttcttatcgggcagccgctgccaaacaaaatgaccgtctttcctaaaaataaaagcagcaccgatttttcttcaagcggggacggcaactccttttatacacagtggggaaatcaagagaccagtaattcaggccgcggaagagtgatacaggacgctgaggaacggccccacagccgatatctgagacgcgcctacagttcagatagatctggaacttctaactcacagtcacaagctaaaacgtatacgatggaaagatgtcacagtgccgagatgttaagcgtttccaaacgcagcgggggaggcgaaaacgaggagaggtactcaccaaccgataacaacgcaaacattttcaactttttcaaggaaaaaaccagcagttcctctggcagttttgagcgcccagataacaatcaggccctgtctaatcacctctgtcctggcaaaacaccgtttcctttcgctgacccaacaccacagaccgaaaccgtgcagcagtggtttggcaatttgcagatcaatgcccatcttcgcaagaccacagagtacgacagtatcagccctaacagagatttccaaggacatcctgatctccagaaggacacgtcaaagaacgcttggacggatacgaaggtgaagaagaacagcgacgctagcgataacgcacatagtgtaaaacaacagaacacaatgaaatacatgacggccttacacagtaaacctgaaataattcagcaggaatgcgtgtttggcagcgacccgctttcggagcagtctaagaccaggggcatggaacctccttggggctatcagaataggacactacgatctatcactagtccccttgtcgcccataggctcaagccgatcaggcagaaaaccaaaaaggcagtggtctccattcttgattctgaagaagtctgcgtcgagctagtcaaagaatatgcctcccaggagtacgtcaaagaagtgctgcagatctcttctgatggtaacaccattaccatctattatcctaatgggggccggggttttccactggcagatagaccaccatctcctactgacaacatcagccgctattcattcgacaatctgcctgaaaagtactggcgtaaataccagtacgcaagcaggttcgtgcaattagtgaggtccaaaagccccaagatcacatacttcacacggtatgcaaaatgtatactgatggagaacagtcctggcgccgactttgaagtgtggttttatgatggagtgaaaatccataagactgaagatttcatacaggttattgagaagactggcaagagttacacactaaagagtgaaagcgaagtcaactccctcaaggaggagataaagatgtatatggatcatgctaacgaggggcatcgcatctgtctcgccctggagagcattatttctgaggaagagaggaagaccagatccgcaccattttttcctatcattatagggagaaagccaggatctacatcctcacccaaggccttgtcccctcctccatccgttgacagcaactaccccaccagagagagggccagctttaatcggatggtcatgcacagcgctgcgtctccgactcaagcacctattctgaatcctagcatggtaaccaacgaaggacttggcctgaccacaaccgccagcggcacggatatctccagtaattctttaaaggattgtctgcccaagagtgcccagctgctgaagagcgtatttgtcaagaatgtcgggtgggcgacccaacttacttctggggctgtgtgggtccaattcaacgacggttcacagctggttgtacaggccggtgtcagtagtataagctacaccagtcccaacggccagaccactagatacggcgagaacgaaaaactcccagattatataaagcagaagctgcagtgcttaagtagcattttgctaatgttttcaaaccctacaccgaactttcattag

SEQ ID NO: 25709 - DNA, 1752 bp, Artificial Sequence
  Description of Artificial Sequence: Synthetic coding sequence
atggccgcccggcggcggcggagcaccggcggcggccgggcccgggctctgaacgaatctaagagagtgaacaacggaaatactgcacccgaggattctagtccagcaaaaaaaacacgccgttgccagcggcaggagagtaaaaagatgcccgtggctggcgggaaagctaataaggacagaactgaagataagcaggatgggatgcccgggcgctcctgggcctcaaaaagagtgtccgagagtgtgaaggccctgcttctgaagggtaaagcccctgtcgacccagagtgtacagctaaggtgggcaaggcccacgtctactgtgaagggaacgatgtctacgatgtcatgctgaatcagactaacctccagttcaacaacaacaagtattacctgatacagctccttgaggacgatgcccaaaggaacttctccgtttggatgaggtggggtcgggtaggtaagatgggacagcattcccttgtggcttgtagtgggaacttgaataaggccaaggagatctttcagaaaaagttcctcgataagacgaagaacaattgggaggacagggagaagtttgagaaagttccagggaagtacgatatgttgcagatggactacgctaccaatacacaggacgaggaagagacaaagaaggaggaatccctgaagtcccctctgaaaccagagagccaacttgaccttagggtgcaggagttgattaagctcatatgtaacgtccaggctatggaggagatgatgatggaaatgaagtacaacacgaagaaagcaccattaggtaaattgacagtggctcagattaaagccggctatcagagtctgaagaagatcgaggactgcatcagggccgggcagcacggacgtgcccttatggaagcatgtaatgaattttacacccgtattccgcacgacttcggacttcgtaccccccctctaattcggacacaaaaggagttgagtgaaaagatccagctgcttgaagcactgggggacatcgagatcgcaatcaagcttgttaaaaccgagctccaaagccccgagcaccctctggaccagcactatcgaaacttacactgcgcgcttcggcccctcgaccatgagtcttacgagtttaaagtgatcagccagtacctccaatcaactcacgctcctacccactctgactacacaatgacactgttggatttgtttgaggtggagaaagacggcgaaaaggaggcattcagggaagacctacataataggatgctgctctggcacggatcacggatgagcaattgggttggcattctgagtcacggcctgcgtatcgcccctcctgaggccccgatcaccggctacatgttcgggaaaggcatctactttgccgacatgtccagtaagtcagctaattattgttttgccagcagacttaaaaacaccggtctccttctcctgtcggaggtcgccctcggacaatgcaatgagctgttggaagctaaccccaaagccgagggcctgctgcagggaaagcattcaacaaaggggcttggaaaaatggccccctcctccgctcattttgtaacactgaatggcagcaccgttccgctggggcccgcctcagacactggaatcctcaatcccgacgggtatactctcaattataacgaatacattgtttacaaccccaaccaagtccggatgcgctacttacttaaggtgcaatttaactttcttcagctgtggtag

SEQ ID NO: 25710 - DNA, 1713 bp, Artificial Sequence
  Description of Artificial Sequence: Synthetic coding sequence
atggccgcccggcggcggcggagcaccggcggcggccgggcccgggccctgaatgagagcaagcgagtgaataacggcaacacagctcctgaggactcatcgccagccaagaaaacacgcagatgccaaaggcaagaatctaagaagatgcctgtagctggcgggaaggccaataaagacagaactgaggataaacaggacgaatcggtaaaggcccttttgctcaaaggcaaggcacccgtagacccggaatgtaccgcaaaggtgggtaaggcccatgtatactgcgaaggtaatgacgtctacgatgttatgctaaaccagaccaacctccagttcaataacaacaagtattacctgatccaactcctcgaagacgacgcccagagaaatttcagcgtttggatgagatggggccgcgtgggaaaaatgggccagcatagcctggtggcctgttctggcaacctcaacaaggcgaaagagatcttccagaaaaaatttctggataagactaagaacaattgggaagatagggaaaaatttgagaaggttcctgggaagtacgatatgctacagatggactatgcaaccaacacacaggacgaagaggaaactaaaaaagaggagtccctcaagtctcctttaaagccagaatctcagctcgacttgcgggttcaggagctaatcaagctcatctgtaacgtgcaggccatggaggaaatgatgatggaaatgaagtacaatactaaaaaagcccctctcgggaaactgaccgttgctcagatcaaggctggctaccagagcctcaaaaagattgaagactgtataagggccggccaacatggaagagctctgatggaggcctgtaatgagttctacaccagaatcccgcatgacttcggcctccgtacaccccctctgattaggactcagaaagagttgtctgagaagatccagctgctggaagcgcttggagacattgaaatagcgatcaagctggtcaagactgagctgcagtcacctgagcacccactagatcagcactacaggaacttgcattgtgctttgcgcccccttgaccatgagtcctacgagttcaaggtgatatcccagtaccttcaaagtacacatgctccaacccactccgactatactatgactctactggacctctttgaagtagaaaaggacggtgagaaggaagcattccgagaggacctgcataaccgcatgctactgtggcatggtagccgtatgtccaactgggtgggcattctctcccatggcctgcgaatcgccccacccgaagcccccatcaccgggtacatgttcggaaaagggatttactttgcagatatgagctctaagagcgccaactactgtttcgcttccagactgaagaatactgggctgctacttcttagcgaggtggctcttggccagtgtaatgaactcctggaggcaaatcccaaggccgaggggctcctgcaggggaaacactcaaccaaagggctaggcaagatggcccctagcagtgcacacttcgtcacattaaacgggagcaccgttcccctgggtccagcatctgacactggaatcctaaacccagatggatacactctcaattacaatgagtacattgtctacaacccaaatcaggtgagaatgcgttacctgcttaaggttcaatttaactttctgcagttgtggtag

SEQ ID NO: 25711 - DNA, 1623 bp, Artificial Sequence
  Description of Artificial Sequence: Synthetic coding sequence
atgagcctgctgttcctggccatggcccccaagcccaagccctgggtgcagaccgaggggcccgaaaaaaaaaaagggcgccaggctgggagagaagaggacccgtttagatcaactgctgaagcactcaaggcaatccctgctgaaaagagaatcattagagtcgatccaacttgcccgctgtcatctaatccaggcacacaggtgtacgaggattacaactgcacactgaatcaaactaatattgagaacaacaacaataagttctacataatacagctactccaggactccaatcgattcttcacatgctggaaccactgggggcgtgtgggagaggtcggccaatcgaaaattaatcactttactaggctcgaagacgctaagaaggatttcgagaagaagtttagagaaaaaaccaaaaataattgggcagaacgcgatcactttgtttcccatcctggtaagtatacactgattgaagtccaggctgaggacgaggcccaagaggctgtcgtgaaggtcgataggggacccgtaaggacagtaacgaaaagggtccagccctgttctctggatcccgcaacacagaagttaattacgaatatattttctaaggagatgttcaaaaacactatggcactgatggacttagacgtcaagaagatgcccttagggaagctctccaagcagcagattgcccgggggtttgaggcattggaagctctggaggaagctctgaaagggcccacagatggaggtcagtcactggaagaacttagctcacacttctacaccgtcatcccgcacaacttcggccacagccagcccccacccatcaactcgccggagctgctgcaggcaaaaaaggacatgctgttagttctagccgatatcgaattagctcaggccctgcaggccgtgagcgagcaggaaaagacagttgaggaggtccctcacccgctggaccgagactatcagctcctgaagtgccagctccaactgttggatagcggcgccccagagtacaaagtgatccagacttacctggaacagaccggtagcaatcacaggtgtcctaccttgcaacatatttggaaggtgaaccaagagggggaagaagaccggtttcaggctcacagcaagcttgggaatcgtaaattgttatggcatggtaccaacatggcagtggtggccgctatcctgacctccggattacggatcatgccgcattctggcggcagagtggggaaaggcatctacttcgcttccgaaaactccaagtccgccgggtatgttattggtatgaaatgtggagcgcatcacgttggatacatgtttcttggcgaggtggcactcggacgtgagcaccatattaataccgacaatccatctcttaaatcccccccgccagggttcgattctgtgatcgcccgggggcatacggagcccgatcccacccaagacacggagctcgaactggatggccagcaggtggtcgtccctcagggccagccggtgccatgtccggagttctcctccagcaccttcagtcagagcgaatacttaatctatcaggagagtcaatgccgcctgcggtatttgctcgaggtgcatctttag

SEQ ID NO: 25712 - DNA, 1602 bp, Artificial Sequence
  Description of Artificial Sequence: Synthetic coding sequence
atggcccccaagcccaagccctgggtgcagaccgagggccccgagaagaagaagggtcgacaggcgggcagggaggaagacccttttaggagcacagctgaggccctcaaagccatccccgccgagaagaggattatcagagttgaccctacatgtccactgtccagtaatcccgggacccaggtgtatgaggattacaattgcacactgaaccaaaccaacatagaaaataacaataacaaattctacataattcagctcctgcaggattccaatagattcttcacctgttggaaccactggggcagagtaggagaagttggccaaagcaaaatcaaccattttacaagactggaggatgctaagaaggacttcgagaaaaagttccgagagaagacgaaaaataactgggcggagagagatcatttcgtttctcacccaggtaagtacactctcattgaggtgcaggccgaagacgaggcccaggaggcggtcgtgaaggtggaccggggccctgtgcgaacagtcacaaagagggtccaaccttgttctctggaccccgcaacacagaagctcatcacaaacattttttctaaggagatgtttaagaacacaatggccctgatggacctcgatgtcaaaaagatgccattagggaaactttcaaagcaacaaatcgctcggggatttgaggcactcgaagccctggaggaggcgctgaaaggaccaaccgacggaggacagagtttggaagagctctctagtcatttctatacagtgatcccccacaactttgggcacagccagcctccgccaatcaacagccccgagctcctccaggctaagaaagatatgctcttggttctggccgatattgagttggcccaggccttgcaagcggtctccgaacaggagaaaactgtggaagaggttcctcatccgctggatagagactaccagcttctcaaatgtcagctacagttgctggatagtggcgcacccgagtacaaggtgatccagacatacctggaacagaccggaagcaaccacaggtgtcctactctccagcatatctggaaagtcaatcaagaaggggaagaagaccggttccaagctcactccaaacttggcaatcgcaaactactctggcatggcacaaatatggccgtggtagctgccattttgacgtccggactaaggataatgccccattccgggggccgcgttggaaagggcatctatttcgccagcgaaaactccaagagcgccgggtacgtaatcggcatgaagtgcggtgcccaccacgttggatacatgttcctgggggaggtggccctcggtagagagcatcatatcaacacagacaatcccagcctaaagagcccccctcctgggttcgatagcgtgatcgcgcggggacatactgaacccgaccctacacaggacaccgagctcgagttagatggccagcaagtggtggtcccacaaggccaacccgtcccctgcccagaattctcaagtagcacattttcccagtccgagtatttgatctatcaggagtcacaatgtagattgaggtatctcctcgaggtccacctatag

SEQ ID NO: 25713 - DNA, 1602 bp, Artificial Sequence
  Description of Artificial Sequence: Synthetic coding sequence
atggcccccaagcccaagccctgggtgcagaccgagggccccgagaaaaaaaaggggcgtcaggcggggcgcgaggaggatccgttccggtctacggccgaggcacttaaggccatacccgccgaaaagcggattattcgcgtcgaccccacatgccccttatcaagcaatcctggtacccaggtatacgaggactataactgtacgctgaaccagaccaacattgagaataacaataataagttttacattatccagctcttgcaagatagcaaccggtttttcacttgctggaaccactgggggagagtaggcgaagtgggtcagtcaaagatcaatcactttacccgactggaagacgcaaaaaaagattttgaaaagaaattccgggaaaaaacaaagaataactgggccgagcgcgaccacttcgtcagccatcccggaaagtacacgctcatcgaggtgcaagctgaggatgaggctcaggaggcagttgtgaaggtcgataggggacccgtcagaaccgtgaccaagagggtccagccctgttcccttgatcccgcaactcagaaactcataaccaatatcttttcaaaggagatgtttaagaacacaatggcgctcatggatctagacgtgaaaaagatgcccctgggcaaactctccaagcagcagattgcgaggggcttcgaggccctggaagccctggaggaggccctcaagggccccacggacggaggccagtcgctggaagagttgtcttcacacttttacactgtcataccacacaattttggccattcccaacctcctccaattaattctccggaattacttcaggcgaaaaaagatatgcttctcgttcttgccgatatagaactggcccaggctctgcaggccgtgtccgaacaggaaaaaacagtagaagaagtcccgcaccctctagatcgcgactaccagttactaaagtgtcagcttcagctgttagattctggcgcccctgagtacaaggtaatccaaacatatcttgagcagactggttccaaccacaggtgccccacccttcagcatatctggaaagttaaccaggagggagaggaggacaggtttcaggctcactctaagctcggcaatcgtaagttgctctggcatggcaccaatatggctgtggtggccgctattctgacatccggactcaggattatgcctcactctggcggacgggtcgggaagggcatctactttgcttccgaaaactccaaatccgcaggctatgtcatcggaatgaaatgtggggcccaccacgtcggatacatgttcttaggagaagtcgctctgggacgtgagcaccacatcaatacagacaacccttcactcaaaagtcctccacccggctttgactcggtgattgcccgaggtcatactgagcccgaccccacccaggacacagagctggagttagatggtcagcaggtggtagttcctcagggacagcctgtgccgtgcccagagttctcctcatcaaccttctcccagtctgagtacttgatatatcaggaaagtcaatgtcggctgagatacctgttggaagtgcatctgtag

SEQ ID NO: 25714 - DNA, 999 bp, Artificial Sequence
  Description of Artificial Sequence: Synthetic coding sequence
atggcccccaagcccaagccctgggtgcagaccgagggccccgagaaaaaaaaaggaaggcaggctggaagggaggaggatcccttcaggtcgaccgcagaggcactgaaagcaatcccagctgagaaaaggattatacgcgtggacccaacctgccccctgagttccaaccctgggacccaggtttacgaagattataattgcaccttgaaccaaaccaatatcgagaacaataataacaaattctacatcatccagctgctccaggacagcaatcggtttttcacgtgttggaatcactgggggcgggtgggcgaggtcggtcagagcaagatcaaccacttcacacggctggaggacgccaagaaagactttgaaaagaaatttagggagaagaccaagaacaattgggccgaacgcgatcactttgtttcccacccaggtaagtataccctcatcgaagtccaggcagaagatgaagcacaagaagcagtcgtgaaagtcgacagaggtccggtgcgaacagtgaccaaaagggtgcaaccatgctccctggaccccgctactcagaaattgattactaacatcttttctaaagagatgtttaagaatactatggctctgatggaccttgatgtgaagaaaatgcctctgggaaaactttccaaacagcagatcgcacgaggcttcgaggcactggaggcacttgaagaggcactaaaaggcccgacagatggcggacagtctctggaggaattatctagtcatttctacacggtgatccctcataactttggccactcgcaaccacccccaatcaattctcctgaactcctccaggccaagaaagatatgctcctggtcttagctgacatcgagctggctcaggcattgcaggcagtcagcgaacaggagaagaccgtcgaagaagtgccgcatcccctggatcgagactatcagctactgaagtgccagcttcagttacttgattccgggtag

SEQ ID NO: 25715 - DNA, 5175 bp, Artificial Sequence
  Description of Artificial Sequence: Synthetic coding sequence
atggtgatgggcatcttcgccaactgcatcttctgcctgaaggtgaaatacctcccccagcagcagaagaaaaagcttcagaccgacatcaaggagaatggcgggaagtttagtttttcacttaacccccagtgcacacacatcattttagacaacgcggacgtgctgagccaataccaattaaactcaatacaaaagaaccacgtgcacatcgccaatcccgactttatctggaagagcatcagagagaaacgactcctagacgtcaaaaactatgacccttacaaacctctggacatcacacctcctcccgatcagaaagccagttctagcgaagtgaagaccgaaggcctgtgcccagacagcgcgactgaggaggaggacacagtcgagttaacagaattcggcatgcaaaacgtggaaatcccacaccttcctcaagactttgaagtggccaaatataacacacttgagaaggttgggatggaggggggccaggaggccgtggtggttgaactacagtgctcccgcgacagcagggactgccctttcttaatctcttctcacttcctgctggacgatggcatggagactagacggcagttcgccataaaaaagacttccgaggatgcttccgaatacttcgagaattacatcgaagaattgaagaagcagggctttcttctgcgtgaacactttacacctgaggccacacagttagcatcagagcagctacaggctctgctactggaagaagtcatgaacagctcaacattgtctcaggaggtgagcgaccttgtggaaatgatctgggccgaggctcttggccatctggaacacatgctgctcaaacctgtcaatcgaatctctctgaatgatgtgtcaaaagccgagggtattctgctactggtcaaggctgccctgaagaatggagagacggctgagcagcttcagaaaatgatgactgaattttatcggctgatcccacacaaagggacaatgccaaaagaggtgaacctaggcttgctcgcaaagaaggccgatctctgtcagctgattcgcgatatggtgaatgtttgtgagaccaacctgagtaaacctaaccctccctctctggcaaaatacagagccctgagatgcaagatcgagcacgtggagcagaataccgaagagttcctcagggttcggaaagaggtcctgcagaatcatcactccaaaagccccgtggacgtccttcaaatcttccgcgtcggaagagtgaatgagaccacggaattcttgtccaagcttgggaacgtccggcctctgctccacggatcaccagtgcagaacatcgtgggaatattgtgcagagggcttttgcttcccaaggtggtggaggatcgcggtgtccagcggacggatgtcggcaatctcggctccggcatctactttagcgattcattaagtacatctattaaatattcccatcctggggaaactgacggaacgaggctgttacttatttgcgatgtcgccctcggaaagtgcatggacctgcatgagaaggatttcagcctcaccgaggcacctccgggttacgattctgtgcatggagtgtcccaaacagccagtgtaacgaccgacttcgaagacgacgaattcgttgtctacaaaaccaatcaagttaagatgaaatacattattaaattttccatgccgggggaccaaattaaagatttccatccctccgatcatactgaacttgaggagtaccgtcccgaattctcaaactttagcaaggtagaggattaccagttacccgatgcgaaaacatccagttctacaaaagccggactccaggatgcctccggaaacctggtaccactggaagacgtacatatcaagggccgtattatcgatactgtggctcaagtgatcgttttccagacttatacaaataagtcccacgtccccatcgaggcaaagtacatctttccactcgatgacaaggccgcagtgtgtgggttcgaggcctttatcaatgggaagcacatcgtcggggaaatcaaggagaaggaagaagcacagcaggagtacctggaggctgtcacccagggccacggcgcgtatctcatgagccaagacgcacccgacgtgtttaccgtgagtgttgggaatctcccacccaaggcaaaagtactgatcaagataacctacatcactgagctttctatactggggacagttggggtgttcttcatgcctgcgaccgtggccccctggcagcaagacaaagcgctgaacgagaacctgcaggataccgtggagaagatctgtatcaaggaaataggaaccaagcagtccttttcgctgactatgtccattgagatgccctacgtgatagaattcatattttccgatacccacgaactgaagcagaagcgcacggattgcaaggcagttatttccaccatggaggggtcctctttggactcctcgggcttttcacttcatattggactcagcgccgcttatttgccacgtatgtgggtagaaaagcaccctgaaaaggagtctgaagcctgtatgctcgtgttccaaccagatctggacgtggacctccccgacctggcatcggagtccgaagttatcatctgcctggactgcagctcttccatggagggtgtcaccttcctacaagctaagcaaatcgcacttcacgcactaagtcttgttggtgagaagcagaaggttaatataattcaatttggtacaggatataaggagctcttctcctacccaaagcatatcacctctaacaccatggcagccgaattcattatgtccgctactcccactatgggaaacaccgacttctggaaaacgctgagatacctttctctgttgtacccggctcgcggtagccgcaacatcctcctcgtatctgacggacacctgcaagacgaaagcctgacgctacagctggtcaaacggagccgccctcatacacgtctgtttgcttgcggaataggctccactgccaacaggcatgtgctgaggatcctgagccagtgcggggcaggcgtcttcgaatactttaacgccaaatccaaacattcatggcggaagcagatcgaggatcagatgactcgcctgtgtagccctagctgtcatagcgtgtccgtcaaatggcagcagctcaatccagatgtcccggaagcactccaggcccccgcccaggttccttctcttttcttgaacgaccgcctactggtctatggttttatacctcactgtacccaggctacactctgtgcacttatccaggaaaaggagttcagaaccatggtctcaaccaccgaattgcagaagacaacagggacaatgatacacaagctcgccgcgcgcgcgctcatcagagactacgaagacggcatcctgcatgagaatgaaactagtcacgaaatgaaaaagcagactctgaagtcacttatcattaaactatctaaggaaaattcactcataacacagttcacgtcctttgtggctgtggagaaacgagacgaaaacgagagccccttccctgacattcctaaggtgagtgagctcatcgccaaggaagacgtggacttcttgccttacatgagctggcagggggagccccaggaggcagtcaggaatcagtcattgctggctagcagcgagtggcccgagctgcggctcagcaagcggaaacacagaaaaatccctttctccaagcggaagatggaactctcccaaccagaagtaagcgaggattttgaggaggatggcttgggggtgctgccagcatttaccagcaatctcgagaggggaggagtcgagaagctccttgacctcagctggactgaatcctgcaagccaacagccacagagcctctgtttaagaaggtgtcaccttgggagacatccacatccagtttcttcccaatactggccccggccgtgggcagttacctgcctccgaccgcgcgcgcccattctcctgctagcctatcgtttgcctcataccgacaggtagcttcattcgggtccgccgcacctccgcggcagttcgacgcctctcagttttctcaggggcccgtgcctggtacctgtgctgactggatcccacagagcgccagttgcccaactggtccaccgcagaatccaccgtcttcaccatattgcggcattgttttctctgggagcagcttgtcgagcgctcagtccgccccacttcagcatcccggaggcttcacaacccggcctagcgccggaacctttcccgaattggactctccccaactgcacttttctcttccaaccgaccccgaccctatccgtgggttcgggagttaccaccctagcgcctcctctcctttccactttcagccatcagctgcttctctcacggccaacctacgcctgcctatggcttccgcgctacccgaagccctttgctcccagtctagaacgaccccggtcgatctgtgcctgttagaggaaagtgtgggtagcctggaaggcagccggtgtcctgtgtttgcctttcagagctccgatacagagagcgacgaactgtcggaagtgctccaggattcctgctttcttcagatcaagtgcgatactaaggacgatagtattttatgcttcctggaagtgaaggaggaggacgagatcgtttgcattcagcactggcaggatgctgtgccctggaccgaattgctgtctctccagaccgaggacggattctggaaactgaccccggagttaggactcatcttgaacctgaacactaacggcctccatagcttcttaaagcaaaagggcatccaaagtcttggtgtaaaggggagagaatgcctcttggacttaattgctaccatgttagttctacagtttattagaacgaggctggagaaagaaggtatcgtgttcaagagcctcatgaaaatggacgacgctagcatctctagaaatatcccctgggcctttgaagctattaaacaggcatccgagtgggtccgccgcactgaagggcagtatccttccatttgtccacgccttgagttggggaacgattgggatagcgcaaccaagcaactgctcggcttgcagcccatttcaactgttagccctcttcatcgtgtgctccactatagccaggggtag

SEQ ID NO: 25716 - DNA, 1911 bp, Artificial Sequence
  Description of Artificial Sequence: Synthetic coding sequence
atgaaccccagcgcccccagctaccccatggccagcctgtacgtgggcgacttacaccctgacgtgaccgaggccatgctctatgaaaaatttagtccagcaggtcccatccttagcataagagtgtgtcgtgacatgatcacaagacgctccctgggttatgcgtacgtaaactttcaacaacctgccgatgcagaaagagcactcgatacaatgaactttgacgttatcaagggcaaaccagtgcgaataatgtggtctcaacgcgatccttccttgcggaagtccggagtaggcaatatttttatcaaaaatttagacaagagtatcgacaataaagcactgtacgatacattctcggcctttgggaacatattaagctgcaaagttgtgtgcgacgaaaatgggtctaaaggctacggctttgtgcattttgaaacccaagaagctgccgagcgagccatcgagaaaatgaacggcatgctgctcaatgacagaaaggtcttcgtcggccgattcaagtcgcggaaggagcgagaagctgagttgggcgcccgcgcaaaagagttcaccaatgtctacatcaagaatttcggcgaggatatggatgatgagcgtctaaaagatctgtttgggaaattcggccccgctcttagtgttaaagtgatgactgatgaatccgggaagagtaaggggttcgggtttgtctcatttgaaaggcacgaggatgcccaaaaagccgtcgacgagatgaacggcaaagaactcaacggcaaacaaatctacgtcggcagggctcagaagaaggtcgagcgccaaacagaactgaaaaggaaatttgagcagatgaagcaggatagaataacaaggtaccagggagttaacttatatgtcaagaatttagatgatgggatagatgatgaacgcctgcgtaaagagtttagcccgtttggtacaattaccagcgcaaaggtcatgatggagggcggccgcagcaaaggtttcggtttcgtgtgtttcagcagtcctgaagaagccacaaaggccgtgaccgaaatgaacggacgcattgtggcaactaagcctctgtatgtggcactcgctcagcgcaaagaagagcggcaagcccacctcacgaatcagtacatgcaacgtatggcttcagtccgcgctgttcccaaccccgtcatcaacccctaccagcctgcgcccccctcggggtacttcatggccgctattcctcagactcaaaaccgagcagcatactatcctccatcacagattgctcagctgaggcctagcccccggtggactgcccagggggcgcggccacatccatttcagaacatgcccggggcaatccgacctgccgctcctcggccccctttctccaccatgagacctgcctcatcccaggtgccgagagttatgtcaacccagcgagttgctaacacatcgactcaaactatgggtcctcgacccgccgcagccgccgctgccgcgacccctgccgtgcgcaccgtaccccagtataagtacgccgctggggtccggaacccccagcagcacttgaacgctcagccacaggtaacgatgcaacaaccggcagtccatgtccaggggcaggaaccactgaccgctagtatgctcgccagcgcgcctcctcaggagcagaagcagatgctcggtgaacgtctgttcccccttatccaggcaatgcaccctacactggctggcaagatcaccggcatgctgctcgagatcgataactctgagctgctccatatgctggagtcccctgaatcattgagatctaaagtggatgaggccgtggcagtcctgcaggcccaccaggctaaggaggctgcacagaaggccgtgaatagcgctacaggggttccaacagtatag

SEQ ID NO: 25717 - DNA, 1644 bp, Artificial Sequence
  Description of Artificial Sequence: Synthetic coding sequence
atgaaccccagcgcccccagctaccccatggccagcctgtacgtgggggatctgcatcccgatgtgactgaggcaatgctctatgaaaagttcagtcccgctggccccatactgtctattcgcgtctgcagagatatgattacacgaaggtcactgggatacgcatacgtgaactttcagcagccggccgacgcggagagggccctggacaccatgaatttcgatgtcatcaagggcaaacctgtcagaattatgtggtcacaacgggacccgagcctgaggaaaagtggggtggggaacatttttataaaaaatctagacaaaagcattgacaataaggcactctatgacaccttctcggctttcgggaatatcctgtcctgtaaggtagtatgcgatgagaatggttctaaaggatatggatttgtgcatttcgagacccaggaggctgccgagcgggcgattgaaaaaatgaatggtatgcttctcaacgatcgtaaagtgtttgtgggtagattcaagagcagaaaggagagagaagcagagctcggagctagggccaaggagtttacgaatgtctatatcaagaactttggagaagatatggacgacgaaaggctgaaagacctcttcggcaagttcgggcccgccctatccgtgaaggtgatgacagacgaatccggcaagtccaagggctttggatttgtaagctttgagcgacatgaggacgctcaaaaggccgtcgatgaaatgaatggaaaggaactcaacgggaagcagatctacgtagggagagcccagaagaaagtcgagcgacagactgagctcaagcgtaagtttgaacaaatgaagcaggatcgtatcacacggtaccagggggtcaacctgtatgtgaagaatctcgacgacgggattgatgacgagagattgcgcaaggagttttcccccttcggcaccataacaagcgccaaggtgatgatggagggaggaaggtccaaagggtttggatttgtctgcttttcaagcccagaggaggcaactaaggccgtcacagagatgaatggcaggattgtggcaaccaagccactgtacgtggcactggcccagcgcaaggaagaacgacaagcacaccttactaaccaatacatgcaacgcatggcttcagtgcgagcggttccaaatccagtaataaacccctaccaaccagctcccccctccggatactttatggccgccataccacagacccagaatagggcagcttattatccacctagccagatagctcagctgcgcccatcacctcgttggacagcacagggggcgcgaccccaccccgccgtgcatgtgcagggacaagagccccttacagcctctatgctcgcctcagccccacctcaggaacagaagcagatgttaggcgagcgcctgttccccttgattcaggctatgcacccaacactggctgggaagattacaggtatgctgcttgagatcgacaacagcgagctcctccacatgctggaatcaccagagagcctgcgaagtaaggtggacgaggccgtagcagttttgcaggcccatcaggccaaggaggctgcacagaaggccgtcaacagcgccaccggcgtacctactgtgtag

SEQ ID NO: 25718 - DNA, 129 bp, Artificial Sequence
  Description of Artificial Sequence: Synthetic coding sequence
tgaatgctggagagccccgagagcctgcggagcaaggtggacgaggccgtggccgtgctccaagcccaccaggccaaggaagcagcccagaaggctgtaaactccgctacaggggtgccaactgtgtag

SEQ ID NO: 25719 - DNA, 117 bp, Artificial Sequence
  Description of Artificial Sequence: Synthetic coding sequence
atgaaccccagcgcccccagctaccccatggccagcctgtacgtgggggacctgcacccagatgtcacagaggccatgttgtatgagaagttctcccctgccggtcctattctgtag

SEQ ID NO: 25720 - DNA, 357 bp, Artificial Sequence
  Description of Artificial Sequence: Synthetic coding sequence
atgaaccccagcgcccccagctaccccatggccagcctgtacgtgggtgacttacacccagacgtgaccgaagctatgctctacgagaagttttcccctgccggccccatcctgagcattcgggtgtgccgggacatgatcacacggcggtctttaggatacgcttacgtcaacttccagcagcccgcagacgccgagcgtgcccttgatactatgaacttcgatgtgattaaagggaaacccgtgagaattatgtggagtcagagggacccaagcctccgaaagagtggggtcggtaatattttcattaagaatctggataagtctatcgacaacaaagcactgtatgatacgtag

SEQ ID NO: 25721 - DNA, 132 bp, Artificial Sequence
  Description of Artificial Sequence: Synthetic coding sequence
atgaaccccagcgcccccagctaccccatggccagcctgtacgtgggtgacttgcaccctgatgtaaccgaggcgatgctgtacgaaaagttcagtccagccggtccaatcctgagcatccgagtttgttag

SEQ ID NO: 25722 - DNA, 510 bp, Artificial Sequence
  Description of Artificial Sequence: Synthetic coding sequence
tgagccagcagccaggtgccccgggtgatgagcacccagcgggtggctaacacttctacccaaacgatggggccacgccctgctgcagctgctgcagccgccactcctgccgtcagaaccgtgccacagtataagtatgcagcgggagtgcgaaaccctcagcagcatttgaatgcacagcctcaagtaactatgcagcagccagcagtgcatgtgcagggccaggagccacttaccgccagcatgctcgcttcagcgccgccccaggagcagaagcagatgctcggtgaaaggctgtttcctttaatccaggctatgcatcctacccttgctggcaagattacaggcatgctccttgagattgacaactcggagttgctgcacatgcttgagtccccagagtccctcaggtctaaagtggacgaagcagtggcggtgttacaggcgcaccaggcaaaagaagcggctcagaaggccgtgaactccgccactggagtgccaaccgtatag

SEQ ID NO: 25723 - DNA, 186 bp, Artificial Sequence
  Description of Artificial Sequence: Synthetic coding sequence
atgaaccccagcgcccccagctaccccatggccagcctgtacgtgggtgatttgcacccggacgtgaccgaagccatgctgtacgaaaagttcagccctgctgggccaattctctcaatcagagtgtgtagagatatgataactcgccgctctctgggctacgcttatgttaactttcagcagtag

SEQ ID NO: 25724 - DNA, 390 bp, Artificial Sequence
  Description of Artificial Sequence: Synthetic coding sequence
atgaaccccagcgcccccagctaccccatggccagcctgtacgtgggtgatctgcacccagatgtcacggaagctatgctctatgaaaaattctctcctgccggccccatcctcagcatccgcgtgtgcagggatatgatcacacgaagaagtctgggctatgcatatgtgaattttcagcaacctgcggacgcggagcgggctctggatactatgaatttcgacgtgattaaaggcaaacccgtgcgtatcatgtggtcccagcgagacccctccctgaggaagtccggcgtgggcaacattttcatcaagaatctggacaagtcaatcgataacaaggctctatacgatacattctctgccttcggtaacattctctcctgcaaatag

SEQ ID NO: 25725 - DNA, 552 bp, Artificial Sequence
  Description of Artificial Sequence: Synthetic coding sequence
atccggcccgccgccccccggccccccttcagcaccatgcggcccgcgtcttctcaggtccctcgtgtgatgtccacacaacgtgtggcaaatacttccacccagacaatgggaccacggcccgcagcagccgcagccgcggcaacccctgcagtcagaaccgtcccacagtataaatatgctgccggggtcagaaacccccagcagcatctgaacgcccaaccacaggtgacaatgcagcagccggccgtgcacgttcagggccaagagccacttaccgccagcatgctagctagtgcaccccctcaggaacaaaagcagatgctcggcgagcgactattccctctgatccaggccatgcatcccacactggctggcaagatcacaggcatgctgttagaaatcgacaactcagagctccttcatatgctcgagtcccctgagtccctcaggtccaaagtagatgaggctgtagctgttctgcaggcccaccaggccaaagaggctgctcagaaagccgtgaactctgctactggagtgccaaccgtgtag

SEQ ID NO: 25726 - DNA, 228 bp, Artificial Sequence
  Description of Artificial Sequence: Synthetic coding sequence
atgaaccccagcgcccccagctaccccatggccagcctgtacgtgggggacttacatcctgacgtgacagaggccatgctgtacgagaagttttcccccgccgggccgattctatccatccgcgtttgcagagacatgatcacccggagatctctgggctatgcatatgtaaatttccagcagcccgctgacgctgagagggccttggacactatgaacttcgactag

SEQ ID NO: 25727 - DNA, 1008 bp, Artificial Sequence
  Description of Artificial Sequence: Synthetic coding sequence
atgagcaagcggaaggccccccaggagaccctgaacggcggcatcaccgacatgctcactgagctggctaacttcgaaaagaacgtgtcacaggccatccacaagtataacgcttatcggaaagcagccagtgtgatcgccaaataccctcataaaattaaaagcggagcggaggcgaaaaagctacccggagtagggaccaagattgccgagaaaatcgatgagttcctcgcgactggcaaacttaggaagctggagaagatacggcaggatgacacttcatccagcattaacttccttacgagggtttctggaatcgggccatcagcagctaggaagttcgtcgatgaaggaataaagacgcttgaggatcttcgcaagaacgaagataagctcaaccatcaccaacgcatcggtctgaagtattttggcgatttcgagaaacgcatcccacgcgaagaaatgctgcagatgcaggacattgtgctcaatgaggtcaagaaagtggactctgagtacatcgcgactgtgtgtgggtcgttccgccgcggcgctgaatcttctggtgatatggatgtcctgctgacacacccaagctttacatcggagtccaccaaacagccaaaactgttgcaccaggtggtcgaacagttgcagaaagtgcattttatcacggataccctaagtaagggcgaaactaagttcatgggagtctgtcagctgccttctaagaacgatgagaaggaatacccccaccgccggattgacattcgactgatacctaaggatcagtactactgcggtgtcctctattttactgggtcagatatttttaataaaaacatgcgggcgcatgctcttgaaaaagggttcactattaatgagtatactattcggcccctgggggtaaccggtgttgctggcgaacctctgccagttgatagtgagaaggacatcttcgattacattcagtggaagtacagagagccaaaggaccgcagcgagtag

SEQ ID NO: 25728 - DNA, 720 bp, Artificial Sequence
  Description of Artificial Sequence: Synthetic coding sequence
tgaggcgacttcgagaagcggatcccccgggaggagatgctgcagatgcaagacattgtactgaacgaagtaaaaaaagttgatagcgaatatatagcaacagtgtgtgggtcttttcgcagaggggccgaatcctccggtgacatggatgtgctcctcacccatccgtctttcactagcgaaagcaccaagcagcccaagttgcttcatcaggtcgtggaacagctccagaaagtccacttcataactgacaccctttcaaagggcgaaacgaagtttatgggagtgtgccagctgccttctaaaaatgacgagaaggagtaccctcaccgccggatagacattcgtctgatccccaaggaccaatactattgcggagtgttgtactttaccggcagcgacatttttaataaaaatatgagggcccacgctttggaaaaggggtttacaatcaatgagtacaccataaggcccttgggtgtgactgtgctgcaagccacacgtgaagatctgatgcataatatgctcttaggtccacagcttaaagctatcaaggagctgcaggagaacccctgtcagtggattgtaaaaaagaccagcctaattacatcatcagggaatacgggcaatccccgcactggagccaatgaggcctgtatattaccgggcagacataacccaatcggggtgctcatctattttctcacctttgcgatgtag

SEQ ID NO: 25729 - DNA, 843 bp, Artificial Sequence
  Description of Artificial Sequence: Synthetic coding sequence
atgagcaagcggaaggccccccaggagaccctgaacggcggcatcacggacatgttgacagagctggccaacttcgaaaagaacgtttctcaggctatacacaagtataatgcttaccgcaaggcagcatccgttattgcaaagtatcctcataagatcaagagtggcgctgaggcaaaaaagcttcccggcgtgggcacaaagatagcagaaaagatagacgagtttctggcaaccggaaagttgcggaaactggagaagatacgacaggacgacaccagctcctccataaacttcctgactcgggtctcgggcatcggacctagcgccgcaagaaagttcgtggacgagggcatcaaaactttggaaggatctcaattggacagttgtccagtcaaggggcatcttaacggtaccgagtccctgttggatttaatctgggacgtgatgacgatcttgaagttaaaaaatgcggacctgcggaagaacgaggacaagttgaaccatcatcagcggatcgggctgaagtacttcggggatttcgaaaaacgcatccctcgcgaggagatgctccaaatgcaggatatagttctcaacgaggtgaagaaggtggatagcgaatacatcgctactgtctgcggcagcttccgccggggggcagagagctccggagatatggacgttcttctcacccatccctcttttactagtgaatccacaaagcagccaaaactgctgcatcaggttgtggagcagctgcaaaaggtgcacttcatcaccgatacactgagcaagggagaaacaaaatttatgggcgtgtgccaattgccgtccaaaaactag

SEQ ID NO: 25730 - DNA, 714 bp, Artificial Sequence
  Description of Artificial Sequence: Synthetic coding sequence
tgagagaagatcgacgagttcctggccaccggcaagctgcggaagttggaaaagatcaggcaagatgacacctctagcagcatcaattttctgacaagggtgtcaggaatcgggccaagtgccgctagaaaatttgtcgacgaaggaattaagacactggaagacctacggaagaatgaagataaactgaaccaccaccagcggatcggactcaaatactttggggactttgaaaaacgtatccccagggaggaaatgcttcagatgcaggacatagtgctgaacgaagtaaaaaaagtcgattccgagtatatcgccactgtgtgtggatcatttcggagaggtgccgagtcctcaggagacatggatgtcctgctaacacatccctcatttacctccgagtctaccaaacagggggtttgccagcttccaagcaaaaatgacgagaaagagtacccccacaggcgcatcgatatccgcctgatccccaaagatcaatattattgcggcgttctctacttcaccggcagtgacatcttcaacaagaacatgagggcccacgctcttgagaagggcttcactattaatgagtataccattcggccactgggggtgaccggcgtggccggcgagccattgcccgtagatagtgagaaagacattttcgactatattcaatggaagtatagggagccaaaggaccgttccgagtag

SEQ ID NO: 25731 - DNA, 546 bp, Artificial Sequence
  Description of Artificial Sequence: Synthetic coding sequence
atgctgcagatgcaggacatcgtgctgaacgaggtgaagaaggtggattctgagtacattgccacagtgtgtgggtcattcagaagaggagctgagtcttccggcgatatggacgtgctgctaacgcacccaagcttcactagcgaatctacaaagcaacctaagctgctccaccaagtggtggaacagctccagaaggttcacttcataaccgatactctgagcaaaggcgagaccaaatttatgggggtctgccaactcccgagtaagaacgatgaaaaagaatacccccaccgaagaattgacattaggttgatccccaaggatcagtattattgtggtgtgctgtattttactggttctgatatttttaacaagaacatgagagctcatgcgttggagaagggatttacaatcaacgaatacactatcaggcccctcggcgtcacaggcgtcgccggagagccccttccagttgattccgaaaaagacattttcgactacattcagtggaaataccgtgaacccaaggacagaagtgagtag

SEQ ID NO: 25732 - DNA, 1728 bp, Artificial Sequence
  Description of Artificial Sequence: Synthetic coding sequence
atggacccccggggcatcctgaaggccttccccaagcggcagaagattcacgccgacgcgtcttcaaaggtgcttgcaaagatcccacgaagggaagaaggagaggaggccgaggagtggttgtcatcactcagggcccatgtggtacgaaccggaatcggcagagctagggccgagcttttcgaaaagcaaatagtgcagcacggtgggcaactgtgtcctgcccagggaccgggcgttacacatatcgtagtggacgagggcatggactacgaaagggccctgcgtctcttacgtcttccccaacttcccccaggtgctcagctcgttaaaagtgcttggttgtctttgtgtctccaggaacggagactggtggatgtggctggtttttccatctttatccctagcagatatttagatcacccccaaccgagcaaggccgaacaagatgcctccattccgccaggcacacacgaagccctgctgcagactgcactctctcccccccccccgcctactaggccggtgtctccacctcaaaaggctaaagaagctcctaacacccaagctcagccaatctcagacgatgaagcctccgacggagaggagacacaagtcagcgcagctgatctggaagcactgatttcagggcactatcccaccagcctagagggcgactgtgaaccatctcctgctcccgcagtgttagataaatgggtgtgcgcccagccatcgtcccaaaaggccaccaaccataacctgcatatcacagagaaactggaggtcttagcgaaagcatatagtgtgcagggagataagtggcgtgccctgggctatgccaaagctattaacgcgttgaaaagctttcataagcctgtgacctcttaccaggaagcatgttccatccccgggatcggaaaacgaatggctgaaaagataatcgagatattagagtctggtcacctgcgaaagctggatcacatatctgaatcggtgccggttcttgagctgttttctaacatttggggcgcaggaaccaaaaccgcacagatgtggtatcagcaggggtttaggagtttggaagatatacgcagtcaagcgtcgctcacgacgcagcaggctattggtcttaagcactattccgatttcctcgagagaatgcccagagaagaggctacagagatagagcaaaccgttcagaaagctgctcaggcatttaactctggcttactgtgcgtggcgtgcggctcatatcggcgcggcaaggccacttgcggagatgttgatgtgctgatcacacacccggatggacggagccaccgggggatcttcagtcgtcttttggactcgttaaggcaagaagggtttttaaccgatgaccttgtgtcccaggaggagaatggccagcagcagaagtatctgggggtgtgcaggttgccaggccccgggcgacggcatagacgcttagatattatcgtggttccctattctgaattcgcttgcgctctcctttactttacagggagtgcacatttcaatagatccatgcgcgcactggccaagacgaaggggatgtctctgtctgaacatgctctctccacggccgtggtgcgcaatacgcatggctgcaaggttggacctgggagagtgctgccaacaccgacagaaaaagacgtgttccgcctgctgggactgccctacagggaacccgccgaacgcgactggtag

SEQ ID NO: 25733 - DNA, 897 bp, Artificial Sequence
  Description of Artificial Sequence: Synthetic coding sequence
atgcaccaccagaagtacctgcagcggttcctgggcggcaagcgggaaaagaagcagaaagaagcctgttcaatccctgggattggaaagcgcatggccgagaaaatcatcgagattttggagagtgggcatttacggaagctggatcacatcagtgaaagcgtacctgtcctggaactattttccaacatctggggggccggcaccaaaaccgcccagatgtggtaccagcagggattcagatccctggaagatataaggagccaggcgtctctgaccactcagcaagctattggccttaaacattactccgacttcctggagaggatgccccgggaggaggctaccgagatcgaacagaccgtgcagaaggccgctcaggctttcaacagtggactgctctgcgtggcttgtggctcttatagacggggcaaagcaacttgtggagatgtcgatgtcttaataacccatcctgatgggagaagccatagaggcattttctctagactgctcgactccctgcgccaggaaggtttcctgacagacgacctggtgagtcaggaggaaaatgggcagcaacagaagtacctcggcgtatgtaggctccctggacccgggcgccgtcataggaggctcgatattatagtggtaccctacagtgaatttgcctgtgctttactatatttcactggatcagcacacttcaatcgttcaatgagggcccttgccaagaccaagggcatgagcctctcggaacacgcgttgtctactgccgttgtaagaaacacacatgggtgcaaagtcggccctgggagagtgctacctaccccaaccgagaaggacgtttttcgactcctaggcctcccctatagggagcctgcagaacgagattggtag

SEQ ID NO: 25734 - DNA, 1548 bp, Artificial Sequence
  Description of Artificial Sequence: Synthetic coding sequence
atggacccccggggcatcctgaaggccttccccaagcggcagaagatccacgccgacgcctcatctaaagttctagccaaaatccccagacgggaggagggcgaagaggcagaggagtggctgtcttcactacgcgcacacgtggtgagaactggtataggaagagctcgagccgagctctttgagaagcagatcgtgcagcacggagggcagttgtgccctgcacaaggccctggcgtgactcatatcgttgtggatgaaggaatggactatgaaagagcgctgcgtctcctgcgtctcccccagttgccccctggcgcgcagctggttaaatctgcgtggttgagtttgtgtttgcaagaacggagactggtcgatgtcgccggattttccatattcatcccgagtcgctacttggaccacccacagccatccaaagccgaacaagacgcaagcatccccccaggcacccacgaagccctgctccaaacagctctctccccacccccacctccaactagacccgtgtcccctccccaaaaggccaaagaagcacctaatacgcaggctcagccaatctctgacgacgaagccagcgacggcgaagagactcaggtgtcagcagctgacctggaagcgctgatctctgggcattaccccacctcattggagggagattgcgagccaagccccgctcctgctgtgctcgataaatgggtttgtgctcagccttcttcccagaaggccacgaaccacaatctccatataacagaaaaattggaagtgctggccaaagcctattcagtgcaaggggacaagtggagagccctgggctatgcgaaagctatcaacgcgttaaaatcattccataagccagttaccagctaccaagaagcttgctccattccgggaatcgggaaacgtatggcagaaaaaatcatagaaatactcgaatccggccatttaaggaagctggaccacattagtgaatcagttccggtactcgagcttttcagtaatatttggggggccgggacaaaaaccgcccaaatgtggtaccagcaggggttcagatccctggaagatatacgatcccaggcttcactcaccactcagcaggccataggactgaaacattactctgactttcttgagcgcatgcccagggaagaagccaccgaaatcgagcagaccgtccagaaggctgcccaggctttcaactctggcctgctctgtgtcgcctgcgggtcttataggaggggcaaggccacgtgcggagatgttgacgtgctcattacacaccccgacgggcgatctcaccggggcatcttttctaggctgctggacagcttacggcaggaaggctttcttacagacgacctggtgtctcaggaagaaaatgggcagcagcaaaaataccttggagtctgccggttgcccgggccaggtagaagacaccgaagactcgacattatagtcgtcccttactccgaattcgcttgcgctttacagggtggtgcatggccctctgctgcacacagtcattag

SEQ ID NO: 25735 - DNA, 903 bp, Artificial Sequence
  Description of Artificial Sequence: Synthetic coding sequence
atgctgatgcaccaccagaagtacctgcagcggttcctgggcggcaagagagagaaaaaacagaaagaagcctgctcgattcctggaatcgggaagcgcatggccgaaaaaattatagagatccttgaatccggacatcttaggaaactggaccatatttcggaatcagtccccgtgcttgagctgttcagcaatatctggggagcaggaactaaaacggctcagatgtggtatcagcagggtttccggtccctggaggatatacgcagtcaggcgtctctcaccacccaacaagccatcggcctgaaacactattctgatttcctggagcgcatgccacgcgaggaagctactgaaatcgagcagaccgtgcagaaggctgcgcaggcattcaatagcggcctgttgtgtgtggcctgtgggtcttatcgaaggggaaaggctacatgcggggatgtggacgtgctgataacacatccggacggtcgatctcacagaggaattttcagtcgcctgctggacagtctgcgacaggaaggtttcctaaccgatgaccttgttagccaagaagaaaatggacagcagcagaaataccttggcgtgtgtcgtctgcctggccccggcagaaggcatcgacgcctggacataatcgtcgttccatattctgaattcgcttgcgcgctcttatattttacaggttccgcacacttcaaccggagcatgagggccttagctaagactaaaggaatgtccctcagcgagcatgccctgtccacagccgtcgtgcgcaacacgcatggttgcaaagtgggccccggccgagtcctgcccactcctactgagaaagacgtgttccgcctcctaggattgccgtaccgagaacccgctgagagggactggtag

SEQ ID NO: 25736 - DNA, 1728 bp, Artificial Sequence
  Description of Artificial Sequence: Synthetic coding sequence
atggacccccggggcatcctgaaggccttccccaagcggcagaagattcatgccgatgctagcagcaaagtactcgctaagattccccgcagggaggagggcgaggaagcagaagaatggctgtcttccctgagggcccacgttgtaaggacagggattggcagagcccgtgccgagctgtttgagaagcaaatagtacagcacggtggccagctgtgcccggcgcaaggtccaggcgtgactcatattgtggttgacgaggggatggactacgaacgggccctgaggctcctgagactcccacagcttcctcccggggctcagctcgtgaaaagcgcatggctctcattgtgcctccaggaacgacggctggtcgacgtcgccgggttcagcatcttcattccttctaggtaccttgaccatccacagccgtccaaggccgaacaggacgcttcaatccctccagggacccacgaggccttgcttcagaccgcgctgtctccaccaccccctccaacacggcctgtctcccccccccagaaggctaaggaggcaccgaacacgcaggctcaacctatcagcgacgatgaagccagtgatggcgaggagacgcaggtgagtgccgccgatttggaggccctgatcagcgggcactacccgactagcctcgagggcgactgtgagccaagtcccgcccctgctgtgctagataaatgggtctgtgcacagccctcgagccagaaagcaacgaatcacaacctacacatcacagaaaagttggaagtgctggccaaagcttactctgtgcagggcgataagtggcgggcactggggtatgctaaagcgattaacgctctgaaatctttccataagcccgtcacaagctatcaggaggcgtgttccatccccgggatcggaaaaagaatggccgagaagattatcgagatcttggaatctgggcacctgcgaaagctggatcatatctccgagagcgtccctgtactcgagctgttcagcaatatatggggtgctggaactaaaaccgctcaaatgtggtaccagcaaggcttccgctccttggaggatataagatcccaggccagcctgaccactcagcaagctattggactcaagcattactcagacttcctcgagcgtatgcctcgggaagaggctacggagatcgaacaaacagtgcagaaggctgctcaagcatttaattctggcctgttatgcgtagcctgcggctcatacaggcgcggtaaagcaacatgcggggatgttgatgtgctgattactcacccggacggccggtctcatagggggattttttctcggctcctggattcactacgccaggaagggttcctcaccgacgatctggtaagtcaagaagaaaatggtcagcaacagaaatatctgggagtttgtcggttgcctggacctgggaggagacataggcggctcgatatcatcgtcgttccctattcagaatttgcctgtgcacttctgtacttcaccggctccgctcactttaacaggagcatgagggccctggccaaaacgaaggggatgtccctgtctgaacatgccctcagcactgctgtggtccgaaacacccatggatgcaaagtaggtcctggcagagtgctacccactccaacggaaaaggatgtgttcagactgcttggtttgccgtacagagagccagcagagagggattggtag

SEQ ID NO: 25737 - DNA, 516 bp, Artificial Sequence
  Description of Artificial Sequence: Synthetic coding sequence
atggactacgagcgggccctgcggctgctgcggctgccccagctgccccctggggctcagttagtgaagtctgcctggctcagcctgtgtcttcaggaaaggagactggtcgacgtagccggattttctatatttattccctccagtccctccctcatgatgaaacctgtgatgggaaagaagcctaggctcgtgcagttgatttggaagcctagcagcgttgcaactactccacctccccttcgggagattgtgagcctcgcccaacccctgctctcctggatcagcggctcagtgcattccccacaggctaggcgtaggccaatcaccacctcgatatcacagaggtcttggaaattctggcccaagccaaccgtctttagggaaactagtgggggcccctgggccatgcctaggccatcaatgcccagcagagcttctatttctctgagccccaggaccaggagaccagctgtatctctcggtctgggaagcggatggctgagaaagtcgtag

SEQ ID NO: 25738 - DNA, 747 bp, Artificial Sequence
  Description of Artificial Sequence: Synthetic coding sequence
atggaggccctgtgcgtgtgcagcctgatgcccctgcactggagctggattctgacggcgtcccacctcgctgcgttttttcagggttttagatcactggaagatatcaggagtcaagcttcactaactacccagcaggccatcggcctgaagcattacagcgatttcctggagcgtatgcctcgagaggaagccaccgaaatcgagcaaaccgttcagaaggctgcccaggctttcaacagtggattactctgcgtggcatgtggctcatatagacgtggtaaggctacgtgtggggacgttgatgtgctgataacccaccccgatggtcgctcccaccggggaatcttttcccggctgcttgacagcctccggcaggaggggttcctgacagatgatttagtgtcacaggaagaaaacgggcagcagcaaaagtacctcggagtgtgtaggctcccaggccctggacgacggcatagacgattagatatcatcgtggtcccctactctgagttcgcctgtgccctcttgtacttcacgggtagcgcccatttcaataggtctatgagggccctggccaagaccaagggcatgtcactttctgagcatgctttgtccactgcagtcgtgcggaatacccatggctgtaaggtcggccccggccgtgtcttacctacgccaactgagaaggacgtctttaggctgcttggactgccctatagagaacccgctgagcgcgactggtag

SEQ ID NO: 25739 - DNA, 1728 bp, Artificial Sequence
  Description of Artificial Sequence: Synthetic coding sequence
atggacccccggggcatcctgaaggccttccccaagcggcagaagatccatgcagacgccagcagtaaagttctggctaagatccctcggagggaagagggagaagaggctgaggagtggctgtcttcactgcgcgcccacgtcgtcagaactgggattggtcgtgcccgagctgagctctttgagaagcagattgtgcagcatgggggccagctttgtcctgcacaaggacccggcgtgacacacatcgttgtggatgagggcatggattacgagcgcgctctgagacttctgcggctccctcagctgcctcccggcgcgcagttggtgaagtctgcctggctcagcttatgtcttcaggagcgcagactcgtggatgtggctgggttcagtattttcattccatctcgctacctggaccacccccagccatccaaggccgaacaggatgctagtatacccccgggtacccatgaagcgctcctccaaaccgcgctgtctcccccgcctcctcccactcgacctgtgtcaccccctcagaaggctaaagaggcgccaaacacacaagcccaacccattagcgacgacgaggcgtctgacggtgaggaaactcaggtgagcgcagccgacttagaggcactcatttctgggcactaccccacaagcctagagggtgattgtgagccctcccccgcgccagcagttctggataagtgggtctgcgctcagccctcttctcagaaggcaacgaaccataatctgcacatcacagagaagttggaggtgcttgccaaggcatactcagtccagggcgataaatggcgagctttgggctacgctaaagccattaacgcgctgaaatcattccataagccggttactagctatcaggaagcttgtagcatccccggcatagggaagcgtatggcggaaaagatcatcgaaattctggaatcaggccacttaaggaagctggaccacatctcagaatccgtgcccgtgctggagttgttctctaacatctggggggcgggcacaaagactgcacaaatgtggtatcagcagggctttcgcagtctggaggacatccggtcccaagcaagtctgaccactcaacaggccatcgggctaaagcactatagtgacttcctagagcgtatgccccgcgaggaagccaccgagattgaacagacggttcagaaggcagcccaggcatttaatagtggattgctctgcgtcgcctgtggatcctacaggcgaggcaaagcaacttgtggggacgttgatgtgctgatcactcatcctgacggtagatcacatagaggaatcttcagcagattgctcgactcactgcggcaggaggggtttttgactgacgatctcgtcagccaggaggagaatggccagcaacagaaataccttggtgtgtgtagactgcctggtccaggccgacggcacaggagattggatatcatcgtcgtcccttactccgaattcgcttgtgcactcctgtacttcacaggctcggcccatttcaatcgctccatgcgcgctctcgcaaaaaccaaggggatgtccctctctgagcacgcgctttccaccgctgtggtgcggaatactcacgggtgtaaagtaggcccaggccgcgtgctgcccactcctacagaaaaggacgtatttagattactcggactgccctatagagagccagccgaacgagattggtag

SEQ ID NO: 25740 - DNA, 1464 bp, Artificial Sequence
  Description of Artificial Sequence: Synthetic coding sequence
atggactacgagcgggccctgcggctgctgcggctgccccagctgcctccaggggcccagttggtgaaatcagcctggctatctctctgcctccaggagcggaggctggtcgatgtagctggattctcgatcttcattccaagtaggtacctggaccacccccagccgagcaaggccgaacaggacgcgagcatcccacccggtacccacgaagccttgttgcaaacagctctgtctcctccacctccacctacccggcccgtcagccctcctcagaaagccaaagaagcacctaatacccaggcacagccaatctcagacgacgaggcttctgacggagaggagactcaggtgtctgcagccgatttagaggctttgatctctggtcactacccaacaagtcttgaaggcgattgtgagcctagcccagcacccgcagtactggacaaatgggtgtgtgcccagccttcttcacagaaagccaccaatcacaacctccacattactgagaaactggaagtccttgccaaggcatactctgttcagggagacaagtggagggccttgggctatgccaaggctatcaacgcccttaagtcttttcacaagccggtcacgtcttatcaggaagcctgttcaatccccggtattggcaaacgtatggctgaaaagattatcgagatccttgaatcgggccatctgcgtaaactggaccacattagcgaaagtgtcccagtattggaactcttttcgaacatttggggggcaggcaccaagacagcgcagatgtggtatcagcagggttttaggtctctggaggacattaggtcacaggcgtcccttaccactcagcaagcaatcggactgaaacattacagcgattttctagagcggatgcccagggaggaggcgacggagatagagcagaccgttcagaaggcagcccaggcattcaacagcggcctcctgtgcgtggcctgcgggtcttatcgacgtggaaaggccacgtgcggagacgtcgatgtgctaataacgcaccccgatggacggtcacaccgggggatcttctctcggctgctggacagcttgcgacaggagggttttcttactgatgacttagtgtcacaggaagaaaacggacagcagcagaaatatctcggggtgtgcagacttccaggaccaggaaggaggcataggaggttggatattattgtggtgccttatagcgagtttgcttgcgctctgctatacttcaccgggagcgcccactttaataggagcatgagggccctagccaagactaaagggatgagtctctcggagcacgcactgtctaccgctgtcgtccggaacactcacggctgtaaagttggtcccgggcgggtgctgccaactccgacggagaaggacgtctttcggctcctgggcctgccttatcgggagccggctgagcgcgactggtag

SEQ ID NO: 25741 - DNA, 1548 bp, Artificial Sequence
  Description of Artificial Sequence: Synthetic coding sequence
atggacccccggggcatcctgaaggccttccccaagcggcagaagatccacgcagacgcatccagcaaggtactagcaaagatcccacgacgtgaggagggggaggaagcagaggagtggcttagctcgctgcgcgcacatgtggtgcggaccggaatcggtcgtgcgagagcagagctgtttgagaagcagattgtccaacacggaggccaattgtgcccagcccagggtccgggggtaacccatattgtcgtggatgagggtatggactatgagagggcactgaggcttttgaggctgccacagctgccacccggagctcagttggtgaagagtgcatggttgtccttatgcctgcaggagagaaggcttgtagacgtcgcgggttttagtatcttcattccctcacggtatttagatcatccccagccctcaaaagccgagcaggacgcaagcatcccacccggaacacatgaggcattactgcagactgccctgtctcccccaccccctcctacgcggcccgtgagccccccccagaaggctaaggaagcccctaacactcaggctcagcctatttctgacgatgaggctagtgacggcgaggaaacgcaggtgagtgccgccgacctcgaggcccttatttccggacattatccaacttctctggagggcgattgcgaaccttcccctgcacctgccgtgcttgataaatgggtgtgtgcacaaccaagctcccagaaagccacaaaccacaaccttcacatcaccgaaaagctggaagttcttgccaaggcttattctgtgcagggggataagtggcgggcattgggttacgctaaggctatcaatgccctgaaatccttccacaagcctgtcacgagttatcaggaggcttgttctatcccagggatcggcaagcgaatggcagaaaagattatagagattttagagagcgggcacttgcgtaagcttgatcacatcagcgaatcagtgcccgtgctggaactgtttagtaacatttggggggcgggaactaagaccgcacagatgtggtatcagcagggctttcgaagcctagaagatatacggtctcaagcctccctgactacgcaacaggctattggtttgaaacactactccgattttctggaaaggatgcctagggaagaggctaccgaaatagagcagacagtacagaaagctgcacaggctttcaattcagggctgctgtgtgtggcttgtggctcgtatcgccgcggaaaggccacttgtggagacgtggatgtgctgatcacacaccctgacggacgttcccacaggggaatcttcagtcggcttctggatagtctgagacaggaaggattcctcactgacgatttagtgtcccaggaagaaaacggccagcaacaaaagtacttgggcgtctgccgcttgccaggaccagggcgaagacacaggcggcttgatattatcgtcgttccctacagtgaatttgcatgtgcgctgcagggcggggcctggccatccgccgcccactcacactag

SEQ ID NO: 25742 - DNA, 810 bp, Artificial Sequence
  Description of Artificial Sequence: Synthetic coding sequence
atggacccccggggcatcctgaaggccttccccaagcggcagaagattcacgctgacgcatccagcaaggtgttggctaagattcccagacgagaagaaggggaagaggcagaggagtggctgagtagcctccgagcacacgtcgtgcgcacggggatcggacgtgcgagagccgaactgttcgagaagcagatcgtgcaacacggaggccaactgtgccccgcacagggacccggagtgacacacatcgttgtggacgaaggcatggactatgaacgcgctctgcgcttgctgcgactgccacaactgcctcctggggcccagctagtgaagtcagcctggctctcgctttgtttacaggaacggaggcttgtcgacgttgctggcttcagcatcttcatcccctctcgctacttggatcacccacaaccatccaaggccgaacaagatgcgagcatccctcccggaacacacgaggctctgttacaaaccgctctgtccccccccccacctccaacccgtcccgtttccccgccgcaaaaggctaaagaagccccaaacacacaggcccagccaatatcagacgatgaggcatccgacggcgaagagactcaagtgtctgcagcggacttagaggcactgatcagcggacactatcccacatcgctggaaggtgattgtgaacccagtcccgctccagccgtcctggacaaatgggtttgcgcccaacctagttcccaaaaggccacgaatcacaacctgcatattaccgaaaagctagaagtcctcgcgaaagcctattctgtgtag

SEQ ID NO: 25743 - DNA, 1413 bp, Artificial Sequence
  Description of Artificial Sequence: Synthetic coding sequence
atggacccccggggcatcctgaaggccttccccaagcggcagaagatacacgccgacgcaagctcaaaagttctcgcgaagattccacgcagagaagagggggaggaggccgaagaatggctttcttcccttcgggctcacgttgtcaggactgggatagggcgtgcccgagccgaactattcgaaaagcagattgttcagcatggtgggcagctttgtcccgcgcagggcccaggcgtcacgcacatcgtggtcgatgaaggaatggattatgagcgagcacttagactgttgcgactgccacagctgccccccggcgcccaactagtcaagtcagcctggctgagtctctgtctgcaggagcgcaggctggtggatgtggcaggattctctatctttatccccagtagatatctggaccacccccaaccgagcaaagcagagcaagatgcgtccattccacccggcactcatgaggctctcttacaaaccgccttatccccgcccccccccccaaccaggccagtttcacccccacagaaagccaaagaggctcctaatacccaggcacagcctatctccgacgacgaggcgtccgatggcgaggaaactcaagaggcatgctccataccaggtataggcaagaggatggccgagaagattatcgagatattggaaagtggacatctgaggaaactggatcatattagcgagagtgtgcctgtcctggagctgttttccaatatttggggcgcggggacaaagaccgctcagatgtggtatcagcagggatttagaagcttggaagacattaggagtcaagcttctcttaccacccagcaggccattgggctcaagcactactcagattttctggagcggatgccaagggaagaggctacggaaattgagcagacggtccagaaagcggcacaagcttttaactccggacttctctgtgtggcttgcggcagctatagaagggggaaagccacatgcggagacgttgatgtgttgataacccaccccgatgggcgcagccaccggggaatcttttcccgtctgctagactccctgcgccaggaggctgtgccatcagttggccctgggttcctaaccgacgatcttgtatcccaagaggaaaacggtcagcaacaaaagtacctaggagtgtgtcgactgcctggacctggcaggcgacaccggagattggacattatagtagtcccctatagtgagtttgcttgtgcgctgctgtactttacggggtcagctcatttcaaccggtcaatgcgggccctggctaaaacaaaagggatgtccctatccgagcacgccttatcaactgcagtggttaggaacactcatggctgcaaagtcgggcctggcagagtgttgcctaccccaacttag

SEQ ID NO: 25744 - DNA, 1005 bp, Artificial Sequence
  Description of Artificial Sequence: Synthetic coding sequence
atggacccccggggcatcctgaaggccttccccaagcggcagaagatccacgccgatgcatcctcaaaacccagctgcgccagtgctcttcggtgtctatgcccagagtcagacatcggcgccgattctgcatgtcctggtccagcagaatggctgtcctccctcagagcgcacgtggtgagaaccgggatcggccgcgctcgagccgagttattcgagaagcaaattgtccaacacggaggacagctgtgccccgcccagggcccaggcgtcacccacattgtggtggacgaaggcatggactatgagagggcacttagactcctgcgactgccccagctgccacccggcgcacaactggtgaaatccgcctggctctcgctgtgcctgcaagagagacgtctcgtggatgtggcaggtttctccatttttatcccgtcccgctatcttgaccaccctcaaccgagcaaggcagagcaggacgcctcaattccgcctggaacccacgaggccttgctacagaccgccctgtcacctcctcctcctcccacccgccccgtgtcaccaccccagaaggctaaggaggcccctaacacacaggcgcagcccatctccgacgacgaagcgtcggacggtgaagaaactcaggtcagcgcagccgacctcgaggcattaatcagtggccactatcctacctccctggagggtgactgcgaacctagtccggcaccagctgtgctggacaagtgggtctgtgctcaaccctcaagccagaaagcaacgaaccacaacctccacattaccgagaaactggaggtgctggcaaaagcctacagcgtccagggggataaatggagggcattggggtacgccaaagcaattaacgctctcaaaagcttccacaagcccgtgacatcctaccaggaagcctgttctatccccggcattggaaaacgcatggccgaaaagatcatcgaaatcctcgagtccggccatctaagatag

SEQ ID NO: 25745 - DNA, 657 bp, Artificial Sequence
  Description of Artificial Sequence: Synthetic coding sequence
atgcaccaccagaagtacctgcagcggttcctgggcggcaagcgggaaaagaagcagaaagaagcatgcagcattccagggatcggaaagagaatggccgagaagataatcgaaatcctggaaagcggacatttgcggaagctcgaccacatttctgagagtgtgcctgtgcttgagctcttttcaaatatctggggggctggtactaaaacagcccaaatgtggtaccagcagggcttcagatctctggaggacatacggtcccaagctagcctgacaactcaacaggccatcggcctgaaacactatagtgacttcctcgagcgaatgcccagggaggaagccacagaaattgaacagacagtgcagaaggcagcccaagcctttaactctggactgctgtgtgtggcatgtggcagttatcggaggggcaaggccacatgcggtgatgtggatgtgctgattactcatcccgacggccggtcgcacagggggattttttctcggttactggatagtcttcgtcaagaggggtttctgacggatgatctcgtgtcccaagaagaaaacggacaacaacaaaagtacctcggggtgtgtagacttccgggccccgggcggcggcatagaaggctcgacatcatagtggttccctag

SEQ ID NO: 25746 - DNA, 567 bp, Artificial Sequence
  Description of Artificial Sequence: Synthetic coding sequence
atggacccccggggcatcctgaaggccttccccaagcggcagaagatccatgcagatgctagctccaaagtcttggcaaagattccgaggcgagaagaaggggaggaggccgaggaatggctgtcgtcactgcgagcccatgtagtgaggaccggaatcggaagagcaagagctgagttattcgagaaacagatcgttcagcatgggggccaattatgccctgctcagggccccggagtaactcacatcgtggtggacgagggtatggattacgaacgtgccttaagattgctgcgcctgccacagctacctcctggtgcacaactggttaaatccgcctggctgagcctctgtctgcaagagagaaggctggtggatgtggccggattctctatctttatccctagtaggtacctggatcatccccagccttcgaaggctgagcaggacgcctcaataccaccgggtactcacgaggccctgttgcagactgcgctctccccgcccccccctcccacccgaccagtgtctcccccgcagaaggctaaggaggctccaaatacctag

SEQ ID NO: 25747 - DNA, 516 bp, Artificial Sequence
  Description of Artificial Sequence: Synthetic coding sequence
atggactacgagcgggccctgcggctgctgcggctgccccagctgccccctggagcacagttagtgaaatccgcctggctatctctgtgcctgcaggaaaggagactggtggatgtggctgggttcagcattttcataccgagttcccccagtcttatgatgaagccagtcatgggcaaaaagcctcgactggtccaactgatttggaagccatcctcagtggccacaactcccccgcctctgcgagagatcgtctctcttgctcagcccttgcttagctggatcagcgggtctgtgcactccccccaggctaggaggcgcccaataactacaagtatttcgcagagatcttggaaattctggcccaaaccaacagtgttccgcgagacctctggcggcccttgggcaatgcccaggccctccatgccctccagggctagtatctccttgagccctaggactaggcgccctgcagttagtctgggcttaggtagtggctggctccgcaaatcctag

SEQ ID NO: 25748 - DNA, 459 bp, Artificial Sequence
  Description of Artificial Sequence: Synthetic coding sequence
atggactacgagcgggccctgcggctgctgcggctgccccagctgccccctggcgcacaattagttaaatcagcatggcttagtctgtgcttgcaggagagacgcctcgtagatgtggcgggattcagcattttcatcccctcttcacccagtctgatgatgaaacctgtgatgggaaagaagccccgtctggtacaacttatttggaagccttcctcagtcgcaacaactcctcctcccctgcgcgaaatcgtctctctggcccagcctcttttaagctggattagcggcagcgtgcacagccctcaggctagaaggagacctatcactacttcgatctctcagagatcatggaagttctggccaaaaccgaccgtcttcagggagacttctggcggtccctgggctatgcccagaccttcaatgcccagcagggccagtataagcctctctccctag

SEQ ID NO: 25749 - DNA, 939 bp, Artificial Sequence
  Description of Artificial Sequence: Synthetic coding sequence
atgcaccaccagaagtacctgcagcggttcctgggcggcaagcgggaaaagaagcaaaagccaatttcagacgacgaggctagcgatggagaagagactcaggaagcttgctcaatccctgggattggcaaaaggatggccgagaagatcatcgaaatactcgaaagtgggcacctgcgaaagctggatcacatctccgagagcgtgccggtgctcgagttattctccaacatctggggcgccgggacaaagacagctcaaatgtggtaccaacagggctttcggtctttagaggatataaggagccaggcctcactgaccacccagcaagccattgggctgaagcattactccgactttctcgaaagaatgccaagggaggaggcaaccgagatagagcagaccgtgcagaaagctgcccaggctttcaattctggacttttatgcgtagcctgtggaagttatcgtaggggcaaagcaacctgcggcgacgttgatgtgctgattacccatccagacggaaggagccacagaggtattttttctaggctgctcgattccctgagacaggagggtttcctgacggacgatcttgtctcacaagaggagaatgggcagcagcaaaagtatctaggagtgtgccgcttgccaggtcctggcagacggcaccgacgcctggacattattgtggtgccatatagtgagttcgcatgcgcattgttgtacttcactgggagcgctcatttcaatcgcagcatgagagcgttggccaagacgaagggaatgtccttgagcgagcacgcattgtccacggcagtcgtaaggaacacacacggatgcaaggtcggacccggacgtgtcctgccgaccccaacagagaaggatgtgttcagactcctcggtctgccttatagagagcctgcggaaagagactggtag

SEQ ID NO: 25750 - DNA, 1401 bp, Artificial Sequence
  Description of Artificial Sequence: Synthetic coding sequence
atggccgaccagctgtacctggagaacatcgacgagttcgtgaccgaccagaacaagatcgtcacgtacaagtggctcagctacaccctgggcgttcacgtaaaccaggctaaacagatgctgtatgactacgtagagcggaagcgaaaagaaaactccggtgcccaacttcacgtcacatacctcgtgtctggcagtctgattcagaatggccacagctgtcataaggtcgcggtcgttcgggaggacaagctcgaggccgtaaagtcaaagttggcagtcactgcgtcaattcacgtttatagcatccagaaggccatgctcaaggattccggacccttatttaacactgactacgacattctcaagtccaatctgcagaattgctctaagttctctgccatccagtgtgcagctgccgtcccacgggccccggcggaatctagcagctccagtaagaagttcgagcagagtcatctgcatatgtcctcagaaacgcaagccaataacgagctgacaactaacggccatgggccccccgcctcaaagcaggtgagtcagcagccaaaagggataatgggaatgttcgcaagtaaagccgctgccaaaacacaggagaccaacaaggagaccaaaacggaggctaaggaggtcacgaatgcaagtgcagctggtaataaagccccaggaaaaggaaacatgatgagcaatttcttcggaaaagcagccatgaataaattcaaggttaacctggattctgagcaggctgtaaaagaagaaaaaatagtagaacagcccaccgtatccgtgactgagcccaaactcgcgaccccagctgggcttaagaaatcctcaaagaaagcggagccggtcaaggtattgcagaaagagaaaaaacgaggcaaacgggtggccttatctgacgacgagacaaaagagaccgaaaatatgcggaagaaacgcaggcggatcaagctgcccgagagtgattccagcgaggacgaggtgttcccagattctcccggtgcttacgaggcggaaagcccaagtccaccgcctcccccatcgccaccgctagagccagttcccaagaccgagcccgagcccccctccgttaaatctagctccggagagaataaaaggaaacgaaaaagggtgctgaagagtaaaacttacctggacggcgagggatgtattgtgaccgagaaggtgtacgaatccgagagttgtacggatagtgaggaggaactgaacatgaaaacatcgagcgtgcacaggccgccagcaatgaccgttaaaaaggaaccccgggaggagcgcaagggtcccaaaaaaggcacggccgcgttaggcaaggcaaacagacaggtgagtattaccggattctttcagcggaagtag

SEQ ID NO: 25751 - DNA, 1284 bp, Artificial Sequence
  Description of Artificial Sequence: Synthetic coding sequence
atgctgtacgactacgtggagcggaagcggaaggagaacagcggcgctcagctgcacgttacttacctggtgtcaggtagcctcatccaaaacgggcactcctgtcataaagtagccgtggtgcgggaagataagttagaagcagtcaagagcaaactcgccgtgactgcctctattcacgtgtattccatccaaaaagccatgttgaaagactccggaccgctcttcaacactgactacgacatactgaaatctaacctgcagaattgttccaagtttagcgcaattcaatgcgcagctgcagttccacgggcaccagcggagagctcgtcgagcagcaaaaagttcgagcaaagtcacctgcacatgtcgagcgagacacaggccaacaacgagttaacgactaacggtcatggacctccagcctctaagcaggtatctcagcagccaaagggcatcatgggcatgtttgcttctaaggccgccgcaaagacccaggaaaccaataaggaaacaaaaacagaggctaaggaggttaccaacgccagtgccgcgggaaataaggctcctgggaaggggaacatgatgtccaatttcttcgggaaagctgcaatgaacaagtttaaggtgaaccttgattctgagcaggccgtcaaggaagagaaaattgttgaacagcctaccgtgtcggtcaccgagccaaaactcgcaacccccgcaggactcaagaagtcatcaaaaaaggctgaacctgtgaaagtactgcaaaaggagaagaaacgcgggaaaagggttgcactgagcgacgacgaaaccaaagaaacagagaatatgaggaagaagagacgacgcattaaactccctgagtcggactcatccgaggatgaggtctttcctgatagccctggcgcctacgaagctgaatcccctagccctcctccccctccgtccccccctctagagccagtgcccaagaccgagccagaaccacccagcgtcaagtcctcctctggagagaataagcggaagcgaaagcgagtgttaaaatccaagacatacttggatggcgagggttgtatcgtcaccgaaaaagtgtacgagtccgagtcttgcacagactccgaggaagagctcaacatgaagacttctagcgtccataggccccccgcaatgactgtcaagaaggagcctagagaggaacgaaagggccctaagaagggtaccgctgcactcggtaaggccaacaggcaagtgtctattacgggcttcttccaacgaaagtag

SEQ ID NO: 25752 - DNA, 1083 bp, Artificial Sequence
  Description of Artificial Sequence: Synthetic coding sequence
atgctgaaggacagcggccccctgttcaacaccgactacgacatcttgaaaagcaacttacagaactgctcgaagtttagcgcaatccagtgcgctgcggccgtgcctcgagccccagccgagtcaagttcgagttctaagaagttcgagcagagccacctgcacatgtcatccgagacccaggcgaacaatgagctcaccaccaatgggcacggacccccagcctccaagcaggtgagccagcagcctaagggcatcatgggcatgtttgcatcgaaggccgccgccaagacacaggaaaccaacaaagaaacaaaaaccgaagccaaggaagtaacaaatgcgtcagctgctggaaataaggcccccggcaaaggaaacatgatgtccaatttctttggtaaagccgctatgaataagtttaaggttaacttagactctgagcaggccgtgaaagaggaaaagatcgtggaacagcccactgtatccgttaccgagccaaaactggctaccccggctggtctgaagaagtcatccaagaaggcagagcccgtgaaggtcttgcagaaggaaaagaagcgtggtaagagggtggcactgtctgacgatgaaacgaaagagacagagaatatgcgtaagaagagacgccgaatcaaactccctgaatcagactccagtgaagatgaggtgttccccgatagccctggggcctatgaggcagagagtccatcaccgcctccaccacccagcccccctctggaaccagtgcctaagaccgaacccgagccaccatcagttaaatcgagcagcggcgaaaacaagcgcaaacgcaagcgggtcctgaagtccaaaacatacctggacggcgaaggctgcatcgtcaccgaaaaggtgtacgaatccgagagttgtactgacagcgaagaggaattgaacatgaaaacatcctccgtgcacaggccgccagcaatgactgtgaagaaagagccccgagaggagcgcaagggtcccaaaaaaggaaccgccgctcttgggaaagcgaatagacaggtgtcgataactggtttcttccaacgaaagtag

SEQ ID NO: 25753 - DNA, 804 bp, Artificial Sequence
  Description of Artificial Sequence: Synthetic coding sequence
atggccgaccagctgtacctggagaacatcgacgagttcgtgaccgatcaaaataaaatcgtcacgtacaaatggttgtcctacactctcggcgtgcacgttaaccaggctaaacaaatgctctacgattacgtggaacggaagcggaaggagaactctggagcccaactccacgtgacctatctggtgtccggttcattgatccagaacgggcatagctgtcacaaagtcgccgtggtcagggaagataaactcgaagccgtgaagtcaaagcttgcagtgacagcatccatacacgtgtactccatccagaaggctatgctaaaagactctgggcccttgttcaacaccgactacgatattctcaagtccaacctgcagaattgttctaaattctcggccattcagtgcgcggcggccgtgcctagggcccccgccgagagcagcagcagcagcaaaaagtttgagcaaagtcatttgcacatgtcctccgaaactcaagcgaataatgaactaacaactaatggtcacggccccccggcctccaagcaggtaagtcagcagcccaagggtattatgggaatgttcgcgtccaaagctgctgcaaagacgcaggagactaacaaagaaacaaaaacagaggcaaaagaggtgactaatgcctctgccgccggcaataaggcgccaggtaaggggaatatgatgtcaaacttttttggcaaagcggccatgaacaaatttaaggtgaacctcgattccgagcaagctgtcaaagaggaaaagatcaaagagaagaagcgttag

SEQ ID NO: 25754 - DNA, 1566 bp, Artificial Sequence
  Description of Artificial Sequence: Synthetic coding sequence
atgggcgaggtggaggcccccggccggctgtggctggagagccccccgggcggcgcaccaccaattttcctccctagtgacggccaagctctcgtgctggggcgcggccccctgacccaagtgaccgaccgaaaatgttccaggacccaggtcgagttggtagccgacccagagacccggaccgtggcagtgaaacagctgggggtcaacccgagtactaccgggacccaggagctgaagcccggtctggaagggagtctgggagtaggtgataccctgtatttagttaacggcctgcacccactgacccttcggtgggaagagacacggactccagagtcacaaccagatacccctcctggcacgcccctcgtgagtcaggacgaaaaacgggacgccgagttaccaaagaaaaggatgcgcaaatctaaccctggatgggagaacctggaaaagctcctcgtgtttactgctgccggtgtgaaacctcagggcaaagtggcaggattcgacctcgatgggaccttgatcaccacccgctccggaaaagtgttcccaaccggcccctctgactggcgcatcctgtacccagagattccccggaagctgcgggaactggaagctgagggctataagctggtgatctttaccaatcaaatgagcattggtcgaggcaaattacccgctgaggagttcaaggcaaaagtcgaggccgtggttgagaagctcggcgttccattccaggttcttgtcgccacccacgccggcctgtacagaaagcccgtgacagggatgtgggatcacctccaggaacaggcgaacgacggaacccctattagtattggagattctatattcgttggtgatgcggcaggtcgccctgccaactgggctccaggccggaaaaagaaggacttcagctgcgccgatagactatttgcccttaatcttgggctgccattcgcgacaccagaagagttttttttgaagtggcccgcagctggattcgaattacctgccttcgatccaaggaccgtgtcaaggagtggtccactctgtctacccgaatcccgcgcattgctcagcgctagccctgaggtggtcgtcgccgtggggtttcccggcgccggaaagtcgaccttcctcaaaaagcacctggtgtctgcgggctacgtgcacgttaatcgcgacaccttagggtcctggcagcggtgcgttacaacatgcgaaaccgccttgaagcaggggaagagggttgccatagataacaccaacccagatgctgcatcccgcgctcgttacgtacagtgcgccagggctgcaggagtcccctgcaggtgcttcctgttcacggccaccctggagcaagcacggcataataacagatttagggagatgacagacagctcccacatcccggtaagtgatatggtcatgtacggataccgcaaacagttcgaagcgcccacattagccgagggattctctgccattttggaaattccattcagactgtgggttgaaccaagactcggcaggctctattgccagtttagtgaagggtag

SEQ ID NO: 25755 - DNA, 699 bp, Artificial Sequence
  Description of Artificial Sequence: Synthetic coding sequence
atgctgggcgccatgttccgggccggcacccccatgccccccaacctcaacagccaaggtgggggccactacttcatagacagagacgggaaggcctttcgccacattttgaacttcctgagactgggaaggctggacctccctcgggggtatggtgaaactgcacttctgcgggccgaggccgatttctaccagatccgtcctttgttggacgccctgcgagaacttgaagctagccaaggaacgccagcacctaccgctgccctactccacgcagatgtagatgtctcaccgagactggtgcacttctcagcgcgcagagggccacaccactatgaactctcttctgttcaggtcgataccttcagagcaaacctattttgtacggacagcgagtgtttaggggccctccgggctcgttttggagtcgcgtccggcgacagagccgaaggctcccctcatttccacttagaatgggcacctcgccccgtggagcttccagaggtggagtatggccgtctgggcctgcagccattgtggaccgggggaccaggtgaaagaagggaagtggtgggaacgccttcctttctggaggaagtcctgcgcgtcgcactggaacacggcttcaggttggacagtgttttccccgatcccgaggatcttctgaacagccgttcactacgcttcgtgcgccattag

SEQ ID NO: 25756 - DNA, 5157 bp, Artificial Sequence
  Description of Artificial Sequence: Synthetic coding sequence
atgaaccagaacaccaccgagcccgtggccgccaccgagaccctggccgaagttcccgagcatgtgctgcggggtctgcccgaggaggtgagattatttcctagtgctgtggacaagacacgaataggggtgtgggccaccaaaccgatcctgaagggcaagaagttcgggccctttgtgggcgataagaagaaacgcagccaggtcaaaaataacgtgtacatgtgggaggtctattacccgaatttggggtggatgtgcattgacgcaaccgatcccgaaaaaggcaattggcttcggtatgtcaactgggcgtgcagcggagaggagcagaacttgttccccctagagattaaccgggccatttactacaaaacgttgaaacctattgctcccggggaagaactgctagtttggtataatggcgaggacaacccagaaatcgctgcagcaatagaggaagagagggccagcgccagatcgaagcgcagttcacctaagtccaggaagggcaaaaagaagagccaggagaacaaaaataaaggtaacaaaatccaggacattcagctaaaaacctctgagcctgatttcacttctgctaatatgcgggatagcgcagagggcccaaaagaagatgaagagaaacctagcgcatctgctctcgaacagcccgcaacattgcaagaggtagcgagtcaggaggttcccccggagctcgccacaccggcgccagcctgggaaccacagcccgaacctgacgaacggctggaggctgccgcctgtgaggtgaatgacctaggcgaagaggaagaggaagaggaagaggaggatgaagaggaggaggaagatgatgacgatgatgaactggaggatgaaggcgaagaagaggcttctatgccaaatgaaaactctgtgaaggagcccgagattcgttgcgatgagaaaccagaagatctgctggaagagcccaagactacatctgaggagaccttggaggactgtagcgaagttacccctgccatgcaaatcccaagaactaaagaggaggccaatggcgatgtgtttgagacgttcatgtttccatgtcagcactgcgaaagaaagtttaccaccaagcagggcctcgaacgccacatgcacatccatattagcactgtcaaccatgccttcaaatgtaaatactgcgggaaggccttcggtacgcagattaacaggcgcaggcacgaaaggcgtcacgaggctggcctcaagcggaagccatcccagaccctgcaaccttccgaagacctggctgatgggaaggcgagcggggaaaacgtggccagtaaggatgatagcagtcctccctcactcgggcccgactgtctcattatgaactctgagaaggcctctcaggacactatcaatagtagcgtggtggaagagaacggggaagtgaaagagctgcacccttgcaagtactgcaaaaaggtctttggcacacacacaaacatgcgtcggcatcagaggagagttcatgagcgtcacttgattccgaaaggggtcagacggaaaggtggtctagaggaacctcagccccccgctgaacaggcccaggcaacacagaacgtatacgtgccaagcaccgagcccgaggaggagggagaggccgacgatgtgtacatcatggatatcagcagcaacatctctgagaacctgaactactacattgacggtaagattcagacaaataataacacaagtaactgtgacgtcatcgagatggaatccgccagcgccgacctgtatgggattaattgtctgctgactcctgtgaccgtagaaatcacccagaatattaagacaactcaggtgccagtgaccgaggatctgccaaaagagccgctgggctctaccaacagtgaggcaaagaaaagacgaaccgcttctccccccgccctgcctaagatcaaggctgagaccgatagcgatccaatggttccttcatgcagcctgtcactccctctgagtatcagcacaacagaggccgtttcattccacaaagaaaagtccgtttacttatccagtaaattgaagcagctgcttcaaacacaggataaactgacccccgctggcattagcgcgaccgagattgccaagctgggaccagtctgtgtgtcagcccccgctagcatgctgccagttaccagctcgcgattcaaaagaaggactagcagtcctccgtcatccccgcagcatagcccagccctgcgtgacttcggcaaaccctcggacggtaaggccgcctggactgatgctgggctcactagtaagaagtccaagctggaatctcactctgatagccccgcatggtctttgtcagggcgggacgagagggagacggtgtccccaccttgtttcgacgaatacaagatgagtaaggaatggactgctagcagcgcctttagcagcgtgtgtaatcagcaacctcttgatttgagcagcggggtaaaacagaaggcggagggaaccggtaaaacgcctgtgcaatgggaatccgtactagatctgtccgtgcataaaaaacattgttccgacagcgaaggaaaggaatttaaggagagtcattctgttcagccaacgtgtagtgccgtgaagaagagaaagccaaccacatgtatgctgcagaaggttttattgaatgagtacaacgggatcgacctgcccgtcgagaatcctgccgacggcacacgatctccaagtccatgcaagtctctcgaagctcagcccgacccagacctggggccaggtagtgggtttccagcccccacagtggagagtacgccagacgtgtgcccaagttcgcctgcccttcaaacgcccagcctcagctctggccagctgccaccccttttgatccctactgacccctcaagtccccccccctgtccaccagtgctgacagtagctaccccgcctcctcctctgctgcccaccgtgcccctccccgccccctcatccagcgccagccctcatccctgtcccagccccctgtccaatgcaacagctcagagccccctcccaatcctaagccctacagtctcaccttcaccctcacctatcccacctgttgagccgctgatgagcgcagcctcaccaggaccaccaactttgtcatcatcttctagtagtagtagttccagtagttcttttagctcaagctccagcagttcctcgccctctccaccacccttaagcgctatttcatctgtcgtcagcagtggcgataacctagaggcctctttgcctatgatcagctttaaacaggaggaactggagaacgagggtctgaagccgagagaggaaccacagtcagcggcagagcaggacgtggtggtgcaggagacctttaataaaaacttcgtgtgtaatgtttgtgaatctccctttctttctatcaaggaccttacaaaacacttaagcatacatgcagaagaatggcctttcaagtgtgagttttgtgtacagctttttaaggacaagactgatctcagtgagcacagattcctgctgcatggcgtgggtaacatcttcgtatgctctgtgtgtaagaaggaatttgcatttttatgcaatttacagcagcatcagagggatctgcatcctgataaagtgtgcacacatcacgaatttgaatctgggacacttcgtccacagaatttcacagacccaagcaaagcacacgtggagcatatgcagagtcttcccgaagatcccctggagacctcaaaagaggaggaggaactgaacgacagcagtgaagagctctatacaacgatcaaaatcatggctagcggtatcaaaacaaaggatcccgacgttagactgggcttaaatcaacattacccatcctttaaacctcccccattccagtatcaccacagaaaccccatgggtattggcgtgacggcaacgaacttcacaacacacaacatcccacagactttcacaaccgctatacgatgtacaaaatgcgggaagggggtcgacaacatgccagaactccacaagcacatcctggcttgcgccagtgcttctgataaaaagcgctacacccccaaaaagaacccggtacctctgaaacagaccgttcaacctaagaacggagtggtcgttctggacaattcaggcaagaacgcattcagacgcatgggccagcccaaacggctcaatttttcagtcgagctctccaaaatgtctagtaacaaacttaagctcaatgctctgaagaagaagaaccaattggtccagaaagctatcctccaaaagaacaaatctgctaagcagaaggcagacctcaaaaacgcctgcgaatctagcagtcacatttgcccgtactgtaatcgtgaattcacctatatcggctccctgaacaagcacgctgctttcagctgtcccaagaagcccctatcacccccaaagaagaaagtctcccactcaagtaaaaagggagggcattcgtcccctgctagttcagacaagaactccaactcaaatcatagacgccggacagcagatgccgagatcaaaatgcagtcgatgcagacgccactggggaaaacaagagcacggagttccgggccaactcaggtacctctgcccagttcgagcttcagaagcaagcagaatgtgaaattcgccgcgtcagtcaaatctaaaaagccctcttcatcttctctccggaattcttctccaattcgtatggccaaaattacacacgtagagggcaagaagcctaaagccgttgctaagaaccattctgctcagttatcgagtaaaacttctcggtcactccatgtacgagtgcaaaaatcaaaagctgtgctgcagagcaaatctacactggcgtctaaaaagcgaactgaccgctttaacattaagagtcgggagaggtctggcgggccagtgaccagatccttacagttggcggctgccgcagacctgtccgaaaataaaagggaggatggaagcgctaagcaggagctcaaggacttctcttacagtttgaggctggcctcccggtgcagtccccctgcagcgccatacattacgcgtcaataccgaaaggttaaagcccccgccgccgcccagtttcagggtcctttctttaaggagtag

SEQ ID NO: 25757 - DNA, 5049 bp, Artificial Sequence
  Description of Artificial Sequence: Synthetic coding sequence
atgaaccagaacaccaccgagcccgtggccgccaccgagaccctggcagaggttcctgagcatgttctgcgaggtctaccagaggaggtgcggctctttccatccgctgtggataaaactaggatcggtgtttgggccaccaagcccatccttaaaggcaagaagtttggaccatttgtcggtgataagaagaagagaagccaggtgaaaaataacgtctatatgtgggaggtctactatcctaatctggggtggatgtgcatagatgctaccgatcctgaaaaggggaactggctgagatatgtgaactgggcttgcagtggtgaagaacagaacctgtttcccctggaaataaaccgcgcgatctattataagacattaaagccaattgcacctggagaagagctcttggtgtggtacaatggcgaggacaaccctgagatcgcagctgcgatcgaggaagagagggctagcgcacggtccaaaagatcctcaccgaaatccaggaagggtaagaagaagtctcaggaaaacaaaaacaagggaaataagatccaggacattcagcttaagacgagcgagcccgactttacgagtgccaatatgcgtgatagtgctgagggccctaaggaggatgaagagaagcccagcgcgtctgcgcttgagcagccagcgaccctccaggaagtggcgagccaggaggtgcctccggagctggccaccccagcccccgcttgggagccacagccagaaccagacgagcgcttagaggccgctgcctgcgaggtgaacgatctgggggaggaggaggaggaagaggaggaagaagacgaagaggaagaggaagacgacgatgatgatgagctagaggacgagggagaagaagaagccagcatgccaaacgaaaactcagtcaaagagcctgaaattaggtgcgatgagaagccagaagaccttctggaagagccgaaaactactagcgaagagacactggaggactgcagcgaggtgacacccgcaatgcagatcccccggacaaaagaggaggccaatggggacgtcttcgagacgtttatgttcccttgtcagcactgcgaaaggaagtttacaaccaaacaggggttggagaggcacatgcacatacatatttcgactgtgaaccatgcctttaagtgtaagtactgcggcaaggcgttcgggactcaaatcaacaggcgcaggcacgagcggagacacgaagccggattgaagagaaagccatcccagactctgcagcccagtgaagatttggccgacgggaaagcttccggagagaacgtggcctccaaagacgactcctccccacccagcctcgggccggattgtctgatcatgaattccgagaaggccagccaggacactatcaatagtagtgtcgttgaggagaacggcgaagtcaaggagctgcatccttgtaagtactgcaagaaagtgtttggcacacataccaatatgaggaggcatcaaaggcgtgtgcacgagcgacaccttatacctaaaggagtgagacggaagggaggacttgaggagccacagccacctgctgagcaggcgcaagccacacagaatgtgtatgtcccgtctacagaaccagaagaggaaggggaagctgacgacgtatacatcatggatatttcctctaatatctcagaaaacctgaattactacatcgacgggaagatccagaccaataataatacttccaactgtgacgtcatagagatggagagcgcatctgccgacttgtatggcatcaactgtctgctgacaccagtgaccgtggaaatcacccagaatattaagaccacccaagtgcccgtgaccgaggatttgccaaaggagcctctgggctccacaaactcagaggcaaaaaaaagaaggactgctagccctccagcacttcctaaaattaaagcagaaaccgacagcgaccctatggttccgagttgtagtctttctttacccctcagcattagcaccacggaggccgtatcttttcataaggaaaagtcagtgtatctttcgtcaaagttaaaacagctcttacagactcaagataaattgacacccgccggcatttcagcgacagagattgccaaactggggccagtctgcgtgtcagcaccggcttcaatgctgccagtcacttcttcccggtttaaacgtagaacaagtagcccaccttctagccctcagcactcccccgcactgagagatttcggcaaacccagtgacggaaaagccgcctggaccgatgccggcctgacatccaaaaagagtaagttggaatctcactctgactcgcccgcttggagcctgagcggacgcgacgaacgggaaactgtgagtccaccttgtttcgacgagtataagatgtcaaaggagtggactgctagtagcgctttctcatctgtgtgcaatcagcaaccgctcgatctgtcaagcggagtgaagcagaaagcagaagggacgggcaagacgcctgtgcagtgggagagcgtcctcgatctatctgttcacaaaaagcattgctcagactctgaaggcaaagagttcaaggaatctcactctgtgcagcccacatgttctgcagtgaagaaaaggaagccaactacatgcatgcttcagaaggtgctgttgaatgagtataatggaatagacctgccagttgagaatcctgcggacggaacacgttcaccctctccgtgtaagagcctcgaggcccagcctgaccccgatctcggtccaggttcaggtttccctgctcccaccgtggagtccaccccggacgtgtgcccaagcagccctgccctgcaaacccccagtctgagctcaggtcagctgcctccattactgatccccacagacccatcatctccaccaccatgccccccagtacttacagtggcaacccccccacctccccttctacccacagtgccattgcccgccccatcctcatctgctagtccgcatccctgcccctccccactgagtaatgccaccgcccagagcccattacctattctatcacctacggtgagccctagcccaagccctataccacccgttgaaccgttaatgtccgcagcttcccctggccctcctacactgtcatcgagctcttccagctcaagttcctcttcctcttttagctcctcttcttcctcaagcagcccctccccaccgcccctcagcgctatctcatccgtggtttcttccggggataacctggaggcatcccttcccatgatcagtttcaaacaagaggagctggaaaatgaagggctcaagccaagggaagagccccagtctgcagccgaacaggacgttgtagttcaggagacctttaataagaacttcgtgtgcaatgtctgcgaaagcccttttctgtccattaaagatttgacaaaacatctttctatacacgcagaggagtggccatttaaatgcgaattttgcgttcaactttttaaagacaaaacagatctgagcgagcatcgctttctgctgcacggggtcggcaacatctttgtgtgcagtgtctgtaagaaggagttcgccttcctgtgtaatctacagcagcatcagcgcgatctccatcctgacaaggtttgtactcaccatgaattcgagagcgggacactcagacctcagaactttaccgacccctcaaaggcccacgtggaacacatgcagtcactgccagaagatcccctagagacctccaaggaggaggaagaattgaatgacagttccgaagaactttatacgacaattaaaattatggctagtggcattaagactaaagatcccgatgttaggctcggactgaatcagcactatcctagtttcaagcctccaccattccagtaccaccaccgaaatcctatgggaattggtgtaactgccaccaattttactacccataacataccacagaccttcactaccgccatccgttgcacaaaatgcggtaagggtgtggacaacatgcctgagctgcacaagcacatcttagcttgcgccagcgcgtcagacaagaagaggtacacacctaagaagaatccggtgccgttgaagcagacagtgcagccaaaaaatggagtggtcgttctggacaattccggcaagaacgctttcagacgcatgggacagccaaagcgacttaacttttccgtcgagctctccaagatgtcgtcaaataaattaaaactcaatgccttgaagaaaaagaaccaactggtacagaaagctatcctccaaaaaaacaagtctgccaagcaaaaggccgacttaaaaaatgcctgtgagagcagtagccatatctgtccgtactgcaatcgagagttcacctatataggcagcctcaataagcatgcggcgttctcatgcccaaagaagcccctcagcccccctaaaaagaaggtctcccacagctccaaaaagggaggtcatagctcgccggcgtcatccgacaagaacagcaacagcaaccataggcggcgaaccgcagatgctgagatcaaaatgcaaagcatgcagactccactggggaagacacgggctcgatcgagtgggcctactcaggtgccactgccctcctcgagtttcaggtccaaacagaacgtgaaatttgccgcctctgtaaaaagtaagaagccctcttcgagcagcctccgaaatagtagcccgatacgcatggcaaaaatcacacatgtggaaggaaagaagccaaaagccgtggcaaaaaaccattctgctcagttgtcgtctaaaacttcacgatccctacatgtacgagtgcagaaaagtaaggccgtgttgcagagcaaatcgactctcgccagcaagaagcggactgaccgatttaacataaaatcccgggaacgttccggcgggcctgttactcgcagtctgcaactcgcagcagctgccgatctctctgagaataagagggaagacgggtccgctaagcaagagctgaaagattttcgaaattttctttag

SEQ ID NO: 25758 - DNA, 4446 bp, Artificial Sequence
  Description of Artificial Sequence: Synthetic coding sequence
atgcgggacagcgccgagggccccaaggaggacgaggagaagcccagtgcttcagcactcgaacagccggccaccttgcaagaagtcgcatctcaggaagtgccccccgagcttgcgacacctgcccccgcttgggagccgcagccagaaccggacgaacgccttgaggcggctgcttgcgaagtgaatgatctcggcgaagaggaagaggaagaagaggaagaggacgaggaagaggaggaggatgacgatgatgacgagctggaggacgagggcgaggaggaagcaagcatgccaaacgaaaatagcgtcaaggaaccagaaatccgatgtgacgaaaaacctgaggatttactggaagagcctaagactacgtcagaagagacactcgaggattgctccgaagtcacgcccgctatgcagattcctaggaccaaggaagaggctaatggcgacgtctttgagacatttatgttcccatgtcagcactgcgagcgcaagtttaccacgaagcagggcttagagcgccatatgcacattcacatcagcacagtcaaccatgcgtttaaatgcaagtactgcggcaaggccttcgggacccaaataaatagacggagacacgaaagacgccatgaagccggacttaagcgaaaaccttcacagaccctgcaacccagtgaagatcttgccgatgggaaggctagtggagaaaatgttgccagcaaagacgacagttcccctccaagcctcggccccgattgcctgattatgaactcagagaaagcctcccaagacacgatcaattcctctgtggttgaggagaacggtgaggtaaaggaactgcacccatgcaagtactgtaagaaagtcttcggaactcataccaacatgcgccgtcaccagcgccgggtgcacgagagacatttgatccctaagggagtacgccggaaaggcggactggaagaaccccaacccccagccgagcaggcacaagcgacacaaaacgtctacgtgcccagcacagagcccgaggaggagggagaagcagacgacgtttatatcatggacatctcctctaacatttctgagaacctgaattattacatcgatggaaagatccagacaaataataatacaagtaactgcgatgtgatcgagatggaaagcgcctccgctgatctctacgggatcaactgtttgctgactccagtgactgtcgagattactcagaatattaaaaccacacaggttccagtgacagaggacttaccaaaggagcccctgggatccactaatagcgaagccaaaaaaaggaggacagcgtcacccccagctctgcctaaaatcaaagcagaaaccgactctgatcctatggtgccgagctgctccttgagcttgcctctgagtatatctaccacagaggcagtttcgttccacaaagaaaagtcagtttaccttagttcaaagctgaagcagttgctccagacccaggataagctcacgcccgctggtatatccgccaccgagatagccaaactggggccagtgtgtgtaagcgcacccgccagcatgctcccggtgacctcgtctcgattcaagagacggaccagttcccctccatctagtccccagcatagtccagcgctgcgcgacttcggtaaaccgtctgatgggaaggcagcctggacagatgcagggttaacctcgaaaaagtccaagctcgagtctcactcagactcacctgcctggtcattgtctggacgcgacgaacgggagactgtgtctccaccgtgttttgacgaatacaagatgtccaaggagtggactgcctcctccgcattctcctctgtttgcaatcagcagccactggacttatcatcaggtgtcaaacagaaagctgagggaactggcaaaacacctgtgcagtgggaatctgtactggacctcagtgtgcacaaaaagcattgctcagattctgaaggaaaagagttcaaggagtcccattctgtgcagcctacctgcagcgctgtcaagaagagaaaacctactacgtgcatgctgcagaaggtgctgcttaacgagtacaatggaatcgatctgcccgtcgagaaccccgctgacggaacaaggtcccctagcccctgcaagagcttggaggcccagcctgatccagacttaggaccaggtagtggcttcccggctccaacagtcgagagcaccccagatgtttgtccctcaagccccgccctgcaaactccgtctctgtcaagtggtcaactcccccctctcctgattcccactgatccgtcgagcccccccccctgtccccctgtgctaacagttgctacaccacccccgcctctgctgcctacagttcctctgccagcccccagctcaagtgcaagtccccacccctgccctagcccgctgtccaacgccactgcccaatcacccctgcccattctgtctccgaccgtttccccatcaccctcaccaatcccgcccgttgagccactcatgtcagccgcatctcccggccctcccaccctgtcttccagttcatcctcatctagctcgagcagtagtttctccagcagctcttccagctcttctccctcacctccgccactgagtgcaatttcctccgtcgtgtcaagcggagacaacctggaggcctccctgcctatgatatcctttaagcaggaggaactcgagaacgagggcctcaagcccagggaagagccacaatccgccgctgaacaggatgtagttgtccaggagacatttaataagaactttgtgtgcaatgtgtgcgaatccccgtttctgtcgataaaagatctcacaaagcatctgagcattcatgccgaggagtggccttttaaatgtgagttctgtgtgcaactgttcaaggataagactgatctctccgaacaccgattcctgcttcacggtgtaggaaacatttttgtctgcagcgtttgtaaaaaagagttcgccttcttatgcaatctccaacaacaccagcgggacctccaccccgataaagtgtgtacccatcacgaattcgagagcgggaccttgcgacctcaaaacttcaccgacccatccaaggctcacgtcgaacatatgcaatccctgccagaagatcctcttgaaacgtcgaaggaagaggaagaattaaacgattcaagcgaggagctgtataccaccattaagattatggcatcaggtatcaaaacaaaggatcctgacgtgcgcctcggtctcaatcagcactaccccagctttaagccaccacccttccaataccaccataggaatcctatggggatcggtgtgaccgcgactaacttcacaactcacaacatcccccaaaccttcactacagccattcgctgcactaaatgtgggaaaggggtcgataacatgcctgagctacacaaacacattttggcctgtgcttccgcttccgacaaaaagcggtacactcccaaaaaaaatcctgtgcctcttaaacagaccgtccagccgaaaaacggcgttgtggtactcgataacagcggcaaaaatgccttccggagaatgggtcagcctaaacgtcttaacttcagcgtcgaacttagtaaaatgagctcaaacaagctgaagctgaatgccctgaaaaagaaaaaccagctggtgcaaaaggccattttacaaaaaaataagtcagccaaacagaaggctgatctgaaaaatgcttgcgaatcctcttcacacatatgcccttattgtaatagggagttcacatatatcggaagtctgaataagcacgcagcctttagctgccccaagaagccattgagtccacccaagaaaaaagtctcccactcttcaaagaagggcggccatagctctccggcctcatccgacaagaacagcaattccaatcaccgccgtcggacggcagacgctgaaataaaaatgcaaagcatgcaaacaccgctcgggaaaacacgtgcccgctctagtgggcccacgcaggttcccctgccctcttcgtcattccgttccaaacaaaacgtgaagttcgcagcgtcagttaagtcaaaaaagccatcatcaagttcactgcggaactcttcccccatcagaatggcgaaaattactcatgttgaagggaagaagccaaaagcagtggctaaaaaccattctgcccagttgtccagcaagaccagtagatccctccacgtgcgggtccagaagagtaaggccgtgctgcagagtaaatccacactcgcctcgaaaaaaagaacggacagattcaacattaagtcgcgtgagaggtccggaggaccagtcacgaggtctttgcagcttgccgccgccgcggatctgagcgagaacaaaagagaagacggaagcgctaagcaggaattgaaagacttcaggaatttcttgtag

SEQ ID NO: 25759 - DNA, 681 bp, Artificial Sequence
  Description of Artificial Sequence: Synthetic coding sequence
atgaaccagaacaccaccgagcccgtggccgccaccgagaccctggccgaagtgcccgaacatgtccttcgcgggttaccagaagaagttcgcctcttccccagcgccgtcgacaagaccagaattggggtgtgggccacgaagcctatactgaagggcaagaagttcggcccattcgtgggagacaagaagaagaggtcccaggtgaagaataacgtgtacatgtgggaggtgtattatcccaacctgggctggatgtgcattgacgcaacggatcctgagaagggaaattggctccgttacgtcaactgggcttgttccggggaagagcaaaatctcttccctctcgaaatcaaccgggccatatactacaagactctgaaaccgatcgcacccggggaggagctgttagtttggtataatggcgaggacaaccctgaaatcgctgccgcgatcgaagaggagagagcctccgctcggagcaagcgaagttcccctaagtcacgtaaggccaccgcatccgcatggaggcccgatgcattgcaccagcggccgcgaaccagccctggttccatcggaagatcgaaattgcagcttcaaccgagctcacgcgaccattctagtaagtcccgccactctggctgctcgcttacagcccccgaggtgacttggaaccagtag

SEQ ID NO: 25760 - DNA, 5049 bp, Artificial Sequence
  Description of Artificial Sequence: Synthetic coding sequence
atgaaccagaacaccaccgagcccgtggccgccaccgagaccctggctgaggtgccagagcacgttcttagagggctcccagaggaggtcaggttatttccgtccgccgtagacaaaaccagaattggggtttgggctacgaagcccatcctgaaaggtaaaaagttcggtcctttcgtgggcgataaaaagaagaggagccaagtcaaaaataatgtttacatgtgggaagtgtactatccgaacttgggctggatgtgcatcgacgccaccgatccagaaaaaggcaattggcttagatacgtgaattgggcgtgttctggggaagagcagaacctgttcccactagagatcaacagggcaatctactataaaacacttaagcctattgctcccggagaagaactgctggtatggtataacggcgaggacaatcccgagattgcagccgccatcgaggaggagcgggcctccgccaggtccaagcggtcttctcccaaaagcaggaaaggaaagaaaaaaagccaggaaaataagaataagggtaataagatccaagacatccagctgaaaactagcgagcccgattttacctctgcaaacatgagagacagtgcagaggggcccaaggaagacgaggaaaaaccgagcgcatcagcactggagcagcccgctaccctccaggaggtggcctcacaggaggtccccccagaacttgcgaccccagcccccgcctgggagcctcagcccgagccagacgagcggctcgaggctgctgcttgcgaggtaaacgatctgggagaggaggaggaagaagaagaagaggaggacgaagaagaggaggaggacgacgacgatgatgaactggaagacgaaggcgaagaggaggcgagtatgccgaacgaaaactccgtgaaagaacctgaaatccgatgcgatgagaagccagaggacctccttgaggaaccgaagaccacctccgaggaaaccttggaagattgctccgaggtgaccccagcaatgcagattccacggaccaaagaggaggcaaacggcgatgtttttgaaacgttcatgttcccctgtcagcattgtgagcgcaagttcaccaccaaacagggactggagaggcatatgcacattcacatcagtacagtgaatcacgcgtttaaatgtaagtattgcggcaaggcattcgggacgcagataaatcggaggagacacgagcggcgacacgaagctggcttgaagcgaaagccctctcagacactgcaaccctctgaagaccttgccgatgggaaggccagtggggaaaacgtcgcgtccaaagacgactcaagtcccccatcccttggacctgactgccttattatgaatagcgaaaaagcctcccaggacaccattaacagcagcgtcgttgaagaaaatggagaagttaaggagctgcacccctgcaagtactgtaaaaaggtcttcggaacccacaccaatatgagaagacaccaaaggcgagtccatgaacgccacttgattccgaagggggtgcggcggaaaggcggtcttgaggaaccccagccaccagcggaacaggcacaggccacacagaatgtctacgtgccttccactgaacctgaagaagaaggggaggctgacgatgtgtacattatggacatttctagcaatattagcgagaacctcaattactatatcgatgggaagattcagactaataataacacgtcaaattgcgacgtgatagagatggaatcagcatccgctgatctttacggtattaattgtttgctgacccctgtaacagtggaaattactcagaacatcaaaacaacacaggtgcctgtgacagaggatctgcctaaagaacctcttggctctaccaactcagaagctaaaaaacgtcgtactgccagcccgccggccctgccgaagattaaagctgagactgattccgaccccatggtgcccagctgtagcttgtctctgcctctgagcattagtacaactgaggctgtcagcttccataaagagaagtccgtctatctgtcctcaaagctgaagcagctgctacagacacaggataagctgacacccgctgggattagcgcaacggagatagccaagctgggcccagtctgcgtgagcgccccggcaagcatgctccccgtgactagctccagatttaagcgccggaccagcagccccccaagcagccctcaacacagccccgctctacgggattttggaaagccttcagacggcaaggccgcttggaccgacgcgggattaactagcaagaagtccaagttggagagccatagcgattcccctgcctggtcgctttccggtcgcgatgaacgagagacggtctcccccccctgtttcgacgaatataagatgagtaaggaatggaccgccagcagcgcattctccagtgtctgtaaccaacaacccctagatctgtcgagcggggttaagcagaaggcggagggcacggggaagacgcccgtgcaatgggagagcgtactcgacttgtctgtgcataagaaacactgttctgactctgagggcaaagagttcaaggagagtcattctgtgcaacccacgtgctccgccgtcaagaaaaggaaacccacaacatgcatgcttcaaaaggtcctgctgaacgaatataatggaatcgacttacccgtggaaaacccggctgacggcaccagaagcccgtccccctgtaagagtctcgaggcgcaaccagaccctgatttagggcccggttccgggttccctgcccctactgtggaaagcacaccagatgtctgtccatccagcccagccctgcagaccccttcactgtctagtgggcaactgccaccacttctcataccaacggatccaagttctccccctccatgtcctcctgtgttgaccgtcgccactcctcccccccctcttctgcctactgtccccctgccagccccatcctcttcggccagcccacacccgtgccctagccccctctcaaatgcaaccgcacagagtcctctgccgatactgtccccaaccgtgtctccaagcccatcccccatccctccagtggagccacttatgtctgccgccagcccaggccccccaaccttatctagctctagctcttcaagctcatcgagctcgtcattctcctcttccagttcttcctccagcccatcacccccaccgctgagcgccataagctcagtagtgagcagtggtgataatctcgaggcctcgctgcctatgatttcatttaagcaagaggagctggaaaacgaagggttgaagccacgcgaagagccccagagtgcagcagagcaggacgtagttgtgcaagagacatttaacaaaaacttcgtgtgtaatgtgtgcgagtccccattcctgagtataaaagatctgacaaagcacctgtcaatccacgcagaagaatggccgtttaagtgcgaattttgcgtccagctgttcaaggacaaaactgacctctccgagcataggttcctcctgcatggtgtcggcaatatcttcgtctgctccgtatgcaagaaagagtttgcttttctgtgcaacttgcagcagcatcaaagagaccttcatcccgataaagtctgtacacatcatgaatttgaatctggaactctgaggccccagaactttactgacccgtccaaggctcatgtggagcacatgcagtcactgccggaggaccccctcgaaacttccaaggaggaagaagagctcaacgattctagtgaggaactgtataccactattaaaattatggctagcggcataaagacgaaagatccagacgtgcggctggggctcaatcagcactacccctccttcaaacctccccccttccagtaccaccaccggaatcctatgggaattggagtgacagccactaacttcaccactcataacatcccgcaaacattcaccactgcgatccgctgtaccaaatgcggcaagggggtggacaacatgccagagctgcataagcacatcctggcctgtgccagcgcaagtgataagaagagatatacacctaagaaaaaccctgtccctttgaaacagaccgtgcagcccaagaatggcgttgttgttttagacaactctgggaagaacgccttcaggaggatgggccagccaaagcggctcaacttttcagtagagctgagtaagatgtcctccaacaagctcaagttgaatgctttgaagaaaaaaaatcagctggtgcagaaggcaattttgcaaaagaataagagcgccaagcagaaggcggatctgaaaaatgcttgtgagtcgtcctctcatatttgcccctattgcaaccgcgagttcacctacataggaagcctcaataagcatgcagcgttttcttgtcctaaaaaacccctcagcccacctaagaagaaagtatctcacagcagcaagaagggcgggcactcatcccccgcatctagtgataaaaacagcaattcgaatcatagacgcaggacggccgatgctgagattaagatgcagagcatgcagacacccctgggtaaaactcgagcccgatctagcggcccgacacaggtaccactgccaagctcttccttcaggtctaagcagaatgtcaagtttgccgcctccgtcaagtctaaaaagccgagcagcagctcccttaggaatagctctccaattagaatggctaagattactcatgtcgagggtaagaaacctaaagcggtggccaaaaatcattctgcacagctgtctagcaaaacgagcagaagcctccacgtgagggtacagaagtccaaggccgtgttgcagagcaagtcaaccctggctagcaaaaagagaactgaccggtttaacattaagtctagagaaaggtcaggaggcccagtgacacgatccctgcagttggcagcagctgccgacctgtccgagaacaaacgcgaggatggctctgccaagcaagagctgaaggatttcagatgcttcctatag

SEQ ID NO: 25761 - DNA, 237 bp, Artificial Sequence
  Description of Artificial Sequence: Synthetic coding sequence
atgcgggacagcgccgagggccccaaggaggacgaggagaagccctccgcatcggcattagaacagccagctaccctacaggaggttgctagtcaggaggtccctcccgagctggccacccccgccccagcttgggaaccccaaccagagccagacgaacgattagaagcggcggcatgcgaagtgaacgatcttggcgaagaagaagaggaggaagaagaagaagatgaggagtag

SEQ ID NO: 25762 - DNA, 4446 bp, Artificial Sequence
  Description of Artificial Sequence: Synthetic coding sequence
atgcgggacagcgccgagggccccaaggaggacgaggagaagcccagcgccagcgccctggaacaaccagccacgctgcaggaggtggcctctcaggaggtcccaccagagctcgcaacaccagcacctgcatgggagccacagccagagcctgacgagagattagaagccgccgcctgcgaagtgaatgatctgggggaagaagaagaggaggaggaggaagaagatgaagaggaagaggaggacgatgacgatgatgagttagaggatgagggcgaggaagaagccagtatgcctaatgagaactccgtgaaagagcccgaaattcggtgcgacgagaagccggaggatctacttgaggagccaaagacaaccagcgaggaaaccctggaagactgctctgaagtaactcccgctatgcagattccgcgcacaaaggaagaagcaaatggggatgtattcgaaactttcatgttcccgtgtcagcattgtgaacgtaagttcactacaaaacaaggcttggagaggcacatgcacatacacatttccactgtgaaccacgcgtttaaatgcaagtactgtggtaaggcattcggtacgcagatcaatcgccgacggcacgagcggaggcacgaagccggcctgaagcggaagcccagtcagacattacagccatccgaagacttggccgatggtaaggcctctggcgaaaatgtcgcaagcaaggatgacagcagccccccatccctaggaccagactgtctcatcatgaactccgagaaagcttcccaagatacaataaatagctccgtcgtcgaagagaatggtgaagttaaagagttacatccctgtaagtactgcaagaaagtgttcgggacacatactaatatgagaagacaccagcggcgcgtgcacgagaggcatctgatcccaaaaggcgttcggaggaaaggcggactcgaggagcctcagcccccagccgagcaggctcaagctacccagaacgtgtacgttccctctaccgaacccgaagaagagggggaggccgatgatgtgtatatcatggatatatcgtccaatatctccgaaaatttgaactattacattgacggtaagatccagacaaacaacaacaccagcaattgcgatgttattgagatggaatcggccagcgcggatctttacggcattaactgtttgctgactcccgtgaccgtcgaaattactcaaaatatcaaaaccactcaggtgcccgttaccgaggatctgccaaaagaacccctagggagcacgaattccgaggcaaagaagaggcgcaccgcatcaccaccagcacttcccaaaatcaaagccgaaacagattccgatccaatggtccctagttgctctctcagtttgccgctgtccatctcgaccaccgaagctgtctcattccacaaggagaaaagtgtgtatctatcctccaagctgaagcagcttctgcagacgcaggataagctcacccccgctggtatctctgccaccgaaatcgccaaactgggacccgtgtgtgtgtccgcgccagcaagtatgctgcctgtgacctcttctcggtttaaaaggaggacctctagtcccccctcttcgccccaacattcacccgccctccgggactttggcaagccttccgatggcaaggcagcgtggactgatgccggtctcacttccaaaaaaagtaagctggaatctcactccgacagccctgcatggagcctcagtggccgtgatgagcgggaaactgtttcccctccgtgctttgatgaatacaaaatgtccaaggaatggactgccagctctgccttcagttccgtatgtaatcagcagcccctggatctaagttccggagtaaagcagaaagcagagggaactggaaaaacgcccgtccagtgggaatccgtattagacctgtccgtgcataagaaacactgtagtgatagcgagggtaaggaattcaaggagagccatagcgtccaacctacctgcagtgctgttaagaagcggaagccaactacctgcatgctgcagaaagtacttctgaacgagtataacgggatcgatctccccgtagagaacccagccgacggtacacgcagtcctagcccttgcaagtccctggaggctcagcccgaccccgacttaggccccgggagtggctttcctgccccaacagttgagagtacccccgatgtttgtccgtcttctccagctctgcagaccccctcactcagcagtgggcagctgcctcctctgttaatccccacagacccctcaagcccacctccatgtcctcctgtgctcacggtcgcgacgcctcctccccctctgcttccaacagttccattgcccgctccctcctcgtctgcctctccccatccctgtccttctcccttgtctaatgctaccgcccaaagcccattgcctatcctcagtcccaccgtgtccccgtcgccctcacccattcctcctgtggaacctttgatgagtgctgcttctccaggaccccccaccctctcctcatctagcagcagttcctcctcttcaagtagtttttcaagcagctcaagctccagctcgccaagtccaccacctctttctgctatcagtagcgtcgtgagcagtggcgataacctcgaggcgtctctcccaatgattagtttcaagcaggaggaattggaaaacgagggcctgaaaccacgggaagagcctcagtccgccgccgaacaggacgtggtcgtgcaggagaccttcaacaagaacttcgtttgtaatgtatgtgaatctccgtttttgagtatcaaagatttgactaaacatctgtcgattcatgccgaggaatggccgtttaaatgtgagttttgcgtccagctattcaaagacaaaaccgacctgtccgagcaccggtttttgctgcatggcgtcggtaacatcttcgtctgcagcgtgtgcaaaaaagaatttgcatttctgtgcaatctgcagcagcatcagcgcgatctgcaccccgataaagtctgcacacatcatgagtttgagtctgggacactgagaccccagaacttcacagacccctccaaggcccacgtcgaacacatgcagagcctcccagaggatcccttggagacctccaaagaagaggaggagttaaatgatagctccgaagaactgtacacgacaattaaaatcatggccagcgggataaagacaaaggaccccgatgtgaggctgggactgaatcagcactatccttccttcaagccccctcccttccaatatcatcacagaaaccccatgggcattggggtgacagcaacaaacttcactactcacaacattcctcaaacttttaccaccgctattcgctgcacaaaatgcggtaagggcgtggacaatatgcctgagctgcataaacatatccttgcgtgtgcatctgcctcggataaaaaaagatacactcccaaaaaaaacccagtgccactgaaacagaccgtgcaaccaaaaaacggcgtcgtcgtactggacaacagtgggaagaacgcttttaggagaatggggcaaccaaaacggctgaacttcagtgttgagttgagtaagatgagctctaacaaattaaagctgaatgccctcaaaaagaaaaatcagctggtacagaaggctatcctgcagaaaaacaagagcgctaagcagaaagcagatttgaaaaatgcgtgtgagtcatcttcacatatatgtccctactgcaatcgagagttcacatatattgggtcactcaacaagcacgccgccttttcctgtcccaagaaacctctgagcccgccaaagaaaaaggtgtcccactctagcaagaaaggcggccatagttcccctgcgtcctccgacaaaaattctaactctaatcatcgacgtcgcaccgctgacgcagagataaagatgcagtccatgcaaacacctctgggcaagacgcgcgcacgctcatccggaccgacccaggtgcctctgccaagttcaagttttaggtcaaagcagaacgtgaagttcgccgcttcagttaaaagcaagaaaccctcatcctcatctctgagaaactcatcccccatacgcatggccaaaataacacacgttgaggggaagaagcccaaagctgtcgctaaaaatcactcagcccaactgtcatctaaaacctctaggagtctgcacgtgcgagttcagaagtccaaggccgtcctgcagtccaaatcaaccttagcttccaagaagcggaccgatcgctttaatatcaagtctcgggagaggagcggcggtcctgtgaccaggagtctgcagctggctgcagccgctgatctgtctgagaacaagagagaggacggctctgcaaagcaggagctgaaggacttcagaaactttctgtag

SEQ ID NO: 25763 - DNA, 675 bp, Artificial Sequence
  Description of Artificial Sequence: Synthetic coding sequence
atgagcagctacttcgtgaacagcaccttccccgtgaccctggcctcaggccaagagtctttcctgggccagctcccactttatagctccggctacgccgatccactaaggcattaccccgctccttatggacccggccccggacaagataaaggctttgccaccagctcatactatcccccggcgggtggcggatacgggagggccgctccctgcgattatggacccgctcctgcgttctacagagaaaaggaaagtgcctgcgctctctctggggccgacgaacagccccctttccacccagaacctcgaaaatccgattgtgctcaggataagtccgttttcggtgaaacagaggagcaaaagtgctccactcctgtctatccatggatgcagcgtatgaattcctgcaacagctcctcttttgggcccagcggccgaagaggccggcaaacatacacaagatatcaaaccttggagctcgagaaggagttccactataaccgttacctgactaggaggcgtcggatcgagatagctcatgccctctgtttgacagagaggcagattaagatctggttccaaaatagacgtatgaagtggaaaaaagagagtaaattactcagtgcatcgcagctctcagcggaagaagaggaagagaagcaagctgagtag

SEQ ID NO: 25764 - DNA, 2496 bp, Artificial Sequence
  Description of Artificial Sequence: Synthetic coding sequence
atgaccgagctgaaggccaagggcccccgggccccccacgtggccggcggacctccttcacccgaagtcggaagccctctcctctgtagaccagccgctggtcctttccccggctcccagacgagcgacacactaccagaggtctccgctatacccatctccctggatggactgctcttccctcggccttgccagggtcaggacccaagcgatgagaaaactcaggaccaacaaagtttgagcgacgtcgagggagcttattccagggctgaggctacccgaggtgccggcggctcttcgagctcacctcccgaaaaggattctggccttctggacagcgtgctggacacgctcctggcaccctctggacctggacaatcgcaaccctccccccccgcgtgtgaagtaacatcaagctggtgcctgttcggacccgaattgccagaggatccaccagccgcacctgctacccaaagagtgctttctccgctgatgtctagatctggatgcaaggtgggtgattcttcgggaacagctgcagctcacaaggttctacccagggggctgtctcccgcacgccagctgctcctacctgctagtgagtcaccacactggtcgggcgcacccgtcaagccttcccctcaagccgccgctgtggaggtggaggaagaggatggatccgaatctgaggagtccgccggacccctactgaaaggaaagccacgggccctggggggggccgccgctggagggggggccgcagcagtgccccctggtgcagcggctggaggggtggccctggtgcccaaggaagacagcagattcagtgccccaagagtcgcactcgtagaacaggacgccccgatggctccgggtcggtcaccattggccacaacggtgatggactttatccacgtgcccatattacctctgaaccatgccctgcttgccgcacgtacccgccagctcctcgaagacgagagttacgatgggggggcgggagcagctagcgcttttgcgccaccccgctcgagcccttgcgcgagttccacacccgtggcggtgggagactttcctgactgcgcctacccccctgatgccgaacctaaagacgacgcctatccgctctattccgattttcagccccccgccctgaaaatcaaggaggaagaggagggggctgaagcaagcgcgagatctccaagatcatacctcgttgccggggcaaacccagccgcatttcctgactttccactgggacctcccccaccactgccgcctcgggcaactccgtcccgcccgggggaggctgcagttactgctgcccctgcatccgcgtctgtatcgtctgcttcatcttctggatctactttggagtgtattctgtataaagctgagggtgcccctccccagcagggaccttttgctcctccgccatgcaaagcacccggggcttctgggtgcctactcccaagggatggacttcctagcacctctgcctcggccgccgcggctggcgctgctcctgccttgtatccggctctcggactgaacgggctccctcaacttggataccaggcggccgtgcttaaagaaggactgcctcaggtataccccccttacctcaactatttgagacctgactcagaggcttcacaatcgccacagtatagctttgagagcttgccccagaagatttgtttgatctgtggcgatgaagcatcaggatgccactacggtgtccttacatgcggtagttgtaaagtcttctttaagcgggccatggaaggccagcacaactacttatgtgctggtcgcaacgactgtattgtggataagatccgcaggaagaattgtcccgcatgtagacttcgcaagtgttgtcaggcaggaatggttctgggaggctttagaaacctccatattgacgaccagatcacgttaattcaatatagctggatgagtctcatggtctttgggctggggtggcgttcctacaaacatgtttctggacaaatgctgtactttgctcctgacctgatcctgaatgagcaaaggatgaaagagtcgagtttctattcgctgtgtctgactatgtggcagattccacaagagttcgtaaaactccaggtaagccaggaagaatttctttgtatgaaagtgctcctgctgttgaatactattcccttggagggcttaagatcacagacccagtttgaggaaatgagaagctcttacatacgcgaattaatcaaagctataggtttgcgtcagaagggggtggtgagttcttcccaaaggttctatcaactcactaagctgttagacaatcttcatgacctggttaaacagctgcacctctattgcctgaatacattcatccagtccagagctctgagtgtggagttcccagagatgatgagcgaagtcattgctgcccagctcccgaagatcctcgccggcatggtgaagccccttttgttccacaagaaatag

SEQ ID NO: 25765 - DNA, 2802 bp, Artificial Sequence
  Description of Artificial Sequence: Synthetic coding sequence
atgaccgagctgaaggccaagggcccccgggccccccacgtggccgggggccctcccagtccagaagttgggagccctctgttgtgccgtccagcagccggcccctttcccggttctcagacttcagacactctcccagaagtaagcgcaattccaatctccttggacggactgctatttccgcggccttgccagggccaggatccaagtgatgagaagacccaagaccagcagtcattgagcgacgttgaaggcgcttacagcagggccgaggccacccggggagccggtgggtcctctagctccccgcctgaaaaagattcagggctgctcgactctgtgcttgatacgctcctggccccttcgggtcccggacaatcccagccctcacctccggcctgtgaagtcactagcagttggtgcctttttggcccagaattgcctgaggatccaccagcagctcctgccacacagagggttctgtcaccattgatgagcagatccggatgcaaagtaggcgactcctctgggactgccgctgcccacaaagttttgcctcgtgggttatctccagcacgacaactcctcctccccgcctccgagtcaccccactggtccggcgctcccgttaagcccagtccacaggctgcagctgtggaagttgaagaggaggatgggagcgagtccgaggagtctgctgggccgcttctgaaaggtaagcctagggctttaggcggtgccgcagccgggggcggagccgcggcagttccccctggcgctgctgctgggggtgtagccttggtgcctaaagaggacagccgatttagtgcaccccgagtggccctggtcgaacaggacgctccgatggctcccggccggagcccacttgccactaccgtgatggatttcattcacgtgccaatactcccacttaatcacgccctgctggccgcacgcacgaggcagttgctggaggacgagtcttatgatgggggagcaggtgccgccagtgccttcgcaccaccaagatctagcccttgtgcttccagtactccagtggccgtcggggatttcccagattgcgcgtatccgcccgatgcggagcccaaagacgacgcttatcccctgtattctgattttcaacctcctgcattaaaaattaaggaggaagaggaaggggctgaagccagcgccaggtcccccaggtcgtatttagtggccggcgcaaatcccgcagccttcccggacttccctctcggaccaccgccacctctacctcctagagctaccccttctcgtcccggcgaggcagccgtaacagccgctcccgctagcgcttcagttagctcagcatcctctagcggtagtacattagagtgcatattgtataaagcagaaggagccccaccccagcagggcccatttgcacctccaccttgcaaggcccctggagctagcggctgcctgctgcccagagacggtcttccaagtacctctgctagtgcagccgccgctggggcagctcctgcactctatccagcactcggattgaacggtctaccccagctggggtatcaggctgctgtgctcaaagagggtctgccacaagtgtacccgccatatctgaactacctccgccccgattcagaagcctctcagagcccacaatatagctttgagtccctgcctcagaaaatctgcctaatctgtggcgatgaggcttcaggatgtcattacggagtgttaacctgtggaagctgcaaggtgtttttcaaacgcgcaatggagggccagcacaattacctttgtgcgggtaggaacgattgcatagtggacaagattcgtagaaagaattgccctgcttgcagactgaggaaatgttgtcaggcaggtatggtgctgggaggccgaaagtttaaaaagttcaataaggtcagagtagtccgcgctctggacgctgtggccctcccgcagccagtaggggtgcccaatgagtctcaggcactatctcaacggttcaccttttcccccggtcaggatatccagctgattccaccactaattaacctactcatgagtatcgaaccagatgtgatttacgctggccatgacaacaccaaacccgataccagcagctctcttctgacatccctcaaccagctgggggaaaggcagctgctgagtgtggtaaaatggtccaaatctctgcctggcttccgcaacctccacattgacgaccagattactctgatacagtacagttggatgagtttgatggtgttcggccttggatggagaagttataaacacgttagcggccagatgttatactttgcacctgacttaatattgaacgagcagcggatgaaagagtcatccttctacagcctctgcctgacgatgtggcagataccccaggagttcgtcaaacttcaggtctcccaagaggagttcctgtgcatgaaagttttactacttctgaatacaattccattggaaggactaaggtcacagacacagttcgaggagatgagaagctcctatatcagggagctaatcaaggccataggcttacgtcagaaaggagtcgtgtcttcgagtcaaaggttctaccagttaactaagttgcttgacaacctgcacgacctggtgaagcagcttcacctgtactgcctcaatacttttattcaaagccgcgctctgagcgttgagttccctgaaatgatgtcagaggtgatcgccgcacagcttcctaaaatcctggctgggatggtgaagcccctcttgttccacaaaaagtag

SEQ ID NO: 25766 - DNA, 2088 bp, Artificial Sequence
  Description of Artificial Sequence: Synthetic coding sequence
atgaccgagctgaaggccaagggcccccgggccccccacgtggccggcggcccccctagcccggaggtgggtagcccactgctttgtcgaccagctgctggaccatttccagggtcgcagacaagcgatacgttacccgaggtcagcgcaattcccattagcttagacggcctgctgtttcccagaccctgtcagggacaggacccctctgacgagaagacccaggaccagcagtccctcagtgacgtcgaaggcgcttattcgagagccgaggcaacccgaggagcaggaggatcctcgtcgagtccgcctgagaaggatagtggactgctcgatagcgttctggatacactgctcgcccctagcgggccaggacagagccagccatctcccccagcctgcgaagtgacatcaagctggtgcctgttcggcccagaattgccggaggatccaccagccgcgccagcgacccagcgcgtactgtcacctctgatgagccgttccggttgcaaggtgggggactcaagcgggactgccgccgcccacaaagtgctgcccagaggactgtccccagcacgccagcttcttctgccagcgagcgaatctccccattggagtggcgcccccgtaaaaccatccccacaggccgcagcagtggaggtggaggaggaagacgggtcagaaagcgaagaatccgcggggccgttgctgaagggaaaacctagggccctcggtggagccgctgccggcgggggcgctgctgctgttcctcctggcgccgcagctggtggagtcgctctcgtgcccaaagaggattctcggttctcagcgccccgggtcgcgctggttgagcaggacgccccaatggcccctggcagaagtcctttggccacaaccgtaatggatttcatccacgtgcccattctaccccttaaccacgcattacttgccgcccggactcgccaacttctagaggacgaaagctacgacggtggggctggggctgcttcggctttcgctccccccagatcaagcccctgcgcgtcatctactccagtggccgtgggcgacttccctgattgcgcctacccgccggatgcggagcctaaagacgacgcctatccactgtacagtgattttcagccgcctgcactgaagatcaaggaagaagaggaaggagctgaggcatcggcgcgcagtccccggtcctacttagtggccggcgcaaatcctgcggccttcccggactttccacttggaccacccccccccttgcccccacgagcaacaccaagtcggccgggggaagcagccgtcacggccgctcccgcctctgcctccgtgtctagtgcttcctctagcggatccacactggaatgtatcctgtataaggccgaaggcgctccacctcagcaggggccttttgctccacccccctgtaaagctcccggggcgtcaggctgcctcctccccagggatggtctgccctctactagtgcttccgctgcggcggcgggggccgcgcctgctctctatccagcgctcggcctgaacgggcttccccagctgggctaccaggcagcggtccttaaggagggactgccacaggtctacccaccttatcttaattatctgagacctgattctgaagctagtcaatctccgcagtattcatttgagtcattgccgcagaaaatctgtctcatctgcggcgatgaagcatcaggctgccactacggggtcctcacatgcggttcctgcaaggtcttctttaagcgggccatggaggggcaacataactatctgtgtgccggaaggaacgactgcatagttgacaaaatcagacgcaaaaattgtcccgcttgccgattaaggaagtgttgccaggccggcatggttctcggtggcttcaggaacctgcacatcgacgaccaaattacgctgattcagtacagctggatgagccttatggtgtttgggctcggctggagatcctacaagcatgtctcggggcagatgctctacttcgccccagatctgatccttaacgattcctttggtcgggctacgaagtcaaatccggtgtag

SEQ ID NO: 25767 - DNA, 2295 bp, Artificial Sequence
  Description of Artificial Sequence: Synthetic coding sequence
atgaccgagctgaaggccaagggcccccgggccccccacgtggccggcggccctccttcacccgaggtgggaagccctctgctatgccggcccgctgctggcccgttccctggctcccagacctcagatacacttcccgaggtctctgctattcccatctccctagacggactgctgtttccacgaccctgtcagggccaagatcccagcgacgagaagacccaggaccagcaatctctcagcgacgtggagggagcctatagccgagccgaagctaccaggggcgccggaggatcttcaagcagccctcctgaaaaagactcgggcttattggattcagtcctcgacacgctgctcgctccctcggggccgggacagtcacaaccttcacccccggcatgcgaggttacttcaagctggtgtctgtttgggccagagttgcctgaggacccaccggcggctccggcgactcaacgagtgctaagtccactgatgtcgcgaagcggctgcaaagtgggggattcttcaggtactgctgccgcccacaaggtcctcccaaggggactgtccccagcccgacaattactgctgccagcctctgagtcccctcattggtcaggcgccccagtgaagcccagcccacaagctgcagcggtggaggtagaagaggaggacggctcagagtccgaggagagcgccggcccgctcctgaaaggaaaacctagagccctgggcggagcagccgcggggggaggcgccgctgccgtgccaccaggagcagctgctggcggggtggcactggtgccaaaggaggatagccggttttcagcacctagggtggcgctcgtggaacaggacgcccccatggctccgggtagatctccgctcgccactactgtgatggacttcatacacgtacccatcctgcctctgaatcatgcactgctggcagccaggacacgtcagctcctggaagatgagtcatacgatggaggggccggcgctgcaagcgccttcgctccgccaaggagcagcccatgtgcatcctcgaccccagtggctgtcggtgatttccctgactgcgcgtaccccccagatgcggagccaaaagatgatgcatatcctctatattctgattttcagccccccgctttaaaaattaaagaggaggaggagggcgctgaagcctccgcacgtagcccccgaagctatttagtggctggtgctaatcctgcagccttcccagactttcctttggggcccccgccacctctgccacctagagccacaccctcaagacccggcgaggccgccgtaactgcagcccccgcaagtgcctctgttagttctgccagtagctcaggctcaactcttgagtgtattctttataaggctgaaggggcccccccacaacaaggcccattcgcccccccaccctgtaaggctcccggcgccagcggctgcctgctccctagagacggattgccatccacctcagcctctgcagctgccgctggtgccgccccagccctatacccggcactcgggctaaacggtctgccacaactcggctaccaggcagctgtgctgaaagaaggcttacctcaggtgtatcctccttatctaaactacctgcgtcccgattccgaggcttcacagtcccctcagtattccttcgagtcactgcctcagaagatatgtttgatttgcggcgatgaggctagcggctgccattacggagtcttgacgtgcggaagttgcaaggtttttttcaaaagagccatggagggcaggaagtttaagaaattcaacaaggtcagggtggtgagggctctggatgcagtcgcactgccacagccggtgggcgtgccgaatgagtctcaagctctgtctcaaaggttcacgtttagtcccggccaggacattcagctcatcccccccctaataaacctgctaatgagcatcgagcccgacgtgatttacgcaggccacgacaataccaaacctgacacttcaagcagcctgctcacatccctgaaccaattgggggagagacagcttttgtctgtggtcaagtggtccaagtcattgccaggtttccggaacttacacatagatgatcaaattacacttatccagtattcgtggatgagcctaatggtattcgggctgggatggcgcagctacaagcatgtctctggacagatgctttattttgccccagatcttatcttgaatgagtcacatcgatccttatcaagtttcaagctggccaagaaaagctccagcgtctag

SEQ ID NO: 25768 - DNA, 1020 bp, Artificial Sequence
  Description of Artificial Sequence: Synthetic coding sequence
atggagggccagcacaactacctgtgcgccggccggaacgactgcatagtggataagatccgtaggaagaattgcccggcttgccggctgcgaaagtgctgtcaggccggcatggttctgggaggcagaaagttcaaaaagttcaacaaggtgcgggtggtgagagctctggatgccgttgctctgccccaacccgtgggggtccccaatgagtcccaggccctctcacagcgcttcacattcagtcctggacaggacattcagcttattccaccgttaattaatctgctgatgagcattgaacctgatgtgatttatgcgggacacgacaacacgaagccagatacctcatctagtctgctcacaagcttgaaccagctgggggaaagacagttgctcagcgtggtcaaatggtctaagtctctcccgggatttagaaacctccatatcgatgaccagataaccttaatccagtactcatggatgagtttaatggtattcggactgggctggcgaagttataaacatgtttccggacagatgctgtatttcgcccccgacttgatcctcaatgagcaacgcatgaaagaaagctctttctactcactctgcctgacaatgtggcagatcccccaagagtttgtcaagctgcaggtgtctcaagaggaattcctttgtatgaaggtactcttgctgctcaacaccatacctctggagggcctgaggtcccaaacccagtttgaagagatgcgttcaagctatatccgagagctgataaaagcgatcggcttaagacagaaaggagtggtttccagtagccagagattttatcagctaaccaagctcctcgataatcttcacgatctcgtaaaacagttgcacctctactgtttgaacacattcatccagagccgggccctgtcagttgagtttcctgagatgatgagcgaagtgatcgctgctcaattgcccaagatacttgctgggatggtcaaacctttgctgttccataagaaatag

SEQ ID NO: 25769 - DNA, 2412 bp, Artificial Sequence
  Description of Artificial Sequence: Synthetic coding sequence
atgaccgagctgaaggccaagggcccccgggccccccacgtggccggcggcccaccttctcccgaggtgggctcccccctgctctgtcgtccagcagcggggcctttccctggtagtcagacttcagatacactgccagaggtaagtgctatccctatttccttagatgggttgctcttcccacggccttgtcagggacaggatccttcagacgagaagacccaggatcagcagtcgttgtccgacgtcgagggggcttatagtcgggctgaagcaactcgaggagcaggcgggtcgagttcctcaccgcccgaaaaggattctggacttttggactccgtgctagacacactccttgcgccctcaggcccaggacagtcccagccctctccaccggcatgcgaagtgaccagttcatggtgtctgtttggaccagagcttcctgaggatcccccggcggcacccgcaacccaaagagtcctgtcccccctgatgtcaagatctggttgcaaagttggcgacagttccggaaccgcagctgcacacaaagtgctgccccggggtcttagcccagccaggcagctcctgctgcctgcatcggaatccccccactggagtggggctccggtcaagccttcccctcaggctgctgccgtcgaagtcgaggaggaagacggatctgagtccgaagaatcagctggacccctactgaagggaaagccccgcgcccttggaggtgctgccgccggcggaggagccgctgccgtccccccaggcgctgctgccggcggggtggctttagtaccaaaagaggacagccgtttcagcgccccccgggtggcacttgtcgagcaagacgccccgatggccccagggcgctcaccactggctacaaccgtgatggacttcatccacgttccaattctcccgttgaatcacgccctgcttgctgcgagaactaggcagctgctggaagacgagagctatgatggcggagctggggcagcaagtgccttcgcacccccaaggtccagtccttgcgcctcttcgaccccggtcgcggttggtgatttcccagattgcgcctaccctcctgatgccgaaccgaaggatgatgcctaccctctctactctgacttccagccgccagccttaaagatcaaagaagaggaggagggcgccgaggcctccgccagaagccccagaagttatttagtcgccggggcaaatcctgctgcattccctgattttccgctagggcctccccctcctttaccccccagggctacaccatcaagaccaggcgaagctgctgtgacggccgcccccgcgtccgcctctgtcagctcagcctcgtcctccggttctacactagaatgtatcctgtataaggcggagggagccccacctcagcagggaccctttgctccacccccctgcaaagccccaggcgccagcggttgcctgctgcccagagacggtctcccaagcacctccgcgtcagctgctgcggccggcgccgcacccgcactatacccagccctgggtctgaatggcctgcctcaactcgggtatcaggctgccgtactcaaagaaggactacctcaagtgtacccaccttacctgaactacttgcgacccgattcagaagcctcgcagagcccacagtattccttcgaatcactgccacagaaaatctgcctaatttgcggagatgaggcgtcaggatgccactacggtgtcctgacctgcgggtcttgtaaagtattttttaaacgggcaatggaaggtcaacacaattacctttgcgcgggcagaaacgactgtattgtcgacaagattcgccgcaagaattgcccagcatgccgcctgcgaaagtgttgtcaggccggcatggttctggggggccgaaaatttaaaaaatttaataaggttcgggtcgtcagggcacttgacgccgtggcgctgcctcagcccgtgggagttccgaatgagtcgcaagccctgagccagcgcttcaccttcagccccggacaagacattcaacttattccccctctcataaacctgttgatgagtatagagccagacgtaatatatgctgggcacgataacacgaagccagacacttcctccagtctgttaacatctctcaaccagctgggagagcggcagttgctgtcggtcgtgaaatggtcaaagtcgctgcctggctttagaaacctgcatattgacgatcagattactctgatacagtattcttggatgtcgctgatggtgtttggactgggatggcgctcttataagcatgtgagcgggcagatgctctatttcgccccagatctgattttgaacgaaagccacaggtcactaagcagttttaaattagctaagaagtcctcctccgtgtag

SEQ ID NO: 25770 - DNA, 2073 bp, Artificial Sequence
  Description of Artificial Sequence: Synthetic coding sequence
atgaccgagctgaaggccaagggcccccgggccccccacgtggccgggggacctccctctcctgaagtcgggtcccccctgctgtgtagaccagctgccgggcccttccctgggtcccagacgtctgacacactcccggaagtgagtgctattcctatttctctggacggcttgctgtttccgagaccctgtcagggacaagacccatctgatgaaaagactcaggatcagcagagccttagtgatgtcgagggcgcctatagtcgggctgaagctactcgcggtgctggtggcagctcatcttctcccccagaaaaggactccggtttgttagactctgtgctcgatacactcctggcaccgagcggccctggtcaaagtcagccctcacccccagcatgcgaagttaccagcagttggtgtttgttcggccctgagctcccagaagatccccccgccgcccctgctacacaacgcgtgctgagccctctgatgagcaggagcggatgcaaggtgggcgacagttctggcacggctgctgctcacaaagtcctcccgcgaggcctttcccctgcacgccaactcctcttgcccgcctctgagtctcctcattggtccggcgctccagtgaaaccatctcctcaggcagccgcggtggaggtcgaggaggaggacggatctgaatctgaggagagcgcaggcccattactgaaagggaagcctagagcgttaggcggcgctgccgctggcggcggtgctgctgcagttccaccgggggcagcagctggcggcgtggccctagtccctaaggaggattcccgctttagcgcccctagggtggccctcgtggagcaagatgcaccaatggctcccggccgctccccattagccactaccgttatggatttcattcacgtgcccattctccccctaaatcacgccctgttggcggcccgaacccggcagctgctggaagatgaatcctacgacggcggcgcaggagcagccagcgctttcgccccgccgcggtcatctccttgtgcctcttcaacgcccgtagccgtgggagattttccagattgcgcgtacccccccgatgcagagccaaaagacgatgcataccctctttacagtgatttccagcctcctgctctgaagatcaaggaagaggaggagggtgccgaagcaagtgccaggagtcctcggtcttatctcgtagccggtgcgaaccccgcagcattccctgatttcccacttggacccccccccccgctgcctcctagggctaccccaagcagacctggtgaggctgctgttactgccgctcccgcatccgcttccgtctctagtgcctctagctctggttccacgctggagtgcattttatacaaggccgagggcgccccccctcaacaaggcccgtttgccccaccaccgtgcaaggcccccggtgcctctggatgcctcctccccagggacggactgccgagcacctcagccagtgccgccgccgcaggagctgctcctgcgttataccccgctttgggactgaacggactaccccaactgggctaccaggccgcggtgctgaaggagggcctgccgcaggtgtaccctccgtacctaaactacttacggccggatagtgaggcatcccaaagcccccagtacagttttgagagtctgccccagaagatttgtctgatctgtggagatgaagcctccggttgccattacggggtccttacttgtgggtcttgcaaagtcttcttcaagagagctatggagggtcagcataattacttatgtgcagggagaaatgattgcatcgtcgataaaattaggagaaaaaactgccccgcctgtaggctgagaaaatgttgtcaggccggtatggttctggggggtttccggaacttgcacatagacgatcagattactctcattcagtatagctggatgagcctgatggtattcggtttaggatggagatcttataagcacgtgagcgggcagatgctgtatttcgcccccgatctgatactgaacgaggagtccattgtgacatcttag

SEQ ID NO: 25771 - DNA, 1410 bp, Artificial Sequence
  Description of Artificial Sequence: Synthetic coding sequence
atggacgtggagaacgagcagatcctgaacgtgaaccccgccgaccctgataacctttcagattccctgttctccggtgacgaagagaatgcaggaaccgaggaaatcaaaaatgaaattaacgggaactggatcagtgcctcttctataaacgaggcccgtatcaacgccaaggccaaacgcagattgaggaaaaatagttcccgagattccggaaggggagactctgtatccgattcagggagtgacgctctcagatctggtttgaccgtacctacgtcacccaaaggcaggctgctggatcggcgcagtagatctggaaaaggcaggggcttgcccaaaaagggcggcgctggcggcaagggggtctggggtacgccaggccaagtatacgatgtagaagaagtggacgtgaaagaccccaattatgatgacgaccaggagaattgtgtttatgaaaccgttgtcctgcctttagacgagcgggccttcgaaaaaactctgaccccgataatccaggagtatttcgagcatggggacaccaatgaagtggcggagatgctgcgtgaccttaacctgggagaaatgaaatccggggtccctgtgctcgctgtgagtcttgcgctggagggcaaagccagccacagggagatgacttctaaactcctcagcgacctgtgtggcactgtcatgagcactaccgatgtggaaaaatcctttgacaagctccttaaggatctgcctgaacttgccttggacaccccgcgagcaccacagctcgtgggacagtttattgcccgcgccgtgggtgacggcatactgtgcaacacatacatcgactcttataagggcacagtggactgcgttcaagctagggccgcgctggacaaagccacagtcctgttgtccatgtcgaagggaggcaaacgaaaagatagtgtttggggcagcggtgggggccaacaaagcgtgaaccacctggtcaaggaaatcgatatgctcttaaaagagtatcttctatcaggtgatatttcagaggcagaacattgcctgaaggagctggaagtgccacatttccaccacgagttagtttacgaagccattatcatggtgctggagagtactggagagtctacatttaagatgattctcgatctgctcaagtcattgtggaaaagctccacgattaccgtggaccagatgaagcgcggctacgagagaatatacaatgagataccagacattaaccttgatgttccacacagttattctgtccttgaacgttttgtggaggagtgctttcaggccggcattataagcaaacagcttcgggacctgtgtccgtcccgaggcaggaaacgcttcgtcagtgaaggagacgggggtcggctaaaacctgagagctattag

SEQ ID NO: 25772 - DNA, 1377 bp, Artificial Sequence
  Description of Artificial Sequence: Synthetic coding sequence
atgaccaagtaccccgacaacctgagcgacagcctgttcagcggcgacgaggagaacgcagggactgaggagatcaaaaacgagatcaatgggaattggatttctgcaagtagtatcaatgaagcccgcattaacgcgaaagccaagaggaggctccgaaaaaacagttctagggatagtggacggggagacagcgtatccgattccggatccgacgcattgcgttcaggcctgactgtgcctaccagcccaaaaggccgcctgctggaccgccgttcacgctctggcaagggccgaggcctgccaaaaaaaggtggagccggaggtaagggcgtgtgggggacgcccggtcaggtgtacgatgtggaggaagtggatgttaaggaccccaactacgacgatgaccaggaaaactgcgtctacgagactgttgttcttcctctggacgagagagctttcgagaagacactgactcccataatccaggaatatttcgaacacggggacactaatgaggtggcagaaatgttacgcgacctgaacctcggcgagatgaaatccggcgtccctgttctggctgtgtctctggccctcgaaggcaaagcctcacatcgcgagatgacctccaagcttctgagcgacttgtgtggcaccgttatgtccaccaccgatgtcgaaaagtctttcgacaagctactgaaggatctgcctgaacttgctctcgacacccccagggcccctcagctggttggccaatttattgccagagcagtgggggacgggatcctgtgcaacacttacatcgattcatacaaaggcactgtagattgcgtacaggctagggctgccctcgacaaggcaactgtgttgctgtcaatgtccaaggggggcaaaagaaaggacagcgtgtgggggtctggagggggccagcagtccgttaatcacctggtcaaagagatcgatatgctgttaaaagaatatttactcagtggagacatctccgaggcagagcactgtcttaaagaattagaagtcccccactttcaccatgaacttgtgtatgaagctatcatcatggtactggaaagcaccggggaatctacattcaaaatgatactggatctgcttaaaagcctctggaaatcatccacaataaccgtcgaccaaatgaagcgcggatatgagcgaatttacaatgaaatcccggatattaatctggatgtgccacactcctattccgttctggagcgatttgtcgaagaatgcttccaggctggcataatttctaaacagctgagggacctgtgcccatctcggggtagaaagcgattcgtctccgagggcgacgggggacggctcaagcctgaatcctactag

SEQ ID NO: 25773 - DNA, 696 bp, Artificial Sequence
  Description of Artificial Sequence: Synthetic coding sequence
atggacgtggagaacgagcagatcctgaacgtgaaccccgccgagaatgccggtacagaagagattaaaaatgagataaacggcaattggattagcgcctcctccattaatgaagccagaattaatgccaaagccaaacgccgccttcggaagaactccagcagagactccggtcgtggcgatagcgtgtccgatagcggatcagacgcgctgagatccggcctgacggtccccaccagccctaaggggcgactcctggaccggagatcacgttccggcaaagggcgggggctccctaaaaaagggggtgccggtgggaagggcgtgtgggggacccctgggcaggtgtatgatgtcgaggaggtagacgtgaaggaccctaattacgacgacgaccaggaaaactgcgtgtatgaaacggtggttttgcctctggatgaaagggcatttgagaaaacactgactcctattatccaagagtattttgaacatggggacaccaatgaagttgccgaaatgctcagagaccttaacctcggagaaatgaagagcggagtccccgtgttggccgtctctctggcactcgagggaaaagcaagccaccgcgagatgactagcaaacttctgtcagacttgtgtgggactgtgatgagcacgaccgatgttgaaaaatcattcgacaaactgctaaaatag

SEQ ID NO: 25774 - DNA, 786 bp, Artificial Sequence
  Description of Artificial Sequence: Synthetic coding sequence
atgttcgaggcccggctggtgcagggcagcatcctgaagaaggtgctcgaggctctcaaagatttgattaatgaagcgtgctgggacatcagctcttccggcgtgaatctacaatcaatggactcatcacatgtgtccctggtacaattgacactgcggtctgaggggtttgacacctacaggtgtgaccgcaatctcgccatgggggtaaatctgacatcaatgagtaaaatcctcaagtgcgccggcaacgaagatattattacactgcgtgctgaggataatgctgacactctcgctctggtgttcgaggctccgaatcaggaaaaagtctctgactacgagatgaaacttatggaccttgacgtggagcagctgggtatacctgaacaggaatactcctgcgtggtgaagatgcccagtggagaatttgcccgtatctgcagagatctgtcccatattggtgatgctgttgtgattagctgcgctaaggacggcgttaagtttagcgcatctggcgaattagggaatggcaacattaagctgagtcaaaccagtaatgtcgacaaagaagaagaggcagttacaatagagatgaacgagccggtgcaattgacattcgcattaagatacctgaatttttttacaaaagctacgccattatcatctaccgttaccctctccatgagcgccgacgttcccttagtcgtcgagtataagattgccgacatgggacatctgaagtattatctcgccccgaagatcgaggatgaagaaggatcctag

SEQ ID NO: 25775 - DNA, 786 bp, Artificial Sequence
  Description of Artificial Sequence: Synthetic coding sequence
atgttcgaggcccggctggtgcagggcagcatcctgaagaaggtgctggaagctctaaaggatttgataaacgaggcctgctgggacatcagttcaagcggcgtgaacttgcagagcatggacagttcccacgtatctctggtgcagcttacactgagaagtgagggcttcgacacctaccgttgtgataggaacctggcgatgggcgtcaatttgactagtatgtcaaagatactgaaatgtgccggaaacgaagacataattaccctgcgggctgaagataacgccgacaccctggctctagtgtttgaagctccgaaccaggagaaagtgtctgattacgaaatgaaactgatggacctggatgtggagcaactcggcattcccgagcaggaatattcctgcgtcgtcaaaatgccgagcggtgaattcgctaggatctgcagggacttatcccacataggcgacgccgtcgtgatttcatgcgcaaaggatggggtcaaattctcggcttcgggcgagctggggaacggaaatataaaactgagccagacctccaacgtagacaaggaagaggaggccgtgacgattgagatgaatgagcccgttcaactgacatttgccttgcgctacttaaacttctttactaaggcgacaccgttgagctctaccgttacactgtccatgagcgctgacgtccctctagtggtcgagtataagatcgctgatatgggtcatttgaagtattacttagctccaaagattgaagatgaagaaggatcatag

SEQ ID NO: 25776 - DNA, 1140 bp, Artificial Sequence
  Description of Artificial Sequence: Synthetic coding sequence
atgagcagccccagcctgagcgacctgggcaagcgggagcccgccgccgcagcagatgaaaggggcacacaacaacgccgcgcctgcgccaatgcaacttggaacagcattcataacggtgtaatcgcagtattccagcgtaagggcctgcccgatcaagagttattttctctcaatgagggagtgcgccagttgcttaagacagagctggggagcttttttactgaatacttgcagaatcagttgttgaccaagggaatggtaatcctcagagacaaaattcgtttctatgaagggcagaaattgctcgactcacttgccgaaacttgggattttttttttagcgatgtgctgcccatgttgcaggccatcttctatcccgtgcagggcaaggagccttcagtgaggcagttggctcttcttcattttagaaacgcgatcacactgtctgtcaaattggaggatgccctggctcgcgcccatgccagggttccacccgcaatcgtgcagatgttactggtgttgcagggagttcatgagtctcgaggagttacagaggattatcttagacttgagaccttggtgcagaaggtggtgtccccatacttaggaacgtatggcctgcactccagcgagggccctttcactcattcatgtattttagagaaacgtcttctgcggaggtcccggtctggagacgtcctggctaaaaaccccgttgtgcgatcaaagtcttacaatactcccctgctcaacccggtgcaggaacacgaggctgagggcgccgccgctggcggaacatccattcggcggcattccgtttcggaaatgacgagctgcccagaaccccagggattctccgatcctcccggccagggaccaacgggcacattcagaagctcccctgcaccacattctgggccctgtcctagcaggctgtacccaactacgcagcccccggaacagggtcttgatccgactcgctcaagtctcccgaggtcctcccctgagaacctcgtcgatcagatcctggagtccgtggactccgacagtgagggcatctttatcgactttgggcgaggtcggggaagcggcatgagtgacctcgaagggagcggcggccgccagagtgtcgtgtag

SEQ ID NO: 25777 - DNA, 1167 bp, Artificial Sequence
  Description of Artificial Sequence: Synthetic coding sequence
atgcggaccctgcggcggctgaagttcatgagcagccccagcctgtctgatcttggtaagcgagagccggcagctgctgccgacgagagagggacccagcagcgcagagcttgcgctaacgctacctggaattccattcacaacggggtgatcgcagtgttccagcggaagggcctgcccgatcaggagctcttttcgctgaacgagggagtcagacaacttttgaaaaccgaactgggatcgttctttacggaatacctgcaaaatcagctcctgaccaaaggtatggtcattctccgcgacaaaatccggttctacgaaggacagaagcttttagatagtctggccgagacttgggacttcttttttagcgatgtgctaccaatgctgcaggccatcttttaccctgtgcaggggaaagagcccagcgtgcggcagctcgctcttctgcattttcgaaacgctatcactctgtctgtgaagctcgaagatgcccttgctcgcgctcacgcccgtgtccctcctgccatcgttcagatgttgttagttctacagggagtgcacgaaagcagaggtgtgactgaagactacctgaggttggaaaccctagttcagaaggtggtcagcccttatttaggaacctacggcctccattccagcgagggaccattcacccattcttgtatcctggaaaagaggttattacgtagatcaagaagcggagacgtgctggccaaaaaccccgtcgtcaggtcgaagtcttataatactccactcctcaaccctgtgcaagaacacgaagcagaaggggctgccgctggaggcacgtcaatcagacgtcactccgtcagcgagatgacctcgtgtcctgaacctcagggcttcagcgacccaccagggcaaggaccaactggcacattccgatcttcacccgcaccgcatagcggaccttgccccagcagactgtatcccaccactcagcctcctgagcagggcctggacccgacgaggtccagccttccccggtcgtccccagagaacttagtggaccagattctagaatccgtcgactcagattctgagggcatctttatcgactttggtagaggaagggggtcaggaatgtctgatctcgagggcagtggcgggaggcaaagcgtggtttag

SEQ ID NO: 25778 - DNA, 804 bp, Artificial Sequence
  Description of Artificial Sequence: Synthetic coding sequence
atgagcagccccagcctgagcgacctgggcaagcgggagcccgccgcagccgctgatgagaggggcactcagcagcggcgggcgtgtgctaacgccacctggaacagcatccataatggcgtgattgcggtctttcagcgcaaaggccttcccgaccaagaactgtttagccttaacgagggggtccgacagcttcttaagacggaactgggatccttttttactgagtacctgcagaaccagctgctgaccaaaggcatggtaatcctacgcgacaaaatccgattctacgaaggccagaaattactggactccctggctgaaacatgggacttctttttttcagatgtcctccccatgctacaggcaattttctacccagtgcagggaaaagagcctagcgtgcgccagctggcacttctgcacttccggaatgccattacactctcagtcaagctggaggacgccctcgcacgagcacatgctcgtgtgccgcccgccattgtacagatgctgcttgtattgcaaggcgtgcatgagtcacgaggagtgaccgaggattaccttcggctggagaccttagtacagaaggtagtgagtccctatctggggacttacggtctacatagcagcgaagggcccttcactcacagttgtattctggaaaagagacttttaaggcgttcaagatccggtgatgtgcttgccaagaacccggtcgtgcggagcaagtcttataataccccactgctaaacccggtccaggagcacgaggctgagggcgccgctgcaggtggtacctag

SEQ ID NO: 25779 - DNA, 681 bp, Artificial Sequence
  Description of Artificial Sequence: Synthetic coding sequence
atgagcagccccagcctgagcgacctgggcaagcgggagcccgccgccgccgccgatgaacgcgggacgcagcagcgacgcgcttgcgccaatgccacatggaattcaatccataatggtgtgatcgctgttttccaacgaaagggactgcctgaccaggaactgttttctttaaacgaaggtgtacggcagctgctgaaaacggaattaggaagcttttttacagaatatctccagaatcagctgctgacaaagggaatggtgatcctgcgggacaaaattcgtttttatgaagggcagaaactgctggatagcctggccgagacctgggatttcttcttcagcgatgtcttgccaatgctacaggcaattttctacccagtgcagggtaaagaaccgtctgtacggcagttggccttgttgcattttcggaacgccataacgttgagtgttaaattggaggatgccctggcccgagcccatgcccgcgtgccacctgcaatagtgcagatgcttctagttttacagggcgtccatgagtcccgtggcgttactgaggactacttgcggctggagaccctcgtgcagaaggtcgtgtctccctatcttggaacttacggcctgcactcctccgaaggcccatttacgcactcctgtattctggagaagcgcctgttgtag

SEQ ID NO: 25780 - DNA, 1236 bp, Artificial Sequence
  Description of Artificial Sequence: Synthetic coding sequence
atggtgtgcctggagctgagccagcgggaggcctggggcagcggctctccagaaaaaatgcccgcacagcccgagggcttgtatcgactgaaattcatgagctcaccctccctcagcgatctgggaaaaagggagcccgccgccgctgccgatgagcgcggcacccagcaacgaagggcatgcgcgaatgccacttggaattctattcacaacggggtgattgctgtgttccagagaaaaggtctgcccgaccaggagctattcagcctaaatgagggggtaagacagctgcttaaaacagagttgggctccttcttcacggagtacctgcagaaccagctgctcaccaaaggcatggtgattctccgggataaaatacggttttacgaaggacagaagctgctggacagcctagccgaaacgtgggacttctttttctctgacgtgctgcctatgcttcaagccatcttctacccagtgcagggtaaagaaccatccgtgcggcagttggccttgcttcattttcgcaacgctatcacactcagtgtgaagctggaggacgcacttgcccgcgctcatgctcgtgtgccacctgctatagttcagatgttgctcgtcctgcagggagtacatgaaagcaggggagttacagaagattaccttcggttggagacccttgtgcagaaggtcgtgtcaccttacctcggtacctatggactgcatagcagcgagggccccttcacacactcttgtatccttgagaaaaggctgttgagacgctccaggtctggtgacgttttagcgaagaatcccgtggtgagatccaagtcttacaacactcctctgctgaatcctgtgcaagaacatgaggctgaaggggctgccgcaggtgggactagcatccgaaggcactcggtaagcgagatgacatcatgtccagagccacagggattttctgaccctccaggccaggggcccacgggcactttcaggtcatcccccgctcctcactccgggccttgcccatcgcggctctacccaacgacccaaccccccgaacaaggcctcgatcctacacgctcctctctgccccggtcatcgccggagaacctcgtagaccagatccttgaatccgtggactcagacagcgaagggatcttcatcgactttggaagggggaggggttccggaatgagcgacttggaaggctctggtggccgccagagcgtggtgtag

SEQ ID NO: 25781 - DNA, 2649 bp, Artificial Sequence
  Description of Artificial Sequence: Synthetic coding sequence
atggagcccgcccccgcccggagcccccggccccagcaggaccccgcacggcctcaggagccaaccatgccacctcccgagactcccagtgaagggcgccaaccttcgccatctccaagcccaaccgaacgagcccctgcctcagaagaagagtttcagttcctcagatgtcaacagtgtcaggctgaggcaaagtgccctaagctgctaccctgcctgcacacactttgtagcggctgcttagaagcttccggtatgcagtgcccgatttgtcaggcaccttggcccctgggcgccgatactccagcactggataacgtcttctttgaatctctccagaggcgactgtcagtctaccggcagattgtggacgcccaggctgtgtgtaccaggtgcaaagagtcagctgatttttggtgtttcgagtgcgaacaattactgtgcgcgaagtgtttcgaggcacatcagtggtttctgaaacatgaggcccggcccctggctgagcttagaaaccagtcagtgcgcgagtttctggacgggaccagaaaaacaaataacattttctgttccaacccgaatcaccggacacctacgttaacatctatctactgtcggggctgcagcaagcccctttgctgttcatgcgcgctcctagactctagtcattccgaactgaagtgcgacatctccgcagaaatccagcaacgacaagaagaactggatgctatgacccaggcgctgcaagaacaggatagcgctttcggcgccgtgcatgcacagatgcacgcagctgtgggccaactggggagagctcgagccgaaactgaagagttgatccgagagcgggtaagacaagtcgtggcccacgtgagagctcaagagcgggaattgctcgaggccgttgacgctaggtaccagcgcgactatgaggagatggcttcaaggttgggccggcttgatgccgtcctgcaaaggatccgcaccggctcagctctcgtacagcgcatgaagtgttacgcgagtgatcaggaagtgttggacatgcacggtttcctgcggcaggctttgtgccgccttcgacaggaggaaccccagagcttgcaggctgcagtccgtactgacggattcgatgaattcaaggtgcggctgcaagacctcagctcatgcatcactcaggggaaagacgcagccgtaagtaagaaggcgagccctgaagctgcttctactcctagagaccccattgacgttgacctaccagaggaggccgagagagtcaaagcccaagtgcaggcattagggctggccgaggcccaacccatggccgtcgtccaaagcgttcctggagctcatccggtccccgtgtacgccttttctattaagggcccttcttacggtgaggacgttagcaatacaacgacagcccagaaacgcaagtgctctcaaactcagtgtccgcggaaggtcattaaaatggaaagtgaggaggggaaagaagcccgcttggcaagaagctctcccgagcagcctcggcctagcactagtaaagctgtctcaccacctcacctggacggacctcccagccctaggagccccgtgattggcagcgaggtatttctccccaattccaatcatgtcgcatccggtgccggcgaagccgaagagagagtggtcgtgatctcgagcagcgaagactccgatgccgaaaactctagctctcgggagctcgatgactcttcgtctgaaagctccgacctgcagctggagggccctagcactctgagagtactcgacgagaatctcgcagacccccaggcggaggacagacccctggtgttttttgatctgaaaatagataacgagacgcagaaaatcagtcaacttgctgctgtcaatcgagaatcgaagttcagagtggtgatccagcctgaagccttcttttcaatatactccaaggctgtgagcttagaagtcgggctacagcactttttgtcatttctgtcctccatgcgacgtcccatcctggcctgttacaaattatggggccctggcctgcctaattttttccgcgccctggaggatattaaccgcctttgggaatttcaggaggccatttccgggtttctcgcagccctcccgttaatccgtgaaagagttcccggtgcttcgagttttaaactgaagaatttggcccagacttatctggcccgcaacatgagtgagcggtccgccatggcggccgtgcttgcaatgagggacctctgtagactgctagaggtgtcaccaggcccccagctggcacaacacgtgtacccattcagtagtctacagtgttttgcgagcctgcagccactggtgcaggcagccgtgctccccagggcggaggcccgcctcttggctctgcacaacgtgagcttcatggagctgctgtctgcacacaggcgggatcggcaaggcggccttaagaaatatagcaggtacctttctcttcagactactaccctgcccccagcgcagcccgctttcaatttgcaggcactgggtacctacttcgaggggctgctcgaaggaccagcactggcaagagccgaaggagtgagtaccccactcgcgggccgcggattggctgaaagggcctctcaacagtcctag

SEQ ID NO: 25782 - DNA, 2490 bp, Artificial Sequence
  Description of Artificial Sequence: Synthetic coding sequence
atggagcccgcccccgcccggagcccccggccccagcaggaccccgctagaccacaggagcccaccatgcctcctcccgagactccaagcgaggggcgccaaccttcccccagtcccagcccaactgagagggctccagcttcagaagaggagttccagttccttagatgccagcagtgccaggcagaggccaaatgtccaaagttgttgccttgcctgcatacactatgcagcggctgtcttgaggccagcggaatgcagtgtccaatctgccaggccccctggcccctgggggcagacacccccgcactcgacaacgtgttcttcgagagtctgcagaggcgcctgtccgtctacagacagatcgtggacgcccaggccgtatgtaccagatgcaaagagtccgcagacttttggtgctttgaatgtgagcaactactatgtgccaaatgctttgaggctcaccagtggtttctgaaacatgaggcccgtccgctcgctgagctccgaaaccagagtgtcagggagttcctggatggcacgcggaaaaccaacaacattttctgcagcaatcctaatcaccgcacccctaccttgacatctatctactgccgaggctgctccaagcctttgtgttgctcttgtgcactgctagactcctcccacagtgaactgaaatgcgatatttcagccgaaatccaacagagacaggaggagctggacgcaatgacccaggccctgcaggagcaggattccgcctttggagccgtgcatgctcaaatgcatgctgcagttgggcagctgggccgagcgagagcagagactgaggagctcatccgagagcgtgtgcggcaggttgttgcgcatgtcagggcccaagagcgagagttgctggaagcagtggatgccagataccaacgggattatgaggaaatggcttcaagactgggcagactcgacgccgttctccagagaattcgaaccgggagcgcacttgtacaacggatgaagtgctatgctagcgatcaggaagtccttgatatgcacggttttctgcggcaggcgctctgccgactgcgccaggaggagccccagtctctgcaggccgccgtacgaaccgacgggtttgatgagtttaaggtcagactgcaagatctgagcagctgtattacccaaggcaaagacgcggctgtttccaaaaaggcctcacctgaggccgcttccaccccacgggacccgatcgacgttgacttgcctgaggaggccgagcgcgttaaggcccaagtgcaagccttgggcttagctgaggcgcaacctatggcagtcgtccaatccgttccgggtgcacaccctgtccccgtctacgccttttcaatcaagggtccctcgtacggtgaggatgtgtccaataccactaccgcacagaaacgcaagtgcagccagactcagtgcccacggaaagtcataaaaatggagagcgaagaaggtaaagaggctcggctggcacgatccagccccgagcaaccacggccgtctacctccaaggccgtgagtcctccccacttggatggacccccatcaccccgctcccccgtgattgggagcgaagtctttttgcccaacagtaaccacgtggcctcaggcgcaggagaggcagaagagcgagtggtagtgatttcctcctccgaagattctgacgcggagaatagctgcatggagcccatggagaccgccgagcctcagagttccccggcccatagtagcccagcccactcgtcacctgcacacagctcacctgtgcagagtttgctcagagcacaaggtgctagttcccttccatgtggtacctatcatccccctgcttggccaccgcatcagccggccgagcaggctgctacaccggatgccgagccacattctgaaccgccagatcaccaagaacggccggcagtgcaccgaggaattaggtacttactgtatcgtgcccagcgcgctatcagactcaggcacgccctgagactccaccctcagctgcacagggcccccatccgaacttggtcaccacacgtagtgcaagcctcaacccccgcaattaccggacctctaaatcatccagctaacgctcaagaacacccggctcagctgcagaggggcatttccccgccccacaggattcgtggggccgtccggagccgcagcaggagtttacggggctccagtcacctcagtcagtggctgaataacttctttgctctgcctttctcaagcatggcttctcagcttgacatgtccagtgtcgttggggccggggaatcacgggcccagacacttggtgcaggtgtacctccaggtgactcagtccgcggctctatggaggcttcccaggtgcaagttcccctcgaggcgtcacccataacctttcctcccccttgtgcacccgagcgtccacccatctctcctgtgccgggagctcggcaggctggtttgtag

SEQ ID NO: 25783 - DNA, 2346 bp, Artificial Sequence
  Description of Artificial Sequence: Synthetic coding sequence
atggagcccgcccccgcccggagcccccggccccagcaggaccccgctcgcccgcaggagccaaccatgccacctccagaaactccatcggaaggccggcaacctagcccctctcctagcccgacggagcgagctccagcgagtgaagaagaattccagttcttgcgctgccagcaatgtcaagcagaggccaaatgtccgaagttgttgccctgtctgcatacactctgctctggctgtttggaagcctctggaatgcagtgccctatctgccaggcaccctggcccttgggagccgatacacccgccttagacaacgtcttctttgaaagcttacagcggagactgtccgtgtatcgtcagattgttgatgcgcaagctgtatgcacgaggtgtaaggagtcagctgatttttggtgttttgagtgcgagcaactgctgtgtgctaaatgcttcgaagcgcatcagtggtttctgaagcacgaggccaggcctctggcagaactgcggaatcaaagcgtgagagagttccttgatggtacgaggaagacgaataacatcttttgctctaatccaaaccatagaacccctacactgaccagcatctactgtcgcggatgctccaagccattgtgttgtagttgtgccctactggatagcagtcactcagagcttaagtgcgacatctctgctgaaattcagcagaggcaggaagagctggatgccatgacacaggcacttcaggaacaggatagcgcattcggagctgttcatgcacagatgcatgcagcagtcgggcagctgggccgggctagggccgaaacagaggaactcatccgcgaaagggtgaggcaggtggttgcgcatgtgagggcacaagagcgcgagctcctagaagcagttgatgcacgataccagagggattatgaggagatggcttctcgtttgggccggctggacgcggtgctccagcggatacgcaccggaagcgcacttgtccagaggatgaagtgctacgctagcgatcaggaagtcctggatatgcatgggtttttgaggcaggctctgtgccgcctccgccaggaggagccgcaatctctgcaagccgccgtgcgcaccgatgggttcgacgaattcaaggttcggctccaggacttgagcagctgcatcacccagggcaaagatgctgccgtctctaaaaaggcttctccagaagcagctagcaccccgagagaccctatcgatgtagacctcgatgtctccaacacaactactgctcagaagcggaagtgctcccagacacagtgcccacggaaagttataaagatggaaagcgaggaggggaaagaagctcggctagctagatcctctcccgaacaaccacgcccttccacaagcaaggcggtgagcccccctcacctagacgggcctccctctccccggtcacccgtcatcggatccgaggtatttctgcccaacagtaaccatgtggcaagtggggccggagaggctgaggagagagtggtcgtgattagtagttcagaagactctgatgcagaaaattcctgtatggaacccatggagacagcagagccccagtcttcacctgcccattcttcaccagcccatagctcacctgcccatagctccccggttcagtcgctacttagagcgcaaggagcttccagccttccctgcgggacatatcaccctcctgcctggcccccccatcagcctgccgagcaggctgcaactcccgacgcagagcctcacagtgaacccccagaccaccaggagaggcccgctgtacatcggggaattagatatctgctgtacagagctcagcgcgctatccgcttgagacatgccctcagacttcatcctcagctgcatagagccccaattcgcacatggagcccacacgtcgtccaagcgtctacccctgcgatcactggccctttgaatcaccctgccaatgcacaggagcatcctgctcagcttcaacgagggatcagccccccacataggatacgcggggctgtgcgtagcagatcaagatccctacgggggagctcccacctatcccaatggctcaacaacttcttcgcactccctttctcctccatggcctcccagctggatatgtcctccgttgtgggggcaggagaaagtagagctcagacactcggggctggagtccctcctggtgattcagtgcgaggttcaatggaggcctcccaggtgcaggtgccgctggaggccagccccatcacatttccaccgccgtgcgcgcccgaaagaccccccatcagccctgttcctggcgctcggcaagccgggttgtag

SEQ ID NO: 25784 - DNA, 1272 bp, Artificial Sequence
  Description of Artificial Sequence: Synthetic coding sequence
atggagcccgcccccgcccggagcccccggccccagcaggaccccgctagaccgcaggagccaacaatgccaccaccggagactccgtccgaggggcgccagccatccccttcccccagccccactgagcgggctccggcctctgaggaggaatttcaattcctccgctgtcagcagtgccaagcagaggcaaagtgccctaaactactgccctgccttcatactttgtgttccggatgcctggaagctagtggtatgcagtgccctatttgccaggcaccctggccccttggcgccgatacacccgcactggataatgtcttctttgaaagtctgcaacggagactgagtgtttaccggcaaattgtcgacgcccaggcggtgtgcacccggtgcaaagagtccgccgatttctggtgttttgagtgcgaacaattgctctgtgccaagtgctttgaggctcaccagtggttcctcaaacacgaggcacgtccactggcagaactgagaaatcagtcagtccgcgaattcctggacgggacccgcaagactaacaacattttttgttcaaatcctaaccacagaacccctacccttacctccatttactgccggggatgctctaaaccactttgctgttcctgcgctctcctggacagctctcactccgagctcaaatgtgatattagcgccgagatccagcagagacaggaggaacttgatgcgatgacccaggccctccaggaacaggacagtgcattcggagcggtgcacgcacaaatgcacgctgctgtcggccagctaggccgggctcgagcggagactgaggagttgattcgggaacgtgtgcgccaagtggtagctcacgtgcgcgcacaggaaagagagcttctggaagctgtcgacgcaagatatcaaagggactatgaagagatggcctccaggctgggtcgcctagacgccgtgcttcagagaatccgcaccggttccgcgctcgttcaaagaatgaagtgttatgcaagcgatcaggaagtccttgatatgcacgggtttcttcgacaggccctctgccgcctgagacaagaggaacctcagagcctgcaagcagcagtccgcactgatgggtttgatgagtttaaagtgcgcttgcaggatctgtcttcatgtatcacacaggggaaggacgccgctgtgtctaaaaaagcttctccggaggcagcaagtacaccacgtgacccgatcgatgtggacctcaggaacgccctgtggtag

SEQ ID NO: 25785 - DNA, 1308 bp, Artificial Sequence
  Description of Artificial Sequence: Synthetic coding sequence
atggagcccgcccccgcccggagcccccggccccagcaggaccccgcacggccccaagagccaacaatgccaccacccgaaactccgagcgaggggagacagccctccccctccccatctccaaccgagcgggcaccagcaagcgaagaagagttccagtttctgaggtgtcagcagtgccaggctgaagcaaagtgccctaagctcctcccctgtcttcacacactatgttccgggtgtctggaagccagcggtatgcagtgcccaatttgtcaagcgccctggcctctcggagctgatactcccgcgctcgacaatgttttcttcgagtctctgcaacggcgcctaagcgtgtaccgtcagattgtggatgcccaggcagtatgcacacggtgtaaggaatcagccgacttttggtgctttgagtgtgagcagcttctctgcgctaagtgcttcgaagctcatcaatggtttctgaagcacgaagcgagaccactggcggagctgaggaaccaatccgtcagggaatttctggatggaaccagaaaaaccaataacattttctgctccaatcccaaccataggacccccaccctgacgtccatttattgtcgtggatgtagcaagcctctttgctgcagctgcgcactcctcgattcttcccacagcgagctcaagtgtgacatctccgctgaaatccaacaacggcaggaagagctggacgccatgacccaggccctccaggaacaggacagcgcgttcggagccgtccatgcccagatgcacgctgccgtgggtcagttaggcagggcccgcgctgagactgaagagctaattagagagagggtgaggcaagtggtggcccacgtgcgtgcccaggaacgcgaattgctggaagccgtggatgccagataccagcgggattacgaggaaatggccagccgtctgggtcgcctggacgcagtgctgcaacgtataagaactggctccgccttagttcagagaatgaagtgttatgctagtgatcaggaagtgctggacatgcacggattcttaagacaggcgctatgtcggctgcggcaagaagagccccaaagcctgcaggctgcggtgaggaccgatggttttgacgagttcaaggttagacttcaggacctgtcaagttgtattacccagggcaaggacgccgccgtgagcaaaaaggcttcccccgaagccgcctcaaccccgcgcgatcctatagatgtggatctgctgcctcccccggctcatgccttgaccggacccgcccagagcagcacccactag

SEQ ID NO: 25786 - DNA, 1902 bp, Artificial Sequence
  Description of Artificial Sequence: Synthetic coding sequence
atggagcccgcccccgcccggagcccccggccccagcaggaccccgctcggcctcaagagcctaccatgcctcccccggaaacaccctcagaagggaggcagccgagcccctctcctagtcccactgaacgtgcaccagcctctgaagaagagtttcagtttttacgatgtcagcagtgtcaggctgaagctaaatgccccaagctcttgccctgtctacatacactgtgctccggatgccttgaggcgtctggcatgcagtgccccatttgtcaggccccgtggccactgggcgctgacacacctgctctggacaatgtattcttcgagagtctgcagcgccgactatcggtctacagacagattgtcgatgcgcaggctgtgtgcacccgttgtaaggagtccgccgacttctggtgttttgaatgcgagcaattgctctgtgcaaagtgttttgaagctcaccagtggttccttaaacatgaagcaaggcccttggcggagttgaggaatcaatcagtgcgcgagtttctcgatggaaccaggaaaaccaacaatatcttttgctcgaatccgaaccatcgaacaccaactctcacatccatttactgccggggatgctctaagcccctgtgttgcagctgtgccctgctcgattccagtcatagcgagttgaaatgtgacatttcggcagagattcagcaaagacaggaagagctcgacgccatgacccaagctctccaggagcaggactccgctttcggagctgttcatgcgcagatgcatgccgcggtggggcagctcggtcgggccagagctgagaccgaagagctcatacgcgagcgagtgcgtcaggtggtcgcccatgtccgggcacaggagcgcgagctgttggaggccgtggacgctaggtaccagagagattacgaggagatggccagcagacttgggagattggatgctgtccttcaaagaataaggaccggttctgccttagtgcagaggatgaagtgctatgcctccgaccaggaggtgctggatatgcacggattcctgcggcaggccctgtgccgcttaaggcaagaagaacctcaatctctccaggctgcggtgagaactgatggcttcgatgagtttaaggttcgactacaggacctctcaagctgcattacacagggcaaagatgctgccgtgtctaagaaggcctcaccggaagcggcgtctacacccagagatccgatcgatgttgacctccccgaagaagctgagcgggtgaaggcgcaggtgcaggcccttggtctggcggaggcccaacccatggctgtggtgcagtcagtgccaggagcccatccggttcctgtgtatgccttctctataaagggaccctcttacggggaagatgtaagtaacaccacaacagcccaaaagcgcaagtgcagccagactcagtgtccccgcaaggtcataaaaatggaaagcgaggagggcaaggaggctaggctggcccgaagctcccctgaacagccgcggccgagcaccagcaaggctgttagccctccccatcttgatggcccacctagtcctaggtcaccagtgataggcagtgaggtatttctcccaaacagcaaccacgtggcatctggagctggcgaagctgaagagcgggttgtggttatctcaagctccgaggattcagacgctgagaattcctctagtagggaactggatgatagttcaagtgaatcctcagatctccagctcgaaggtcccagcactttgcgagtgcttgatgagaacttggcggacccccaggccgaggacaggcctttagtattcttcgacctcaaaattgataacgagagcggcttctcttgggggtacccacacccttttctgatttag

SEQ ID NO: 25787 - DNA, 1332 bp, Artificial Sequence
  Description of Artificial Sequence: Synthetic coding sequence
atggccgtggtgcagagcgtgcccggcgcccaccccgtgcccgtgtacgccttctctatcaagggccccagctacggtgaagatgtgtctaacacaacaacggcacaaaagcgcaagtgcagtcagacccaatgtcctagaaaagtcatcaagatggagagtgaggaaggcaaagaagcgagactcgctagatcctcacccgaacagcctaggccatctacatcaaaagccgtcagcccgccccatcttgatggtccgccatcccctcgatctccagtcattggatccgaggtctttctgcccaattcaaatcacgtggcctcaggagccggtgaggctgaggagcgtgtagtagtgatcagcagtagtgaagacagcgatgcagagaacagctcctccagagagctcgatgactccagttcagagtcctcagatctgcagctagagggccccagcacattgagggtgttggatgagaacttagcagatccacaagcagaggatcggcccctggtgtttttcgacctgaaaatagacaacgaaacacagaagattagtcagctggcggctgttaacagagagtcaaagtttcgcgtggtcatccagccagaggccttctttagcatttattccaaggcagtgtcactggaagtgggattgcagcactttctgagttttctctccagtatgcggcgacctatccttgcctgctataagctgtgggggcccggcttgcctaacttcttcagggctttggaagacattaaccgcctttgggagttccaggaggccatctcgggatttctggccgcactccccctaatccgggagcgggtgcccggcgcctccagctttaagctgaagaatctcgctcaaacttatctggcccgcaacatgagcgaacgctccgcgatggctgcggtgcttgccatgagagatctttgccgactgctcgaggtgagtcctgggccccagctggcccaacacgtgtaccccttctccagtctgcagtgcttcgcaagcctccagccgcttgtccaggcagctgtcctccctcgcgctgaggctcgactgctagcgctgcacaatgtgtcattcatggagctcctgtccgcccatagaagggaccggcagggcgggctgaagaaatactcaagatatctgtccctgcaaactacgactttaccgccagcccagcctgcttttaacctccaggcccttggcacttactttgaaggcctccttgaagggcccgccttagccagggccgagggagtttccacccccctggctggacgcggacttgctgagagggcttctcaacagagttag

SEQ ID NO: 25788 - DNA, 2598 bp, Artificial Sequence
  Description of Artificial Sequence: Synthetic coding sequence
atggagcccgcccccgcccggagcccccggccccagcaggaccccgctaggcctcaagaacccactatgcctcctccagagacaccaagcgagggcaggcagccgagtcccagcccgagccccactgagagggcacccgcatcagaagaagagttccagttcctacggtgccagcaatgtcaagccgaagctaagtgtccaaagctactcccatgtctccacacactctgtagcggctgtttagaggcctccggtatgcagtgtcctatctgccaggcaccctggccccttggtgcggacactccggcccttgacaacgtcttctttgagtctttgcaacgcaggctaagtgtgtacagacaaatcgtggatgctcaagcagtctgcactcgctgtaaagagagtgccgacttttggtgcttcgaatgcgagcagctgttatgtgccaagtgttttgaggctcaccaatggtttctgaagcacgaagctaggcctctagctgaattacgaaaccaaagcgtcagggagttcctagacggaactcgaaagacaaacaacattttttgttctaaccccaatcaccggacccccacactgaccagcatttattgcagagggtgctccaagcctctttgttgttcatgcgccctgctggacagctcacatagcgagctgaaatgtgatatctcggccgagatccaacagcggcaagaagaactggatgccatgacgcaagccctgcaggagcaggattcagctttcggggctgtccatgctcaaatgcatgccgccgtcggccagttgggcagagcccgcgccgaaactgaggaacttatccgcgagagagtcaggcaggtggtcgcccacgtgcgagcccaggagagggaactgcttgaggctgtggacgcaaggtatcaacgggattatgaggagatggctagcagactagggcggctcgatgccgtgctccaaaggatccggaccggatcagccctggttcaaaggatgaagtgctatgcatcagaccaggaagtcttggacatgcacgggtttctacggcaggcactgtgtcggctccggcaggaagaaccccagtcattgcaagccgctgtgcgcactgacggattcgacgagttcaaggtgcgattgcaggatctgtctagttgcatcacacagggaaaggacgcagcagtgtcaaagaaggccagccccgaagccgcctcgactcctcgggaccctattgacgtggacctgcccgaggaggctgagcgagtgaaagcgcaggtgcaggctctcggcttagccgaagctcaaccgatggccgtggttcagtctgtacctggagcccacccagtaccggtctatgcctttagcatcaaagggccctcctacggcgaggacgtctctaacacaactactgcgcagaagaggaaatgctctcagacgcaatgtccgcgcaaggtcattaaaatggagtctgaggaggggaaagaggcacgcctcgcaaggagctctcctgaacagcctaggccaagtacaagcaaggcagtcagtcctccacacctcgatgggccaccctcccctaggtcccctgtgattgggtcagaagtattcctgcctaactcaaaccacgtggccagtggcgcgggtgaagccgaagaacgagtggtggtgatatctagctctgaggacagcgacgcagaaaattcatcctcacgagaactggacgatagttcttccgaaagctcagacctgcagctggagggccccagtacacttcgggtgttggacgaaaatttggcagacccccaggctgaggacagaccgcttgttttctttgatctgaaaatcgataacgaaactcagaagataagtcagctggctgccgtaaatcgcgaaagcaagttcagagtcgtgatccaaccggaggccttttttagcttcctgtcctctatgcgtcggccaatcctggcttgttacaaactatggggcccaggcctcccgaacttttttcgggctttggaggacatcaaccggctctgggaatttcaggaagccatcagcgggtttctcgccgccctccccctgataagagagcgagtacctggcgcttcctcctttaaattaaaaaatctcgcacagacttatctggctcggaacatgtctgagaggtcagcaatggcggccgtactggctatgagagatctttgccgactgctggaggtttcccccggcccccaactagcccagcacgtgtatccattttcctccctgcagtgttttgcctcactgcagccattggtacaggctgcggtgctcccccgggccgaggctaggctgcttgcccttcacaacgtgtcattcatggagttgctctccgcccatcgaagagatcggcagggcggcctgaagaagtattcccgctacctttctctgcagacaacaacactgcctccagctcagcccgccttcaacctccaagccctgggcacatacttcgagggtctccttgagggcccagctttggcaagggccgagggggtgagcacccccctggccggcaggggcctcgccgagcgggccagccagcagagttag

SEQ ID NO: 25789 - DNA, 1836 bp, Artificial Sequence
  Description of Artificial Sequence: Synthetic coding sequence
atggagcccgcccccgcccggagcccccggccccagcaggaccccgcccggccccaggagccgactatgcctcctcctgagactccgtccgaggggagacagcctagcccatctccgagtccaactgagagggcccctgcctcggaggaggagttccaatttctgcgctgccagcagtgtcaggctgaggcaaagtgtcctaaactgctgccatgtctgcacaccttgtgttctggttgcctggaggcgtctgggatgcagtgccccatctgccaggcaccatggcccctgggagccgacacgccagcgctcgataacgtctttttcgagtcgttgcagaggcggttgtccgtgtatagacagattgttgatgcgcaggccgtatgtactcgatgtaaagagtctgccgacttttggtgcttcgaatgcgagcagctcctctgtgctaagtgcttcgaggcccaccagtggtttttgaagcacgaggccagacccctggccgagctgcggaaccagtctgtgcgcgaatttttggatgggaccaggaagacgaataacatattctgctctaatcctaatcatcggactcctacactgacttcaatctactgtcgtggttgcagcaagccactatgctgctcatgtgccctcctggactcaagtcattcagaactaaaatgcgacatatctgccgagattcagcaacggcaggaagaactcgatgctatgacccaggctctgcaggaacaagattcagctttcggggctgtccatgcccagatgcacgctgccgtcggccagttggggagggcccgggctgagaccgaggagttgataagagagagggtgcgacaagtggttgcccacgtgagggcccaggaaagagagcttctggaagcggtggacgccagatatcagcgggattacgaggaaatggccagtcgattgggaagactggacgctgtgctgcaacgaataaggacagggtcagctctggtacagcgcatgaagtgttacgcatccgatcaggaggtcttggatatgcacggcttccttagacaagctctgtgcagactgcgtcaggaggaaccccagtcactccaggctgctgtacgaacagatggtttcgatgaattcaaagtccgcctgcaggatctttctagctgtataacccagggcaaagacgctgcagtgtccaaaaaagcctcccctgaggccgcatccacacctcgtgatccgattgatgtggacctacccgaggaagccgagagggttaaggctcaggttcaggctctgggcctggccgaggcccaacccatggcagtggttcaatcagtaccgggagctcatcccgttccggtgtatgcgttcagcataaaaggtccctcttacggtgaggatgtgtcaaatacaaccacagcgcagaaaagaaagtgtagtcagacgcagtgtcctcgtaaagtcatcaaaatggaaagtgaggaagggaaggaggctcgtctagcccgcagctctccagagcagccccgtccttccacctcgaaggcggttagtccaccacacttggatggtcccccatcccccaggtcacctgtcatcggatctgaagtgttcctgccaaactccaaccacgtggcgagtggagccggcgaggctgaggaacgcgtcgtggttatttcatcttcggaagactccgatgcggagaactctgtttctggacctgaggtacagccacggactccagcttcacctcacttccgctcccagggagcgcagccgcaacaagtgacccttaggcttgcactgaggctcggaaactttccagtgcgccactag

SEQ ID NO: 25790 - DNA, 1683 bp, Artificial Sequence
  Description of Artificial Sequence: Synthetic coding sequence
atggagcccgcccccgcccggagcccccggccccagcaggaccccgccaggccccaggagcctaccatgcctcctccagagaccccttccgaagggagacagccatccccaagcccatcccctacagagagggcacctgctagcgaggaggaatttcaattcttgcgctgtcagcaatgtcaggcggaggctaaatgcccaaagttgctgccctgccttcatactctatgttccggatgcctggaggcatctggcatgcagtgtcctatttgccaggcaccttggccactgggcgcagatactccagccctggacaacgtcttcttcgagagtctacaacgtcggctcagtgtgtatcgacaaattgtcgacgcacaggcagtgtgtaccaggtgcaaagagagcgccgatttttggtgcttcgaatgtgagcagctcctgtgcgcgaaatgcttcgaagctcaccagtggtttctgaagcacgaggcccgccctcttgccgaactgcgtaatcagtcagttagggagtttcttgatggaacccgtaaaacaaacaacatcttctgctcaaaccctaatcaccggacacctacgctgactagtatctactgccgcggctgctctaagcctttatgttgctcctgcgccctgcttgatagctcacactcggaattaaaatgcgatatcagtgccgaaattcaacagaggcaggaggagctggatgccatgacgcaagctttgcaggaacaagattcggcattcggcgcagtgcacgcgcagatgcatgctgccgtgggccagcttggccgtgcacgggctgagacagaggagctgattcgcgagagagtgcgtcaagtagtcgcccatgtgcgcgcacaggaaagggagcttctggaggcagtggacgcacgttaccaaagagattatgaggaaatggctagcaggctgggtcggttagatgccgtgctgcagagaatccggactgggtccgctcttgtgcaacgaatgaagtgttatgcttctgatcaggaggttctggacatgcatggtttcctgcgccaagccctgtgtcggttgcggcaggaagaaccacaatcattacaggcagcggtaagaactgacggatttgacgaatttaaagttaggctccaggacctctcctcatgcattacccagggaaaagacgcggccgtgtccaagaaggccagccccgaagccgcatctactccaagggatcctatcgacgtggatttaccagaggaagcggagagggtgaaagcacaggtccaggccctcggactggccgaagcacagccgatggcagtagtccagagcgtgcccggagctcatccagttccagtttatgctttttcaatcaagggaccaagctacggcgaggatgtgagtaataccaccacggctcagaaacggaaatgcagccaaacacagtgtcctcgaaaggttatcaagatggaatccgaggaagggaaagaagcgaggttggcgcggagctctcccgagcagccacgaccaagtacctccaaggcagtctctcctccccatctggacggcccacctagccccagaagcccggtaattgggagcgaggttttcctgcctaactccaatcacgtggcctctggcgccggggaggccgggagggaacggaatgcactctggtag

SEQ ID NO: 25791 - DNA, 1758 bp, Artificial Sequence
  Description of Artificial Sequence: Synthetic coding sequence
atggagcccgcccccgcccggagcccccggccccagcaggaccccgcaagaccacaggagcccacgatgccacctcctgaaaccccatcagaggggaggcagccttctccctccccatcccccacagaacgggctccagcatctgaggaagagtttcagtttctgcgatgtcagcaatgtcaggcagaggccaagtgtcccaaactcctgccctgcctgcataccctgtgctccggctgtctcgaggcatctggtatgcagtgtccaatttgccaggctccttggccactgggggctgacactcctgctctggacaacgtgttctttgagtctcttcagcgaagattgagcgtttacagacagattgtcgatgcacaggcagtctgtacacggtgtaaagagagcgctgacttctggtgtttcgagtgtgagcagttgctgtgtgccaagtgcttcgaggcccaccagtggttcttgaaacacgaagctcgtccactggccgaacttagaaaccaaagcgtccgtgagttcctagatgggacaagaaaaaccaataacattttttgcagtaacccgaatcatcgcacccccaccctcaccagtatatactgcaggggctgctccaagcctttgtgctgttcttgtgctctccttgattcatcgcattcagagctgaagtgcgatatctctgcagagattcagcaacgccaagaggagcttgacgccatgacgcaggctctacaggagcaagacagcgcctttggtgcggtgcatgctcagatgcatgccgcagtcggccagctcggaagagctcgggctgagacagaggagctgatccgagagagggtccgacaggtggtggcccacgtacgggctcaggaaagagaactgctcgaggccgtcgatgcgagatatcagcgggactatgaagagatggctagtcgactgggacgtctcgacgccgtcctccagcgaataaggacgggaagcgcattagtacagaggatgaagtgctatgcctctgatcaggaggtgctagatatgcatggctttttgcgccaggcactttgtcgcctccggcaggaggagcctcagagcctgcaagctgcagtgcgaacagatggcttcgacgagttcaaagtgcgccttcaggatctgtccagttgcattactcaaggaaaagacgccgcagtctctaagaaggccagtccagaggccgcgtccactccacgcgacccgatcgatgtggacctcgatgtcagcaacacaacaacggcccagaagcgaaaatgctcccagacgcagtgccctaggaaagtgatcaaaatggaaagcgaggagggtaaggaggctcggctggccagaagcagcccagagcaaccgaggccctccaccagcaaagccgtgagtccaccacacctggacggcccaccctccccacggtctccagtgatcggaagcgaagttttcctgccgaacagtaatcatgtggcgtccggtgctggcgaggctgaagaacgggtcgtcgtcattagcagttccgaggacagcgatgccgagaacagctcttcaagagagctcgacgattcatcaagcgagagcagcgacctgcagctcgaggggccaagtaccttgcgcgtcctcgatgaaaatttagccgatccacaagccgaggaccgacctctggtgttcttcgacctgaagatagataatgagagcggatttagttggggatatccacaccctttcctgatctag

SEQ ID NO: 25792 - DNA, 483 bp, Artificial Sequence
  Description of Artificial Sequence: Synthetic coding sequence
atgcagcccgccagcgccaagtggtacgaccggcgggactacgtgtttatcgaattttgcgtggaggattcaaaagacgtgaacgtgaacttcgagaagagcaagttgaccttctcatgcctgggcggtagcgataattttaagcatctgaatgagatcgacttgttccactgtattgatcctaatgattctaagcataagcgcacggacagaagcatcctgtgctgcctgcgtaagggagaaagtggccagtcctggcctagactgaccaaggagcgggccaagctcaactggctttccgttgatttcaataactggaaagactgggaggacgactcagacgaagatatgtccaattttgacagattcagtgagatgatgaacaacatgggcggtgacgaggacgtcgatttacctgaagtggatggcgccgacgatgattcccaggattcagacgatgagaaaatgcccgatctcgaatag

SEQ ID NO: 25793 - DNA, 3141 bp, Artificial Sequence
  Description of Artificial Sequence: Synthetic coding sequence
atgcagaagcccagcggcctgaagccccccggccggggcggcaagcactcctctccaatgggaaggaccagcacaggaagcgcctcaagcagcgcagcagtcgcagcatccagtaaggagggcagtccattacacaaacagagcagcggcccatcttcctctccagccgccgcggccgcaccagagaagccgggccctaaagcagcagaggtaggagatgactttctgggcgacttcgtcgtgggggagagagtctgggtgaatggcgtgaaaccgggcgtcgtgcaataccttggagagacccagttcgcgccagggcaatgggcaggcgttgtgctagatgatccagtggggaaaaacgacggggcagtgggcggtgtccgatacttcgagtgcccagctcttcagggaatttttactcgcccttcgaagctcacaaggcaaccaacagctgagggttcaggttcagacgcccactctgtggagtccctgaccgcgcagaacctgtccctgcatagcggcacagccacaccaccactgacctctcgggttatcccgctacgagagagcgtgctcaactcatccgtaaagactggaaatgagagtggttctaacctgagcgattcgggctcagttaagaggggagagaaagaccttaggcttggagaccgcgtgctggtgggcggcaccaagactggagtcgttcggtacgtgggagaaacggactttgccaaaggtgaatggtgtggggtggaacttgacgaaccgctgggaaaaaacgacggtgccgtagccggcacacgatattttcagtgccctccaaagttcggcctctttgctcctatccacaaggtgatccggataggtttcccctccactagccctgccaaagcaaaaaaaacaaaacggatggccatgggggtgtctgcactgactcatagtccttccagtagttcaatatcttccgttagctctgtggcctcgagcgtagggggccggccttctagatccggcctactcacggagacgtcctctaggtacgcacgaaagatctcgggcacaaccgccctgcaggaggccttaaaggagaaacagcagcacatcgaacagcttctggccgaaagggatctagaacgagccgaagtggccaaggccacttctcatatatgtgaagtcgaaaaggagatagctctcctcaaggcccaacatgagcaatatgtggcagaagcggaggaaaagctacagcgagctaggctgctcgtggagtccgtgcggaaggaaaaggtggacctgtctaatcagttggaagaggagaggaggaaggtggaggatcttcaatttcgggtggaggaggaatccataacaaagggggatttagagacacagacccagttagagcacgcacgaatcggcgaattggagcagtccctcttgctggaaaaggctcaggccgagaggctgttgcgcgaactggctgacaacaggctcacgaccgtggcagaaaagtcgcgggtcctgcagctggaggaagaacttactctgagaaggggagagatcgaagaactccagcagtgcttgttgcactctggccctccacctcccgatcatccagacgcggcggagatcctgagactccgggaaagactgctatccgcctctaaggagcatcaaagggaaagtggggtgctgagggacaagtacgagaaagcactgaaagcataccaggcggaagtggacaagctccgcgccgcgaacgaaaagtatgcgcaagaagtcgccggtcttaaggacaaagtgcagcaggctacttcggagaatatgggccttatggataactggaaatccaagctggactctctagcctccgaccaccaaaagtcactggaggacctgaaggcgacattgaatagcgggcctggagctcaacagaaagaaatcggggagttaaaggcagtgatggaagggatcaaaatggagcatcagctcgaactgggcaacttgcaagccaagcatgacctggagacggctatgcacgtaaaggagaaagaggccctgagagagaagctgcaagaggcacaggaggaactggcaggtctgcaaaggcactggagggcccagttggaagtgcaggcgagccagcaccggttagaattgcaggaagcacaggatcagcggcgggatgcggaactccgagttcacgaactggagaaactagacgtggaatacagaggacaggcgcaggctatcgagtttctaaaagaacagattagcttggcggagaagaagatgctagattacgagagactgcagcgtgcagaggcacaaggaaaacaggaggtcgagtccctgcgagagaaactgctggtggccgaaaaccgcctgcaggcagtcgaagccttgtgtagcagtcaacacactcatatgattgagagcaatgatatcagtgaggaaaccatcagaacaaaagagacagtcgagggcttacaggataaacttaataaacgggataaagaggtcacagctttaacctctcagactgaaatgcttagggctcaggtcagtgctttggaatcaaaatgcaagagcggggagaagaaggtcgacgcactgctgaaggaaaaaaggagactggaggccgagctggaaaccgtttcccggaagactcacgacgccagtggccaactagtgctcatatctcaggaactgcttagaaaggaacgcagcctcaacgaattgagagtgcttctactcgaagcaaacagacacagtccaggacccgagagggacctttcacgcgaggtgcataaggcagagtggagaattaaggagcaaaagctcaaggatgacatccgaggcctgcgtgagaaattaacaggtcttgataaagagaagagtcttagcgatcagagaagatattccctgattgacaggtcctctgctccagaactcttgcgtctgcagcaccagttgatgtcaaccgaggatgcactgagagacgccctcgaccaggctcagcaggtggagaagttaatggaggctatgcgctcttgtcccgataaggcacagaccatcggcaactccggatctgccaacggtattcaccagcaggacaaggctcagaagcaggaggacaaacactag

SEQ ID NO: 25794 - DNA, 1800 bp, Artificial Sequence
  Description of Artificial Sequence: Synthetic coding sequence
atgagccggagcctgctgctgtggttcctgctgttcctgctgctgctgccaccattgccagtgctcctagcagatcctggcgctccaactccagtgaacccttgctgctactatccctgtcagcatcagggaatctgcgtgcgcttcgggctggacagatatcagtgcgactgcacgaggacaggatattcagggcccaattgtaccattccgggcctgtggacatggctgagaaacagcttacgaccgagtccaagtttcacccacttcctgcttactcacggacggtggttctgggaattcgtgaatgcgacctttatcagggaaatgctgatgcgcctggtgttaacagtacgcagcaacctgatccccagtccccccacatacaactccgctcacgactacatctcctgggagagcttctccaatgtgagctactatacgagaattttaccctccgtgccaaaggattgtcctaccccgatgggtaccaagggcaaaaaacaactcccagacgcccaactgttggcgcgcagattcttactccgtcgcaaatttatcccagacccccagggaaccaacctcatgtttgcattttttgcccagcacttcacacaccaattcttcaagacctcagggaagatgggtccaggttttactaaggcccttggtcacggggtagatctaggccatatctacggtgataaccttgaaaggcaataccagctgcgcctgtttaaagacgggaaattgaaataccaggtactggacggggaaatgtatccacctagcgtggaagaggcccccgtgttgatgcattaccccagagggatccctccccagagccagatggcagttggccaggaagtctttgggctcctccctggcctgatgctgtacgcaactttgtggctgcgagagcacaatcgcgtctgcgacttattgaaggctgaacatcccacctggggagacgagcaactcttccagaccacaagattgatattgatcggtgagactatcaagattgtgatagaggagtacgttcaacagctctccggatattttctgcagctgaagtttgatcccgaattactgttcggtgtgcagtttcagtacaggaaccgcatcgctatggaattcaaccatctgtatcattggcatcctctaatgccagattccttcaaggtggggagccaggaatactcttacgagcaatttttattcaatacttctatgctcgtggactacggtgttgaggccctggttgatgctttcagccgccagatcgcaggcaggattggcggaggccgaaacatggaccatcacatcttacatgtggcagtggacgtgatccgagaatcccgagagatgcgtctgcaaccatttaacgagtaccgcaaaaggttcggaatgaaaccttatacaagctttcaggaacttgtgggcgagaaagaaatggccgctgagttggaagaactatatggcgatatcgatgcactggaattctatcctgggcttcttctcgagaagtgtcatcccaactcaatctttggtgaatctatgatcgagattggggcccctttctccctgaaggggctgctggggaaccctatttgtagtcctgagtattggaaacctagcacatttggaggagaggtgggctttaatatagtgaaaacagctacgctgaagaaattggtgtgtctcaacactaagacatgcccctatgtctctttcagagtgccggacgcgtcacaggatgacggccccgccgttgagcggccctcaacagagctttag

SEQ ID NO: 25795 - DNA, 1473 bp, Artificial Sequence
  Description of Artificial Sequence: Synthetic coding sequence
atgctgatgcggctggtgctgaccgtgcggagcaacctgatcccctcccctcccacgtacaatagcgcccacgactatatttcttgggagtcattctcaaacgtaagttactatacccgcatcctgccgtctgtccctaaggattgtccgaccccaatgggcaccaaaggcaagaagcagctgcctgatgcacaattgcttgcacgccgttttctgctcaggagaaagttcattcccgacccccagggaacaaatttgatgttcgccttctttgctcagcactttactcatcagttctttaaaacgtctggcaagatggggccggggttcaccaaggccctgggccacggggttgatcttggccatatctacggagacaacctggagcgacagtatcagctccgcctgtttaaggatgggaagctaaagtatcaggtgcttgacggtgagatgtatcctccttccgtggaggaagcgccagtgctcatgcactacccccggggtattcccccacagagccagatggccgttggtcaggaggtcttcggcttgctccccggtctgatgctctacgctacattgtggctgcgggaacataaccgggtctgcgatttgctgaaggccgagcatcctacttggggggacgagcagctgttccagaccaccaggctgatcttgataggtgaaaccataaagattgtgatcgaagaatatgtgcagcaactgagcggatactttttgcagctcaaattcgatccagagctgttgtttggagtgcaattccaatacagaaatcgtattgccatggagttcaaccacctgtaccactggcatcccttaatgcccgatagttttaaagtcggttcccaggagtatagttacgaacagtttctgttcaatacatctatgctggtggactacggggtggaagcactcgtcgacgctttcagtcgacagatagcaggccgcatcggaggaggccgaaacatggatcaccacattctgcacgtggcggtagacgtgatacgcgagtcccgcgagatgaggctacagcccttcaacgaatatcggaaacgctttggcatgaaaccctacaccagctttcaggaactcgtgggagaaaaagagatggctgcagagttagaggaactttacggcgacatcgacgctctggagttctaccctggtctgttgctcgaaaagtgccatcccaattcaatcttcggggagagtatgatcgaaattggcgcacccttcagtttaaaaggtttactgggaaacccaatctgtagccctgagtactggaagcccagcacgttcggtggcgaggtagggttcaacatcgtgaagactgcgactttgaagaagcttgtgtgtcttaatacaaagacatgtccctacgtctctttcagggtcccggacgcaagtcaggacgatgggcctgctgttgaaaggcccagcacagaactctag

SEQ ID NO: 25796 - DNA, 471 bp, Artificial Sequence
  Description of Artificial Sequence: Synthetic coding sequence
agcctgctgctgtggttcctgctgttcctgctgctgctgccccccctgcccgttctcctagccgatcctggggctccaacgcccgccggactgtggacctggctgaggaatagcctcagaccgtccccgtcttttacgcacttcctactcactcatgggaggtggttctgggagtttgtgaacgccacctttatcagggaaatgcttatgcgcttagtactgaccgttcgcagcaatctgattccatccccccccacctataattcagcccacgactacatctcctgggagagcttcagtaacttcttcaagactagtggtaagatggggcccggttttactaaggctctgggccacggtgtcgacctaggacatatctatggcgacaatctcgaaaggcagtaccagctgagactgttcaaggatggaaagttaaagtaccaggtgctggacggcgaaatgtatccctag

SEQ ID NO: 25797 - DNA, 1614 bp, Artificial Sequence
  Description of Artificial Sequence: Synthetic coding sequence
atgcggaagccccggctgatgaacccctgctgctactacccctgccaacatcaggggatctgcgtaagatttggactggatcgatatcaatgtgactgcacccgtactggatattcaggacccaactgtactatccctgggctctggacgtggctgcggaattcattgagacccagtccgtccttcacccactttctcctaacacatggcaggtggttctgggaatttgtgaacgcaacttttatccgcgagatgcttatgaggcttgtgctaactgttaggagtaatctgatcccctcccccccaacctataacagcgcacacgactacattagttgggaaagcttctctaacgtcagctattacaccagaattctgcccagcgttccgaaggactgccctacaccaatggggaccaaaggaaagaaacagctgcctgacgctcagttactggcacgccgctttttacttcgccgaaaatttatccctgacccccaaggtacaaacttgatgtttgcttttttcgcccagcattttactcatcaattttttaagacctcggggaagatgggacctggatttaccaaagccctgggccacggcgtggacctcggccacatctacggcgacaatcttgagcgccagtaccagcttcggttatttaaggatggaaagctcaaataccaggtgttggatggagaaatgtacccaccatctgtggaagaggctcctgtgctgatgcattaccccagaggcataccgccccagtcccaaatggctgtgggtcaggaggttttcgggttactccccggtttgatgctgtacgccactctgtggctgagggagcacaatcgagtctgcgacctactgaaggctgaacatcccacctggggcgacgaacagctcttccagacgacgaggcttattctgattggagagaccatcaagatcgtgattgaagaatacgtacagcagttaagcgggtacttccttcagcttaagttcgacccagaactgctttttggtgtgcagttccaataccggaatcggattgctatggaattcaatcatctatatcattggcacccacttatgcccgattcattcaaaatcgggggtggccgcaatatggatcaccatattctgcacgtggctgtcgacgttatccgagagtctcgcgaaatgaggctgcaaccattcaacgagtatcgcaagcgtttcggtatgaaaccttacacctcattccaagagcttgtcggtgagaaggagatggccgccgaactggaggagctttatggggatatcgacgccctggagttttaccccgggttgcttctggagaagtgccatccaaattcaattttcggtgagtcaatgatcgaaattggtgcccctttctctctgaagggactgctaggcaaccctatttgcagccccgagtattggaagccctccacattcgggggggaggttggattcaatatcgtgaagaccgctactctcaagaaactcgtgtgtcttaatactaaaacttgcccatatgttagcttccgcgtgcccgacgccagccaggacgatggacctgccgtggagcggccttctacagagctgtag

SEQ ID NO: 25798 - DNA, 1815 bp, Artificial Sequence
  Description of Artificial Sequence: Synthetic coding sequence
atgctggcccgggccctgctgctgtgcgccgtgctggccctgagccacactgccaatccctgctgttcacatccttgccagaatcgcggcgtgtgtatgagcgtcgggttcgaccagtataagtgcgactgcaccagaaccgggttttacggagagaactgctcgacacctgagtttttaacccgaatcaagctttttcttaaacccactcccaacacagtacattacattctcactcatttcaaggggttctggaatgtcgttaataatatcccatttctcaggaatgctattatgtcttacgtcctgacctctcgaagccacctgatcgatagtccccccacctacaatgcagattatggatataagtcttgggaagcttttagtaacttgtcctattatacacgggccttacctccggttcctgacgactgcccgacacctctgggcgtgaagggtaagaaacagctgccggactccaatgagatcgtagagaagctgttacttagaaggaaattcattccggacccccagggcagcaatatgatgtttgcttttttcgcacagcacttcactcaccaattcttcaagacagaccataaacgaggtcccgctttcaccaacggcctgggtcacggcgtagacttgaatcatatctatggcgagaccctggcaagacagagaaagctgcggttgttcaaggacggtaagatgaagtaccagattatcgatggggagatgtatccccccactgtgaaagacactcaggctgagatgatctatccgccccaggttcccgagcatcttaggtttgcagtggggcaggaagtgttcggacttgttcccggacttatgatgtacgccacaatttggctgcgggagcataaccgagtctgtgacgtgttaaaacaggaacaccctgagtggggagacgagcagttatttcaaaccagtcgcctcatcctgatcggagaaaccattaagatcgttatagaggactacgtgcagcacctgtcaggttaccactttaagctaaagtttgatcccgagcttctgttcaataagcagtttcaatatcagaaccggatcgctgccgagtttaatacactttaccactggcatccgcttctccctgatactttccaaatacacgaccagaaatacaactatcagcagttcatttacaataattcgatactgctggaacatggcataacacaatttgtggagtctttcacaaggcagattgccggcagagtcgctggcggaagaaacgtgcctcccgctgtgcaaaaagtctcccaagccagcattgaccagtcgcgccagatgaagtaccaaagctttaatgaatatagaaagaggttcatgttgaagccatatgaaagctttgaagaactgaccggggagaaggagatgagtgctgagttagaggcactctacggggatattgatgcggtggaactgtacccagcattgctggtggagaaacctaggcccgacgctatctttggagaaactatggttgaggtgggagctccatttagtctgaaaggcctgatgggtaacgtcatctgtagccctgcatattggaagccaagcaccttcggtggcgaggtggggtttcagataataaatacagccagtattcaatccttaatctgtaacaatgtgaagggttgccccttcacttccttctcagtccctgatcccgagctcatcaagaccgtcaccatcaacgcttcttcaagccgcagcggccttgatgacattaatccaactgtgcttctgaaagagcgttcaacagagctgtag

SEQ ID NO: 25799 - DNA, 1614 bp, Artificial Sequence
  Description of Artificial Sequence: Synthetic coding sequence
agcctggtgcccgccaccaactacatctacacccccctgaaccagttaaagggaggtaccattgtcaacgtttatggtgtcgtgaagtttttcaagccaccctacttgagcaaaggaacggactactgcagtgtggtcaccatcgtggatcagaccaacgtgaaattgacttgcctcttgttctcaggcaactatgaagccctccccataatctacaagaatggggatattgtacggttccaccggttgaagatacaagtctacaaaaaggaaacccaggggatcacaagctccggattcgcttctctgaccttcgagggaaccttaggtgcacccatcatacctcggacctctagcaaatactttaatttcaccacagaggatcacaagatggttgaggctttgcgcgtgtgggcttccacacacatgagcccctcttggaccctgctgaaactatgtgacgtacagccaatgcagtactttgacctgacttgtcaactgctgggcaaagcagaggtggatggtgcaagttttctgttaaaagtatgggatggcacccgaacccccttcccatcctggagggtcttgatccaggacttagtgcttgaaggagatttatctcatatccaccggctgcagaacctaactattgatattctggtgtatgacaatcacgtccacgtggctagatcactcaaggtgggctcatttcttaggatctattctctgcacaccaagttgcaatcgatgaacagtgaaaaccagacaatgctgagcctggagttccacctccacgggggcacaagttatgggaggggtataagggttctacccgaaagtaattctgatgtagaccagctgaaaaaggatttggagtccgcaaacctaaccgctaatcaacatagcgacgtgatctgtcagagcgaaccagatgacagttttccttcctcggggtctgtgagtctgtacgaggtcgaacgatgccagcagttgagcgcaaccatcctcaccgaccatcagtatctcgagagaacgccactgtgtgctatactgaagcaaaaggctccacagcagtacagaattcgtgcaaaactacgcagctacaaaccccggcggctctttcagagtgttaagctgcactgtcctaagtgccacctcttacaggaagtgccccatgagggggatctagacatcatcttccaagatggcgccactaaaacgcccgatgtgaagcttcagaacaccagtctgtacgattcaaagatctggaccactaagaaccagaaaggtcgaaaggtagccgtacactttgtaaagaacaacgggatccttcccctttccaatgagtgtctcctcttgatcgaaggcgggactctgagcgagatctgtaagctgagtaacaaattcaattccgtgattcccgtgagaagtgggcacgaggacttggagctcctggatctctctgcgccttttctaatacaaggaacaatccaccactatgggtgtaaacagtgctcctctttgcgcagcatacagaatctcaatagcttggtggacaagacttcctggatcccatcatcagtggccgaggagctggacatcgtactgcagtag

SEQ ID NO: 25800 - DNA, 1905 bp, Artificial Sequence
  Description of Artificial Sequence: Synthetic coding sequence
atgagcctggtgcccgccaccaactacatctacacccccctgaaccagttgaagggtggcacaatcgtgaacgtctatggggtggtcaagttttttaagcccccctacctatctaagggcactgactactgctctgttgtgaccattgtggaccaaacgaacgtaaaattgacttgcctgctgttcagtggcaattatgaagccttgcctataatttataaaaatggagacatcgtgaggttccacagactcaagattcaagtgtacaagaaggagacccagggcatcaccagctcgggatttgctagcctgaccttcgagggtactctgggtgctccaatcatacccagaacctcttccaaatactttaatttcaccactgaggatcacaaaatggtggaggcattacgtgtctgggcgtctacccatatgagccctagttggactctgctaaagttgtgcgatgttcagcctatgcaatacttcgatctcacatgtcagctcctgggtaaggccgaggtcgacggcgcatccttcctccttaaggtctgggatggcacacgcaccccattcccaagctggcgagttcttattcaagacctagtcctggagggggatctttcacacatccaccggcttcaaaatctgacaatagacatacttgtatatgacaatcacgtgcatgtagctaggagccttaaagttggatcgttcctccgcatttattctctccataccaagttgcagtcaatgaactcggagaatcagaccatgctatccctggagtttcacctgcatgggggaacaagttatggacgtggcatccgcgtgctccccgaatcaaacagtgatgttgaccagctgaagaaggatttagagagcgccaatttgacagcgaatcaacattctgacgtgatatgtcagtccgaaccagatgacagcttcccatcatctgggtccgtaagtctgtacgaagttgaaagatgtcagcagctcagcgcaactatactaaccgaccaccagtacttagaacgaactcctctctgtgccattttgaaacagaaagccccccagcagtatagaatcagagctaaactcagatcctacaaacctcggagactgttccagtcagtcaaactgcattgccccaagtgtcacctgctgcaggaggttccccacgaaggagatttggatatcatttttcaggacggggcaactaagacacctgacgttaagttgcagaatacttctctttatgactccaagatctggacaactaagaaccagaaaggtaggaaagtggccgtacacttcgtgaaaaataacggtatcctgccattgagtaacgagtgtctgttacttatcgaaggcggcactttatcagaaatctgtaagctcagtaataagttcaatagcgtgatccccgtgcgatcagggcatgaagacttagaactgttagacctgagtgctccgttcctgatacaggggacaattcatcactatggttgtaagcagtgcagtagtttaagaagcatacagaacttgaacagtctcgttgacaaaacgagctggatccccagttcagttgccgaggcccttgggattgtgccgctgcagtatgtgttcgtcatgacattcacactggacgatggaacgggcgtgctcgaagcatatcttatggacagcgataagttttttcagattcccgctagcgaggtgttaatggacgatgacttgcaaaaatccgtggacatgatcatggatatgttttgccccccaggaattaaaattgatgcatatccctggctggagtgttttattaagtcctataacgtgactaatggtactgacaaccagatatgttatcagattttcgatacgacagttgccgaagacgtcatttag

SEQ ID NO: 25801 - DNA, 1023 bp, Artificial Sequence
  Description of Artificial Sequence: Synthetic coding sequence
ctgagcctggtgcccgccaccaactacatctacacccccctgaaccagctgaaaggaggcactatcgtgaacgtgtatggtgtggtgaagttttttaaacctccttacctctcgaaagggactgactactgctctgtggtgacaatcgtggatcaaactaacgtcaaactaacctgtctgttgttttctggcaattacgaggcactgccgattatctataaaaatggcgatatcgtaaggttccatcgattgaagatacaagtttataagaaggaaactcaggggataacttcgtctggtttcgctagcctcaccttcgagggtacactgggagcacccattatccctcggacttcatctaagtactttaacttcaccacagaagaccacaaaatggtggaggccctcagggtctgggccagcacgcacatgtcaccaagttggaccctcctgaagctttgcgacgtccaacctatgcagtatttcgaccttacgtgccagttactgggcaaggccgaggtggacggggctagcttcctcctcaaggtttgggatggcactcgtaccccattcccttcttggagagtcctaattcaggacctcgtgctggaaggggatctgagccacatccatcgcctgcagaatctcacgatagacatccttgtttacgacaaccacgtgcacgtcgctcggagcctaaaggtaggatcctttctaaggatctattccctgcacaccaaactgcagtcaatgaacagcgagaaccaaactatgctgagcctcgagttccacctgcatggtgggaccagttatggcagaggcattagagtcctaccagaatccaacagcgacgtcgaccaattgaaaaaggatctggaatcggccaatctcacagccaaccagcactctgatgtgatctgtcagagcgagccagacgactccttcccaaacggagtgtccctccgcccgcccggatggtcctccgtggcaagaagtcggctcatcgctgcctctacttcctag

SEQ ID NO: 25802 - DNA, 1512 bp, Artificial Sequence
  Description of Artificial Sequence: Synthetic coding sequence
atggtggaggccctgcgggtgtgggccagcacccacatgagcccctcatggacattattaaagttatgcgatgtccagccaatgcagtacttcgacctcacttgtcagttattgggcaaggctgaagttgatggagcctcattcctgcttaaagtctgggatgggaccaggaccccattccccagctggcgggtccttatacaagatctcgtcttggaaggcgacctgtctcacatccatcgcttacagaacttgactatcgacatcctcgtttatgataatcacgtccatgttgcaaggagcctgaaggtagggtcctttctccgaatttatagcctccatactaaactgcagtcaatgaacagtgagaatcagacaatgttaagcctggagttccacttgcatggaggcacatcatacggcaggggaattagagtgctccccgagtccaacagtgatgtcgatcaactcaaaaaagacttggaatccgcgaacctgaccgcaaatcagcactcagacgtgatctgtcagagcgagccagatgacagcttcccgagctcaggatcagtgagtttatacgaggtggaaagatgccagcagttatctgctacaattttaactgatcaccagtatctggagcgcaccccgctttgcgctatcctgaagcagaaggcccctcaacagtacagaattcgagcaaaactgagatcatacaaaccaagacggctgttccagagcgtgaagttgcactgccccaagtgccatctactgcaggaagttcctcacgagggcgaccttgacatcatcttccaggacggggcaacaaagacaccagatgtgaagctccagaacacatcattgtacgatagtaagatttggacgacaaaaaaccagaaggggaggaaagtggccgtgcacttcgtcaaaaataacggaatcctccctctgagcaatgagtgtctactgctgattgagggcgggactctaagcgaaatctgtaagctgagcaacaagttcaactccgtgattcctgttcgttccggacatgaagacctcgaactacttgacttatctgcaccattcctaatccagggaacgattcatcattatggctgtaagcagtgtagttcgcttcgctcaattcagaacctcaatagcctggttgataaaactagctggattccttcgagtgtcgcagaggctttgggaatagttccgctgcagtatgtgtttgtgatgacatttaccctggatgacggtaccggagtgttggaggcctacctgatggattctgacaagttcttccagattcccgctagcgaagtgctcatggacgacgacctccagaaatccgtcgacatgatcatggacatgttctgtccccctggtatcaaaattgacgcttatccatggctagagtgctttattaagagttacaatgtgacaaatgggaccgataatcagatctgctaccagatcttcgatacaacagtagctgaggacgtaatatag

SEQ ID NO: 25803 - DNA, 1380 bp, Artificial Sequence
  Description of Artificial Sequence: Synthetic coding sequence
ctgagcctggtgcccgccaccaactacatctacacccccctgaaccagctgaaagggggtacgatcgttaatgtttacggtgttgtcaagttcttcaagcccccttatctgtctaaggggacagattactgctccgtggttaccatcgtggatcagacgaacgttaagcttacttgcttactgttcagcgggaactacgaggccttgcctattatctacaagaacggcgatatcgtccggttccaccgcctgaaaatccaagtctataagaaagagactcagggtattaccagttccggcttcgcctctctgacattcgagggcaccctgggcgctccaatcatccctcgaacttcaagcaaatactttaactttacaacagaggatcataagatggtggaggccctgcgagtgtgggcctccacgcatatgtctccctcatggacactacttaaactgtgtgatgtgcaacctatgcagtactttgacttaacctgccagctgttgggaaaggctgaagtggatggcgcgtcattcctgctgaaagtgtgggatggaactaggacccccttcccaagctggcgggtgctcatacaggatctggtgctggagggtgatctttctcacattcaccgcttgcagaaccttaccattgacattctagtgtacgacaatcacgtgcacgtggcgagaagtctgaaggtcggaagctttcttaggatttacagtctgcacacaaagctgcagtccatgaattctgaaaaccagacaatgctgagtttagaattccacctgcacggaggcacatcctatggccgcggcattcgggtcctgcctgaaagcaactctgacgtggatcagctaaagaaagacctagaaagcgcaaacctaacggcgaatcaacattctgacgtgatctgccaaagtgagcctgacgacagcttcccttcatccggcagtgttagtctgtacgaggtggagcgttgtcagcagctgtccgcgactatcttgacagatcaccagtatctagaacgtactcctctctgcgccatattaaagcagaaagctcctcagcagtaccgaattagggcgaagctgcggagctataagcctagaaggttgttccagagcgtgaagcttcactgccccaaatgtcacctattacaagaagtgccgcatgagggagacctggatatcatctttcaagacggcgccacgaagacccccgacgtaaagctgcagaacacttctctctacgactccaagatttggaccactaagaaccaaaaggggcggaaggtagccgtacacttcgttaagaacaatgggatactcccattaagcaatgagtgtctactgctcatcgaagtgttgctatag

SEQ ID NO: 25804 - DNA, 249 bp, Artificial Sequence
  Description of Artificial Sequence: Synthetic coding sequence
atgagcctggtgcccgccaccaactacatctacacccccctgaaccagctgaaggggggcactatcgtgaacgtctacggcgtagtcaagttttttaaacctccttatctgagtaaaggcacggattactgctcagtagtgaccatagtggaccagactaatgtcaaactcacgtgcttgctgtttagtggcaactacgaggccttgcccatcatttataagaatggagacatcgtgaggttccactag

SEQ ID NO: 25805 - DNA, 1557 bp, Artificial Sequence
  Description of Artificial Sequence: Synthetic coding sequence
ctgagcctggtgcccgccaccaactacatctacacccccctgaaccagctgaaaggaggaacgatcgtcaacgtttacggagtggtcaaattcttcaagcctccgtacctgtctaaaggcaccgactactgctccgtggtgaccatcgtcgatcagacaaatgtcaaacttacctgtctcttattttccggtaactacgaggcgctgcccatcatctataagaacggtgacattgtcagatttcataggctcaagatccaggtgtacaagaaggagacacaaggaataacgagctccggattcgctagcctcaccttcgaaggcaccttgggagcacccatcatcccccggaccagcagtaaatacttcaatttcaccacggaagatcacaaaatggtcgaggctctaagagtttgggctagtactcacatgtctccatcctggactcttctgaagctctgtgacgttcaacctatgcagtacttcgacctgacctgccagctcctgggcaaagccgaggtagacggggcttcctttctcctgaaagtgtgggacggcacccggactccttttccatcttggagggtgctgatccaggatctcgtgctcgagggtgacttgagccatatccacaggctgcaaaacctgacgattgacatcctcgtgtacgataatcatgttcatgtggcccgaagccttaaagtcggcagtttccttcggatttactcccttcacacgaagctccagtcaatgaatagcgaaaaccagaccatgctctcactagaatttcacttacatggtggtacttcctacgggagggggatccgagtattacccgagagtaatagtgacgtcgatcagctgaagaaagacctcgaaagcgccaacctcacagcgaaccaacattccgacgtgatttgtcagtccgagccagatgatagcttcccatccagcgggagtgtcagtctgtacgaggtagaacggtgtcagcagttatccgcaaccattttaaccgaccatcaatatctcgaaaggacccccctgtgcgcgatcctgaagcagaaagccccccagcagtatcgcattagagccaaactgagaagctacaagccacgaagactcttccaatcggtgaaactgcattgccccaaatgtcacctgctgcaagaggtcccgcatgaaggagatctcgacattatctttcaggacggtgccacgaagaccccagacgtgaaactccaaaatacatccctgtacgacagcaaaatttggaccacaaagaaccaaaaggggcgaaaagtcgcggtccatttcgtaaaaaacaacggcatccttccactgagcaacgagtgcttactgctgatcgaggggggtaccctctccgagatatgtaagctctccaacaagttcaattctgtgatccctgtgcgctcaggccacgaagatctggagctgctggatttatctgcacccttcctcattcaggggacaattcaccactatgggacgggctactgtaccccaccaatctgtgtgtgttatgacctgtatacctag

SEQ ID NO: 25806 - DNA, 1374 bp, Artificial Sequence
  Description of Artificial Sequence: Synthetic coding sequence
agccccgaggacccccggagcaagcacaagttcaagatccacacctacggatctcctactttctgtgaccactgcggttctttactgtatggcttgatacaccagggcatgaaatgtgacacctgcgacatgaacgtccacaaacagtgtgtcattaatgtgccaagtctctgtggcatggaccacactgagaaacgaggacgcatctaccttaaagccgaagttgctgacgaaaagctgcatgtcaccgttcgcgatgccaagaatcttatccctatggatcccaatggactcagtgatccctacgtcaagcttaaacttatccccgacccaaagaacgagagcaaacaaaagaccaaaactattcggtccaccctgaatccacagtggaatgaatctttcacttttaagctgaaaccctcggataaggatcggcggctcagtgtggaaatctgggattgggatcgcaccaccagaaatgactttatgggatctctctcttttggggtgtctgaacttatgaaaatgcctgcaagcggttggtacaagttgttgaatcaagaagagggggaatactacaatgtcccaattcctgagggcgatgaggaaggcaatatggaactgaggcagaaatttgagaaagcaaaactgggccccgctgggaataaagtcatcagcccgtcagaagaccgtaaacagccctccaacaacctcgatagagttaaactgacagactttaactttctcatggtactcggcaagggcagttttggaaaggtgatgctggcagaccgcaaaggcaccgaggagctctacgctattaagatccttaagaaagacgtggtaatccaggacgacgatgtggaatgtactatggtggagaagagagttctagccttactcgacaaaccgccctttctcacgcagcttcattcgtgctttcagaccgtggatcgactgtactttgtgatggaatacgtcaatggaggcgacctgatgtaccatattcaacaagtgggtaagtttaaggaaccgcaggctgtgttttatgctgccgaaatttcaatcggcttattttttcttcataagagagggattatctacagagacctcaagctcgacaacgtgatgctcgattccgaagggcatattaagatcgcagatttcggtatgtgtaaagagcatatgatggatggcgtgaccaccagaaccttctgtggcactcctgattacatcgctcccgaaattatcgcttaccaaccttacgggaagtccgtagattggtgggcctacggggtcctgttgtacgagatgttggctgggcaggtgatgttttgttacatctttatgttcgtatattgctgcgtgatgtag

SEQ ID NO: 25807 - DNA, 2019 bp, Artificial Sequence
  Description of Artificial Sequence: Synthetic coding sequence
atggccgacgtgttccccggcaacgacagcaccgccagccaggacgttgccaatcggttcgcacgtaagggagcactgagacagaaaaacgtacacgaggttaaggaccacaaatttatagcacgattctttaagcagcccaccttttgctctcactgtactgactttatctggggcttcgggaagcaaggcttccagtgtcaggtgtgttgcttcgttgtgcataaaagatgtcacgagttcgtgactttttcttgtcctggtgctgataaggggccagatactgatgatccacggagcaaacacaaatttaagattcacacctacgggtcaccaactttttgtgatcattgtgggagccttctttacggcctcattcaccaggggatgaaatgtgacacctgtgatatgaacgtccacaagcaatgtgtgattaacgtaccctctctatgcggcatggatcatacggaaaagaggggccgtatttacttgaaagcagaagtcgccgatgagaaactacatgttacagtcagagacgcaaaaaatctgattcctatggatccgaatggactgtccgacccatacgtgaaattgaaattgataccagatccaaagaacgagtccaagcagaagactaagacaattagatccaccctcaaccctcagtggaacgaaagttttaccttcaaacttaaacctagtgataaggacagacggctgagtgtggaaatctgggattgggaccggactacacgtaatgattttatggggtcattgtcttttggcgtgagcgagctcatgaagatgcctgcttcaggatggtataagctgctgaaccaggaggaaggcgagtattacaacgtcccaatccccgaaggagatgaagaggggaatatggagctgcgtcagaaatttgagaaagctaagctcggaccagcaggtaataaagtgatcagcccctctgaggatcgaaagcaaccctctaataacttagaccgggtcaagttaaccgacttcaacttccttatggtattgggcaagggttcattcggcaaagtgatgctggctgaccggaaaggaacagaagagctgtacgctatcaaaatcctgaaaaaggatgtggtcatccaggatgacgatgttgaatgcacaatggtcgagaagagagtgcttgccctgttggacaagcctccatttttgacacaactacacagctgttttcagacagttgatcggctttatttcgtgatggaatatgtaaatggtggggatttgatgtatcacattcaacaggtcggaaaattcaaagagcctcaggcagtcttttacgctgccgagatctccatcggactcttcttcttgcacaagagggggatcatctatcgtgatttgaagctcgataatgttatgcttgatagcgagggtcacataaagatcgccgacttcggaatgtgtaaagagcacatgatggatggtgtgaccacacgtaccttctgcgggactcccgactacatagctccagagatcatagcctatcaaccttatggcaaatccgtggactggtgggcctatggggtcctgctctacgagatgctggcaggacagccgccattcgacggcgaggatgaagacgagctattccagagcattatggagcataatgtgagttatccaaaatccctgagcaaggaagccgtcagcgtctgcaagggcttgatgaccaagcatcccgctaagaggctgggctgcggcccggagggtgaaagggatgtcagagagcacgcctttttcaggcgtatcgattgggaaaaactggaaaatcgtgagatccagccgccattcaagcccaaggtgtgtggcaagggagcggagaacttcgataaattcttcacccgcggccagcccgtgctcacccccccagatcaactcgtaattgctaatatcgatcaatctgatttcgaggggtttagttacgtcaacccccaattcgtacatcccattttgcagagcgcggtttag

SEQ ID NO: 25808 - DNA, 2022 bp, Artificial Sequence
  Description of Artificial Sequence: Synthetic coding sequence
atggccgaccccgccgccggccccccccccagcgagggcgaggagagtaccgttcggttcgctaggaagggggcactgaggcagaagaacgttcacgaagtgaagaaccacaaatttacagctaggttctttaaacaacctaccttctgttcccattgtaccgatttcatctggggctttggcaaacagggctttcagtgtcaagtttgctgcttcgttgtgcataagcgctgccacgaatttgtcacattcagttgtcctggcgcagacaagggtccagccagtgatgatccacggtcaaagcacaaattcaagatccacacttactctagtcccaccttttgcgatcactgtggatccctactctacggcctgattcatcagggtatgaaatgtgacacttgtatgatgaatgtgcacaaaagatgcgtcatgaacgtgcctagtctgtgtggtactgatcacactgaaaggagagggaggatctatatccaggcacacatcgacagagatgtattgattgtcttggttagggatgctaagaatttggttcccatggatcctaacggactgtcagacccatacgtcaaactcaaattaattcctgatccgaagtcggagagcaagcagaaaacaaaaactattaagtgcagcttgaatcctgagtggaacgaaacttttaggttccaactcaaggaaagcgacaaagatcgccgactctccgttgagatctgggactgggacctgacttccagaaacgatttcatggggtccctcagcttcgggatatccgagttgcagaaagctagtgtagatggatggttcaagctgctctcacaggaagagggtgaatactttaatgtgccggtgccgcctgagggaagcgaggccaatgaagagctgaggcaaaagtttgagcgggcaaaaatcagccaagggacaaaggtgccggaagagaagaccaccaacacagtctcaaagttcgataataatgggaatcgtgaccggatgaagttgactgactttaacttcttaatggtgcttggcaaagggtcatttgggaaggtaatgcttagtgaacgtaagggtacagacgaactctacgcggtcaagatcctgaagaaagacgtggttatacaagatgacgacgtagaatgtacaatggtggagaagcgagtgctggctttacccgggaagccgccctttctcacacagctgcattcttgctttcagaccatggaccgtctgtacttcgtaatggaatatgttaatggaggtgacctgatgtatcacatacaacaggtgggccgtttcaaggagcctcacgcagtcttctatgccgccgagatcgcaatcggcctgtttttcctgcagagcaaagggattatttatagagatttgaaactcgataatgtgatgctggacagcgaaggacacatcaaaatcgcagacttcggcatgtgtaaagagaacatatgggacggcgttaccactaaaacgttttgcggcactcccgactacattgctccggaaattattgcctaccagccctacggcaagagcgtggactggtgggctttcggcgtgttactgtacgagatgctcgcaggacaggccccttttgaaggcgaggacgaagatgaattattccagtctatcatggagcataatgtagcctaccccaaatcgatgtccaaagaagcagtggcgatctgcaaaggcctgatgactaagcaccctgggaaacggcttggctgcggccctgagggtgagagggatattaaggaacatgccttcttccggtatatcgattgggaaaaactggagagaaaagaaattcagcccccttacaagcccaaagcctgcgggcgaaatgccgagaacttcgataggttttttaccaggcaccctcctgtgttgacacccccggaccaggaagtgatccgaaacattgatcagagcgagtttgaaggattctcatttgtgaatagcgagttcctgaaacctgaggtgaagtcctag

SEQ ID NO: 25809 - DNA, 2016 bp, Artificial Sequence
  Description of Artificial Sequence: Synthetic coding sequence
atggccgaccccgccgccggccccccccccagcgagggcgaggagtccacggttcgcttcgccaggaagggagccctgagacagaaaaacgtgcacgaggtgaaaaatcacaaatttactgctaggtttttcaaacaaccaaccttttgcagccactgtacagactttatatgggggtttggtaagcagggctttcagtgtcaggtatgttgcttcgtagtgcataaacggtgccatgagtttgtgacgttcagctgtccaggcgctgacaaaggacccgctagtgatgacccccgctctaagcacaagttcaagatccacacttactccagtccaactttctgcgaccactgcggcagcctactatacgggctgattcatcaggggatgaaatgtgacacatgtatgatgaacgtgcacaagcgctgcgtaatgaacgtacccagtttgtgtgggacggatcatacggagagaagagggagaatttacattcaggcccatattgatagggatgtgttgatcgtgttagtgagggatgcaaaaaaccttgtgcccatggaccccaatggcctctccgacccatacgtaaaattgaagctaatcccagatcccaaatccgagagcaaacagaaaactaagacgatcaagtgttcattaaacccagagtggaatgaaactttccgcttccaactgaaagagagcgacaaggacagacggctatcagtggagatctgggactgggatctgacgtcaaggaacgactttatggggagcctgtctttcggcattagcgaactgcagaaggcaagtgtcgatggatggttcaagctcctcagccaggaggagggcgagtatttcaacgtgccagtccctccagaagggagcgaagccaacgaggaactcagacagaaattcgagagagccaagatctcccagggcaccaaagtgcctgaagagaagacaaccaacacagtgtcgaagttcgacaataacggaaatcgcgatcgaatgaagttgaccgactttaactttttaatggtcttgggtaaaggatcattcggtaaggttatgctctcagaacggaagggaacagatgaactgtatgccgttaagatcctcaagaaagatgtggtgattcaagatgatgacgttgagtgtacgatggtggagaagagagtgctggccctgccgggaaagcctcctttcctcacccagctccactcctgctttcaaaccatggaccgactctatttcgttatggagtatgtgaatgggggggatctcatgtaccatatccaacaggttgggcggtttaaggagcctcatgccgtgttttacgctgccgaaattgccatcggcctgtttttcttacagagtaagggcatcatctaccgcgatttgaagctggacaatgtgatgttagactccgaaggacacatcaaaatagctgattttggaatgtgcaaggaaaacatttgggatggggtcaccactaagactttttgtggcactcctgactacattgccccagagattatcgcctaccaaccatatggcaagagcgtagattggtgggcgttcggcgtacttctgtatgagatgctggccggacaggctcccttcgagggcgaggacgaggacgagctgtttcagtctattatggaacacaatgtggcgtacccaaagagcatgtctaaagaagctgttgccatctgtaaaggccttatgacaaagcaccctggaaaaaggctgggctgtggtcctgagggggagcgtgatatcaaagaacatgccttctttaggtacatcgactgggagaaattggaaaggaaagagatccagcccccctacaagcccaaagcgcgagacaaacgggatacctctaattttgacaaagagtttactcggcagcccgtggagctgacacccacagacaagctgtttatcatgaatcttgaccagaacgagttcgccgggttctcctacaccaaccccgagttcgttattaatgtctag

SEQ ID NO: 25810 - DNA, 786 bp, Artificial Sequence
  Description of Artificial Sequence: Synthetic coding sequence
atgcgggagagcgccctggagcggggccccgtgcccgaggcccccgccggaggaccggtacatgcggtgaccgtggtcactttgttggaaaagctggcatctatgctggagaccctgcgggagcgccaggggggtcttgccaggaggcagggtggtctggccggcagcgtcaggaggattcagagtggactgggggcgctgagcagatcgcatgacaccacttcgaatactctcgcacagctgcttgcaaaggccgagagagtctctagccacgctaatgcagcccaggagcgagcagtgcgccgggccgcgcaggtgcagagattagaggcgaaccacggcttgttagtcgctagggggaagctgcatgtactgctgttcaaggaggagggcgaagtaccggcatcagccttccagaaggccccagaaccactcggacctgccgatcagagcgagcttggtccggagcagctggaagccgaggttggcgagtcttccgacgaggaaccagttgagtcacgggcccagcgactcagacgtacgggtcttcaaaaagttcagtcgctaaggcgcgccctctccgggcgcaaagggcccgcggccccaccccccacacctgttaagccaccccggctcggtcctggccgtagcgcggaagcacagcctgaagcacaacctgccttggagccaactcttgagcctgagccaccgcaggacacggaggaggatcccggccgccctggagctgctgaagaggcgctgcttcagatggaatccgttgcatag

SEQ ID NO: 25811 - DNA, 2214 bp, Artificial Sequence
  Description of Artificial Sequence: Synthetic coding sequence
atggtggtgttcaacggcctgctgaagatcaagatctgcgaggccgtctctctgaaacccacagcctggtccttacgacacgcagttggcccccgcccacagactttcctccttgatccatacattgcactgaatgttgatgacagcaggatcgggcaaaccgctacaaaacaaaaaacgaattcacctgcctggcacgacgaattcgtcaccgacgtctgtaatggccgtaaaatcgaactggccgtgttccatgatgcccccataggctacgatgacttcgtggcaaattgcaccattcagttcgaggagcttctgcagaacggcagccgtcacttcgaagattggattgatttggagcctgaaggaagggtgtacgtgataattgacctgagcgggtcctccggggaggctcccaaggacaacgaagaaagggtcttccgcgagcggatgagaccacggaagcgacaaggggcggttcggcggcgggtccatcaagtgaacggtcacaaatttatggcaacctacctgaggcagccaacctattgttcccactgtcgggacttcatatggggtgtgattggtaagcagggttaccagtgccaggtctgtacctgtgttgttcacaagagatgtcacgagctgattattacgaaatgcgcgggcctgaagaagcaagagactccggatcaggttggatcccaacgttttagtgtaaatatgccgcacaaattcggcatccataattataaagtgcctacgttctgtgatcactgcggttccctattgtgggggctgttacggcagggcttgcagtgtaaggtctgcaagatgaacgtgcatcgtcgatgtgagacaaacgttgccccaaattgcggggtcgatgccaggggcatcgcgaaagtgctggcagatctgggcgtcacccccgataagattacaaattcgggacagcggcgtaagaagcttattgcgggcgctgagtccccccagcctgcgtctggaagttccccgagtgaggaggacagatccaagagtgcccccacctctccctgtgatcaggaaatcaaagaactcgaaaataacatccggaaggcgctttcattcgacaatcgtggtgaagaacatcgggcagcaagtagtccagacggccaattgatgagtcccggtgagaatggcgaggttcggcagggacaagcaaaaagactgggactggatgagtttaatttcataaaggttctcggcaagggatcattcggtaaagtcatgttggcggagttaaaaggcaaggacgaggtgtacgcggtcaaggtgctgaagaaggatgtgattctgcaggatgacgacgttgattgcaccatgaccgagaagcggatcttagccctggcccgcaagcatccctatttaactcagctatactgttgctttcagacaaaagataggctgtttttcgtcatggaatatgttaatggaggggatctgatgtttcaaattcagagatctcgcaagttcgacgaaccaagaagcagattttatgcagccgaggtcactagtgctcttatgttcttgcaccagcacggcgtgatataccgcgacctaaagctggataacattttgctggatgcagaagggcattgtaaactagcagacttcggcatgtgcaaagaggggatcttaaacggtgtaacaaccacaactttttgcggcaccccagactacatcgctcctgaaatccttcaggaactggagtacggaccctccgtggattggtgggctctgggtgtgctcatgtacgagatgatggctggccagccaccctttgaagccgataacgaagacgatctcttcgagagcatcttacacgacgatgtcttataccccgtgtggcttagcaaggaggctgtctccatcctcaaagcattcatgactaaaaatcctcacaagaggttgggttgcgttgcaagccagaatggcgaagatgcaatcaaacaacatccattttttaaagagattgattgggtgttgctggagcagaagaaaatcaaaccacctttcaagccaaggattaagactaagcgcgacgtaaacaactttgaccaagatttcacccgcgaagagccagtgctgacactggtggacgaggcaatcgtgaagcagatcaaccaggaagagttcaaggggttttcttactttggggaggatcttatgccctag

SEQ ID NO: 25812 - DNA, 384 bp, Artificial Sequence
  Description of Artificial Sequence: Synthetic coding sequence
atggtggtgttcaacggcctgctgaagatcaagatctgcgaggccgtgtcgttgaaaccaaccgcatggtcgctgaggcacgctgtcgggccacggccgcagacattcttactcgatccctatatagccctgaacgtggacgattcaagaatcggtcagacagctacaaagcagaagaccaacagcccagcttggcatgatgaattcgttaccgatgtgtgcaacgggcgaaagattgaactcgcagtatttcatgatgcacctatcggttatgacgactttgtcgctaactgtaccattcagttcgaagagctgctgcagaacggaagcaggcactttgaggattggattgacttggaacccgaagggagggtgtatgtctag

SEQ ID NO: 25813 - DNA, 2094 bp, Artificial Sequence
  Description of Artificial Sequence: Synthetic coding sequence
atggccggcctgggccccggcgtgggcgacagcgagggcggccccaggccacttttttgccgcaaaggagctctcaggcagaaggtcgtccatgaagtgaagtcacataagtttaccgccagattcttcaaacagcccacattttgcagccactgtaccgatttcatctgggggattggcaagcagggcctccagtgccaggtttgcagctttgtggtgcacagacgctgccacgagttcgtgacattcgagtgtccgggtgcagggaaagggcctcagaccgacgacccacggaacaaacacaagttccgacttcattcatactcgtctcctactttctgtgatcactgtggctctctgctctacggattggtccaccaaggaatgaagtgtagctgctgtgaaatgaacgtgcatcggcggtgtgtaaggagcgtgccgtccctgtgcggggtggaccataccgagcgaagagggaggctgcagctcgagataagagccccaaccgccgacgaaatacatgtgaccgtgggggaagctcgaaatctgatcccgatggatcccaacggattatccgacccgtacgtgaaactcaaattaatcccagatcccaggaacctgactaagcagaaaacaaggacagtgaaagccactctgaatccagtctggaacgagactttcgtattcaatctgaaacccggcgacgttgagaggagacttagtgtagaagtgtgggactgggatcggacctcccgcaatgacttcatgggcgccatgagcttcggtgtgtccgagctgctgaaagcgcccgtcgatggctggtataagctgcttaaccaagaagagggagagtactataacgtccctgttgcagatgcagataattgctctttgcttcagaaattcgaagcctgtaattatcccttagaactctatgagcgagtaaggatgggtccttcctcatcccctattccctctcccagccccagcccaactgacccaaaaagatgcttctttggggcatcacccggccgtctccacatctccgattttagcttcctcatggtgttagggaaggggtcatttggaaaagtcatgctcgcagagagaagagggtccgatgagctgtacgccattaaaatcttgaaaaaggacgtcatcgtgcaagatgatgacgtagattgtaccctggtggagaaacgagtgctcgccctcggcgggaggggtccaggcggacggccgcacttcttaactcaattacactcaacgttccaaacccccgataggctgtactttgtgatggagtacgtgaccgggggcgacctaatgtaccatatccagcagctgggcaagtttaaagagccccatgctgccttctacgcagcagagatcgccatcggcctcttctttctccacaatcaagggattatatacagggacctcaagttggacaacgtcatgctcgatgccgagggacacatcaagatcaccgatttcggaatgtgtaaggagaacgtgtttccgggaactaccactcgcaccttttgcggaacccctgattatatcgcaccagaaatcatcgcctatcagccgtatggcaagagcgttgattggtggagcttcggggtgttgctctatgaaatgttggcggggcagcccccatttgatggagaggacgaagaggagctcttccaggctatcatggaacaaaccgtgacctaccccaagagcctctcgcgggaagctgttgctatctgtaagggatttctcactaaacaccccggaaagcgcctagggtctggccctgacggcgaacctacgattagggcacacggcttctttaggtggattgattgggagagactggagagattggagataccgccgccttttcggcctagaccttgtgggcgctcaggggaaaactttgataaatttttcacccgtgcagcccctgcactgactccccccgatcgtcttgtactggcctcaatcgaccaggcagatttccagggattcacttatgtgaacccggacttcgtgcatcccgatgcccggtccccaacgagcccagtcccggtgccagtgatgtag

SEQ ID NO: 25814 - DNA, 984 bp, Artificial Sequence
  Description of Artificial Sequence: Synthetic coding sequence
atggccggcctgggccccggcgtgggcgacagcgagggcggccccaggcccctcttctgccggaagggggcacttcggcaaaaagtggtgcacgaagtaaaatctcacaagtttactgccaggtttttcaaacaacccacattttgcagccattgtaccgatttcatatggggcatcgggaagcaggggcttcaatgccaggtgtgttctttcgtggtgcataggcggtgtcacgagttcgtgacctttgaatgtcctggcgccggtaagggcccccaaacagatgatccaaggaacaagcacaagtttcggctccacagttacagcagtcccacattttgcgaccactgtggttccctgctttatgggctagtccatcaagggatgaagtgcagctgttgtgagatgaatgtgcatcgcaggtgcgttcgcagcgttcctagcctctgcggggtggaccacacagagcgacggggtcgcctgcaactcgagattcgcgctccaaccgccgatgagatccacgtgaccgttggtgaggccagaaatctgatccccatggatcccaacggcctgtcagatccctacgtcaagttgaaactcatacctgacccccgcaatctaacaaagcagaaaacccgaaccgtgaaggccacactgaacccggtctggaatgagaccttcgtcttcaatctgaagcctggagacgtggagcggagactatccgtcgaggtatgggactgggataggacttccagaaatgacttcatgggagctatgtccttcggggtgtccgaacttctgaaggcacccgtagacggttggttggttactacgccatggaattgtatgagcgggtgcggctgggcccccctgcctttgccctccccaccgttgcccctggtgcctcccacacctagtgcagcctctagcgggagggtccaggacgcctgcaccagcccaacgtcggcatcatcctggttctag

SEQ ID NO: 25815 - DNA, 2133 bp, Artificial Sequence
  Description of Artificial Sequence: Synthetic coding sequence
atggccggcctgggccccggcgtgggcgacagcgagggcggccccagacctctgttttgtcgaaaaggtgcacttaggcaaaaggttgttcatgaggtgaagagccataaattcaccgcaaggttcttcaagcagccgacattctgctcccactgcactgacttcatctggggcatcggcaaacagggcctccagtgccaagtctgctctttcgtagtgcaccgccgctgtcatgagttcgtgaccttcgaatgtccaggagccggcaagggtccacagaccgacgatccgagaaataagcacaaatttcgattgcactcttatagctctcctacgttctgcgaccattgcggttctctcctgtatggattggtccaccagggcatgaagtgctcctgctgtgagatgaacgtgcaccgacgatgtgtgcgttccgtgccaagtttgtgcggagtggaccacaccgagcgtagaggtcgcctgcaactggagattagggcccccactgcagacgagattcacgtaaccgtgggagaggcgagaaatctgatccctatggaccccaacggcctctccgacccatacgtcaagctgaaactgatccctgacccgagaaatctcaccaagcagaaaacacggaccgtcaaggctacgctgaatcctgtatggaacgaaactttcgtattcaatttgaaacctggcgacgtagagcgacggctctctgttgaggtctgggactgggatagaaccagtcgaaatgactttatgggcgctatgtccttcggggtcagcgagttgttaaaggctcctgtggatgggtggtacaagctcttgaatcaggaggagggggagtattataatgtacctgtcgccgatgctgataattgttccttgctccagaaatttgaagcatgcaactatcccctggaattatatgaacgagtgagaatggggcctagcagcagcccaattcccagccctagcccctcacctaccgatcctaaaagatgtttcttcggggcatcacctggccgtctacatattagcgatttttcattcttgatggtactgggcaagggcagttttgggaaagtgatgctggccgagcggagaggttcagacgagctgtacgcaatcaagattctgaaaaaggatgtgatcgtgcaggacgatgatgttgactgcacactcgtggaaaagcgcgtgttggctcttggaggccgcggacctggagggcgtccccactttctaactcagctccatagcacctttcaaaccccagataggttgtactttgtgatggagtacgtgaccggaggtgatctgatgtatcatattcagcagctgggcaagtttaaggaaccccatgcagcattttatgctgccgagatcgcaattggtctgttcttcctgcacaaccagggaattatttatcgagacctgaagttagacaacgtgatgcttgacgccgagggtcacataaagatcacggattttggtatgtgcaaggagaacgtttttccggggaccaccaccaggactttttgcggtactcccgactatatcgcacccgagatcatcgcatatcaaccctacggcaaatccgttgactggtggagctttggagtgctcctgtacgaaatgttagccggtcagcctcctttcgatggggaagacgaagaagagcttttccaggcgatcatggaacagaccgtgacttatccaaagagcctcagtagggaggccgtggcgatttgtaaaggtttcctgactaagcaccctggcaaaagactggggtctggtcccgacggtgagcctacaatcagagctcacggtttcttccggtggatcgactgggaacggttggagcggctcgaaatcccccctcccttcagacccagaccgtgtggccggagtggtgaaaattttgataagttctttactcgcgcagctcccgcccttacacccccagaccgcctggtcttagcctccatcgaccaagcggatttccaaggcttcacctacgtgaatccagatttcgttcatccagatgcccgttcaccaacctcaccagtgcccgtccctgtcattagttgtacacctgccttccagctttgccctaggggtttctag

SEQ ID NO: 25816 - DNA, 1647 bp, Artificial Sequence
  Description of Artificial Sequence: Synthetic coding sequence
atgccccggatctgcgacctgcgggtgagccggcggtgggagggccctcccgacggacggtgtgagatgaatgtgcaccgtcgatgtgtgcgcagtgtcccgagcctatgtggggtagaccatactgaacgacggggcaggttacagctggagattagagctccgacagcggatgagatccacgttactgtgggagaggcaagaaatctcatacccatggaccccaatggactgagtgacccatacgtgaagctgaaactcattcctgatccaagaaatctgacaaaacaaaagaccagaactgtcaaagcaacactgaacccagtgtggaacgaaacattcgtttttaatttaaagcctggggacgtggaacgcagactgtcagtcgaagtgtgggactgggatcgaaccagtagaaatgacttcatgggggccatgtctttcggtgtctctgagctgttgaaagctcctgttgacgggtggtataagttactgaaccaagaggagggagagtattacaatgtgcctgttgcagacgccgataattgcagcttgttgcaaaagttcgaagcctgcaattacccgctggaactatacgagagagttagaatgggtccatccagctcacccatcccatctccgagcccatccccgaccgacccaaaaagatgcttcttcggcgctagcccaggtcggctgcacatctctgatttttcattcctgatggtgctcggcaaaggttcttttggaaaggtaatgttggccgaacggagaggcagcgatgagttgtatgcaatcaaaatcctgaagaaagatgtgatcgtgcaggacgatgacgtggattgcacactggtcgagaagagggtgctcgcacttgggggtcgtgggcctggcggcagacctcacttccttactcaattgcattcaactttccagacccctgaccgcctgtattttgtaatggaatatgtgactggcggcgatcttatgtatcatattcagcagctcggcaagttcaaggagccacacgctgctttctacgctgctgagatagcgattggattgttcttcctgcataaccagggaattatttatagagacctgaagttggacaatgtcatgctggatgccgaagggcacatcaaaatcacggattttggaatgtgtaaagaaaatgtctttcccgggaccacaacacgtactttttgtggcacccccgactacatcgcccccgaaattatcgcttatcagccgtatggcaagagcgtggattggtggagctttggcgtcctgctatacgaaatgcttgctggacagttcctgacaaagcacccaggcaaaagattaggctcgggcccagatggggagccgacaatcagagcgcatgggttcttcaggtggatagactgggagcgcctggagagactcgaaattcctccaccctttagacctcgcccctgtggccgctctggcgagaattttgacaaattttttacaagggctgccccagccctgacaccaccggatagattagtccttgcttcaatagatcaagccgactttcagggcttcacctacgtaaaccccgacttcgtgcatcctgacgcccgaagccctaccagccctgtgccggtccccgtcatgtag

SEQ ID NO: 25817 - DNA, 1779 bp, Artificial Sequence
  Description of Artificial Sequence: Synthetic coding sequence
atgcccagccggaccggccccaagatggagggcagcggcggccgggtacgcctcaaagctcactacggaggcgacatcttcataacgtcagtggacgcagcaacaactttcgaagaactgtgcgaggaggtacgggacatgtgccgtctgcatcagcagcatccgctcacacttaagtgggtcgactctgagggcgatccttgtactgtcagtagccagatggaactggaagaagcctttcggctggccaggcagtgcagggacgagggcctgattatccacgtcttcccttctacacctgaacagcccgggctgccatgcccgggtgaagacaaaagcatttatcggagaggggctcgcagatggagaaaactgtaccgtgctaacggtcacctttttcaggctaaacgcttcaaccgtagggcgtattgtggacagtgctccgaacggatttggggccttgctcgccagggttatcggtgcataaactgcaagcttctcgtccacaaacgctgccatggactcgttccactcacgtgtcgtaagcatatggattctgtgatgcccagccaggagcctcctgtcgatgacaaaaatgaggatgccgatctgccgagcgaagagaccgacgggatcgcgtacatcagctcctctaggaaacacgatagcattaaagatgacagcgaagacctaaaaccagtgatcgacggtatggatggcattaagatctcacagggcctaggcctccaggactttgatctgattagggtgatcggcagagggtcttacgcaaaggtcttactggtacgtctgaagaagaacgaccaaatctacgcgatgaaggtggtcaaaaaggagctagtgcacgacgacgaagacatcgattgggtccaaaccgaaaagcatgtatttgaacaggctagctcaaatccctttctggttggcctgcactcgtgcttccagacaacatctcgcttgttcctcgtaattgagtacgtaaacggcggcgacctgatgttccacatgcaaagacagagaaagttgcccgaagagcatgcccgtttttatgccgctgagatttgtattgccctgaattttctccacgaacgcggcatcatttatagagacctgaagcttgacaacgttctgttagatgccgacggtcatattaaacttaccgactacggaatgtgtaaggaaggcctcgggcctggagacactacgtccaccttctgtgggactcctaattatattgcacctgagatactccgaggcgaggaatatggcttctcagtggactggtgggcattgggcgtcctcatgtttgagatgatggctgggcgttccccctttgacataattacggacaaccccgatatgaacaccgaggattacctgttccaggtcattctggaaaaacctattcgaataccccgctttctttccgttaaagcttctcatgtgcttaagggcttcctgaacaaggatcctaaagagcgcctggggtgcaggccccagacagggttcagcgacataaagagccacgcatttttccgatcaattgattgggatttgcttgaaaaaaagcaggctctcccaccatttcaaccccaaattactgacgattatgggctggacaactttgatacgcagtttacgtctgagcccgtgcagcttactcctgatgacgaggatgcaatcaagagaatagatcagtcggaattcgagggcttcgaatatattaatcctttgctgctgagtaccgaggagtctgtgtag

SEQ ID NO: 25818 - DNA, 1230 bp, Artificial Sequence
  Description of Artificial Sequence: Synthetic coding sequence
atggacagcgtgatgcccagccaggagccccccgtggacgacaagaatgaggacgctgatctacctagcgaggagacagacggtatcgcttatataagctcatctaggaagcacgacagtattaaggatgattctgaagatcttaagcccgtgattgacggaatggacggtatcaagatcagccaaggcctcggcctacaggattttgacctgatccgagtaataggcaggggaagctacgccaaagtgctcctggtgagactgaagaagaacgaccagatatacgcgatgaaggtggtgaaaaaagaactagtacatgatgatgaggatatcgactgggtacaaacggaaaaacacgtctttgagcaggctagctctaacccatttctggtgggtctgcattcctgcttccagaccacctcccgcctgttcctggttattgagtatgtcaatggcggagacttgatgttccacatgcaacggcagaggaagttgcctgaagagcatgcaagattttatgccgccgagatctgtatcgccctgaactttctgcatgagagaggaatcatctaccgggacctcaaactcgataacgtgctgctggatgccgatggacatattaaactgactgactatgggatgtgcaaagagggactcgggcctggggacaccacgtctacattttgcggaactccgaactatatcgcccccgagattctccgcggagaagagtatggtttttcagtggactggtgggccctgggcgtcctgatgttcgaaatgatggccgggagaagcccctttgacatcatcactgacaatcctgatatgaacaccgaggactacctgttccaggtgattctcgagaagcctattcgcattccaagattcctatccgtgaaggctagtcacgtgcttaagggcttcttaaacaaggaccccaaggaacgactgggatgcaggccacagacaggcttttcggatataaaaagtcacgctttctttagatctatagactgggatctgctcgagaaaaagcaggctctccccccctttcagccgcagataaccgacgattatggactggataactttgacactcagttcaccagcgaaccagttcagctcacacctgatgatgaagacgccattaaaagaattgatcagagcgaattcgagggctttgagtacataaaccctctcctgctttcaacagaagaatccgtttag

SEQ ID NO: 25819 - DNA, 1230 bp, Artificial Sequence
  Description of Artificial Sequence: Synthetic coding sequence
atggacagcgtgatgcccagccaggagccccccgtggacgacaagaacgaggacgcagatctcccgtcagaagagactgacggcattgcatatatctccagttctagaaaacacgatagtataaaagacgactcagaggaccttaagccggtcatcgatggtatggacgggattaagatctcacaggggctcggacttcaggatttcgacttaatcagagttattggccggggcagctacgccaaagttctgctcgtgaggctcaaaaagaacgatcaaatttatgcaatgaaagttgttaagaaggagctcgtccatgacgatgaggacatcgattgggtccaaactgagaaacatgtatttgagcaagcgagcagtaatccctttctggtgggattacattcttgttttcagactaccagccgactgttcctcgtgatcgaatacgtgaacgggggagacctaatgttccatatgcagagacagcggaaacttcctgaggagcatgccaggttctatgctgccgagatttgcattgccttgaattttttgcatgagagagggattatctatagggacctgaaactggacaatgtgcttctggatgctgacggccacatcaaactcaccgactatggcatgtgcaaggagggtctgggaccaggggacaccactagtacattctgtggaacacccaactacatcgcgccagaaatcctccgcggcgaggagtatgggtttagcgtggattggtgggctctcggggtgctaatgtttgaaatgatggcaggccgctcgcctttcgacatcataactgacaaccccgatatgaatacagaggattacctgtttcaggtgattctcgagaagcccattcggattcctagatttctgagcgtgaaggcatcccacgttctcaagggtttcctaaataaggaccctaaggagagactgggctgtagacctcagacgggatttagcgacatcaaaagtcacgccttctttagatccattgactgggatttgctggagaagaaacaggctcttcccccctttcaacctcagatcaccgacgattatggtttggacaacttcgatacacagtttacctccgagcccgtgcagctcacccccgatgacgaggacgccatcaaaaggatagaccagagcgaattcgagggcttcgagtatatcaatcccttgctgctgagcacagaggaatccgtttag

SEQ ID NO: 25820 - DNA, 1467 bp, Artificial Sequence
  Description of Artificial Sequence: Synthetic coding sequence
atgctgaccccccggaccgacgagagcatctaccggcggggcgccaggagatggcgcaagttataccgagcgaacggtcacctgttccaggctaagcggtttaatagacgggcctactgcggccagtgttcagaacgcatatggggcctggcccgtcaggggtatcgctgtatcaattgtaagctgctcgttcacaaacgatgccatggactagtgcctctgacttgtcggaagcatatggatagtgtcatgccctcacaggagccccccgtggacgataagaacgaggatgccgacctcccttctgaagaaaccgatggcatcgcatatatttccagcagccgaaaacacgattccattaaagacgacagtgaggacctgaaacctgtgattgacgggatggacgggatcaaaatttcacaaggattgggattgcaggacttcgacttgattagagtcatagggcgtggctcctatgccaaggtccttctcgttaggctgaagaagaatgatcaaatttacgcaatgaaagtcgtgaagaaagaacttgtccacgacgacgaagatattgattgggtgcagactgaaaagcacgtttttgagcaggcatcaagcaacccattcctggtcgggctgcactcgtgttttcaaacaacttctaggctctttctggtaatcgagtatgtgaatggtggcgatctaatgttccacatgcaacgccaacgaaaacttcctgaggagcatgccagattttatgctgcagaaatctgcatcgccctgaattttctgcacgagcggggaatcatctatcgtgacctgaagctggacaatgtccttctggatgccgacggacacattaaattgaccgattacgggatgtgcaaggaaggcctggggccaggagatacgacctcaacattctgtggaacacctaactatatagctccagagatacttcgaggagaagagtacgggttctccgtggactggtgggcccttggcgtgttgatgttcgagatgatggctggccgcagcccattcgacatcatcacggataaccccgacatgaacactgaggactatctctttcaggtaattcttgagaagccaatcagaataccacgattcctttcagtcaaagcctctcatgtgctgaagggatttttgaacaaagatccaaaggagcggcttggttgccgtcctcagactggtttcagtgacattaagtcgcacgccttctttcgcagcatcgattgggatctccttgaaaagaagcaggcactaccacctttccagccccagattacagacgactacggtttagataactttgacacacagtttaccagtgagcccgtgcagctgacccctgacgatgaagatgccattaaacgaatcgaccagagcgaattcgagggtttcgagtacattaacccactgctgctgagcaccgaagagtccgtttag

SEQ ID NO: 25821 - DNA, 78 bp, Artificial Sequence
  Description of Artificial Sequence: Synthetic coding sequence
atggacagcgtgatgcccagccaggagccccccgtggacgacaagaatgaggatgctgatctgccttccgaggagtag

SEQ ID NO: 25822 - DNA, 249 bp, Artificial Sequence
  Description of Artificial Sequence: Synthetic coding sequence
atggacagcgtgatgcccagccaggagccccccgtggacgacaagaatgaggacgctgacctcccttctgaggaaacagacggtattgcctacatttcttcatctcggaaacatgactcgattaaggacgattccgaagacctcaagcccgtgattgatggaatggacggcatcaaaataagccagggtttaggtttgcaagattttgatctcataagagtgattggccgggggtcctacgctaagtag

SEQ ID NO: 25823 - DNA, 297 bp, Artificial Sequence
  Description of Artificial Sequence: Synthetic coding sequence
atggacagcgtgatgcccagccaggagccccccgtggacgacaagaatgaagacgctgacttgccttccgaggagacagatggcatcgcttacataagcagctctaggaagcacgattccatcaaggacgatagcgaggacttaaaacccgtgattgatgggatggacggcataaaaatctcccagggcctgggcctgcaagactttgaccttatccgcgtcattggcaggggcagttatgccaaggttctgttagtccgcctcaagaagaatgaccagatctatgccatgaaatag

SEQ ID NO: 25824 - DNA, 330 bp, Artificial Sequence
  Description of Artificial Sequence: Synthetic coding sequence
atggacagcgtgatgcccagccaggagccccccgtggacgacaagaatgaagacgctgatctgccatctgaagagacagatgggatcgcctatatctcttcctcacggaagcatgactcaatcaaagacgactcggaggacttgaaacctgtcattgacggtatggacggaattaagatatctcaagggctggggctgcaggacttcgatctgataagagtgattgggcggggctcatacgccaaggttctgttggtccgccttaagaagaatgaccaaatttacgccatgaaggtggtgaagaaagaactggtacatgacgacgagtag

SEQ ID NO: 25825 - DNA, 141 bp, Artificial Sequence
  Description of Artificial Sequence: Synthetic coding sequence
atggacagcgtgatgcccagccaggagccccccgtggacgacaagaacgaagatgcagatttgccatccgaggagactgatggcattgcatacattagctcatcccgaaaacacgactcaattaaggacgatagcgagtag

SEQ ID NO: 25826 - DNA, 222 bp, Artificial Sequence
  Description of Artificial Sequence: Synthetic coding sequence
atggacagcgtgatgcccagccaggagccccccgtggacgacaagaacgaagacgccgatctcccttcggaagagacagatggtatagcatacatttcgtcatctcgcaagcatgacagcataaaggatgacagcgaagatctcaaaccagtgatcgacggtatggatggtattaagatcagtcagggactcgggctccaagacttcgatcttatccgatag

SEQ ID NO: 25827 - DNA, 66 bp, Artificial Sequence
  Description of Artificial Sequence: Synthetic coding sequence
atggacagcgtgatgcccagccaggagccccccgtggacgacaagaacgaagacgcagatctatag

SEQ ID NO: 25828 - DNA, 216 bp, Artificial Sequence
  Description of Artificial Sequence: Synthetic coding sequence
atggacagcgtgatgcccagccaggagccccccgtggacgacaagaatgaggacgccgacttaccaagtgaggagaccgatggcatagcctacatttcctcctctagaaaacacgattccatcaaagatgattctgaggatctgaaaccagtgatcgatggcatggatggtattaaaatttcacagggccttggattgcaggatttcgatctgtag

SEQ ID NO: 25829 - DNA, 417 bp, Artificial Sequence
  Description of Artificial Sequence: Synthetic coding sequence
atgatcagcctgaccgacacccagaagatcggcatgggcctgaccggattcggcgtgtttttcctgtttttcggcatgatcctctttttcgacaaggcactcctagccataggtaatgtgttattcgtggcaggcttggctttcgtaatagggctggagagaacttttagatttttttttcagaagcacaagatgaaggccacaggattcttcctcggcggcgttttcgttgtcctaatcggctggccactgatcggcatgatttttgaaatttatggttttttcctgctctttcgcggctttttcccagttgttgtgggctttattcggcgcgtccctgtgctggggagtctccttaacctgcccggcatccggtcctttgttgacaaggtgggcgaaagtaataatatggtttag

SEQ ID NO: 25830 - DNA, 702 bp, Artificial Sequence
  Description of Artificial Sequence: Synthetic coding sequence
atggacagccccgaggacgccgacctgttccacagcgaggagatcaaggcgcccgagaaggaggaatttcttgcttggcagcatgacctggaagtcaacgataaggcgccagctcaggctcgtcccactgtttttagatggacaggaggaggaaaggaggtgtatctttctgggtcattcaataactggagtaagctcccattaacaagaagtcataacaactttgtcgccattctcgacctgcccgagggagagcaccagtataagttcttcgttgacggccagtggactcacgaccccagtgaaccgatcgttacatcacagctgggtaccgtgaataatattatccaggtcaagaagaccgattttgaagtatttgacgcgctgatggtcgacagccagaagtgttcggacgtctctgagctatccagcagcccaccaggcccatatcaccaggagccttacgtttgcaagccggaagaacgcttccgcgccccacccatacttccccctcacctgcttcaggtaattctcaacaaggatactggaatcagctgtgaccctgccctcctgcctgagcctaatcacgttatgttgaaccacctgtacgccctgagtattaaagatggcgtgatggtgctctccgcgacccaccggtataagaaaaaatacgtgactaccctcttgtacaagcccatttag

SEQ ID NO: 25831 - DNA, 813 bp, Artificial Sequence
  Description of Artificial Sequence: Synthetic coding sequence
atgggcaacaccagcagcgagcgggccgccctggagcggcacggcggtcacaaaacaccaagacgggatagctcagggggaacgaaagacggcgaccgaccaaagattctgatggacagcccagaggacgctgacctcttccatagtgaggaaattaaggcgccagagaaggaggagttcttggcttggcagcacgacctcgaggtcaacgataaagctcccgcacaggcccgcccaaccgtcttccggtggacagggggcggtaaagaagtgtacctttcaggatcctttaataattggagcaagctccccctgacccggtcacacaacaatttcgtggcaatcctcgacctgcccgagggtgagcaccagtacaaattctttgtcgatggccaatggacacacgatccaagcgaacccatcgtgacatctcaactcggcaccgtgaacaacatcattcaggtgaaaaaaacggacttcgaggtgttcgatgcactgatggttgacagccagaagtgctctgacgtatcagagctcagttcctcgccgcccgggccctatcatcaggaaccctatgtgtgcaaaccagaagagagattcagagccccccccattctcccaccacacctcctgcaagtgatactcaacaaagatactggaatcagctgtgaccctgccctactgcctgagcccaatcatgttatgctgaaccacctttacgccctgtctattaaggatggggtgatggtgttgtctgctacccatcggtacaagaagaagtacgtcaccacacttctgtataaacccatttag

SEQ ID NO: 25832 - DNA, 12384 bp, Artificial Sequence
  Description of Artificial Sequence: Synthetic coding sequence
atggccggcagcggcgccggcgtgcggtgcagcctgctgcggctgcaggaaaccctgtcggcagcggatagatgcggagctgctctcgcaggccaccagctcattcggggactggggcaagagtgtgtactgtctagtagccccgcagtcctggccctgcagacctctttggtgttttcacgtgatttcggattgctggtcttcgtgaggaagagcctgaactccatcgagttcagggagtgtcgggaggaaattttgaagttcctgtgcatctttttggaaaaaatgggccaaaagatcgccccttattccgtcgaaattaagaatacctgtacttcagtctacaccaaggatcgcgctgctaaatgcaagattccggccctggacctgttgattaagctgctgcaaactttcagatcgtctcggctgatggatgaattcaaaattggagaactgttttctaagttctatggtgagctggcactgaaaaagaaaatccccgacactgtgttggagaaggtgtacgagttactagggctgttgggcgaggtgcatccaagtgagatgattaacaacgcagagaacctgtttcgggcttttctgggcgaactgaagactcagatgaccagcgctgtgcgagaacccaagctgcccgtgctggcaggatgtctgaagggcctgtcttctctcctgtgcaatttcactaagtccatggaggaagacccccagaccagcagggagatcttcaactttgttttaaaggctattcggcctcagattgacttgaaaaggtacgctgtaccatcagccggactccggttgtttgccctgcatgcatcacagttctcgacgtgcctgcttgacaattatgtgtctctttttgaggttctcctgaagtggtgcgcccacacaaacgtagagctaaagaaggctgctctgagtgctttggagagtttccttaagcaagtgagcaatatggtggctaagaacgctgaaatgcacaaaaacaaactgcagtacttcatggagcaattttatggcatcatacggaatgtggatagtaacaataaggaactctcaatcgctatccggggctatggcttatttgccgggccttgtaaggttatcaatgccaaggatgtggatttcatgtatgtggagttgatacagagatgcaaacagatgttcctcacccagactgatactggagatgacagggtttatcagatgcccagcttcttacagtctgtggcttctgtcctgctctacctggacaccgtgcctgaggtctatacccctgtcctggagcatctggtagtgatgcagatagactcgttccctcagtactcaccaaagatgcagctggtgtgttgccgggctatcgtgaaagtgttcctcgctctggcggcaaaaggacccgtgcttaggaactgtatatccaccgtagttcaccaaggtctgattaggatatgttcaaaaccagtggtcttgccaaaaggacccgagtcagagagtgaggaccacagggcctctggcgaagtgcgcaccgggaaatggaaggttcccacctataaagactatgtggaccttttccgtcatctgctgtcttcggaccaaatgatggacagcatcctggcagacgaagcatttttcagtgttaatagcagctccgagagcttgaatcacctgttgtatgatgagttcgtcaagagtgttctaaaaattgttgaaaagttagacctgacacttgagatccaaaccgtcggagagcaggaaaacggcgatgaggcgcccggggtttggatgatccccacctcggaccccgctgctaatctgcatccggctaagcccaaagacttttctgccttcattaatttggtggagttttgcagagaaatcttgccagaaaagcaggctgagttcttcgagccgtgggtgtactctttttcctatgagctcatcctccagtccacccggctcccgctcataagtgggttctataagctcctatcaattacggtgcgaaatgccaagaagataaagtactttgagggggtgtccccaaaatccctgaaacactcacctgaggacccagagaagtactcctgcttcgctttgttcgtcaaatttgggaaagaagtcgcagtgaaaatgaaacagtataaggatgagctgctggcatcttgtttgacattcctgctgtccttacctcataatatcatagagctggacgtgcgtgcatacgtgcccgccctacagatggctttcaaactcggcctctcttataccccgctcgccgaggtgggacttaacgcattggaggaatggtcaatctatattgatagacacgtcatgcagccttattacaaggacatacttccttgtctcgacggctacttaaagacaagcgctctgagcgatgaaactaaaaacaattgggaggtctctgcactctcccgcgcagcacaaaaagggtttaacaaagttgtcctcaaacaccttaagaaaacgaagaatttgtcatccaatgaggcgatctctttggaggaaatccggatccgggtggtccagatgctgggaagtcttggggggcagatcaataagaacctccttactgttacttcttcagatgaaatgatgaaaagttatgttgcctgggatcgcgaaaagcgtttgagcttcgcggtcccttttcgtgagatgaaaccggttatatttctcgatgtcttcctgccgcgggttaccgagctggcccttaccgctagcgacagacagacaaaggtggcagcttgcgagttactgcacagtatggtgatgtttatgctcgggaaagcgacacaaatgccagaagggggacagggagcccctcctatgtaccaactctataagcggacatttcccgttctgcttcgcctcgcctgcgacgtggaccaggttactagacagttgtacgaacctcttgtcatgcagttaatccactggtttactaacaacaaaaaattcgagtcccaggatactgttgccctcctggaggcaattcttgacgggattgtggatcctgtggacagtaccctcagagatttctgcggcaggtgtatcagagaattcctcaagtggagcattaagcagataactccccagcagcaggagaagagccctgtgaatactaagtcccttttcaagcggctgtactcactggccctccaccctaacgcgtttaagcgtctgggcgccagtctggccttcaataacatttacagagagtttcgcgaggaagaaagccttgtcgagcagttcgtattcgaggccctggtcatatacatggaatcacttgcgctcgcccacgccgatgagaagagtttggggacaattcagcagtgctgtgatgccattgatcatctgtgtcggatcattgagaaaaaacatgtctctctcaataaagcaaagaaacgtcggctaccaaggggcttcccaccaagcgccagcttgtgtctccttgacctggtgaaatggcttttggctcattgtggccggccccagacagagtgtcgacataagagcatcgaattgttttacaagttcgtgccgctattgcctgggaaccgctccccaaatctctggctgaaagatgttcttaaggaagaaggagtgagttttttaattaatacttttgagggcggtgggtgcgggcagccgtccggaattttagcccaaccaaccctcctttatcggggccccttcagtttacaagcaacattgtgctggctggatctcttgctcgccgcgttggagtgttacaacacctttataggagagcgaactgtgggtgctctgcaggttctaggcactgaagcccagtcctcgctgctgaaggctgttgcatttttccttgagagtattgcgatgcatgacattattgcggcagagaaatgcttcggcaccggcgccgctggaaatcggacgagcccacaggagggtgaacgatacaactacagtaaatgcacagtcgtggtgcgcatcatggagttcactacaacattactgaatacctcccccgaaggctggaagctactgaaaaaagatctgtgtaacacccacctgatgagagtgctagttcagaccctatgtgaaccagcttctataggcttcaacattggggatgtgcaggtgatggcacatctgcccgacgtatgtgttaacctaatgaaggctctgaagatgtccccatataaggatatcctggaaacccacctgcgcgaaaagattaccgcacagtccatcgaagagttgtgtgccgtgaatctgtacggccccgacgcacaagtggaccgtagccgcttagccgcggtggtgtctgcatgcaagcagctgcaccgtgcgggcttactgcataatattctcccatcccagtctactgatctccaccacagcgtggggacagagctactcagcctggtctataaagggatagcccctggcgacgagagacaatgcctgccaagcctggatctgagctgcaagcagctggcttcaggcctccttgagcttgcttttgccttcggcggcctgtgtgaaaggctagtgtcccttctccttaacccggcagtcctgtcgaccgcctctttagggagctctcagggatccgtaatccatttctcccacggagaatacttttactccctgttttcagagaccataaatactgagcttttaaagaatctggacctggccgtgctggaactgatgcaatcttcagttgataacacgaagatggtgtctgccgtgctgaatggcatgctcgaccaaagtttcagagagagggccaaccaaaaacaccaggggctcaagttggcaacaactattctgcagcactggaagaagtgtgactcctggtgggctaaggattccccattggaaactaaaatggccgtgcttgctctacttgccaagattctccagatcgactcttctgtgtctttcaatacttcacatggaagctttcctgaagtctttaccacttacatttccttactggcagacaccaagttggacctgcacctgaagggtcaggccgttaccttgctgcctttttttacaagtctcactggcgggagcctcgaagagctcagacgtgtactcgaacagctgatcgtagcacacttcccgatgcaatcgcgcgaatttccaccagggaccccccgatttaacaactacgtcgactgcatgaaaaagtttctggacgctctggaactgtctcagagccccatgctcctcgaattgatgactgaggtgctgtgcagggaacagcagcacgtgatggaggaactttttcagagttctttcagaaggatagcaaggaggggatcctgcgtcactcaagtcggcttgctggaatccgtttacgaaatgttccgaaaagatgacccacgcctcagttttacaagacaaagctttgtagatagaagcctcctaacattgctgtggcactgctccttggacgcactccgagaattcttttcaacgattgttgttgatgccattgacgtcctgaaaagcagattcaccaaactcaacgaatcaaccttcgacacacagatcaccaagaagatgggatattacaaaattctggacgtcatgtacagtaggctccctaaggatgacgtgcatgccaaggaaagtaagatcaaccaagtgtttcatgggtcgtgtatcaccgagggaaacgaactgacaaagaccttgatcaagctttgctatgacgccttcactgaaaatatggcgggcgagaatcagctgcttgagcgccggcgattgtaccactgtgcagcctacaattgtgccattagcgtgatttgctgcgttttcaatgagttgaagttctatcaaggttttctttttagtgaaaagccagagaagaacctgctaatctttgagaatctaatcgatcttaaacggaggtataattttcctgtagaggttgaggtacccatggaaaggaaaaaaaagtatatcgagatacgaaaggaggctagagaagcggctaacggtgattctgatggccccagttacatgtcgagtctctcctacctggcagactccaccctgtcagaggaaatgtctcagtttgacttttccacaggggtgcagtcttactcctactcttctcaggaccccagacctgccacaggacgcttccgaaggagagagcagcgcgatccaactgttcacgatgatgttctggagcttgaaatggacgagctgaatcgacatgaatgcatggctcctttaactgccctcgtgaagcacatgcacaggtcccttgggcctcctcaaggcgaggaggatagcgtgccccgagacctaccttcttggatgaagttcctgcatgggaagcttggcaatcccattgtgcctctaaatattcggctgttcctggctaagctcgtgatcaatacagaagaagtatttcggccctacgccaaacactggctcagccccctcctccaactggctgctagcgagaataacggcggcgaaggaatacactacatggtggtggagatagtggcaactattctatcttggactgggctcgctactcccactggagtgcccaaagacgaagtgcttgccaacagacttctcaacttcctgatgaaacatgttttccaccctaagcgcgccgtgttccgccataatctggaaattatcaagacactggtggaatgctggaaagactgtctgtcaatcccgtaccgcctgatctttgagaagttcagtggcaaagatcccaacagtaaagataactctgttggcatccagttgctggggatcgtcatggcaaacgacctccctccttacgatccccagtgtggcatccagagctcagagtacttccaggctctcgtgaataatatgagcttcgtgcgctataaggaagtgtacgcggccgcggccgaagtgttaggactgattcttcgttacgtcatggagcgtaaaaatattttggaagagtctctctgtgaactggtggccaagcaattgaaacaacatcagaacacaatggaggacaagtttattgtgtgcttgaataaggtgacaaaatctttccccccgctggcagatagattcatgaatgccgtgttctttctcctcccgaaattccacggcgtgctgaagaccctgtgtctggaggtcgttctctgccgagtagagggcatgacagagttatactttcagctcaagagcaaggattttgtgcaggttatgcgtcatagagatgacgagcgtcaaaaggtgtgcctcgatatcatatataagatgatgcctaagcttaaaccagtggagctccgcgaactcctgaatccagttgtggagtttgtatctcatccgtcaactacctgccgagaacagatgtataacatcctcatgtggatacacgacaactatcgagatcctgagtccgaaacagataatgactctcaggaaatctttaaactagccaaggatgtgcttattcaaggacttatagacgagaatcctggactgcagctgataatccgcaatttctggtcacacgaaacccgcctgccctccaacacgcttgaccgcctactagcgctcaatagcctgtactcgcccaagattgaggttcacttcctctcactcgctacgaacttcctgcttgagatgacaagcatgtctccagactaccctaacccaatgttcgaacaccctttatctgagtgtgaatttcaggaatacaccatcgactctgactggcggttccgcagcactgtgctcacccccatgtttgtggagacccaggcctcacaggggacgctccaaaccaggacccaagagggatccctgtctgcaaggtggccggttgctggacagatccgagcgactcagcaacagcatgatttcactctcacccagacagccgacggtcgaagctcctttgactggctgactgggagctctaccgacccactggtggatcatactagcccaagtagtgattcgttgctgtttgcacataagcggtcagagaggttgcagagagcccctctgaagtccgttggaccagattttggaaaaaagagacttggcctaccaggagatgaagtagataacaaggtcaagggcgcagccggaaggacagacctgcttcgcctgagaagacggtttatgagagatcaggagaaactgtcactcatgtacgctaggaagggcgttgcagaacaaaaaagagagaaagagatcaagtctgagcttaagatgaaacaagatgcccaagtggtgctttacaggagctataggcacggggacctgccggatattcaaatcaaacattcctcactaattacgcccttgcaagctgtggctcagagagatcccattatcgccaaacagttattttcctccctgtttagcggcatactgaaagagatggacaaatttaaaacccttagtgagaaaaacaacattacacagaagctgctgcaagatttcaatcggtttctcaacacgactttttcatttttcccaccatttgtcagctgtatacaagatatctcctgccagcatgccgccctcttgtctcttgacccagctgcggtatccgcaggctgtcttgcctcgttacaacagccggtcggaattcgcctgctggaagaagcccttctaaggcttctaccagctgagctgccagccaaaagggtacggggcaaggcccgactgccaccagacgtgcttcggtgggtcgaacttgccaagctgtatcggagcattggagagtatgacgttttacgcggaattttcacatctgagatcgggacaaaacagatcacccagtcagccctgttggctgaggcacgcagcgactactctgaggctgctaagcagtacgatgaggcactgaataagcaagattgggtcgacggagaaccaacagaagcggagaaggacttttgggaactggcctctttggactgctataaccatcttgcagaatggaaaagccttgagtactgcagtaccgcctccatcgatagtgagaacccccctgatcttaacaagatctggtcagaacctttttaccaggaaacctacctgccatatatgatccggagcaagctaaagctattgctgcagggcgaggctgaccagtccctgttgacattcatcgataaggcgatgcatggggagcttcagaaggcgattctggaactacattattctcaggagttaagtctcctctatttgctgcaggatgatgtggaccgcgccaagtactacattcagaacggcattcagtcctttatgcagaattatagttctatcgatgtgctgctgcatcagtcccgcttgacgaagctgcagtcagtgcaggcactcacagagattcaggagttcatctccttcatatctaaacaggggaacctcagcagccaggtgccactcaagcgtcttcttaacacctggacaaacaggtaccccgacgcaaagatggatcccatgaacatctgggacgatataattacaaatcgatgcttttttctttccaaaatcgaagagaaacttactccactacccgaggacaatagcatgaatgtcgatcaggatggggacccctctgatcgaatggaggtgcaggaacaggaggaggacatctcctctctgatccggagttgtaagttttctatgaaaatgaagatgattgatagtgcccgaaaacaaaataattttagtcttgccatgaaattactcaaagaactgcacaaggagtccaagacccgcgacgactggttggtgtcctgggtgcagagttactgtcggctgtcccattgccgatctaggagccaggggtgttccgagcaggtgttaaccgtgctaaagacagtgtcactgctcgatgaaaacaacgtgtcatcatatttgtcgaagaatatcctcgcttttcgggaccaaaacatcctgctcgggacaacgtaccgcatcattgctaatgcgttgagttccgagccagcttgcttggccgaaattgaagaagataaagcaaggcggatcctcgagctgtccggatctagtagtgaagattctgaaaaagtcatcgctgggctgtaccagagggccttccagcatctgtctgaagctgtccaagccgctgaggaagaggcccagccaccctcttggagttgcggccctgcagccggcgttattgacgcatatatgactctggccgatttttgtgaccagcaactgcgcaaggaggaggagaatgccagcgtcattgacagcgcggagctgcaggcatatcctgcactggtggtcgaaaaaatgctgaaagcccttaaactgaattcgaacgaggctcggttgaagttcccccgcctcttacagattatcgaacgatatcccgaagaaactctgagcttgatgaccaaagagatctcatccgtgccttgttggcaattcataagctggatttctcatatggtcgcactgcttgacaaagaccaggccgtcgccgtccagcacagcgtggaggaaattactgataattaccctcaggccatcgtttacccctttatcatttcttcggaatcttactcgtttaaggatacatccaccggccacaagaacaaagagttcgtcgcccggatcaagagtaagctggaccaggggggtgtaatccaggatttcattaacgcattagaccagctttccaatcctgagctgctgtttaaagactggtcgaatgatgtgagagccgagctcgccaagacacccgttaacaaaaagaatatcgagaagatgtatgagaggatgtatgctgctctcggcgatccaaaagcgcccggcctcggagcctttcgccggaagtttatccagaccttcggtaaggaattcgacaagcactttggaaaagggggatccaagctgctcagaatgaagctaagcgactttaatgacattacaaatatgctgctgctgaagatgaacaaagacagtaaaccacccggcaacctgaaggagtgtagtccttggatgtccgattttaaagttgagttcttaaggaatgaattggagatacctggccagtacgatggaaggggaaagccgttgccagaatatcacgttaggatcgctggtttcgacgaacgggtgacagtcatggcttccctgcgcagacccaagagaattatcattagggggcacgacgaaagagagcacccattcctggtgaagggtggtgaggacctccgccaggaccagcgggttgagcagctgttccaggtgatgaacggaattctggcgcaggatagcgcctgctcacagagagccctccagctccgaacgtattccgtggttccaatgacttcgagactcgggctgatagagtggctagaaaacacggtcaccctgaaggacttactccttaatactatgtcgcaggaagaaaaagcagcctacttaagcgatcctcgggcccccccatgcgagtacaaggactggctgacaaagatgagcggcaaacatgatgtcggtgcctacatgctgatgtacaaaggagctaaccgcactgagacagttacctctttccgcaaacgggagtcaaaagtgccagccgatctgttgaaacgggcgtttgttcgcatgtcaacatcacctgaagcctttttagccctgcgaagccactttgcttctagtcacgccctgatttgtatttctcactggatattgggtataggagatagacacctcaacaatttcatggtagcgatggagacgggtggggttattggcattgattttggacatgcattcggctctgcaacgcagtttctgccggtgccggaactaatgcccttcaggttaacacgacaattcattaacctgatgttaccaatgaaggagactggcctcatgtactctatcatggtccatgccctgagggcattcaggtccgaccctggccttttaacaaataccatggacgttttcgttaaggagccatccttcgattggaaaaattttgaacagaagatgctcaaaaaggggggtagttggattcaagagatcaacgtggctgaaaaaaactggtatccacgccagaaaatatgttacgcaaagcggaagcttgccggcgccaacccagccgtcatcacctgcgacgaattgctcctgggccacgagaaagcacctgctttcagagattacgtggctgtcgcaagaggctctaaggaccacaacatcagagcgcaggagccggaatccgggctttctgaggaaactcaggttaagtgcctgatggaccaagccaccgacccaaacatcctagggcgcacgtgggagggttgggagccgtggatgtag

SEQ ID NO: 25833 - DNA, 12291 bp, Artificial Sequence
  Description of Artificial Sequence: Synthetic coding sequence
atggccggcagcggcgccggcgtgcggtgcagcctgctgcggctgcaagagaccttgagtgccgctgatcggtgtggcgctgcccttgcgggacaccaattgattcggggtttgggccaggaatgtgtgttgagctccagtccagcggtactagccctgcagacctcccttgtcttttcacgtgacttcgggctgctggtctttgtgcgtaaaagcttgaattcaatagagttccgggagtgtcgggaggaaatcttaaagttcttatgtatctttctggagaagatgggccagaaaatcgccccttattccgtggagattaagaacacttgcacttcggtttataccaaggaccgggcggcgaagtgcaaaattcctgccctggatttgctgattaagctgctgcagacttttaggagttcacgccttatggacgaatttaaaataggggagctattcagcaagttttacggtgagctggcactgaagaagaaaatcccagacactgtactggaaaaagtgtacgaactccttggactgctgggcgaggtccatcccagcgagatgatcaacaatgccgaaaacctcttcagggccttcctgggggaacttaaaacccagatgactagcgccgtgagggagccgaaactgcccgttctggcgggttgccttaaaggtttgtcaagcctgttatgcaattttacaaagagtatggaagaggatccccagactagccgcgagattttcaatttcgtgctcaaggccatacggccccaaattgacttgaagcgctatgcggttccttccgctgggctgcggctgttcgcactgcatgctagtcagtttagtacctgtctgctagacaactacgtttcactgtttgaggtcctgcttaagtggtgtgcgcatactaatgtcgagctgaagaaggccgcactatccgcgttggaaagtttcctcaagcaagtgtctaatatggtggccaagaacgccgagatgcataaaaataagctgcagtactttatggagcagttttatgggataattagaaatgttgatagtaacaacaaggagcttagcatagcgataagggggtatgggcttttcgcaggaccctgtaaggtcatcaacgccaaagatgtcgactttatgtatgtcgaactgattcaacgatgcaaacagatgtttttgacacagacggatacaggcgacgaccgagtttaccagatgccaagttttctgcagtccgttgcaagtgtgctgctttacctggatacggtgcccgaggtgtataccccagtactcgagcatctggtcgtcatgcagattgattcattccctcagtattcaccaaagatgcagctcgtgtgctgtcgcgctattgtgaaagtcttcctggctttagccgctaaagggcccgtgctccgcaattgcatttccactgtcgttcatcagggattaatccggatttgttccaaacctgtggtccttccgaaaggccctgagtccgaaagcgaagaccacagagcttccggcgaagtgcgtactgggaagtggaaagtccccacttataaagactacgtcgatctctttaggcatctgcttagttcagaccaaatgatggatagtatactggcggacgaggccttctttagcgtgaattccagtagtgaatccctgaaccatctcctgtacgatgaattcgttaagtcggttttgaaaattgtcgaaaaactagacctcaccctggagattcaaacagtgggcgaacaagagaatggcgacgaggctccaggagtttggatgattccgacctcagaccctgctgcaaacctgcacccagcaaagcccaaagacttctcggcctttatcaacttggtggagttctgtcgggagatcttgccagagaagcaggcagagttcttcgagccctgggtatactccttcagctatgagttaatcttgcaatctactagactccctctaatatccgggttctacaaactcctgtccattactgtcagaaacgcaaagaagatcaagtactttgaaggggtaagcccaaaatccctcaagcactcacctgaggacccagagaagtactcttgtttcgccctcttcgtcaaatttggcaaggaggttgcagtgaagatgaagcagtataaggatgagcttctggcctcctgcctcacttttctgctaagcctaccccacaatataatcgaacttgacgtgcgggcatatgtgcccgccttgcaaatggcgtttaagctgggtttatcatatacacccctggccgaagtggggctcaacgctctggaagagtggtcgatatacatagaccgccatgtgatgcagccctattataaggatattctaccatgcctggacggctatctgaaaacatcagctctgagtgatgaaacaaagaataactgggaagtgtctgccctgagcagggctgctcagaagggttttaataaggtggtgttaaaacacttgaagaagacgaagaatctgagctctaatgaagcaatatctctggaggaaattcggatccgtgtggttcagatgctgggaagcctggggggccagattaacaagaatctgctgaccgtgacctcgagcgatgaaatgatgaagtcttatgtagcttgggatcgggagaaaagactgtctttcgctgttcctttccgtgagatgaaaccagttatcttccttgacgtgttcctgcctcgtgttaccgaactggcgctgacagcctcagatcgacagaccaaggtcgctgcgtgtgagctgctccactccatggttatgtttatgttgggcaaagctacacaaatgccggagggcgggcagggagccccccctatgtatcagctctataagagaacctttccagtgcttttacggctggcttgcgacgtagatcaggtgactcgccagctctacgagcctcttgtcatgcaacttatccactggttcaccaacaacaaaaaattcgaatcccaggacaccgtcgccctcctggaggcaattctggatggcattgtagatccagtagattcaaccctgagggacttctgcggcaggtgtatccgcgagttcttgaaatggtccattaagcagatcacgccgcagcagcaggagaaaagtcctgtgaacacaaagtctctattcaaacggctgtactctcttgcccttcacccaaacgcctttaaacgactgggcgcctctcttgcattcaacaatatatacagagagtttagagaggaggagtccctcgtggagcagtttgtgttcgaggcattggtaatatacatggagtcacttgctttggctcatgccgacgagaaatcacttggaactatccagcagtgttgtgatgctatagatcacttatgtcgaattattgaaaaaaagcacgtcagtctgaacaaggccaagaagcgcaggctgccccgcggatttcctccatctgcgagcctttgcctgctggatttggtgaaatggctgctggcacactgcgggcggccacagaccgagtgtcgacataaatctatagaactcttttataaattcgttcctctgctgcctggaaacagatccccaaatctgtggctgaaagacgttctgaaagaggaaggagtgtcctttctcattaacactttcgagggaggcgggtgcggacagcccagtgggattctggcccagcccaccctgctgtatagaggaccgttctccctgcaggccaccctgtgctggctggatcttctcttggctgccctggagtgttataacacattcattggtgagcgcacagtaggggcacttcaagtgttggggacagaggctcaatctagcctgcttaaggccgtcgccttctttctagaaagtattgctatgcatgatatcattgctgcagaaaagtgctttggaacaggtgcagcaggtaaccgaactagtccccaagaaggagagcgctacaactactcaaaatgtaccgtagtcgttcgcatcatggaattcaccactactctcttgaacaccagcccagaaggctggaagctccttaaaaaggacctgtgcaacactcatttaatgcgtgtgttggtccagacactatgcgagcccgcatcgataggcttcaacataggcgatgtgcaagttatggcccacctacctgacgtgtgtgtgaacctaatgaaagctttgaaaatgtccccatacaaggatatccttgagactcacttacgcgaaaaaatcactgcccagtccatcgaagagctttgtgcggtcaacctctatggccctgacgcgcaggtcgatagaagcagactggccgccgttgtttccgcatgcaagcagttgcaccgtgccggcctgcttcacaacattttgccgtcccagagcacagacctgcatcattcagtagggaccgagctcctgagtctcgtctataagggcatcgctcccggggacgagcgccagtgcctgccatctctcgatctgagctgcaaacagctggcctcgggcctgttggaattggcattcgcctttgggggattgtgtgaaaggcttgtcagcctattactcaatcccgccgttctttcaaccgcctcccttggttccagccaaggcagcgttattcactttagccacggggagtatttttactccctgtttagcgagacgattaacaccgagctcttgaaaaacctggatcttgcagtgttagaactgatgcagagtagtgtggataacacaaagatggtgtctgcagtcttgaacggcatgctcgaccaatcttttcgagaaagggctaatcagaaacaccagggtctcaagctagcgaccacaatattacagcattggaagaagtgtgacagttggtgggcaaaggactctccccttgaaacaaagatggctgtcttagccctgttagctaaaatactacagatcgattcatccgtgtcattcaatacctctcacggctcattccctgaggttttcactacctacattagtctattggctgacacaaagctagacttgcacctcaaaggccaggcagtgacacttctgccattcttcacctccttaacgggagggagtctagaagaactgcgccgggtgctcgagcagctgattgttgcacatttccccatgcagtctagagagttcccgcccggtaccccaaggtttaataactacgtcgactgcatgaagaaatttttggacgccctggaactgagccagagtccaatgctgttggaattgatgaccgaggtgctctgtcgggagcagcagcatgttatggaggagctcttccagtctagcttcaggcgcattgctaggagagggagctgcgtgacgcaagtgggactgctggagtccgtctacgaaatgttccggaaagacgacccgaggcttagcttcacccggcagagctttgttgatcggtctctcctgaccctgctttggcactgctctctcgatgcactacgcgaattcttttcaacgatagtagtagacgccatagatgtgttaaaaagtaggtttacaaagctcaatgagtccaccttcgatactcaaatcacgaaaaagatgggctattataagattctggacgtaatgtactcgagattgccaaaggacgatgttcacgccaaggaatctaagattaaccaggtgttccatggttcatgcataacggaagggaatgagctgacgaaaactctcatcaaattgtgctatgatgctttcacagagaatatggcaggagagaatcaactcctggagcggaggcggctgtatcactgcgccgcatacaactgcgcgatctctgtgatctgctgcgtatttaatgagttaaaattctaccagggatttttgttctccgagaaacccgagaaaaacctcctcattttcgaaaatctgatcgatctgaagaggcgatacaatttccctgttgaagtcgaggttcccatggagagaaagaagaaatatattgaaatcaggaaggaggctcgcgaggctgctaatggcgatagtgatgggccaagctacatgtccagcctgtcatacctggcagactctacgctgtccgaagagatgtcccagttcgacttttctactggcgtgcaaagctatagttactcatctcaggatccgaggccagctaccggccgcttccgacggcgggagcagcgcgatcctacagttcatgatgatgtacttgaactggagatggacgagcttaacaggcacgaatgtatggcccccctgaccgccctggttaagcacatgcatagatcactggggccaccccaaggggaagaggactcagtgccccgtgatctaccctcctggatgaaatttctgcacggaaagctcggtaatcctatcgttccacttaacattagactcttcctcgccaaacttgtgatcaacacggaggaggtgtttcggccctatgcaaagcattggctgagccctctgctgcagctggcagccagcgagaacaatggcggcgagggcattcactatatggtggtggaaatcgtggccaccattctgagctggacggggctggccaccccgaccggcgtgcctaaagacgaagtgctggccaaccggctgctcaattttcttatgaaacacgtgttccatccgaaacgggcagtgtttcgtcacaacctcgagattatcaaaacacttgtggaatgctggaaagactgcttgtctatcccctatcggctgatttttgagaaattttccggcaaggatccaaactccaaagataatagcgtcgggatccagctgttgggcattgttatggccaacgacctcccaccctatgatccacagtgcgggatccaaagctctgagtactttcaggcattggtgaacaatatgagctttgtcagatacaaagaagtatacgccgccgccgccgaagtgctaggactcattctgaggtacgtgatggaacgcaagaacatccttgaagagtccctatgcgagctggtggccaagcagctgaagcagcatcagaatactatggaggacaaatttatcgtctgtcttaataaagtaacaaagtccttcccaccccttgccgatagatttatgaatgccgtgttctttctgctcccaaagttccacggcgtactgaagacactgtgcttagaagtcgtgctgtgcagagtggagggcatgacggagctgtacttccaactgaaatctaaggactttgtgcaggttatgcgacaccgcgatgacgaaagacagaaggtgtgcctggacataatctataagatgatgcctaaactgaaaccggttgaactccgggaactgctgaaccctgtggtggagttcgtgtcccacccctcaactacctgtagagagcagatgtacaatattttgatgtggatacatgacaattaccgggaccctgagtccgagaccgacaatgatagtcaggaaatcttcaagttggccaaggacgtgctcattcaaggccttatcgacgagaatccaggtctgcagttaatcatccgaaacttctggagtcacgagacccgtctgccctccaatactctcgatagactcctggctctaaattctctctattcacctaaaattgaagtgcacttcttgtccctcgctacaaatttcctcctcgaaatgacttccatgtcccctgattaccccaaccccatgtttgaacaccccctgagcgaatgcgaatttcaggagtacactatcgactcggactggaggttccggtccaccgtgctaactccgatgtttgtagagacccaagcctcgcagggcaccctgcaaaccaggacgcaggaaggcagcctctccgctcgctggcccgttgctggccagattcgagccacccaacagcagcacgacttcacgttgacccagaccgccgacggccggtctagtttcgactggttaactggctctagtactgatcccctggtcgaccacacaagtccatcttccgatagcctgttgttcgcccataagagatcggagcggctgcagcgcgccccgctgaagtccgtcggacctgatttcggcaagaaacggctggggttgccgggagatgaagttgataacaaggtcaaaggcgccgcgggccgaactgacctgttgagactccgacggcggttcatgcgagaccaggaaaaattgagtctgatgtacgccagaaagggagtggcagagcagaagcgcgaaaaggagatcaagtctgaattgaagatgaaacaggacgcccaggtcgtgctttaccgctcataccgtcatggagatctgcctgacatccagattaaacactctagtctcatcacccctttgcaagcagttgcacagcgtgaccctatcatcgcgaaacagttattttcctctctgttctcaggaatcttgaaagagatggataagtttaaaaccctgagtgaaaaaaacaatatcacccagaagttgctgcaggattttaaccgttttttgaatacgactttttcatttttcccacccttcgtttcgtgcatccaagatatctcctgccagcacgctgccttgctgagcctggaccccgctgctgtcagtgccgggtgtctagcaagcctgcagcagcccgtagggatcagactgctggaggaagctctactaaggctcctacccgccgagctccccgctaaacgagtgagagggaaggcccgactccccccggacgtacttcggtgggttgaacttgcaaagctctataggtccattggtgagtacgatgtcctccgtggcattttcacgtccgagatcggtaccaagcagattacacaatctgctctgctggcagaagcccggtctgactactccgaagctgccaaacagtatgatgaggccttgaataaacaagactgggtggatggagaacctacggaggctgaaaaggacttttgggagctggctagcctcgattgctataaccacttagccgaatggaagtccttggaatattgcagcactgcatcaatcgacagcgagaacccccccgacctaaataagatatggagtgagccattctaccaggaaacctatctaccatacatgattcggagcaagttgaaactgctcctccagggggaagctgaccagtctctgctcacctttatcgataaggccatgcatggggagttacaaaaggccatcttggagcttcactacagccaggaattgtctctgctgtacctcctgcaggatgacgtcgatcgcgccaagtattacattcagaacggtatccagagcttcatgcagaattactcctcgattgacgtcctccttcatcagagtcggctgaccaaattgcagtctgttcaagccctgacggaaatccaagaattcatatcattcataagtaagcaggggaacttgtcatcgcaagttcctttaaagcgattacttaatacctggaccaaccgatacccagacgcgaaaatggacccaatgaacatatgggacgacatcataacaaatcgttgtttcttcctaagcaagatcgaagagaaactgacccctctgcccgaagacaattcgatgaacgtggaccaggacggcgaccccagtgatcggatggaggtgcaggagcaggaagaggatattagttccctgatccgatcttgtaaatttagtatgaagatgaagatgattgatagcgcaagaaaacaaaacaacttttccctggccatgaaactattgaaggaactgcataaggagtctaagacgcgggacgattggttggtttcttgggtacagtcatactgcaggctctcccattgtcgaagcagaagtcaagggtgctccgaacaggtgttgacagtacttaagaccgtctcattgctcgacgagaataacgtcagttcctacctcagcaaaaacatcttagcatttagagatcagaacatcttgctgggtaccacctataggatcatcgcgaacgccctgagcagtgagccggcatgccttgccgaaattgaagaggacaaggcccgtcggatcctcgaactgtccgggagctcatcagaggatagcgaaaaagtgatcgccggcctttaccagcgtgctttccaacatctctcagaagctgttcaagccgcggaggaggaggcccagccaccgtcttggtcttgtggacctgctgccggtgttatcgacgcgtacatgacactggccgacttttgcgaccagcagctccgcaaggaagaggagaatgcgtctgtaattgactcagccgaactccaggcatatcccgcgctggtcgtagaaaagatgttgaaagccctgaaacttaacagcaacgaggccaggcttaagttcccccgcctgctgcaaataattgagagatatccagaagagacattgtcattgatgacgaaagaaatatcctccgttccgtgttggcaattcattagctggattagtcacatggttgccctcctcgacaaagatcaggccgttgctgttcagcacagcgtggaagagattaccgataactacccacaggccatcgtatatccgttcatcattagttcagagtcatatagctttaaagacacctcgacgggccacaaaaacaaggagtttgtggccaggatcaagagcaaactagaccagggaggggtgatccaggactttatcaatgcacttgatcagctgagtaatcctgagctcctttttaaggactggagcaatgatgtcagggctgagctggccaaaacccccgtaaacaagaaaaatatagagaagatgtacgagcgcatgtacgccgctcttggcgaccctaaagcgcccggacttggcgccttcaggcggaagttcattcagaccttcggaaaggagttcgacaagcacttcggaaagggcggatcgaaactcctgcggatgaagcttagcgatttcaacgacattacaaatatgttgctcctgaagatgaacaaggatagtaagcctcccgggaacctcaaggaatgtagcccctggatgtcggatttcaaagtcgaattccttaggaatgaactcgaaatccctgggcagtacgatggccggggcaaacccctgcctgagtaccacgtgaggattgccgggttcgatgagcgggtcacagtgatggctagcctccggaggccaaaacgtataataatccgaggtcacgatgaacgtgaacatccattcctcgtcaagggcggcgaggatctcagacaagatcagcgagtggaacaattgtttcaggtgatgaatggcattttggcccaggacagcgcctgtagccagcgtgccctgcagctacggacatacagcgtcgttcctatgacctcttccgaccctcgcgccccaccctgtgaatataaggattggctcactaaaatgtctgggaaacatgatgtgggcgcatacatgctgatgtacaagggagcaaatcgaacagaaacagtgacctcattccggaaacgagaatcaaaggttccagcggacttactcaagagggcctttgttcggatgtcaacctctccagaggcctttctcgccttacggagccattttgccagcagccacgcccttatttgcatctcccactggatcctgggcattggagaccgacacctaaacaatttcatggtcgcaatggagaccggcggcgtgatagggattgacttcgggcatgcatttggaagcgcaacccaatttctccctgtccctgaattgatgcctttccggcttacccggcagttcatcaacttaatgctcccaatgaaagagaccgggttaatgtactcaatcatggtccatgcgctgcgagcattcaggtccgatccaggcctgttaacgaacaccatggacgtgtttgttaaagagccttccttcgactggaaaaactttgaacagaaaatgctgaagaaaggaggcagttggattcaagaaataaacgtggccgagaagaactggtacccacgccagaaaatttgttacgcgaaacgtaagctggcaggagctaacccagctgtgatcacttgcgatgaactgctacttggacatgagaaagccccagccttccgtgactatgtggcagttgcgcggggctcaaaagatcacaacatccgcgcacaagagcctgaatccgggcttagtgaggagactcaggtgaagtgtctgatggaccaggcaaccgatccaaatatcctcgggaggacatgggagggctgggagccctggatgtag

SEQ ID NO: 25834 - DNA, 444 bp, Artificial Sequence
  Description of Artificial Sequence: Synthetic coding sequence
atggccgcccagcggctgggcaagcgggtgctgagcaagctgcagagtccctcccgggcccgggggccaggcggctctcctggcgggctccagaagcggcatgcaagagtcactgtgaagtatgatcggcgcgagctgcagagacggctggacgtcgaaaagtggatcgatggtcgacttgaagagctgtataggggtatggaagccgatatgcctgacgagataaacattgatgaactgctagagttagaatcagaagaagagagaagtcgcaagatacaggggctcttaaagtcttgcggcaagccagtggaggacttcatccaggagctactggcaaagctgcagggattgcaccggcagcccggcttaagacaacctagccccagccacgacggtagcctctctccattacaggatagagcccgaaccgcccacccctag

SEQ ID NO: 25835 - DNA, 363 bp, Artificial Sequence
  Description of Artificial Sequence: Synthetic coding sequence
atggccgcccagcggctgggcaagcgggtgctgagcaagctgcagagtccttctagagccaggggacctggtggaagccccggaggattgcagaagcgtcacgctcgcgtcaccgtcaagtacgacagaagagagctgcagcggcggctcgatgtggagaaatggattgacggacggctcgaggagctttatagaggaatgggactgttaaaatcctgcgggaagcccgtagaggacttcattcaggaacttcttgcaaaactgcaagggttacacaggcagccaggcctgcgtcagccatcccctagccatgacggttccctttcgcctctacaggaccgtgcaagaaccgcccatccatag

SEQ ID NO: 25836 - DNA, 2025 bp, Artificial Sequence
  Description of Artificial Sequence: Synthetic coding sequence
atggcccccggccaggccccccaccaggccaccccctggcgggacgcccacccgtttttcctgttgagcccggtcatgggtctgttatcccgtgcctggtcccggctgcggggactgggacccttggaaccgtggttagtggaggctgtcaagggtgcagccctggtcgaagccggcctggagggcgaagcgcgcacgccgctggctataccacataccccctggggtcgcaggcctgaagaggaggcggaggactcgggaggaccaggtgaggaccgagaaactctcgggctgaagacgagtagctctttacccgaagcgtggggcctcctggatgacgacgacggaatgtacggcgaacgagaagccacctccgtcccgcggggccagggtagccaatttgccgacggtcagcgggctccacttagtccaagtctactcatccgcaccctccaaggtagtgacaagaacccgggcgaagagaaagcagaggaagaaggggtggctgaggaagagggcgtgaataaattcagctaccctcctagccaccgcgagtgttgtccagcagtcgaggaggaggatgatgaggaagcggtgaagaaggaggctcatcgcacttcaacaagcgctctcagtccagggtcgaagcccagtacctgggtatcatgcccaggagaagaagagaaccaggccacagaggacaagcgtacagagaggagtaaaggggctagaaagactagcgtatcaccgaggtcatctggctctgacccaagatcatgggagtatagatccggagaagccagcgaagaaaaggaggagaaagcacacaaggagactggaaagggcgaggcagctccaggcccgcagtcttcagccccagcccagcggccccaactgaaatcctggtggtgtcagccgtcagatgaagaggagggcgaagtgaaagccctcggcgctgctgagaaggacggggaggccgagtgtcccccctgtataccccctcccagtgcattccttaaggcttgggtatactggcccggcgaggacaccgaggaagaggaggatgaggaggaggatgaagactctgactccggctcagatgaggaagagggggaggcggaagcatcaagctcaacgcctgccacaggagtcttcctgaagtcttgggtgtatcagcctggggaggatactgaggaagaagaagatgaggacagcgacaccgggtctgccgaagacgaaagagaagcggaaactagtgcatctacccccccggcatcagcgttcctcaaggcatgggtttacagacccggcgaggacaccgaggaggaagaggacgaagatgtggattcggaggacaaagaagatgattcagaggccgcacttggggaagctgagtctgatccccatcccagtcaccccgatcagagggcacatttcagaggttggggttatcgcccgggcaaagaaaccgaggaggaagaggccgccgaggactggggagaggccgagccttgtccctttcgggtcgcaatctatgttccaggagagaaaccacccccaccatgggcaccaccccggctgcctctgagactgcagcgccgtcttaaacgcccagagacaccgactcatgacccagaccctgagacacctcttaaggcccggaaagtaagattttccgagaaggtgaccgtgcatttcctggccgtttgggccggcccagctcaggccgcccggcaaggaccttgggaacaactcgccagggaccgcagcagatttgcccggcggatcactcaggcacaggaagaactttctccctgtctcacaccagcggctcgtgccagagcttgggcaagacttcgaaatcctcctctagccccaattccagctctgacacagacgctgccatcttcctctgtgccctcgagccccgtccagactacccccctctcccaggcagttgcaaccccttcacggagctccgcagcagctgccgctgctctcgaccttagcggacggcggggctag

SEQ ID NO: 25837 - DNA, 1545 bp, Artificial Sequence
  Description of Artificial Sequence: Synthetic coding sequence
atgaaggccgaggaggagggcgtggccgaggaggagggcgtgaacaaattttcatatcccccatcgcatagggagtgctgtcccgccgtggaagaggaggatgacgaggaggctgtgaaaaaagaagcacaccggacaagcactagtgccctaagtccgggatctaagccctccacctgggtaagctgtccaggggaggaagaaaatcaagccactgaagacaaacggaccgagcgctccaagggagccaggaagaccagcgtttcgcctagatccagcggctccgaccctaggtcctgggagtaccgctcaggggaggcctctgaggagaaagaggagaaagcccacaaggaaacggggaagggagaagccgctcccggtccacagagctcggcaccagcgcagaggcctcagctgaagtcctggtggtgccaaccatccgacgaagaggagggtgaggtgaaggcgctgggcgctgcagagaaagacggagaggccgaatgccctccttgtatccctcctccaagtgcgttcctgaaagcatgggtctactggcccggcgaagatacagaggaagaagaggacgaggaggaagatgaagattctgacagcggctccgacgaggaggagggtgaagccgaggcttcgagttccacacccgcaacgggagtttttctgaaatcatgggtgtatcagcctggcgaagatacggaagaagaggaggacgaggacagcgacacgggtagtgccgaagatgagagagaagcggaaaccagcgctagcactccacctgcttccgcttttctaaaggcttgggtctatcgtcccggggaggatacagaagaggaagaagatgaggatgtagattcggaggacaaagaggacgacagcgaggcagctttgggggaggccgagagcgatccccacccaagccaccccgatcaaagagcgcactttcgcggctggggttaccgaccaggcaaggagactgaggaagaagaagcggccgaggattggggagaagccgaaccctgccccttcagagtggcaatttacgtaccaggagaaaagccccctcccccatgggcccctcctagactaccattacgcctgcaacgccggctcaaacggcctgagacaccaactcatgatccagatcctgagacccctctaaaggctcgtaaggtgagattttccgagaaagtaacagtgcattttttggccgtctgggctggcccagcgcaggcagcccggcagggcccttgggaacagttagcccgagatagatccagatttgcaagacggattacgcaggcccaggaagaactgagcccctgtcttactcctgccgctagagctcgcgcctgggcgcggttacggaacccccctctcgcccccatccctgcactaacgcagacattaccctcttcatcagttccttcatctcccgtgcagaccacacccttgtcacaggccgtggccactccctccagatccagcgcagccgctgccgccgctctggatttatccgggaggagggggtag

SEQ ID NO: 25838 - DNA, 1899 bp, Artificial Sequence
  Description of Artificial Sequence: Synthetic coding sequence
atgccctggctggtggaggccgtgaagggcgccgccctggtggaggccggcctggaaggagaagcacgaacgccgctcgctatccctcataccccctggggtcgccgcccggaggaagaggcagaagactccggaggtcctggcgaagaccgcgagacattgggactgaaaacttcctcgagtctgcccgaggcatggggcctgctggacgacgatgacggaatgtacggcgaaagggaagccacgtccgtccctagaggccagggttcccagttcgctgacgggcagcgcgcccccttgagtcctagcctgctcatcagaactctccaaggttctgacaaaaatccgggcgaggaaaaagcggaagaagaaggggtggccgaagaagaaggggtcaataagttttcctatccgccatctcacagggaatgttgcccggcggtagaagaagaggatgacgaggaagcagtcaagaaagaagcgcacaggacctctacttccgccctgagcccgggaagcaaaccatcaacttgggtaagttgcccaggcgaggaggagaaccaagccaccgaggataagaggaccgagcgcagtaaaggcgcgcgtaaaacctcagtgtcaccccgctcctctgggagcgatccccgcagttgggagtatagatcaggagaagcaagcgaggagaaggaggaaaaggcccacaaagagactgggaagggcgaggccgcccccggacctcagtcgagcgctcccgcccagcgcccccaactcaaatcatggtggtgccagcccagtgacgaggaggagggcgaagtcaaagccctcggagcagcagaaaaagacggggaggccgagtgcccaccctgtatcccaccgccgtcagcgtttctcaaggcctgggtctattggcctggcgaagataccgaggaagaggaagatgaagaggaggacgaggatagtgattcgggtagcgacgaagaagagggcgaagccgaggcaagtagcagcacccctgcgaccggagtgttcctgaaatcttgggtctaccagcccggggaggatacagaagaggaggaagacgaggactctgatactggtagtgctgaagacgaaagggaagctgagacttccgcgagcacaccacccgcctcagcctttctgaaagcctgggtgtaccgtcctggcgaggataccgaagaggaagaagacgaagatgtggatagtgaggacaaggaagatgactctgaggccgccctgggtgaggccgagagcgatccacatccctcccatcctgaccagcgggctcactttcgggggtggggatatcgccccggaaaggaaacggaagaagaagaagccgcagaggactggggagaggccgagccctgcccttttcgcgtggcgatctatgtgcccggcgagaaacctccaccgccttgggcgccgccgagactgccattacgattacagaggaggttgaagcggccagaaaccccaactcacgacccagaccctgagactccactaaaagccagaaaagtgcgcttcagcgagaaggtgaccgtgcacttcctcgctgtatgggccggtccagcccaggctgcccggcagggaccatgggaacagttggccagagacagatcccgtttcgccaggagaataacacaggcacaggaggagctgtcgccctgcctgacccccgccgccagggccagggcttgggcacggttgcgcaatccccccctggctcccatcccagcattgacgcagacccttccctcctcaagtgtgccgtcctcgcccgtccagactacacccttatcacaggcagtggctactccatccagatcaagtgccgccgctgccgccgccctggacttgagcggtaggagagggtag

SEQ ID NO: 25839 - DNA, 1671 bp, Artificial Sequence
  Description of Artificial Sequence: Synthetic coding sequence
atggccggcgccagcgagctgggcaccggccccggcgccgccggcggagacggagatgactctttgtacccgatcgcagtgttgatcgacgagctgagaaatgaagacgtacagcttcgtctgaacagcataaagaaactgagcaccattgctcttgccttgggagtggagcgaacccgcagcgagctactgcccttcctgaccgataccatttatgatgaagacgaggtgctgctagcactggccgagcagctcggaaattttacaggccttgtgggaggtcccgattttgctcattgcttgttaccacctctagagaacctcgcgaccgttgaggaaaccgtggtacgtgacaaggccgtggagtccctgcggcaaatttcccaggagcacaccccagtggccttggaagcctacttcgtccctctcgtgaagagattagctagcggcgactggtttacatcccgaacatccgcctgcggtctatttagtgtatgttatccaagggccagcaacgctgttaaagcggagatccgacagcagttccgatctctgtgcagcgacgatacccctatggtcagacgagccgcagcaagcaagcttggcgaattcgctaaggtcctggaacttgactcagttaagtctgagattgtacccctttttacttccttggcctccgatgagcaggacagtgttagactccttgcagttgaggcctgcgtttctatcgcgcagctgctttctcaggacgacctggagacactggtcatgcctaccctgagacaagctgccgaagacaaatcttggcgtgtgcggtatatggtggccgatagattctcagagctccagaaggccatgggccctaagattacactcaacgacttgatacccgcctttcagaacctcttgaaagattgcgaggcggaggtcagagccgccgccgcacataaggtgaaggagctcggggaaaatctgcccatcgaggaccgcgaaactatcataatgaatcagattctgccttacattaagtgccctgatgtccggttgaacatcataagcaatctggactgtgtgaatgaagtcatcggcattaggcagctttctcagtccctcctcccggccatagtggaactggccgaggacgccaaatggcgagtacggctcgccatcatagaatatatgccacttctggcgggccagcttggcgttgagttcttcgatgagaagctaaacagtctgtgcatggcatggctcgtggatcacgtgtacgcgattagagaggctgcaacgaacaacctgatgaaactggtgcagaagttcggtactgagtgggcacagaacactatagtgcccaaggtcctagtaatggccaacgatccaaactacctacatagaatgactacactcttctgcataaatgcactgagcgaagcgtgtggccaagaaatcactacgaaacagatgttacctatcgtactgaaaatggctggggaccaagtggccaatgtccgtttcaacgtggctaaatccctgcaaaaaataggtcccatccttgacactaatgccctgcagggcgaggtgaagcccgtcctgcagaaattgggccaggacgaagacatggacgtaaaatacttcgcacaagaggccatcagtgtgcttgctctggcatag

SEQ ID NO: 25840 - DNA, 1770 bp, Artificial Sequence
  Description of Artificial Sequence: Synthetic coding sequence
atggccgccgccgacggcgacgacagcctgtaccccatcgccgtgctgatcgacgaactccggaatgaggacgttcaactgagactgaattcgatcaaaaaattatccacgatcgctctggcgctcggggtggagcgcacccggtccgaacttctgccgtttttgacggacaccatttatgatgaggacgaggtgctcctagccctggccgaacagctcggtacattcactaccctcgtgggtgggccggaatatgtccactgtctgttgcctcctctggaaagcctcgccaccgtagaggagacagttgtgcgggataaggctgttgaatcgttaagggctattagtcacgagcacagtcccagtgatttagaggcccatttcgtcccactggtgaagcggctggccggcggagattggttcacgtccagaactagtgcgtgcggcctattttccgtatgctacccacgcgtctcttccgcggtaaaagcagagctgcgccaatatttcagaaacctgtgctccgacgatactcccatggtgagaagggccgccgcctccaagctgggagagttcgccaaagtgctggaactcgacaatgttaaaagcgaaattatccccatgttctcgaacctggccagcgatgagcaggactctgtgaggctgcttgctgtggaagcctgcgtgaatatcgctcagctactgccccaggaggatctggaggccttagtgatgcccactctacgacaggccgccgaagacaaatcctggcgcgtgcggtacatggtcgctgacaagtttaccgagctgcagaaggccgtcggacctgagatcactaaaacagacctcgtaccggctttccagaaccttatgaaggattgtgaggctgaagtgagggccgctgccagccacaaagtcaaagaattctgcgaaaatttatctgcggactgtagagagaacgttatcatgtcgcagatcctgccctgtatcaaagaattagttagcgatgccaaccagcatgtgaaaagtgctctcgctagtgtcattatgggacttagtccaattctcggtaaagacaacacaatcgagcacctgctgccactcttccttgcccaactgaaggatgaatgccccgaggttcgtctcaatattatctctaacctcgattgcgtaaatgaggttattgggataaggcagctatctcagagtctattaccagcgatcgtggagttggcggaggacgcaaagtggagagtccggttagccatcattgaatatatgcctctcttggctggccaactgggtgttgagtttttcgatgaaaagctgaattcgttgtgcatggcttggttggtagaccacgtttacgcaatcagagaggccgccacaagcaacctcaaaaagttggtagagaaattcggaaaggagtgggcccacgctacgatcataccaaaagtgttggccatgtccggcgacccaaactacctgcaccgaatgacgaccctcttctgtattaatgtactatccgaagtgtgtggacaggacatcacaactaagcatatgttgcccaccgtcctgagaatggcgggcgaccccgtagccaatgtgagattcaacgtcgccaagagtctgcagaaaatcggccccatcttggataattctactctccagtccgaggtgaagccgatactggagaagctgacgcaggatcaagacgtggacgtgaagtacttcgcgcaggaggccctgactgtgctgtcactcgcttag

SEQ ID NO: 25841 - DNA, 1740 bp, Artificial Sequence
  Description of Artificial Sequence: Synthetic coding sequence
atggccgccgccgacggcgacgacagcctgtaccccatcgccgtgctgattgatgagctgcgtaacgaggatgtgcagctgagactgaattcaattaaaaagctgtcaactatcgcactggcactgggagtcgagcggactcgttccgagctgctgccattcttaaccgataccatctatgacgaagacgaagttctgctggccttagctgaacaactgggcacctttacgaccttggtgggcggtcctgaatatgtccactgcctcctgccgcctctggagagcctagccaccgtggaatctctccgcgccataagccacgagcattctccaagcgacttggaagcacacttcgtgcccctcgtgaagcgactggctgggggcgactggttcacatctcggacatctgcttgtggcctcttctctgtgtgctacccacgcgtgagctcagcagtcaaagcagaattgcgccagtactttcggaatctgtgctccgatgacacgccaatggtaaggcgagccgccgcaagtaaactcggggaatttgcaaaagtgttggagctggataatgtgaaaagcgagattatccccatgtttagcaacttagcaagcgacgagcaagactccgttagactgctcgctgttgaggcatgcgtgaatatcgcccaactgctcccccaggaagacctcgaggctctggtgatgcccaccctgaggcaggctgcggaggataagagttggcgagtaagatacatggttgctgacaagttcaccgagttgcagaaagcagtcggacctgagattactaagactgatttagttccagccttccaaaacctgatgaaggactgtgaagccgaggtgcgggcagctgcgtctcataaggtgaaagagttctgcgaaaatctgtccgctgactgccgggagaatgtgataatgagtcaaatcttgccctgcataaaagagctagtctcagacgcgaaccagcatgttaagagcgctctcgctagcgtcattatgggcctgagccccatacttgggaaggataatactattgaacacttgctgccgctgtttctggcccagctgaaagacgaatgccctgaggttagactcaacattatcagcaatctggattgtgtgaatgaggtcattggtattaggcagttgagccagagtctgctgcctgcaattgtcgagctcgccgaggacgctaagtggagggtccgactggccattattgaatacatgcccctgttggctggccagctgggcgtggagtttttcgatgaaaaattaaacagcctgtgcatggcctggctggtggaccacgtttacgccatcagggaggcagctacttcgaacctgaagaaactcgttgagaaattcggaaaggaatgggcacacgcgactatcataccaaaagttctggccatgagcggcgacccgaattacctccacagaatgactaccctattttgtatcaacgtgttgagcgaagtgtgcggacaggatattaccaccaagcacatgctgcctactgtgctgagaatggccggcgatcctgtggccaacgtgcggttcaacgttgctaaatctttgcagaagatcggcccaattctggataacagcactctgcagagtgaggtgaagcccattctcgaaaagcttacccaggatcaagatgtggacgtgaaatattttgctcaggaagccttgacggtcctttccctggcctag

SEQ ID NO: 25842 - DNA, 471 bp, Artificial Sequence
  Description of Artificial Sequence: Synthetic coding sequence
atggccgccgccgacggcgacgacagcctgtaccccatcgccgtgcttatcgatgagctgcgaaatgaagacgtgcagcttagattaaatagcaatctcaagaagctcgttgaaaagtttggaaaggagtgggcccacgcgaccattattcctaaagtgcttgccatgagcggcgatcccaattacctgcaccggatgacgaccctgttttgtatcaacgtactgtcagaagtgtgcggacaagatattaccacgaagcacatgctgcctacagttcttcggatggccggggatccagtggcaaatgttcgattcaatgtggccaaaagcttgcagaagataggtcctatcctggataattccacactacaatcagaggtaaagccaattttggaaaaactcacacaggatcaagacgtggatgtgaagtatttcgcacaggaagcactaacagtgctgtctctggcttag

SEQ ID NO: 25843 - DNA, 1605 bp, Artificial Sequence
  Description of Artificial Sequence: Synthetic coding sequence
atgcggaccttcagcttcgccagcaccgccagccggagctgccccccaagtccctggccccttggcctcaagggaccggaggtttcgttctgtctctcgctccagccccctctggaatctttagctactgtggaagaaactgtggttcgggataaggccgtcgagtccctgcgagccatctcacatgagcatagccctagcgatctggaggcgcacttcgtgcccctggtcaagagattggccggcggagactggtttacctcaaggacaagcgcttgcggcctcttcagtgtctgttacccacgggtgtcatcagctgtgaaggcagaactgcgccagtattttcgaaacctgtgctctgacgatacgcctatggtcagacgcgcagcagcctctaaactcggcgagtttgcaaaggtgctcgagctcgacaatgtgaaatccgagataatacctatgttcagcaaccttgcaagtgatgaacaggacagtgtccgattattggcagtggaggcctgtgtgaatatcgcccagctgctcccacaggaagacctagaggctctggtgatgccaaccctgcggcaagcagcggaggacaagtcctggagggttcggtatatggtggccgacaagttcacagaactgcagaaagccgtcggaccggagatcactaagaccgatcttgtgccagcgttccagaacctcatgaaagattgcgaggctgaggtccgcgctgccgcctcccacaaggtgaaggagttctgcgaaaacctcagtgctgattgtcgggagaacgtgataatgtctcagattctgccttgtatcaaggaactggtgtcagacgccaaccagcatgtgaagagtgcattggcttctgtgatcatgggtctcagcccaatcttgggaaaggacaacactattgaacatttactgccgctgtttctcgcccaactgaaggacgaatgcccagaggtacgcctgaatataataagtaacctcgattgtgtcaatgaggtgatcgggatccggcagttgtcacaatctctgttgcctgctatcgttgagctagcggaagatgcaaaatggcgtgtcagattagccatcatcgaatacatgcctctgctcgccggacaactgggggtggagtttttcgacgaaaaattaaattccctctgtatggcgtggctagtagaccacgtatacgcaattagagaggccgctacatctaatctgaaaaagctggttgagaagtttggtaaggagtgggcccacgctactattatcccaaaagtgctggcaatgagcggcgacccaaactaccttcatcgcatgaccacattattctgtatcaacgtcctctccgaggtgtgtggtcaggacatcacaaccaagcacatgcttcctaccgtgctgagaatggcaggagatccagtcgccaacgtgagattcaatgtggcaaaatcactgcagaaaattggacccatattggataattcaacacttcagtcagaagttaaacctattttggaaaagctaactcaggaccaggatgtcgacgtgaagtattttgcacaggaggctttgacagtcttgtcgcttgcctag

SEQ ID NO: 25844 - DNA, 2004 bp, Artificial Sequence
  Description of Artificial Sequence: Synthetic coding sequence
atggccggcgccagcgagctgggcaccggccccggcgccgccggcggcgatggggatgactctctctatcccatagcagtgttgatagacgaattacgcaatgaggacgtacagctcaggctgaattctattaagaaattgagcacaattgcactggcgttgggcgtcgagcgcacccgatcggagttactgccctttttgactgatactatctacgacgaagatgaggtactattggcactcgctgagcagctgggtaactttaccggactcgtgggggggccggatttcgcccactgcctactgcctcccctggagaacctggctaccgtcgaagagaccgtggttagggacaaggcggttgaaagcctgcgccaaatcagtcaagaacacacccctgtcgcgctcgaggcctattttgtgcccctcgtgaaacgcttggcttcaggagactggtttacaagcaggaccagcgcctgcggcctgttctccgtatgctacccacgcgcaagcaacgccgtaaaggctgagattcgccagcagtttcgcagtctgtgcagtgatgacaccccaatggtgcgcagggctgcggcttctaaactgggagagtttgcgaaggttctcgagctcgactcagtgaagagcgaaattgttccgctattcacctcgctggcctctgatgaacaggatagtgtgagattacttgctgtcgaagcatgcgtcagcatcgcccagcttctgagtcaggatgacctggagaccctcgtgatgccaaccttgagacaggcagccgaggataagagttggcgggtgcggtacatggttgccgaccgtttctcagagctgcagaaagctatggggccgaagatcacactgaatgatttaatcccggcttttcagaacctgcttaaggattgtgaggctgaggtaagagcggcggccgctcacaaagtgaaagaattgggtgagaatcttcctatagaggaccgggagacaattatcatgaatcagattcttccatatatcaaggagctggtgtctgataccaaccagcatgtcaagtcagccctggccagcgtaattatgggattatctaccatcctggggaaggagaataccatcgagcacctcctgcccctgttcctcgcacagctgaaggatgaatgccccgatgtgagactgaacattattagcaatctagattgcgttaacgaggtaatagggattcggcaattatctcagtcgttactgccagccatcgtagagctcgccgaggacgctaaatggcgagtccggctcgctatcatcgaatatatgccgctgctcgctggtcagctgggagttgaattcttcgacgagaagttgaatagcctctgcatggcatggttggtcgatcatgtctatgctataagggaagccgctaccaacaacctcatgaagctggtacaaaaattcggaacagaatgggctcagaatactatcgttccaaaagttctggtcatggcgaatgacccaaactacctgcatcgcatgacgacactcttctgtatcaacgccttatcggaggcatgtggtcaggaaatcactactaagcagatgctgccaatcgtactcaaaatggccggagaccaagtcgccaacgtgcgcttcaacgtagcgaaaagtctccaaaagatcggccccatcctcgacactaacgccctgcagggagaggtgaagccagtgcttcaaaaactcggccaagacgaggatatggatgtcaaatactttgcccaagaggccattagcgtggtcgcacaacgccttcgtaaattggaatttcctgtgaaagactccggcgaacctagcgtcccccgagccgacaagaatcacttccctcgaccgacagtgcctggcgaggatatgggcaagggacctgtttatcaactgaggggcgatacccgggacaccctggcccagcttgggattgcagagttggtccacttctcacagtctaccgactag

SEQ ID NO: 25845 - DNA, 1425 bp, Artificial Sequence
  Description of Artificial Sequence: Synthetic coding sequence
atggccggcgccagcgagctgggcaccggccccggcgccgccggcggagatggtgacgattcgttgtatccaatcgccgtcttaattgacgagttacgaaatgaggacgttcaactgagattgaattccatcaagaagctcagcacaattgcactggcactgggagtcgaacgaacccgctccgagctcctgcccttcctgaccgatactatctatgatgaagacgaagtcctgctggccctcgccgaacagcttggaaacttcacgggactcgtgggcggtcccgattttgcgcattgcctgcttgacagcgtacgattactggcggtggaggcttgcgtgtccatcgctcagctgcttagtcaggatgacctagagactttggtgatgcccactttgaggcaagctgctgaggacaagtcctggcgagtgagatacatggtggccgaccgattttcagagttgcagaaagccatgggacccaagataacccttaacgatcttattccggcctttcagaatttgttgaaggactgtgaggcagaggtacgggctgctgctgcccataaggttaaggaattgggggaaaatcttcctattgaagaccgagagactatcataatgaatcaaatattgccttacatcaaagagctcgtgtccgatactaaccaacacgttaagtctgcccttgcctccgtcattatgggactgagcacgattctcgggaaagaaaacacaatagagcacctcctgcccctgtttctggcacaactaaaggatgaatgtccggatgttcgcctcaatatcatcagtaacttggactgtgtcaatgaggtgattggtatccggcagctgtcccagtctcttctcccagcaatagtagagttagcagaagacgctaagtggcgggttagactggcaattattgagtatatgcccctcctggctggacagctgggagtcgagttctttgacgagaaacttaacagcctttgcatggcttggttggtagaccatgtttacgctattagagaggctgccacgaataacttgatgaaactcgtgcagaagttcgggaccgagtgggcccagaataccatcgtgccgaaggtgctcgtgatggccaatgaccctaactatttgcatcgaatgactacgctgttttgcataaacgccctgtccgaggcgtgtggacaggagattaccaccaagcagatgctgcctatagtgctcaagatggctggcgaccaggtggctaatgtgaggtttaacgttgcaaaaagccttcagaagatcggccccatcctggatacaaacgctctccaaggggaggttaaacctgtgctacagaagctggggcaagatgaggacatggacgttaaatactttgcacaggaggccataagtgttctggcccttgcttag

SEQ ID NO: 25846 - DNA, 1365 bp, Artificial Sequence
  Description of Artificial Sequence: Synthetic coding sequence
atggccggcgccagcgagctgggcaccggccccggcgccgccggcggtgacggcgacgacagcctgtaccccattgctgtcctgattgacgagctaaggaacgaggacgtccagcttcgcctcaattcaatcaagaaattaagtacaattgctctggcgctcggagtggaacggaccaggagtgaactgctgcctttcttaactgatacaatctacgatgaagacgaggtgttattggcgctcgccgagcagctggggaactttaccggcctggtgggcgggccagactttgcccattgtctgctggattcagtccggctactagctgtcgaggcctgcgttagcatagcacagctgctcagccaagatgatctggagacgttagtgatgccgacgctcaggcaggccgccgaggataagtcttggagggttagatacatggtggcggataggttttccgagctccagaaagcgatgggaccaaaaattactctgaatgacttgatccccgccttccagaacctgctgaaggactgtgaagcggaagtgcgggcggctgcagcccacaaggttaaggagcttggcgagaacctgcccatcgaggacagggaaacaattattatgaaccaaatcttaccttacatcaaggaactggttagcgacaccaaccagcacgtcaaatcagcccttgcctctgtgataatgggattatccacgatactggggaaagagaatacgatcgaacacctgctccccctgttcctagctcagctcaaggatgagtgtcctgacgtcaggctaaatatcataagtaaccttgactgtgtgaacgaagtcattggcattcgacagttgagtcagagcctcctccctgccattgtcgaactggccgaggatgcaaaatggcgggttcgcctagccataattgagtatatgccacttctagccggccagttgggggtggaatttttcgacgagaagctgaactccctctgcatggcctggttggtggatcatgtatacgctatccgcgaggctgcgaccaacaacctcatgaagcttgtccagaaatttgggactgagtgggcgcagaatactattgttccaaaagtcctcgtgatggctaatgacccaaactatctccaccgaatgactaccctgttttgcattaacgctctctctgaagcatgtggccaggaaatcacaacgaaacagatgttaccaatagtgaagaacggacgtcgcccaagctctaagtgttctctgcagtgtgggcaaattagcaccaaagattggactaactcccgctatcaatgcttcaccggaaggagcgaagcatccacgacagaggtgcggtctcgttag

SEQ ID NO: 25847 - DNA, 1812 bp, Artificial Sequence
  Description of Artificial Sequence: Synthetic coding sequence
atggccggcgccagcgagctgggcaccggccccggcgccgccggcggcgacggagacgatagcctgtacccaattgccgttcttatcgacgaactgcgaaacgaagatgtacagcccccgctggagaaccttgccactgtagaggagacagttgtcagggacaaggccgtggaatcacttcggcagatctcacaggagcacacgccggtcgccctggaggcctacttcgtgccacttgtgaaacgcttagcatccggcgactggttcacatctcggacatctgcgtgcggattattttcagtatgttatcccagagcttctaatgctgttaaagcagagatccgccagcagtttcgcagcctatgttcagatgataccccaatggtgcgtagagccgctgcctccaaactgggcgagtttgctaaggtgctcgaactggacagcgttaaatcagagatcgtaccgctgttcacatctcttgcttccgatgaacaggactcagtcaggctactcgccgtcgaagcttgtgtttctattgcccagttactgagccaggacgatctggagactctagtgatgcccactttgcgacaggccgccgaggacaaaagttggcgagtgcgctacatggtcgcggacagattttcagagttacagaaggctatgggcccaaaaattaccctcaatgacctcattcccgcctttcagaatctactcaaggattgcgaagcggaggtgcgggccgccgccgcgcacaaggtgaaggagctgggtgagaacctgcccattgaagatagggagacgatcatcatgaaccaaatcctcccctatatcaaagaactggtcagcgacaccaaccagcatgtcaagtcagcacttgcatctgtcattatgggactctctacaatactgggtaaggagaatacaattgagcacctgttgccactgtttttagcacaactcaaggacgagtgccctgacgtgcggttaaacatcatatccaacctcgattgtgtaaatgaggtaattggcattcgccagctaagccagtccctcctgcccgctatcgtcgagctcgcagaggatgcaaaatggcgggtacgtcttgccatcatcgaatatatgccccttcttgcaggtcaactcggcgtcgaatttttcgacgagaaactgaattctctatgcatggcctggctggtggatcacgtctacgcaattcgggaggctgccacaaataaccttatgaaattggtccaaaagttcggaactgaatgggcccagaatacgatcgtgcctaaggtgttggtgatggcaaacgaccccaactatctgcaccggatgaccaccctgttctgtattaacgctctcagcgaggcttgcggccaggaaatcaccaccaagcagatgttgcctatcgtgctcaaaatggccggagatcaggtggcaaacgtgcggtttaatgtggccaagagtttgcaaaaaatcggccctattctggacacaaatgccctgcaaggcgaggtgaagcctgtgttgcaaaaactgggacaagatgaggatatggatgtgaagtactttgcccaggaggctatttcggtagtcgctcagcgtctgcgcaagctggaatttcctgtgaaagattccggggaaccgagcgttccccgagccgacaagaaccatttcccgcgccctaccgttccgggggaggacatgggaaaaggtccggtttatcagctccgcggcgacacaagggacacactcgctcagcttgggattgccgaactagtgcactttagccagtctacggattag

SEQ ID NO: 25848 - DNA, 1323 bp, Artificial Sequence
  Description of Artificial Sequence: Synthetic coding sequence
atgatgcagctgaccttctggctgcgggtgcccccccccttcagccactttaagcgccagtttaggagtctatgtagcgacgacaccccaatggtgagacgggccgcggcctcaaagttaggggaatttgccaaagtgctggagttagactccgtgaagagcgaaatcgtgccgctctttacttccctggccagcgacgagcaggattctgtgagactcctagccgtcgaagcttgtgtctctatcgctcagctgctctcccaggacgatctcgagaccctcgtcatgccaacactgcgtcaagcggccgaggataagagctggcgtgtgagatatatggtggccgacaggttctccgagctccagaaagctatgggcccaaagataaccttgaatgatctgatccctgcattccagaacctgctgaaagactgtgaggccgaggtccgggccgctgcagcgcacaaagttaaagagctgggcgagaaccttccaattgaggatcgggagacaattatcatgaaccagattttgccgtacatcaaagaacttgtgtccgataccaaccaacacgttaaaagcgcccttgcatctgtaattatgggcctgagcacaatactgggcaaggaaaatactatagaacacctgcttccactttttctggcccagctaaaggacgagtgtcctgatgtcagactgaatataataagtaacttggactgcgtcaacgaggtcatcggaattaggcaactcagtcagagccttctcccagctatcgtcgagctcgccgaggatgctaaatggagagtgcgactggccatcattgagtacatgcctttactggccggccagttaggtgttgagtttttcgacgaaaaattgaactccctgtgtatggcttggctggtcgaccacgtgtatgccatcagggaggcggctaccaataatctcatgaagctggtgcagaagttcgggaccgaatgggcccagaatactatcgtacctaaagtgcttgtcatggcaaacgatcccaattatctgcatcggatgaccacactgttctgcatcaacgctctgagtgaggcatgtggacaagagattaccacaaagcagatgttaccaatcgtgcttaagatggccggagatcaagtcgcaaatgtgcgcttcaacgtggccaagtcacttcagaaaatcggcccaatcctggatacaaacgcactccaaggtgaggtgaagcccgtgctgcaaaagctgggacaagatgaggacatggatgtaaagtatttcgcacaggaggccatatctgtcctcgcactggcctag

SEQ ID NO: 25849 - DNA, 1806 bp, Artificial Sequence
  Description of Artificial Sequence: Synthetic coding sequence
atggccggcgccagcgagctgggcaccggccccggcgccgccggcggcgacggtgacgacagcctctatcctattgccgtgcttatcgatgaactacgcaacgaagatgtacagctgaggcttaattccattaagaagctgagtaccatcgcccttgccttgggggtcgagagaacaagatccgagctcttacccttccttaccgatacaatctatgatgaggacgaggtcctcttggccctggccgaacagttgggaaatttcacaggcctggttgggggcccagacttcgcgcactgtctgctccctcccttagaaaatctggcaacggttgaagaaaccgtggttagggacaaagctgtggaaagcctgagacagatttcccaggagcatacccctgtcgcattagaggcatactttgtgccactggttaagaggcttgcatccggagactggttcacatcccgtacttctgcatgcggcctcttctcagtatgctacccacgggcttccaacgccgttaaagcagagattcggcagcagttccgctcactgtgtagcgatgacacacctatggtgcgtcgtgcagcagccagcaaactaggagagttcgctaaagtactggagctcgattccgtcaagtctgagatagtgcctctgtttacgtcactggcatctgacgaacaggactcggtgcggctgcttgccgtcgaagcttgtgtttcaatcgcacagctgctctcccaggacgacctggagacattggtgatgccgacgctgaggcaagctgccgaggacaagtcctggcgagtgcgatatatggtggccgaccgtttttctgaattgcagaaggcaatgggtcctaaaattactctgaatgatcttatcccagcattccagaacctgctcaaagattgcgaggctgaagtccgggccgcggcagcccataaggtaaaagagctcggggaaaatctgccaatcgaggacagggaaaccatcatcatgaatcagattctgccctacatcaaagagctggtgtctgacaccaatcagcatgtgaaatctgcccttgccagcgttatcatgggcctaagtaccatcctcggcaaggaaaatacgattgagcacctgctcccactattcctcgcccagctgaaggatgagtgtcccgacgtccggctcaatatcattagtaatttggactgtgtgaacgaggtgattggcatcaggcagctcagccagtcacttcttcctgccatcgtggaattggcagaggacgcaaaatggcgggtgaggctggccatcattgaatacatgcctttactcgccgggcagttgggggtggagttcttcgacgagaaactgaatagcctgtgcatggcatggttagttgaccatgtgtatgccataagagaagcagctacgaacaatctgatgaaactggtccagaagtttgggaccgagtgggctcagaacactatcgtgcccaaggtccttgtcatggccaacgacccaaactacctgcaccgaatgactaccctcttttgcatcaatgctctgagcgaggcctgtggccaggagatcaccaccaaacagatgctgcctatagtcctgaagatggccggggaccaggtagcgaacgttcggttcaatgtggctaagtctcttcagaaaattggtcctatcttagatacaaacgcattgcagggggaggtgaaacccgtgctgcagaaactgggacaggatgaagacatggacgtaaagtactttgctcaggaggcgatcagtgtgctggccttagcgtag

SEQ ID NO: 25850 - DNA, 1566 bp, Artificial Sequence
  Description of Artificial Sequence: Synthetic coding sequence
atgagcggccggcggttccacctgagcaccaccgaccgggtgatcaaggccgttcctttcccccccacacaacggctcaccttcaaggaagttttcgaaaacgggaagcctaaggtcgacgtgctgaaaaaccatctcgtgaaagagggaagattggaggaagaagtcgccttgaaaatcataaatgacggggcagcaatcctgcgccaggagaaaaccatgatcgaggtggatgcccccatcacagtatgtggcgacatccatggtcagtttttcgacctgatgaagctgtttgaggtcggggggtccccttctaacacccggtatctgttcctcggcgattacgtggatagagggtacttctcaatcgagtgtgttttgtacttgtggtctctaaagatcaaccatcctaaaactcttttcctgctgagaggtaatcacgagtgcagacatttaaccgattacttcaccttcaagcaagagtgccggatcaagtactctgaacaggtctatgacgcatgcatggagacattcgattgcttgccccttgcagcccttttaaatcagcagtttctatgcgttcatggagggatgtctcctgaaatcacctctctggacgatatcagaaagctcgacaggttcacggagccccccgcctttggtccggtgtgtgaccttctgtggagtgacccctccgaggattacggtaatgagaaaacactggaacactacactcataacacagtgagggggtgcagttacttctatagttatcctgctgtgtgtgagtttttgcagaacaataatctgctgagtatcatcagagcacacgaagctcaggacgccggctatcgaatgtaccggaagagtcaagccacagggttcccctctctcattacaattttctccgccccaaattatctggacgtctacaataataaggcagcagttcttaagtatgagaacaacgtgatgaatatccggcagttcaattgctcgcctcatccatattggcttcctaactttatggacgtctttacctggagcctgccctttgtgggagagaaggttactgaaatgttggtgaacgtcctgaacatttgtagcgatgatgaactgatctcagacgacgaagccgaggatcattacatcccctcataccagaaaggctccaccaccgtgcgcaaggaaatcattcggaacaaaattcgcgcaataggcaagatggctcgcgttttctcgattttgcgacaggaatcggagagcgtgctcaccctcaaaggcctcacccccactggaacactgcctctgggggtgctgagcggcgggaaacagacaattgagaccgccactgtggaggcagtggaggcccgcgaagcgatccgaggcttcagcctgcaacacaagatccgcagctttgaggaggctaggggtctggaccggatcaatgaaaggatgcctcctcggaaagactctatacatgctggtggccccatgaagtcagtcaccagcgctcacagccacgctgcccaccgtagcgaccagggcaagaaggctcactcctag

SEQ ID NO: 25851 - DNA, 1410 bp, Artificial Sequence
  Description of Artificial Sequence: Synthetic coding sequence
atgagcgagcccaaggccatcgaccccaagctgagcaccaccgacagagttgtgaaagctgtaccatttcccccatcacaccgcctcactgctaaggaagtgtttgataatgatggaaaaccccgagttgacattcttaaagcacacttaatgaaggagggtcgcctcgaggaatctgtagcgctgaggatcatcacagagggagcgtcaatcctgcggcaggaaaaaaatctgctcgacatagatgctccggtcacagtatgtggtgatattcacggacaattttttgacctgatgaagctgttcgaagtcggtggtagccctgctaacactagatatctgtttctgggtgattatgtggacagggggtacttttcgattgaatgcgtgctgtacctttgggccctgaaaatcctttatccgaaaactctctttctcctgagaggtaatcatgagtgtcgtcatctgaccgaatatttcactttcaagcaagagtgcaagataaaatattctgaacgcgtctacgacgcgtgcatggatgccttcgactgcctgccactggcggcgctcatgaatcagcaattcctctgcgtgcacggtggtctgtcaccagaaatcaatactctggacgatattcggaaactggaccgctttaaggagccaccagcatacggccccatgtgcgatatattgtggtcggacccactcgaggactttggcaacgagaaaactcaagaacacttcacacataatactgtacgaggctgcagctacttctactcgtatccagccgtctgtgaatttctgcagcacaacaacctcctgtctattttgcgcgctcacgaagcccaagatgccggttaccgcatgtatcggaagagccagaccacgggattcccaagtttgataacgattttttccgcacccaattatctggacgtctataataacaaagtgactgaaatgctggttaacgttttaaacatttgttcggacgacgagctcggtagcgaggaagatggctttgatggagctactgctgcggccaggaaggaggtcatcagaaataagatccgggcaatcggcaagatggccagagtgttctcagtgctgagggaagaatcagagagcgtactgaccctgaagggcctaacgcctaccggcatgcttccgagcggggtgctgtctgggggcaaacagacactgcaatccgccattaaggggttctcacctcagcataaaattaccagctttgaagaggctaaaggcctagaccggattaacgagcgtatgcctccccgacgagatgccatgccttctgacgccaatcttaattctattaacaaggctctgaccagcgagacaaacggaactgactctaatgggtccaactctagcaatattcagtag

SEQ ID NO: 25852 - DNA, 1536 bp, Artificial Sequence
  Description of Artificial Sequence: Synthetic coding sequence
atgagcgagcccaaggccatcgaccccaagctgagcaccaccgacagggtggtcaaagctgtgcccttccccccgtctcatagacttacggccaaggaagtattcgataatgacggaaaacctagagtagatattctcaaggcacatttgatgaaggagggcagattggaggagtccgtcgccctgcgtattattacagagggagccagcattctcagacaggaaaagaatctcctagacatcgatgcccccgtgactgtctgcggggatattcatgggcagtttttcgacctcatgaaacttttcgaggtcggtggcagtccagcaaatactcgctacctattcctgggggattacgtggacagaggttatttctctatcgagtgcgtgctgtatctctgggccctcaagatcttgtaccctaagaccctcttcctgctgagaggcaaccatgagtgcaggcacctcaccgaatatttcacctttaagcaggagtgtaaaatcaagtactccgaaagagtgtacgacgcttgtatggacgccttcgactgcctgcccttagctgctctgatgaatcagcagttcctgtgtgttcacgggggactgtctcccgagatcaacacgctagatgacatccgcaagctggaccgcttcaaagagccacccgcctatggccctatgtgcgatatcctgtggtcagaccctctggaggacttcggaaatgaaaagacacaagaacacttcacacacaatactgttagagggtgctcttacttttactcctacccggctgtatgcgagtttctgcagcataataacttactatccattctgcgcgcccatgaggcccaagatgcagggtaccgtatgtatcggaagtcgcagaccacaggattcccaagcctgatcacaattttttccgccccaaattatctggatgtctataacaacaaggccgcagtactcaagtacgaaaacaacgtgatgaacatccgccaattcaattgttctccgcatccatactggctgcctaatttcatggatgtgtttacttggagcctccctttcgtgggagaaaaggtgaccgaaatgctggtcaatgtgctgaatatatgctcagacgacgagcttgggagcgaggaggacggtttcgacggagccaccgccgctgcccgcaaagaggtgataaggaataaaatacgtgccataggaaagatggccagggtgtttagcgtgctgcgggaggaatccgaaagtgtccttacgctgaaggggctaacccccacaggcatgctgccctccggggtcctcagtggaggcaaacagacactgcagtctgccataaagggattctcaccccaacataagatcacatctttcgaagaagctaaaggactagaccgcattaatgaacgcatgccgccaaggagggacgctatgccaagcgacgcgaatttaaacagcatcaacaaggctctcacaagtgagaccaacgggacagactccaacggcagcaatagctcgaacatccagtag

SEQ ID NO: 25853 - DNA, 1566 bp, Artificial Sequence
  Description of Artificial Sequence: Synthetic coding sequence
atgagcgagcccaaggccatcgaccccaagctgagcaccaccgaccgggtcgtgaaggcggtgccgtttccacccagtcatcgcctgacggccaaagaagtgttcgacaacgacggaaaacccagggtcgatatacttaaggcacacctgatgaaagaaggacgactagaggagtcagtcgcactgaggattattaccgagggcgcatccatcctacgacaggaaaagaacttactggatatcgacgctccagttactgtgtgtggagacatccatgggcagttcttcgacctcatgaaactgtttgaggtaggcggcagtcccgctaacacacggtacctctttctgggcgattacgtggaccgtggatacttctctatcgagtgtgtcctgtatctctgggcactcaagatactgtatcccaaaacgctgtttttgcttaggggcaaccacgagtgcagacatctgacagagtacttcacctttaaacaggagtgcaagatcaagtattccgaaagggtctacgacgcttgtatggacgcttttgactgtctgcccttggcagctctcatgaatcagcagtttctttgcgtccacggaggcctcagtcccgaaatcaatactctcgacgacattcgaaagctagaccgattcaaagagcccccggcctatggccctatgtgtgatatcctatggtccgacccactggaagactttgggaacgagaaaacacaggaacacttcacccacaacaccgtgagggggtgttcttacttctattcctatcccgccgtatgtgagttcctgcagcataataacctgctgtccatcctgcgcgctcatgaggctcaggacgccgggtacaggatgtacaggaaaagtcagaccacaggttttccttctctgatcactatcttcagcgctcccaactatttggatgtctataacaataaggccgcagtgcttaagtatgaaaacaacgtcatgaacatacggcagttcaactgttcaccgcacccttactggctgccgaatttcatggatgtttttacctggtccctcccttttgtcggtgaaaaggtgacagagatgttggtgaacgtcctgaatatttgctccgacgatgagttgggttcagaggaggatggcttcgatggagccacggccgctgctcgaaaggaagtgatacgaaacaagatccgggccataggcaaaatggcacgcgttttttcagtcctgagggaggagtcagaatccgtgctgactctgaagggcctgaccccaacagggatgctaccctctggcgtcctgagtggtgggaaacagactctgcagtccgccacagtggaggcaattgaggctgacgaggccattaagggctttagtcctcagcataagatcacatcattcgaagaggcaaaaggcctagatcgaattaacgaaagaatgccgccacgcagggacgccatgcctagcgacgccaatctgaactcgatcaacaaggctttgacatccgaaacaaatggtaccgactctaacggcagcaacagctcaaatattcagtag

SEQ ID NO: 25854 - DNA, 1272 bp, Artificial Sequence
  Description of Artificial Sequence: Synthetic coding sequence
atgaagctgttcgaggtgggcggcagccccgccaacacccggtacttatttctgggtgactacgtagatagggggtactttagtatcgagtgtgttttatacttatgggccctgaaaatattgtatcctaaaaccctctttctcctgcgtgggaatcacgagtgtagacacctgactgagtacttcactttcaagcaagagtgtaaaatcaagtactccgaacgggtttacgacgcctgtatggatgcattcgattgccttccccttgctgctctaatgaatcagcagtttttatgtgttcacggcggattgtctcccgagatcaacacactggacgatattaggaagctggataggtttaaagagcctccagcctatggccccatgtgtgatatcctgtggtccgacccattagaggacttcggcaatgagaagactcaggagcattttacccacaacacagtgaggggctgtagctatttctatagctatccagccgtttgcgagttcctccagcataacaacctgttaagtatcctgcgcgcgcacgaagcacaggatgccgggtatcgtatgtaccggaaatcccagacaaccgggtttccctcactgatcaccatttttagcgcgcccaattacctcgatgtatacaataataaagctgcagtcctgaagtacgagaacaatgtgatgaatattaggcagtttaattgttcaccgcacccctattggctgccgaacttcatggatgtgtttacgtggtctttaccctttgtgggcgagaaggtcacagagatgttggtgaatgtcctgaatatttgcagcgacgacgagctaggcagtgaggaggatgggttcgatggagcaacagcggccgctcggaaagaggtcatccgcaataaaattagggctatcggcaagatggcaagagttttttccgtcctccgagaagagagcgaatccgtactcacattgaaaggtttgaccccgactgggatgctgccctctggggtgctaagcggcggtaagcagactttacagtcagctactgtcgaggccattgaagccgatgaggcgatcaaaggcttttcgccacaacataagattacaagctttgaggaggccaagggcctggatcgcatcaacgaacggatgccacccaggagagatgcaatgccttccgatgctaatctaaacagcatcaacaaagccctgaccagcgagacaaacgggacagattcaaatgggagcaatagctcaaacattcaatag

SEQ ID NO: 25855 - DNA, 870 bp, Artificial Sequence
  Description of Artificial Sequence: Synthetic coding sequence
atgagcgagcccaaggccatcgaccccaagctgagcaccaccgaccgcgttgtgaaggcagttccattccctccgtctcatcggctgaccgcgaaggaggtattcgacaacgatggaaagccaagagtcgacattctgaaggcgcacttgatgaaggaggggcgcctcgaagagtctgtggctctgaggatcattaccgagggcgcctcaattctgaggcaggaaaagaatctgctggatatcgatgctcctgttactgccgctgttctgaagtacgaaaataacgtgatgaacatcaggcagttcaattgttcccctcatccatactggctcccgaatttcatggacgtcttcacgtggtccctgccctttgttggcgagaaagtgactgagatgctggtcaacgtgctcaatatttgttccgacgacgagctgggatccgaggaagatgggttcgatggcgccacagccgccgcacgaaaagaagtgatccgcaataagatccgggccattggcaagatggctcgggtgttcagcgtgctccgggaggagtcagaatccgttctcacactgaagggcttgaccccaacaggtatgctgcctagcggtgtgctatctggaggaaagcaaacgcttcagtcggctactgtggaggctattgaagctgacgaggctatcaaaggattcagcccccagcacaagatcacctccttcgaggaagccaagggattggaccgcatcaacgaaaggatgccacccagaagagacgcaatgccctccgatgcgaaccttaattcaatcaataaggcattgactagcgaaaccaacggaaccgactcaaacggctcgaattcaagcaatattcagtag

SEQ ID NO: 25856 - DNA, 1365 bp, Artificial Sequence
  Description of Artificial Sequence: Synthetic coding sequence
atgagcgagcccaaggccatcgaccccaagctgagcaccaccgacagggtggtcaaggtgtgtggagacattcacggccagtttttcgatctcatgaagttatttgaggtcgggggaagccctgccaatacacgctatttatttctaggggactacgttgaccggggctacttttccatagaatgcgtcttgtatctgtgggccttgaagatcctgtatcctaagaccctattcttactgaggggaaaccacgaatgcagacacctcaccgagtacttcacttttaaacaagaatgcaaaatcaaatattctgagcgggtgtacgatgcatgcatggatgcattcgattgccttcccctcgccgcactcatgaatcagcagttcctctgtgtacacgggggcctgtctcccgaaattaatactctggatgacatccgcaaactggatagattcaaggaaccccccgcctatggaccaatgtgcgacatcctatggtccgatccactggaggacttcggaaatgagaagacccaggaacactttacacataatactgtgagaggatgcagttatttctattcctatccagccgtgtgtgagttcctccaacacaacaatctgctgagcatccttcgggctcatgaggcgcaagacgccggatatcgcatgtatcgtaaaagccagactactgggttccccagtttgatcaccatcttttctgctccaaattacctagacgtctataacaataaagccgccgtgctgaaatatgaaaacaatgtcatgaatattaggcagttcaactgtagtccacatccttattggctaccaaactttatggatgtcttcacctggtcactgcccttcgtgggggaaaaggtgaccgaaatgttagtgaatgtgctcaacatctgttccgatgatgagttagggtcagaggaggatggattcgatggagctacggctgctgctcggaaagaagtcattaggaacaaaatccgcgccatagggaagatggcacgagtattctccgttcttagggaagagtctgaaagtgtcctgaccttgaaaggcctcactcctactgggatgttgccttccggcgtgctcagtgggggtaagcaaacattgcagtctgctacggtcgaagcgattgaagctgacgaagccattaagggtttttccccacagcataaaatcacgtcgttcgaggaggcgaaaggactggatcgcattaatgaaagaatgcccccgaggcgggacgcaatgccatcagatgcaaacctgaactcaatcaacaaggccctgacatcagagactaatgggaccgattcaaatggaagtaacagtagtaacatacaatag

SEQ ID NO: 25857 - DNA, 399 bp, Artificial Sequence
  Description of Artificial Sequence: Synthetic coding sequence
atgaaggagggccggctggaggagagcgtggccctgcggatcatcactgagggagcaagcattttgcgccaggagaagaatttacttgatatcgacgcaccagttaccgtttgcggcgacatacatggacaatttttcgacctgatgaagctctttgaggtgggaggctctccggctaacaccaggtacctatttctgggagattacgtagatcgggggtacttcagtatcgaatgtgtgctttatctctgggctttgaaaatcctgtatcccaagacactttttttgctccgcgggaaccacgagtgccggcatctgacagaatacttcacatttaagcaggagtgcaaaattaaatatagtgaaagggtctatgatgcttgcatggacgcattctag

SEQ ID NO: 25858 - DNA, 444 bp, Artificial Sequence
  Description of Artificial Sequence: Synthetic coding sequence
atgaaggagggccggctggaggagagcgtggccctgcggatcatcactgaaggcgccagcatactaaggcaggagaaaaacctgctggatatcgatgcccccgttactgtgtgcggggatattcacggccagttctttgatttgatgaaactatttgaagtaggcgggtccccagccaacacaaggtacctgtttctcggggattatgtggaccggggttacttttcgatagagtgtgtcctctacctgtgggccttaaaaattctttatcccaaaactctttttctcctgcgtggtaaccatgaatgccgtcacttaaccgagtatttcacttttaagcaagagtgtaagataaaatatagcgaaagggtgtacgacgcatgcatggacgccttcgattgtttgcctctcgccgcactcatgaaccagcaattcctatgctag

SEQ ID NO: 25859 - DNA, 1491 bp, Artificial Sequence
  Description of Artificial Sequence: Synthetic coding sequence
atggccgcccccgagcccgcccgggccgccccccccccccccccccctcctcccccacctcctggagccgatcgcgttgtgaaggcagttccattcccgccaacccatagactaacgtcagaggaggtattcgatctcgacgggatcccccgagtggacgtactgaaaaaccacctggtcaaggagggcagagtcgacgaggagattgccctcagaatcatcaatgagggagctgcaattctgcgacgggaaaaaaccatgatcgaggttgaagcacccataacagtatgtggggatattcacgggcaattctttgacctgatgaagctcttcgaggtcggtggcagccctgctaatactcgctacttatttcttggcgactatgtcgatcgtgggtacttctctattgaatgcgtgttgtatctctgggtgctgaagatcctatacccctcgaccctttttctcctgcgtgggaaccacgaatgtcgacacctaacagagtatttcacctttaagcaggaatgtaaaatcaagtactctgaacgagtatatgaagcttgcatggaggcatttgacagccttcccttagcagccctattgaaccagcagtttctatgtgtccacggaggattgtcaccagaaattcacactttagacgatatccgcaggctcgataggttcaaggaaccacctgcttttggtcctatgtgcgacctcctgtggtccgatcctagtgaggattttggcaacgaaaagtctcaagaacacttctctcacaatacagtccgaggatgctcctacttctacaactatcctgccgtgtgtgaatttcttcagaataacaatctgctgagtatcatacgggcgcatgaggcgcaggacgccgggtacagaatgtaccgtaagtctcagaccaccgggttcccctctctgattaccatttttagcgctccaaattacctggatgtatataataacaaggccgcggtcctgaagtacgaaaacaacgtgatgaatattcggcagtttaactgtagccctcacccgtactggttacctaactttatggatgtgtttacctggtctctcccctttgtgggcgaaaaggtgacggagatgctggttaatgtactctccatatgttccgatgacgaattaatgacggaaggcgaggatcagtttgacgggagcgccgccgcccgtaaagagatcatccgaaacaaaataagagcaataggtaaaatggctcgcgtgttcagtgtgctcagagaggaaagtgaaagcgtgcttactctcaagggcttaaccccaaccggcatgctgccgtccggcgtgctggccggaggacgccagacacttcagtcaggcaacgacgtaatgcagttggctgtgccccagatggactggggaactcctcactcattcgctaataattcccataacgcttgcagagagttcctcctttttttcagctcctgtctgtcctcatag

SEQ ID NO: 25860 - DNA, 1575 bp, Artificial Sequence
  Description of Artificial Sequence: Synthetic coding sequence
atggccgcccccgagcccgcccgggccgcccccccccccccccccccacctcctcccccacccggcgcagaccgagtggtgaaggccgtcccatttccccccacccataggctcacctcagaggaagttttcgacttagacggcattcctagagtcgacgttctgaagaaccacctcgtcaaggaaggccgagttgatgaggagatagccttaaggatcatcaatgagggtgcagccattctgcgtagggaaaaaactatgatcgaggtcgaggcgcccatcacagtgtgcggcgacattcatggtcagttctttgatttgatgaaattgtttgaggtgggcggtagcccagccaatactagatacctgtttctgggtgactatgtcgatagaggatatttttctattgagtgtgtattatacttatgggtgctcaaaatcctttacccttccactcttttcctcctgagaggaaaccatgaatgcagacacctcaccgaatatttcaccttcaagcaggaatgcaaaatcaagtactcagaaagggtctacgaggcttgcatggaagcgtttgattccctccctctggcagcgctgttaaaccagcaattcctttgtgtgcatggaggcctcagcccagaaattcacacactggacgatatccggcgtctcgatcggttcaaggagcccccagcttttgggccaatgtgtgacctcctgtggagcgacccaagcgaggatttcggtaatgagaaatcacaggagcacttttcacacaatactgtgcggggatgctcctatttctacaattatccagcagtgtgcgagttcttacagaacaataatctcttgagcatcattcgggctcatgaagcacaagatgcaggttatcgtatgtacagaaaatcgcaaaccacaggcttcccctcgttaattactatcttttccgcaccgaattatcttgacgtgtataataacaaagccgccgtgctgaaatacgagaataatgttatgaacatccggcagttcaactgtagcccccacccatactggctaccaaactttatggacgttttcacatggagcttgcctttcgtcggcgaaaaagtaactgaaatgcttgtgaatgtgctgtcgatttgctccgatgatgaactgatgaccgagggcgaggaccaatttgacgggagcgccgcggcaagaaaggagattattcggaataagattcgtgcgatcggtaagatggccagagtgtttagcgtgttaagggaggaatccgaatcagtgctgacattaaaggggctcacgcccactggtatgttgccctctggtgtgttggccggaggacgtcagacgctgcaaagcgccactgtggaggcgattgaggccgaaaaagcaattaggggcttttctccaccacaccggatttgcagtttcgaggaagccaagggactggatcgcataaatgaacgaatgcccccccgaaaggatgctgtacaacaggatgggttcaattcgctgaacactgcgcacgccaccgaaaatcacgggaccggtaatcacacagcccagtag

SEQ ID NO: 25861 - DNA, 1545 bp, Artificial Sequence
  Description of Artificial Sequence: Synthetic coding sequence
atggccgcccccgagcccgcccgggccgcccccccccccccccccccacctccgccccctcccggggccgacagggtggtgaaggccgttcccttcccacccacacatcggctgaccagtgaggaggtattcgatcttgatggtattccccgcgtagacgtcctaaagaatcacctagttaaggaaggaagggtcgacgaagaaatcgcactgagaattatcaatgagggtgctgcaattcttaggcgggagaagacaatgatcgaagtggaagcacccatcacagtgtgcggcgacatccacggacagttttttgacctgatgaaactgtttgaagtcgggggatctcctgccaataccagatacctatttcttggggactacgttgatcgtgggtatttttccatagaacatgttctaggaaccgaggatatctccattaatcctcataacaacataaacgagtgcgtgctgtatctgtgggttctcaagatcctgtatcccagcactctcttcttgctcaggggaaatcacgaatgtagacacctgactgagtacttcacctttaaacaagagtgtaaaatcaagtatagtgagcgcgtttacgaggcttgcatggaggctttcgactccctgccattggccgccctcctgaaccagcagttcttgtgtgtgcatgggggccttagccctgagattcatacgttagacgacatacggcggctcgatcggtttaaggagccacccgcctttggccctatgtgcgacttgctgtggagcgacccttctgaggacttcggtaacgagaagagtcaggagcacttctctcacaataccgtgcgaggttgttcttatttctacaactacccagccgtatgcgagttcttgcagaataataatctgctgagtatcatcagagctcatgaagctcaggacgctggctatagaatgtatagaaagtcacagaccaccgggttcccgtcgttaatcaccattttttctgctccaaactatctggacgtgtacaacaataaagcggccgtgctgaaatacgagaacaatgtcatgaatattaggcaatttaactgttccccccacccctactggctgcccaatttcatggacgtgtttacatggagcttaccattcgtgggggagaaggtgacagaaatgctggtgaatgtcttgtcaatctgcagcgatgatgaattaatgacagagggtgaagaccagttcgatgggagcgctgccgctcgaaaggaaatcattcgtaacaaaatcagagcaattggcaaaatggctcgagtatttagcgtgttgcgagaggaaagcgagtccgtactcacacttaaagggctgactcccaccggaatgctgccaagcggcgtcctggccggcggaaggcagactctccaatctgggaacgatgtgatgcagttggccgttccccaaatggattggggaacgcctcacagcttcgcaaataacagccataatgcctgccgtgaattcctcttatttttttcctcgtgtctctcctcctag

SEQ ID NO: 25862 - DNA, 591 bp, Artificial Sequence
  Description of Artificial Sequence: Synthetic coding sequence
atgaacatccggcagttcaactgcagcccccacccctactggctgcctaatttcatggacgtcttcacctggtcgctgccctttgtgggggagaaggtgacagagatgttggtgaacgtgctttcgatctgcagcgacgacgagctgatgacagagggagaggatcagttcgatgagaggctcatctatggcaataaaaagggaagcgctgcagcacgcaaagagatcataaggaacaaaattcgggccatcggcaagatggctagggtgtttagcgtgctgcgagaggagagtgagtccgttctgacattaaaaggtttgaccccaaccgggatgctgccatctggtgtgctggcagggggaagacaaaccttacagtctgccactgtggaggccatcgaggcggagaaagccatcaggggattttcaccaccccataggatttgcagttttgaagaggcgaaaggactcgaccggattaatgagcgcatgccaccacgtaaggatgccgtgcagcaagacggttttaactccctgaacaccgctcacgcaacggaaaaccatggcacagggaaccacactgcgcagtag

SEQ ID NO: 25863 - DNA, 1548 bp, Artificial Sequence
  Description of Artificial Sequence: Synthetic coding sequence
atggccgcccccgagcccgcccgggccgccccccccccccccccccctcctcccccaccacctggcgcagacagggtcgttaaagccgtgcctttccccccaacccataggctcacctcggaggaagtgttcgacttagacggcatcccccgagtggacgtcctgaaaaatcacctggtgaaagaaggccgggtggacgaagaaatcgcgttaagaattattaacgagggggctgcgatcttgagacgcgagaaaacaatgatcgaagtcgaagcccccataactgtttgcggcgatattcacgggcagtttttcgacctcatgaaattatttgaggtcgggggaagccccgccaatacaagatacctgttcctcggagactacgttgatcgcgggtatttttcgatagaatgtgtgctctacctctgggtgctgaagattctgtaccctagcactttgttcctgcttcgagggaaccacgagtgccggcatctgaccgaatattttaccttcaaacaggaatgcaaaattaaatactccgaacgggtctatgaggcttgcatggaagccttcgattcacttcctctagccgctctactgaatcaacaattcctgtgtgtacatggcggcttgagtcctgaaattcatacattggacgacattaggaggctagaccggttcaaagaaccccccgcattcggacctatgtgcgacctgctgtggtccgatccctccgaggactttggcaatgagaagagccaggagcacttctctcataataccgtgagagggtgttcgtacttctataattaccccgccgtgtgtgaatttctgcaaaacaataacctcctgagcataataagggctcatgaagcgcaagacgctggctatcgcatgtataggaagagccaaactacaggcttcccatccctgattactattttttcagcaccaaattatctggacgtctacaataacaaagccgccgtgctgaagtacgagaacaacgtgatgaatatccgacaattcaattgctcaccccatccatactggcttcccaactttatggatgtgtttacgtggtctctgccgttcgtcggagaaaaagttaccgaaatgcttgtgaatgtcctgagtatctgttccgacgatgagctgatgaccgagggggaggaccaattcgacgtcgggtccgctgccgcccgcaaggagattatcagaaataagattagagcgatcgggaaaatggccagggtgtttagtgttctgcgcgaggaatcagaaagcgtgctgaccttgaagggattaacaccaaccgggatgctgccgagcggcgtgttagcaggcggtcgtcagacactgcagtcggctatccgaggcttttcacctccacataggatctgttcatttgaagaggctaaggggctggatcggattaacgagcgaatgcccccaagaaaggacgcggtgcagcaggatggatttaattctctgaatacggcacatgcgactgagaaccacggcaccggaaaccataccgcacagtag

SEQ ID NO: 25864 - DNA, 1578 bp, Artificial Sequence
  Description of Artificial Sequence: Synthetic coding sequence
atggccgcccccgagcccgcccgggccgcccccccccccccccccccgcctccacctccccccggcgcagatcgggtggtgaaagctgttcccttccctcccacacaccgccttacctccgaggaagtatttgacttagatggcatacctcgtgtcgatgttctgaaaaatcacctagttaaggaaggtagagttgacgaggaaattgcactcaggattatcaacgagggagccgccatccttcgccgagagaaaactatgatcgaggtggaggcaccgataacagtctgcggcgacatacacggccaattcttcgacctcatgaagttgttcgaagtcggtggaagccctgcgaacacacggtacctctttctgggggattacgtggaccggggttacttctccattgagtgcgtcctgtatctgtgggttctgaagatcctctatccaagcactcttttcctgctgcgcgggaatcatgaatgtaggcatctgaccgagtacttcacgtttaaacaagagtgcaaaattaagtactccgagagggtttacgaggcatgcatggaggcattcgactccctgcccctggccgccctgctgaaccagcaattcttatgcgtgcacggaggcctcagccctgagattcataccctggacgacattagaagactggacagatttaaagaaccacccgcttttggtcctatgtgcgacttgctctggtcggaccctagtgaggactttggtaatgaaaaatcacaggagcatttttcacacaataccgtacgcggttgctcctatttttacaattatcccgcagtgtgtgaattccttcagaataacaacctcctctctattatcagggcacatgaagctcaagatgcggggtacagaatgtatagaaagagccaaactaccggcttcccctcactgatcactatttttagcgcaccgaactacttagacgtctacaataataaggccgctgtccttaaatatgagaataatgttatgaatattcgtcagttcaattgttctccacatccctactggctgcctaactttatggatgtgttcacctggtctctcccattcgtaggagagaaagtgaccgagatgcttgtcaatgtgttgtctatctgtagtgacgatgaactcatgaccgagggtgaagatcagttcgatgtcgggtctgcagccgcaaggaaggaaatcattagaaacaagattcgcgcaatcggtaaaatggccagagtgttctctgttctgagagaagagagcgaaagcgtgttaaccctaaaaggccttaccccaacaggaatgctcccatcaggggtgctagcaggcggcaggcagactcttcagtcagctaccgtggaggccatcgaagctgagaaggccatccgcggcttttcccccccacatcgaatatgtagtttcgaggaggctaagggcctggataggattaacgaacggatgcccccccgcaaggacgctgtgcagcaggatgggttcaatagcttgaatacagctcacgcgacggagaatcacgggacaggcaaccacaccgctcagtag

SEQ ID NO: 25865 - DNA, 561 bp, Artificial Sequence
  Description of Artificial Sequence: Synthetic coding sequence
cacccctactggctgcccaacttcatggacgtgttcacctggagcctgcccttcgtcggcgaaaaggtcacagagatgctggtaaacgtgctctccatctgtagcgatgacgagctgatgacggaaggcgaggaccagttcgatgagcgcttgatctatggtaacaaaaaggggtccgcagcggccagaaaggagatcattagaaataagatcagagcgatcggcaagatggcgcgcgtgttttcagtgctgagggaagagtccgagtctgtgctcacactgaaggggcttactccaaccggcatgctcccaagcggtgttcttgctggcggcaggcagactctgcagagcgcgacagtggaggcaattgaggccgagaaagctatacgcggcttttcccctcctcataggatctgctccttcgaagaagccaaggggcttgaccgtattaatgagcggatgccacctagaaaggacgccgtgcagcaggacgggtttaactctttaaacaccgcccacgcgaccgagaatcatgggactggtaatcacactgcacagtag

SEQ ID NO: 25866 - DNA, 459 bp, Artificial Sequence
  Description of Artificial Sequence: Synthetic coding sequence
atgctggtgaacgtgctgagcatctgcagcgacgacgagctgatgaccgaaggcgaggaccagtttgatggctcagccgctgccaggaaggaaatcataagaaacaagatccgagccattgggaagatggcgcgggtgtttagcgtgttgcgcgaagaatctgagagcgtgctgaccctgaagggattgacacccaccggcatgcttccatcaggagtgctcgctggtggccgacaaaccctgcagtcggccactgttgaagcaattgaggcggagaaagccattagaggatttagccctccacacaggatatgttccttcgaagaggcaaaagggctggatcggatcaacgagcgcatgccccccaggaaagacgccgtccagcaggatgggttcaattctttgaataccgcacacgccacagagaaccacgggaccggcaaccacactgcccaatag

SEQ ID NO: 25867 - DNA, 1236 bp, Artificial Sequence
  Description of Artificial Sequence: Synthetic coding sequence
atgatcgaggtggaggcccccatcaccgtgtgcggcgacatccacgggcagttcttcgacctcatgaagcttttcgaagtgggtggctcacctgccaacacgagatatctgttcttgggggattacgtagacagggggtacttctcgattgaatgtgtgctgtacctctgggttttgaagatcctttacccctcaacactcttcttgctccgggggaaccacgagtgtcgtcaccttaccgagtactttactttcaagcaagagtgcaaaatcaagtatagcgaaagggtatacgaggcatgtatggaggcttttgacagtctgccactggctgctttattgaaccaacaattcttatgcgtccacggtggcctcagcccggagatccacacactggacgatatcagacggttggaccggttcaaggagccacctgcattcggaccaatgtgcgatctcctgtggtctgacccgagcgaggactttggtaacgagaaatcccaggaacacttctcacataacaccgtgcgcggctgtagctacttctataactatcccgccgtttgtgaatttcttcagaataacaacctcctaagtatcatacgagcccatgaggcccaggacgccggctacaggatgtataggaaatcccagacgaccggctttccgtctcttattaccatattcagcgctccaaattatttagacgtttataataataaggccgcagtgcttaaatacgaaaataacgtcatgaatatccgccaatttaattgctcgccgcatccgtattggctgcccaactttatggacgtattcacctggagcctacccttcgtcggcgagaaggtgacagaaatgctggtgaatgtgttgtcaatttgctcggacgacgagctaatgacagagggcgaggaccagtttgatgtaggatcagcagcagcaaggaaagaaatcatccgtaacaaaattcgagcgatagggaaaatggccagggtgttttcagtcttgagggaagagagcgagtctgtcctgactttgaagggactcaccccgacaggcatgcttcccagtggcgtcctggccggcgggagacagactttgcaatccggcaacgacgtcatgcagctggctgtccctcagatggactggggtaccccccatagcttcgcgaacaactcacacaatgcctgccgggagtttttgctgttcttttcaagctgtctcagttcctag

SEQ ID NO: 25868 - DNA, 1539 bp, Artificial Sequence
  Description of Artificial Sequence: Synthetic coding sequence
atgagcggccggcggttccacctgagcaccaccgaccgggtgatcaaggccgttcccttccctcccacccaacgcttaacgttcaaggaggtgttcgagaacgggaagcccaaggtagacgtgctcaaaaaccatctggttaaggaggggaggctggaagaagaggtggcacttaagatcataaacgacggtgcggcaatactgcggcaggagaaaaccatgattgaagtggatgcccccattactgtgtgcggagatattcatggccaattttttgatttgatgaaactgtttgaggtgggtggatccccgtcaaacactcgctacttatttctcggcgattacgtagaccgaggctactttagcattgagtgcgtattgtacttgtggtctctcaagattaaccacccaaagaccctcttcttgctgcggggcaaccatgagtgtcgtcacctcacggattattttacattcaagcaggagtgccgaataaagtatagcgaacaggtatatgacgcttgtatggagacatttgattgtctgccactcgcagccctgctgaatcagcagttcttgtgtgtccatggcggaatgtctccagaaattacttcactcgacgacatacgcaagctagataggttcaccgagccaccagccttcgggcctgtttgcgatttactgtggagcgacccaagcgaagattatggtaatgaaaagacactggaacactatacccacaacactgtccggggttgtagttacttttactcctacccagctgtgtgcgaattcctgcagaacaacaacctgctgtccatcattagagctcacgaggcccaggacgcagggtatcggatgtataggaaatcccaggctacaggcttccccagcctgattactatattctccgccccgaactacttggacgtctataacaataaggcagcggtgctcaaatatgaaaacaacgtcatgaacatccggcaatttaactgtagtcctcacccatattggctcccaaattttatggatgtttttacctggagcttaccgttcgtgggagagaaagtgactgagatgctcgtgaacgtgttgaacatttgttctgatgatgagctcatctcagacgacgaagctgaggggtctaccaccgtgcggaaagagatcatccgaaataaaatcagggccattggaaaaatggctagggtgttctctatcctccgccaggaaagcgagtctgtgttaacactaaaaggactgacccctactggaacactccccctcggcgtcctcagcggcggtaagcagacgatcgaaactgccaccgttgaggcggtcgaagcgagggaggcgataagaggctttagtctgcaacacaagatcaggagtttcgaagaagcacgggggcttgaccggatcaatgaaagaatgccgcctagaaaggactctatccatgccggcggccctatgaagtctgtgacatccgcccattctcacgcggcacatagaagcgatcaggggaagaaggctcatagttag

SEQ ID NO: 25869 - DNA, 1509 bp, Artificial Sequence
  Description of Artificial Sequence: Synthetic coding sequence
atgagcggccggcggttccacctgagcaccaccgaccgggtgatcaaagccgtacctttcccgcctactcaacgcctgacttttaaagaagtcttcgagaacgggaaacctaaagttgacgtcctgaaaaaccatcttgtaaaggagggccggctcgaggaagaagtcgcgctgaagatcattaatgacggcgcggccatattgcgacaggagaagacgatgatcgaggtggatgctccaattaccgtatgcggagacatccatgggcagttctttgatttaatgaagctcttcgaagtaggggggagtcccagtaatactcggtatctgtttttgggcgattacgtagaccggggctattttagtatcgagtgtgttctttacctctggagcctgaagatcaaccaccctaagaccctgttcctgttgagaggaaatcatgagtgtcgacatctcacggattacttcacctttaaacaggagtgtaggatcaaatattcagagcaggtgtatgatgcgtgcatggagacttttgactgtttacctctagcagccctgttgaaccagcagttcctgtgtgtgcatggcggtatgtctcctgaaattacctccttagacgatattcgaaagcttgaccgcttcaccgagcccccagcctttggtccagtgtgcgatctgctgtggagcgatccttcagaagattacgggaatgagaaaaccctcgagcactacacccacaatacagtgcgggggtgttcctatttctactcttatccggctgtgtgcgaattcctccaaaacaataacctgctgtctatcatccgcgcccatgaggctcaggatgcaggctatcggatgtacagaaaatctcaggcaaccggttttccatctcttattaccatttttagcgcgccgaattaccttgacgtttacaacaacaaagctgccgtgttgaaatacgagaataacgttatgaacatccggcagttcaactgcagtccacacccatactggctgcctaattttatggacgtcttcacctggagtctgccatttgttggggagaaagttactgagatgctggttaatgtgctcaacatctgttctgatgacgaactaattagcgacgacgaagcagaagggtccacaaccgtacgcaaagagattatcaggaataagatcagggctattgggaagatggcaagggtgttcagcatcctgcgacaggagagtgagagtgtcctgacccttaaaggcctcaccccaacaggtactctgccattgggagtgctgagcggcggaaaacaaactattgagactgctatcagggggttttcactgcaacacaagatacgttcgtttgaggaggctcgaggactggatagaattaatgaacgcatgcccccgcggaaagatagcatacacgctggggggccaatgaaaagtgtgacttcagcccactctcatgcagcccaccggtccgatcagggtaagaaagcacacagttag

SEQ ID NO: 25870 - DNA, 345 bp, Artificial Sequence
  Description of Artificial Sequence: Synthetic coding sequence
atgtactacaagttcagcggcttcacccagaagctggccggcgcctgggcttccgaggcctattcgccccaggggttaaaaccagtggtatcaactgaggctcctcccattatctttgctacccctacaaaactgacatcggacagcacagtgtacgattatgccggaaaaaataaggtgcccgagttgcagaagttttttcagaaggccgacggggtgcccgtatacttgaagaggggtcttcccgatcagatgctgtaccggacaactatggcgctaacagtgggcggaacaatttactgccttatcgccctctacatggcctcccaaccaaagaacaagtag

SEQ ID NO: 25871 - DNA, 522 bp, Artificial Sequence
  Description of Artificial Sequence: Synthetic coding sequence
atgagcaccatgggcaacgaggccagctaccccgccgagatgtgcagccactttgataatgatgagattaaaaggttgggccggcgtttcaaaaagctggatttggacaaaagtggttcgctgagtgtggaggaattcatgagtctgcctgaattaagacacaatcctttggtcaggcgtgtgattgacgtgttcgacactgacggcgatggagaggtcgactttaaagagttcatcttaggaacatctcagttcagcgtgaagggcgatgaagagcaaaaactgaggtttgccttttctatctatgatatggacaaggacggatatatttccaatggtgagctttttcaggtgctgaagatgatggtgggaaacaatctgaccgactggcagttgcaacagctcgtagacaagaccattattattttagacaaagacggagatgggaagatcagctttgaggagttttccgctgtcgtccgggatctggagattcataaaaagctggtgttaatcgtatag

SEQ ID NO: 25872 - DNA, 420 bp, Artificial Sequence
  Description of Artificial Sequence: Synthetic coding sequence
atgagcaccatgggcaacgaggccagctaccccgccgagatgtgctctcattttgataacgacgaaattaagaggctgggccgccggtttaagaagctggacttggataagtccggctctttgagtgtggaggagtttatgtctctgccagagcttagacacaatcctttggtgcgcagagtgatcgatgtgttcgacaccgatggagatggggaagtggatttcaaagaattcattctgggaacttcccagtttagtgtgaaaggcgatgaggaacagaaattgaggttcgcatttagcatatacgatatggataaggacggctacatcagcaacggagagctgttccaggtactgaaaatgatggtgggtaataacttgaccgactggcagcttcagcagctcgtcctcatcgtctag

SEQ ID NO: 25873 - DNA, 1818 bp, Artificial Sequence
  Description of Artificial Sequence: Synthetic coding sequence
atggccggcctgtacagcctgggcgtgagcgtgttcagcgaccagggtggtcggaagtacatggaagatgttacccagattgtagtggagcccgagcccacggccgaggagaagccaagccccagaaggtctttgtctcagcccctccccccccgtccaagtccagcggcattgccaggtggcgaagtgtctggaaagggccctgctgtggccgcaagagaggctagagacccccttcctgacgctggagctagcccggcaccaagccgctgttgcaggcggcgctctagcgtcgcttttttcgctgtctgtgacggccacggcgggcgcgaagccgcccagtttgctcgggagcacctctggggtttcattaaaaaacaaaagggtttcacctcttcagagcctgccaaagtctgtgcggctatccgtaaaggattcctggcatgccacctggctatgtggaagaagcttgctgagtggccaaaaaccatgaccggacttcccagcaccagtggaaccactgcctctgtggtgatcattagaggcatgaagatgtacgtggctcacgttggggacagcggagtggttctgggcattcaggacgatccaaaggatgattttgtaagagctgtggaagttactcaggatcataagccagagctgcccaaagagcgtgaaagaatagaagggctgggagggtctgtcatgaacaagtcaggtgtgaatagagtggtgtggaagagaccacgcctgacccacaatgggcctgtcaggcgatctaccgtgatcgaccagattccattcttagcagttgccagggcccttggcgatctctggagctacgatttcttcagcggagagttcgtcgtgtctcccgagccagacacttctgttcatacccttgacccccagaagcacaaatacatcatcttaggtagcgatggtctctggaacatgattcctccacaggatgccatctccatgtgtcaggaccaggaagaaaaaaaatacctgatgggcgaacatggtcaaagctgtgctaagatgttggtgaatcgagccctgggacgctggagacagaggatgttaagggcagacaacacttcggccattgtgatatgtattagcccagaggtggacaatcagggcaactttacgaacgaagacgagctgtatctcaatcttacagactccccaagttataatagtcaggagacctgcgtcatgactccttccccctgttccacacccccagtgaagagcctcgaggaggatccatggccccgagtcaattcaaaggatcatataccagccctggtgcgatctaacgccttttcagaaaattttctggaggtttccgccgagattgctcgtgagaatgtccagggggtggtaataccctctaaagaccctgagcctcttgaggagaattgcgccaaagctttgacactgcgaatccacgattctcttaacaattctctgcctatcggtctggtcccaaccaattcaaccaatacagttatggaccagaaaaacctgaaaatgtccacacccggccaaatgaaagcccaggagattgagaggaccccacctactaattttaagagaacactggaggaaagtaactcagggccgctgatgaagaaacataggcgcaacggactctctagaagctctggtgctcagcctgcatctctgcctacaacatctcagagaaagaacagtgttaagctaacaatgaggcgccggctgcgcggccaaaagaagattgggaaccccctgctgcatcagcaccggaagactgtttgtgtctgttag

SEQ ID NO: 25874 - DNA, 1293 bp, Artificial Sequence
  Description of Artificial Sequence: Synthetic coding sequence
atggccggcctgtacagcctgggcgtgagcgtgttcagcgaccagggtggtagaaaatacatggaggacgtaactcaaatcgtcgtggaacccgaacctactgccgaggagaagcctagccccagacgcagtttgtcccaacccctccctcctaggccttctcctgccgcccttccaggcggggaagtctccggcaaaggccccgcagtcgccgcacgcgaggcacgcgacccattgcccgacgcaggagcttctcctgcgcctagtcggtgttgtagacgaagatcctctgtggctttttttgcagtgtgcgacggacacggcggtagggaggcagctcagtttgcccgggagcacctctggggttttatcaaaaagcagaaggggtttacatcctctgaacccgctaaggtctgcgctgccattcgcaagggattcctggcttgtcacttggccatgtggaaaaagctcgccgagtggccaaaaaccatgacagggctgccttcaacatctgggacaaccgccagcgttgttataatacgagggatgaaaatgtacgtagctcacgtgggggatagcggagttgtcttgggtattcaggacgatcctaaggacgacttcgtgcgggcagtagaggtcacccaggaccacaagcctgagctccctaaggagcgcgaaaggatcgaagggctgggcgggtctgtgatgaacaagtctggcgtcaaccgtgtcgtatggaaaaggcctaggctcacacacaacggccctgtcaggcggtccaccgtgattgaccagatcccattcttggctgtggcaagagcgctgggagatctctggtcctacgacttcttctcaggagagtttgtggttagccccgagcccgatactagcgtccacacactcgatccccagaagcacaaatacataattctaggttcagacggactgtggaatatgatccctccacaagacgctatttccatgtgtcaggaccaggaagagaagaagtatttgatgggcgaacacggccaatcctgtgccaaaatgctagtgaacagggccttagggagatggcggcagcgtatgctgcgtgctgataatacttccgcgattgtcatctgtatttctccagaagtagataatcagggcaacttcacaaacgaagacgagctctacctgaatctgacagacagcccctcttacaacagccaggagacttgcgtcatgacaccctcgccatgtagcacccctcctgtgaaagacttcggatttgagctggattctaggaagtag

SEQ ID NO: 25875 - DNA, 837 bp, Artificial Sequence
  Description of Artificial Sequence: Synthetic coding sequence
atgtggaagaagctggccgagtggcccaagaccatgaccggcctgccttccacctctggaactacggcctcagtggtgattatcagaggcatgaagatgtatgtcgcacacgtcggggactccggggtggttctggggatccaagatgatcctaaggatgactttgttagagcagtcgaagtcacacaagaccataagcccgaactaccgaaagaaagggagcgcattgaaggcctaggtggttctgttatgaacaaatccggggtgaatcgtgtggtctggaaacggccaagattgactcacaatgggcccgtccggcgctcgacagtaattgaccagatccctttccttgccgtggcacgcgctctgggcgatctatggtcatacgattttttttctggcgagttcgtggtgagccctgaacccgacacgtctgtgcacaccttagatccccaaaaacacaaatacattatcctgggcagcgacggcctgtggaacatgatcccaccacaggacgcaattagcatgtgccaagaccaggaagagaagaagtacctgatgggcgagcacggccagtcatgtgctaagatgctggtgaaccgggctctgggccgctggcgacaaagaatgctccgtgcagataacacttcagccatcgttatatgtataagtccagaagttgacaaccaggggaacttcaccaacgaggatgaactgtatctcaacctgacagatagtccctcctataactcgcaggaaacctgcgtcatgacgcctagtccctgcagtacccctcccgtcaaggattttggcttcgagcttgatagtcggaaatag

SEQ ID NO: 25876 - DNA, 3432 bp, Artificial Sequence
  Description of Artificial Sequence: Synthetic coding sequence
atgtacctgtggctgaagctgctggccttcggcttcgccttcctggatactgaggtgttcgttactggacagtccccgacccccagccccacagacgcttacctgaacgcttccgaaaccaccacactttctcctagcggatcggccgttataagtaccacgaccattgcgaccaccccttccaaacccacctgtgatgaaaagtatgccaacatcaccgtggattatctctacaataaagagacaaaattattcactgcgaagttgaacgtgaatgagaatgtggagtgtgggaataatacatgtacgaataatgaggttcacaaccttactgagtgcaagaatgcctccgtcagcattagccataacagctgtaccgctccagacaagaccttgatactagacgtgccccccggcgtggaaaaatttcaacttcacgactgtactcaggttgaaaaggccgacacaacaatatgtcttaagtggaagaacatagaaacctttacttgtgatacacagaatattacttatagatttcaatgtggcaatatgatctttgacaacaaggagataaaactggaaaatctggagccggaacatgaatataaatgtgattcagagatactgtataacaaccataaattcacaaacgctagcaagattattaagaccgacttcgggtcccccggggagccgcaaataattttttgcaggagtgaagctgctcaccagggtgtgatcacttggaatcctccacaaaggtctttccataacttcacactgtgctatattaaagaaacagagaaggactgcctcaacttggataagaacctgatcaagtacgacctccagaatttgaagccatatacaaagtacgtgctaagcctccatgcctacatcattgccaaggtccagagaaacggatcagcagcgatgtgtcactttacaaccaagtctgctcccccttcacaggtgtggaatatgaccgtctccatgacttccgataactcaatgcatgtcaagtgtagacctccccgggatcggaatggcccacacgagaggtatcatctggaggtggaggccggcaacaccttggtcagaaatgagtcccataagaattgtgactttagagtcaaggatctccagtacagcacagactataccttcaaggcctattttcacaatggcgattaccctggcgaaccgttcattttacaccattctacgtcgtacaactctaaggccttgattgcctttctggctttcctgatcatcgttaccagtatagctctcctcgtggtcctgtacaaaatctatgacctacacaagaaacgttcttgcaacctggacgagcagcaggagttggtcgagagagacgatgaaaaacagctgatgaatgtggaacccatccatgcagatatccttctcgaaacctataagaggaagattgccgacgagggaagactgtttctggctgagtttcagagcattccacgcgtattttcaaagtttccgatcaaggaggcccgcaagccctttaatcagaacaaaaatcgatatgtggatatattaccgtatgattacaacagggttgagctcagcgaaattaacggcgatgctggttccaactatatcaacgcgtcttacatcgatggctttaaggagccacggaagtatatagccgcacaggggccgagagatgagacagtagatgacttctggaggatgatttgggagcaaaaggcaaccgtgatcgttatggtcacccgatgcgaggaaggaaataggaacaaatgtgcagaatattggccctccatggaagagggcaccagagctttcggagacgtcgtagtaaaaatcaaccagcacaagcgatgccctgattacattatccagaaacttaacatagtgaataagaaggaaaaggctacagggcgtgaagttacacacatccagttcacctcatggccggaccacggagttcctgaagatccgcatctgctccttaagctgcgacgccgcgtgaacgcgttctccaactttttctctggtcctatcgtggtgcattgttcagctggtgtggggcgaacgggaacttatattggcattgatgccatgctggaaggcctcgaagccgaaaacaaggtcgatgtctatggctacgtggtcaagcttcggaggcaaaggtgcctcatggtgcaagttgaggctcagtatattctgatccaccaggcacttgtagaatataaccaattcggcgagacggaggtgaacctttcagagcttcacccttacctacacaatatgaaaaaacgcgaccccccgtctgagccctccccgttagaggctgagtttcagcgcctgccttcgtatcggtcgtggcgaacacagcacattggcaaccaggaagagaacaagtcaaagaaccgcaatagcaatgtaatcccatacgactacaaccgcgtgccgctgaaacacgagctggaaatgagtaaagagtctgagcacgattcagacgagtcttcagacgacgattccgattcggaagagccctccaagtatatcaatgcatcgttcattatgtcatactggaagccagaggtcatgatcgccgcgcaggggcctcttaaggagacaattggggacttctggcagatgatctttcagagaaaggtaaaggtgatcgtgatgctgacagagttgaaacacggtgaccaggagatctgtgctcagtactggggcgaaggcaagcagacctacggagatatagaagtcgatttgaaagacacagataaaagcagcacttatactttgcgggtctttgagttgagacatagtaagagaaaggattctcgaacggtgtaccagtaccaatatacaaattggtcagtcgaacagctacccgcagaaccgaaagagttgatttctatgatccaggtggtcaagcagaaactgccacagaaaaatagctctgagggaaataaacaccataaatctacccccttgctcatccattgtcgggatgggtcgcagcagaccgggatcttttgcgctcttctgaatcttttggaatccgcggagacggaagaagtagttgatatattccaggttgtcaaggccttgagaaaggcacgtccggggatggtctcaacattcgaacagtaccagttcctctatgacgtgattgcgtcgacttaccccgcacagaacgggcaggtgaaaaaaaacaaccatcaagaagacaagatagaatttgataatgaagttgataaggttaagcaggacgccaactgtgttaatccactgggtgccccagagaagctcccggaagcaaaggagcaagccgagggatcggagcccacttctgggaccgaaggtcctgagcattccgtaaacgggccagcaagcccagctctgaaccagggatcttag

SEQ ID NO: 25877 - DNA, 105 bp, Artificial Sequence
  Description of Artificial Sequence: Synthetic coding sequence
atgtacctgtggctgaagctgctggccttcggcttcgccttcctggacacggaagtgttcgttaccgggcagtcacccacaccctccccaaccggtaaaaactag

SEQ ID NO: 25878 - DNA, 447 bp, Artificial Sequence
  Description of Artificial Sequence: Synthetic coding sequence
atggcccggatgaaccggcccgcccccgtggaggtgacctacaagaatatgaggttcttaattacccacaatcccaccaatgctactctcaacaaattcattgaggagttgaagaagtatggcgtgaccacaatcgtgcgtgtgtgcgaggccacctacgatacaaccctcgttgagaaggaagggatccacgtgctggattggcccttcgacgatggagccccaccatcaaatcagattgttgatgattggctctccctggtcaaaatcaaattccgtgaagagcctggctgctgcattgcggtgcactgcgtggccggtctggggcgtaaacggagaggagcctttaacagtaagcagcttctgtatctggaaaaatacagacctaagatgagactgcgattcaaggactcaaacggccatcgaaataattgttgtatccagtag

SEQ ID NO: 25879 - DNA, 447 bp, Artificial Sequence
  Description of Artificial Sequence: Synthetic coding sequence
atggcccggatgaaccggcccgcccccgtggaggtgacctacaagaacatgcggtttctcatcacgcacaatccaactaacgctactctcaacaagttcatcgaagagctgaaaaaatacggagtgactactatcgttcgtgtgtgcgaagctacctatgacactaccctagtcgaaaaagaaggcattcatgtcttggactggcctttcgatgatggcgcccccccttcaaatcaaatcgtggacgattggttgagccttgtgaagatcaagtttagggaagaacccggctgctgtatcgccgttcactgcgtcgctgggctgggcagaaagcggagaggagcttttaattcaaagcaacttctgtacctggagaaatatagaccaaagatgagactgagattcaaagatagtaacggacatcgcaataattgctgtatacagtag

SEQ ID NO: 25880 - DNA, 522 bp, Artificial Sequence
  Description of Artificial Sequence: Synthetic coding sequence
atggcccggatgaaccggcccgcccccgtggaggtgacctacaagaatatgaggtttctaatcactcacaatcctacaaatgcaacgctcaacaaatttatcgaggaattaaaaaaatatggagttaccacaatcgttcgagtttgcgaggctacgtacgatactactttggtcgagaaggaaggtattcacgtgttagactggccctttgatgacggtgcaccaccgagtaatcaaatagtggatgactggctctcactggtgaaaattaagtttagggaggagcccggatgttgcatcgcagtgcattgtgtagcaggcctcggacgcgccccagtcctggtagccttagctctgattgaaggtgggatgaagtatgaggacgccgtccagtttattaggcagaagcgccgaggggcgtttaatagcaaacagttactgtatctggagaaatacagaccgaagatgcggctaagattcaaggacagcaacggtcacagaaacaattgttgcatacaatag

SEQ ID NO: 25881 - DNA, 1308 bp, Artificial Sequence
  Description of Artificial Sequence: Synthetic coding sequence
atggagatggagaaggagttcgagcagatcgacaagagcggcagctgggccgcgatttatcaggacatccggcacgaggcaagcgatttcccgtgccgagtagcaaaactgcccaaaaacaaaaataggaaccgttatcgggacgtcagcccgttcgatcactcccgaatcaagttgcaccaggaagacaacgactatatcaatgccagcttgatcaaaatggaggaggcccaacggtcatatatactgacccagggccccctacctaacacctgtggtcatttttgggagatggtgtgggagcaaaagtcacgaggagtggtgatgcttaacagagtgatggaaaagggtagtctcaaatgcgcccagtattggcctcaaaaagaggaaaaggaaatgatattcgaggatacgaacctcaagttgacgcttatttctgaagacataaaaagctactataccgtccgccaactggagctagagaatctgacaacccaggaaacccgtgagattctccactttcactacactacctggcctgatttcggggtccccgaaagcccagcctcatttcttaacttcctgtttaaggtgagagagtctgggagcttgtctcccgagcacggaccagtcgtggttcattgtagcgctggaattggaagaagcggaacattctgcctcgcggacacttgcctgcttctcatggacaaacgcaaggatccaagttctgtcgacattaaaaaggtccttctggaaatgcgcaagttcaggatgggtctgatccaaacagcagaccaactgcgtttctcttacctcgcggtgattgaaggtgccaagtttattatgggggactccagcgtgcaggatcagtggaaggaactctcacacgaggacttggagccgccacctgagcatatcccccccccgcctcgaccacctaagaggattcttgagcctcacaatggaaagtgtagagagtttttccccaaccaccagtgggtcaaagaggagacccaggaggacaaggactgtcccattaaggaggaaaaaggcagtccactgaatgccgcaccctacggcatagagtcaatgagtcaggataccgaagtccgaagcagggtggtggggggaagcttacggggtgcccaggctgcttcccctgcgaagggcgagccttctttgcccgaaaaagacgaagatcacgccctatcctactggaagccgttcttagtgaacatgtgtgtggccacagtactgactgcgggcgcttacctttgttaccgctttttgttcaacagtaatacctag

SEQ ID NO: 25882 - DNA, 1089 bp, Artificial Sequence
  Description of Artificial Sequence: Synthetic coding sequence
atggaggaggcccagcggagctacatcctgacccagggccccctgcccaacacatgtggtcacttctgggagatggtttgggagcagaaatccagaggcgtagtgatgctgaacagagtgatggagaagggatcactgaagtgtgcgcaatattggccccagaaagaagaaaaagagatgatcttcgaggacacaaaccttaagctgactctgatatccgaggacatcaagtcgtattatacagtgagacagctcgaactggaaaatctgacgacacaggaaactcgtgagatcctgcactttcactacacgacctggccagactttggtgtcccggagagtcccgcatcatttctaaatttccttttcaaggtgcgggagtcaggcagtttgagccccgaacatggcccggtggttgtccactgctcagcaggaatcgggcgttccggtaccttctgtctcgctgacacctgccttctgttgatggacaaaagaaaagatccctcatccgtggacataaagaaggtgctgttggagatgcgcaaattcagaatggggctaatccagacggcggaccagttacggttttcctatttagccgtgatcgagggagccaaatttattatgggagattcctctgtccaagatcagtggaaggaactgtctcatgaagacctggagcccccacccgaacacatcccaccccccccccgccccccaaaaagaatcctggagccccataatggaaagtgtcgggaattcttcccaaatcatcagtgggtgaaagaagagacacaggaggataaagattgcccgattaaagaagaaaaaggcagccccctcaatgcagcgccatatggcattgaatcgatgtctcaggatactgaggtcagatccagagtggtcgggggctcgctgcgcggagcccaagccgcctctcccgccaaaggtgaacctagtctgcctgaaaaagacgaggatcatgccttaagctactggaaaccttttctggtgaatatgtgtgttgccacagtacttaccgccggagcctatctttgttacagattcctgttcaactccaacacttag

SEQ ID NO: 25883 - DNA, 1782 bp, Artificial Sequence
  Description of Artificial Sequence: Synthetic coding sequence
atgaccagccggcggtggttccaccccaacatcaccggcgtggaggccgaaaatttgctgttaaccagaggagtggacggtagctttctggctagaccttcaaaatccaaccccggcgacttcacattgagcgtgagaaggaacggggccgtcacacatatcaaaatccagaacacaggagactattacgatctctatggtggagaaaaattcgccactctcgcagagcttgtgcaatattacatggagcaccacgggcagctcaaggagaaaaatggcgatgtaatagaactcaagtatccgctcaactgcgctgaccctacatctgagaggtggtttcacggccatctaagcggtaaagaggccgagaaacttctgactgaaaaaggcaaacacggctcttttttagttcgggaaagtcaatcacacccaggagacttcgtgctttctgtgaggactggggatgataagggagagtcaaacgatgggaaaagtaaggtaacacatgtgatgattaggtgccaggagctcaaatacgacgttggcggcggcgagaggttcgattccctcaccgacctcgtcgagcactataaaaagaaccccatggtggagactctgggaacggtcttacagttgaaacagccgttgaataccacccgcatcaacgccgctgagatagagtcccgggtgagagaactgtcgaagttggctgaaactactgacaaggtgaagcagggattttgggaggagtttgagaccctgcagcaacaggagtgtaaactgctttactctaggaaggagggccagcgccaggagaataaaaataaaaaccggtacaagaacatcttgccctttgatcacacacgagtagtactacacgatggggatcccaatgaacccgtaagcgattacattaacgccaacattatcatgccggagttcgagaccaaatgcaacaactcaaagccgaagaagtcgtatatcgccacccagggttgtttgcaaaatacagtgaatgatttttggcgtatggtgttccaggagaatagccgagtgatcgtaatgacaacaaaagaggtggaacgagggaagtctaaatgcgtcaaatactggcctgacgagtacgccctaaaggagtacggcgtcatgagggtgcggaatgtgaaggagagtgctgctcatgactataccctgcgggaattaaaactgtcgaaagtgggccaggggaatacagagcgaacagtgtggcaataccactttcgcacatggccagaccatggggtgccatccgacccaggtggcgtgttagacttcttggaggaggtgcatcacaagcaggaatctatcatggatgctggacctgttgtggtacattgtagcgccggaattggccgaaccggaactttcatcgtgattgacatactcattgacattatccgcgaaaagggcgtggactgtgacatagacgtgccaaaaaccattcagatggtacgaagtcagcgtagcgggatggtccagactgaggcccaatataggtttatttatatggctgtgcagcactacatcgaaacactgcagcgcagaatagaggaggagcagaaatcaaagagaaaaggacatgagtacaccaatatcaaatattcattggcagatcaaaccagcggcgaccagtcacccctcccaccatgcacccctacgcccccctgtgccgagatgcgtgaggattctgcaagagtgtacgagaatgtgggcctgatgcagcagcagaagagcttcagatag

SEQ ID NO: 25884 - DNA, 651 bp, Artificial Sequence
  Description of Artificial Sequence: Synthetic coding sequence
atgaccagccggcggtggttccaccccaacatcaccggcgtggaggcagagaaccttctcctgacacgaggcgtcgacggatcttttcttgccaggccttccaagtcaaatccgggagattttactcttagcgtaagacgcaacggcgctgtgacacacattaaaattcagaacaccggagactattatgacttgtatggtggagagaagtttgccactctagctgagctggtgcagtattatatggagcaccatggacagctgaaagagaaaaatggtgacgtgatagaactgaaatatcctttgaattgtgcagatccaacctctgagcggtggttccacggccatctcagcggcaaggaggcagagaaattactcaccgagaagggtaaacacggtagcttcttggtacgggagtcccagagccacccgggggatttcgttctttccgtccgtacgggggacgacaagggggagagcaatgatgggaagtcgaaggttacacacgtcatgattcggtgccaggagctgaaatacgatgtgggtggcggagaaagattcgactcattgactgacctggtggaacattacaaaaaaaaccctatggtcgagacactcggtaccgtgctgcagctgaaacaaccactatag

SEQ ID NO: 25885 - DNA, 1383 bp, Artificial Sequence
  Description of Artificial Sequence: Synthetic coding sequence
atgaccagccggcggtggttccaccccaacatcaccggcgtggaggcagaaaatctcctgctgacccggggagtggacggctcttttttggctcgtccctccaagtcaaaccccggggattttacgctgagtgttcgcagaaacggcgctgtgactcatataaagatccagaatacgggcgactattacgatctgtatgggggcgaaaagttcgcgaccctcgcagagctggtgcagtattatatggagcaccacggacaactgaaggaaaagaacggggatgtgatcgagctcaaatatcctcttaattgtgcagatccaacctctgaacggtggttccatggccatctcagtggcaaagaagccgaaaagctcctgaccgagaaaggaaagcacgggtcgttcctcgtgcgggagtcacaaagccatcccggggattttgtactttctgtccgcacaggcgatgataaaggggagagtaacgacggtaagagcaaggttacacacgtcatgatccgttgtcaggaacttaagtacgacgtaggaggcggagagagattcgactccctcacagatttagttgagcattacaaaaagaacccaatggtggagactctcggtaccgttctgcagctcaagcagccattgaacacaactagaatcaacgctgcggaaattgaaagtagggtgcgcgagctgagcaagctggctgagacaacggacaaggttaagcaaggcttctgggaggaatttgagactttacagcaacaggaatgtaaactcctgtatagtcgcaaagagggccagcggcaggagaacaagaataagaatcgttacaagaatatcctgccattcgaccacactcgagtggtgctgcacgatggggaccccaacgagcctgtctccgattatattaatgccaacattatcatgcccgaatttgaaactaagtgtaacaacagcaaaccgaaaaaaagttatattgcgactcaaggatgcctgcagaacaccgtcaatgacttctggagaatggtgtttcaggaaaatagtcgtgtgattgtcatgactacaaaagaggtggaaaggggcaagtcaaaatgtgtgaagtattggcctgacgaatacgctctgaaggaatatggcgtgatgcgcgtgcggaatgtgaaggaatcagccgcacacgattacaccctgagagaactgaaactcagcaaagtgggtcaaggcaatacagaaagaacggtttggcagtaccattttcgaacgtggccagaccatggagtgccgtctgaccccggcggcgtgctggacttcctagaggaggtccaccacaagcaggagtcaattatggatgcgggtccagtagtcgttcattgtcgatag

SEQ ID NO: 25886 - DNA, 723 bp, Artificial Sequence
  Description of Artificial Sequence: Synthetic coding sequence
atgtacctgtggctgaagctgctggccttcggcttcgccttcctggacacagaggtctttgtgacaggacagtctccaactccatccccgactggacaccttcaggccgaggaacaaggatcacagtccaagtcccctaatctgaaatcccgcgaagccgatagtagcgccttctcctggtggcctaaagccagagaaccgctcactaatcactggcggctgacaactgctaaaatgccgagcgtacccctaagtagcgacccattgcctacacacactactgctttcagcccagcttcaacgttcgagcgtgagaacgatttcagcgagaccacgaccagtctgagccccgacaacacttctacgcaggttagcccagattctctcgataatgctagcgctttcaacactaccggtgtgtcaagcgttcagaccccacaccttccgacccacgctgattcacaaacgccctcagctggcaccgatacccaaactttcagtggcagcgccgctaacgccaaacttaacccaacacccggcagtaatgctattagtgacgtacccggagagcgcagcaccgccagcacattcccaacagatcccgtgagcccccttactacaacattatccctggcccaccactctagcgctgccctcccagcccgaacatcaaacacaacgatcacagccaacacctccgatgcttacttgaacgcgtcatag

SEQ ID NO: 25887 - DNA, 3432 bp, Artificial Sequence
  Description of Artificial Sequence: Synthetic coding sequence
atgtacctgtggctgaagctgctggccttcggcttcgccttcctggacacagaggtcttcgtgacaggacagagtcccaccccaagcccgacagatgcgtacctgaatgccagcgagaccaccaccttgagtccatctggcagcgccgtgatcagtacaaccacaatagcaacaacccctagtaagcccacatgtgacgagaagtacgccaacataacagtggactacctctataacaaagagacaaagctgtttacagcaaaactcaatgtaaacgaaaacgtggagtgtggtaataatacctgcacaaacaatgaagtgcataatttgacagagtgtaaaaatgcctctgtttcaatcagccacaatagttgcactgcccctgataagacacttatcctggacgtgccgcctggggtcgaaaagttccagctgcatgactgtacacaggtagagaaggccgatacaacaatctgcctgaaatggaagaacattgaaacttttacgtgcgacactcaaaatataacttaccggtttcaatgtggcaacatgatcttcgacaataaggagataaagctcgagaatctggaacccgaacacgagtataaatgtgattctgagattctgtataacaatcacaagtttactaatgcaagcaaaattatcaagacggacttcggttcccctggagagcctcagatcattttctgtaggagcgaggccgcgcaccaaggagtgatcacttggaaccctccccaacggagcttccataatttcacactttgttatatcaaggagactgagaaagactgcctgaatttagacaagaacctaatcaagtacgacctgcagaatctcaagccctatacaaagtatgtcctgtctctgcatgcgtacataatcgcgaaagtgcagcgaaacgggagcgcagcaatgtgccattttaccacaaagagcgcaccaccatcccaggtgtggaatatgacagtatctatgacaagtgacaactctatgcatgtgaaatgcaggcccccaagagaccggaacggccctcacgagcgataccatctggaggtggaggccgggaatactctggtgagaaatgagtcacacaagaactgtgattttcgagtcaaagacttacagtactcaacagattacacgtttaaagcctactttcataacggcgattacccaggagaaccatttatactgcatcactccacaagttataatagcaaagcgttgattgccttcttggctttcctgataatagtgactagcatcgctttactcgttgttctgtacaagatatacgatctgcacaaaaaacgtagctgcaacctcgatgagcaacaagagctggtcgagcgggacgacgaaaaacaattgatgaacgttgaacctatccacgccgacatactcctggagacttataagcgaaagattgccgatgagggacgcctcttcttagctgaattccaatcaattccccgggtgttctccaaattccctattaaggaagctcgtaagccatttaatcaaaataagaaccgatatgttgacatccttccttatgactacaatagggtggaactgagcgagataaatggcgatgccggcagcaattacattaatgctagctacatagatggattcaaggaacctcgcaagtatatcgcggctcagggcccccgggacgagacagtagatgacttttggcgcatgatttgggagcagaaggcgacagtgatagtgatggttacacgatgtgaagagggcaatcggaacaaatgcgccgagtactggccctctatggaggagggaacacgcgcttttggagacgttgtggtgaaaatcaaccaacacaaacgttgccctgactatataattcagaagctgaacattgtcaacaagaaggagaaagccacgggcagagaagtcacccatatccagttcacttcttggcctgatcacggggtccccgaggacccacacctgctgttgaaactgcggaggagagttaacgccttttccaacttcttctcggggccaatcgtggtgcactgcagtgctggagtcggacgcaccggaacatacattgggattgacgctatgttggagggcctggaggccgagaataaggttgacgtgtacggatacgttgtgaaactgagaagacagcgatgtcttatggtccaggtggaagctcagtatattcttatccatcaggcactcgtagaatacaatcagtttggcgaaaccgaagtcaacctgagcgagctgcacccttacctgcacaacatgaagaagagggacccaccttcagaaccatcaccgctcgaagccgagtttcagagattgccctcataccgtagttggcgaactcagcacatcggtaaccaggaggagaataagagtaaaaaccgcaatagcaacgtgattccatatgattacaacagggtcccacttaagcatgaacttgaaatgtctaaggaatctgagcacgacagtgatgagtcctcggacgacgactctgatagcgaggaaccatctaagtatatcaatgcctcgttcattatgagttactggaaacctgaggtgatgatcgccgcacaaggcccacttaaagaaactatcggcgacttctggcaaatgatctttcagagaaaggtgaaagtgattgtgatgctcacagagctcaaacacggtgatcaggagatctgcgcccagtattggggtgaggggaagcagacttacggagatattgaggtcgatcttaaagacacagacaagagtagtacatacaccctgcgcgtcttcgagctccggcacagcaagcgtaaggacagccgcactgtgtatcaatatcagtacacaaattggtccgtcgagcagctgcctgctgagccgaaagaattaatctctatgatccaggtcgtgaaacagaaactgccccagaaaaacagctcagagggtaacaaacatcacaaatccacacctcttctcatccactgtcgcgatggcagccaacagactggaatcttttgcgcactgctcaatcttttagagtccgctgaaaccgaggaggtggtagacatcttccaggtggtgaaggccttgcgcaaggccaggcccggcatggttagcacattcgaacaataccagttcctctacgatgttattgcgagtacataccccgcccaaaacggacaagtgaagaagaataaccatcaggaagataagattgaattcgacaacgaggtggacaaagttaaacaggacgctaactgcgtaaacccattgggagctccagagaaacttcctgaagcaaaagaacaggcagaaggtagcgagccgaccagcggcactgaaggacctgaacactcagtaaacgggccagcatccccagccttaaaccaaggctcatag

SEQ ID NO: 25888 - DNA, 3771 bp, Artificial Sequence
  Description of Artificial Sequence: Synthetic coding sequence
atgtacctgtggctgaagctgctggccttcggcttcgccttcctggatacagaggtattcgtgactggccagtcaccaaccccctctcccacaggtctgaccacagctaaaatgccatctgttcctctaagctctgatccactgccgactcacacaaccgccttttcgcccgctagcacattcgaacgagagaacgacttctcagagacaaccacatctctcagccctgacaacacatccacacaagtcagtccagactcactagacaatgcgtctgccttcaacaccactggagtatcatcagtgcagactccacatctccccacccacgccgactcacagacacctagtgccggcactgacacacagaccttttccggcagcgccgcaaatgctaagctgaacccaactcctgggtcgaacgctatttctgacgcctatctcaacgcttccgaaaccaccactctttcgcctagtggatcagctgtcatttccacaacaaccatcgctacaacccctagtaagccaacttgcgatgagaagtacgccaacatcaccgtcgactacctgtacaataaagagactaagctgttcaccgctaagctgaacgtgaacgagaatgtcgagtgtggaaacaacacatgtaccaacaacgaagtgcacaacctaacagaatgtaagaacgcatctgtatctattagtcacaatagctgtacggctcccgataagacacttattctcgacgtccctcccggtgtcgagaaattccaactgcatgactgcactcaggttgagaaggccgataccaccatttgcctgaaatggaagaacatcgaaaccttcacctgcgatactcaaaacataacttatcgatttcagtgcggtaatatgatcttcgacaacaaggaaatcaaactcgaaaatctcgaacctgaacatgagtataaatgtgactcggagattctctacaacaaccacaagtttactaatgcatctaaaatcatcaagaccgatttcggcagtcctggagagcctcaaattatattttgcaggtcagaagccgcacatcagggcgtgatcacgtggaaccctcctcagaggagcttccacaattttaccctgtgctatattaaagaaaccgagaaagactgcttgaatctcgataagaacctgattaagtatgacctgcagaacctgaagccatacaccaagtacgtgctcagcctgcacgcgtatattattgcaaaagttcagcgcaacggttctgctgcaatgtgccatttcacaacgaagtccgcccccccatcacaagtgtggaatatgacagtgagcatgacatccgataacagcatgcacgtcaagtgccggcccccaagagacaggaacggaccacacgagcgctaccatctggaagttgaggctgggaacacgctggtgagaaacgagtcacataaaaactgcgacttccgcgtgaaagacctgcagtacagtaccgactatacctttaaggcatactttcacaatggagactaccccggagagcctttcatactgcaccactccacatcctataacagtaaggccttaatcgctttcttggcgtttctgataattgtcacgtccatagctctcctggtggtgttgtataaaatatatgacctgcataaaaaacgctcttgcaatctggatgagcagcaggaactggtggagagagacgatgagaaacagctaatgaacgtggagcctatccatgccgacattctcttggaaacctacaagcgaaagatcgcagatgaggggagacttttcctagcagagttccagtccataccaagagttttttctaaattcccaatcaaagaagctagaaagccctttaaccagaataagaaccggtacgtggacatcttgccttacgactataacagagtcgagctcagcgagatcaatggcgacgcaggcagcaactacatcaacgctagctatattgatggtttcaaggaaccccgtaaatatatcgctgcacaggggccacgagacgaaactgttgacgacttctggagaatgatctgggagcagaaagcaaccgtgattgtgatggttacacgatgcgaggagggtaaccgcaacaaatgcgctgaatattggcccagcatggaggaagggacccgtgcgttcggcgacgtggttgttaagatcaatcaacataagagatgtccagattacataatccagaagttgaatattgtaaacaagaaagagaaggccacaggacgagaggtgacccatattcagtttaccagctggccggaccatggcgttcccgaggatcctcacctgctgctcaagttacgccgtagggtgaacgctttctccaactttttttctggtccgatcgttgtgcattgcagcgcaggtgtgggtcggacgggaacatatattggcatcgatgcaatgttggagggtcttgaagccgaaaataaagttgatgtctatggctacgttgtgaagttacgacgccaacggtgccttatggtccaggttgaagctcagtatatactaatccaccaggcactggtggaatataaccagttcggagagactgaagtgaatctttcggagctgcatccttatcttcacaatatgaaaaaaagggatcctccatctgaaccgagcccgctagaggccgagttccagcggttgcctagctacaggagctggagaacgcagcatatcgggaatcaggaggaaaataagagtaagaacaggaattccaacgtgattccttatgattataatcgcgtgccactaaagcatgaactggaaatgtctaaagaatccgaacacgacagcgatgaaagctcagacgatgattctgactcagaagaaccctctaaatatatcaacgcgagcttcattatgtcttattggaaaccagaagtaatgatcgccgctcagggtccgctgaaggaaacaatcggcgatttctggcagatgatatttcagaggaaagtgaaggtgatagtgatgctcaccgagctaaagcacggggaccaggagatctgtgctcagtattggggtgagggcaagcagacatatggagatattgaagtggatctcaaagatacggataagagctcaacctatactctgagagtgttcgaactgagacactcgaaacgcaaagactcccggacagtttatcaatatcagtacactaactggagtgtggagcagctacccgcggagccaaaagaacttatctccatgattcaggtcgtaaagcagaagctgccccagaaaaactccagtgaaggtaataaacaccacaagtcaaccccattactcattcattgtcgggatggcagtcaacagaccggcatcttctgcgccctactcaacctattagagtccgccgagactgaggaggttgttgacattttccaggtggtcaaggccctgagaaaggcgcgccccgggatggtatctaccttcgagcagtatcagtttttgtatgatgtcattgcctccacttaccctgctcagaatgggcaagttaagaagaacaaccaccaggaggataagattgaattcgataacgaagtggacaaagtgaaacaagatgctaattgtgtgaatccactgggagcacccgagaagttgcccgaggccaaggagcaggccgagggttccgagccaacatcaggcaccgagggacctgagcatagcgtcaatggcccagcctcaccagcccttaaccagggctcatag

SEQ ID NO: 25889 - DNA, 2208 bp, Artificial Sequence
  Description of Artificial Sequence: Synthetic coding sequence
atgaccatgtacctgtggctgaagctgctggccttcggcttcgccttcctggacacagaggtgttcgttaccggccagtcaccgaccccttcgcccacgggagtaagcagcgttcagacgccacatctgcccactcacgccgacagccagactcccagcgcaggaactgacacccagactttcagtgggtcagctgctaacgctaagcttaacccaacacctggttccaacgccatttccgacgttcctggcgaacggtcaacagccagcaccttccctactgatccagtatcccccctgacaaccaccctcagcctggcacatcacagtagcgctgccttgccagccaggaccagcaataccactataacagcgaacacatccgacgcctacctgaacgcaagcgagacaaccacgctcagtccctctggcagtgccgtgatttctaccactaccattgccactaccccctctaaacccacctgcgatgagaaatacgcaaatattacagtggattatctctacaataaagaaactaaactcttcaccgcgaaattgaatgtaaatgaaaacgtggagtgtgggaacaacacgtgcacaaacaatgaggtacataatctgacggagtgcaagaacgctagtgtctcaattagccacaatagttgcacggcaccagataagactctcatattagatgtcccgcctggcgttgaaaaatttcagttgcacgattgtacacaagtggaaaaggcagacactaccatttgcctgaagtggaaaaacattgagacctttacgtgcgacacacaaaatattacctaccgctttcagtgtggtaacatgatcttcgataataaagagatcaagctggagaacctggagccagaacatgaatataagtgtgactctgagatcctctataataaccataagtttaccaatgcaagcaaaatcataaaaactgattttggctcacctggtgagccccagatcatattttgccggtccgaagcggcccatcagggggtgatcacttggaatcctccccagagatcctttcacaactttaccctctgttatattaaagagaccgagaaagactgtcttaacctcgataaaaacctgatcaagtacgacctacaaaacctcaaaccatacacaaagtatgtgctatctttgcacgcctatattattgctaaagtccagcgaaatggctctgccgccatgtgtcattttacgaccaagtcggccccaccttcccaggtctggaacatgacagtgagcatgacaagcgataattccatgcacgttaagtgccgcccccctagggaccggaacgggccacacgagagataccacctggaggtcgaggccggcaatactcttgtacgaaatgaatcccataaaaactgcgattttagagtaaaggacctgcagtattctactgactacacatttaaagcttacttccataatggagactaccccggtgaacctttcattctgcaccattccaccagctataactcaaaggctctcatcgcctttctcgctttcctgattatagttacttccatagccctcctcgtggtgttgtataagatatacgacctgcataagaaaagaagctgcaatctggacgagcagcaggaactggttgagcgcgatgatgaaaagcagctcatgaatgtggagcctatccacgcagacatccttctggagacatataaaagaaaaattgccgatgaggggcggctgttcctcgcggagtttcaatccatcccaagggtgttttctaagttccccattaaggaagctcgtaagccatttaatcagaacaaaaaccggtatgtggatatcctaccatacgactataaccgcgtggagctatctgagattaacggagatgcagggagcaactacataaatgcttcctacatcgacggcttcaaagaaccccggaaatacattgccgcacaggggccgcgcgatgaaaccgtcgacgacttctggcgcatgatttgggaacagaaggcaacagtcattgttatggtaactagatgtgaggaaggcaaccgcaacaaatgcgcagaatactggcctagcatggaagagggcacacgcgctttcggagatgtagtagttaaaattaatcagcataaacgttgtcctgactatataatacagaagttgaacatagtaaactag

SEQ ID NO: 25890 - DNA, 2202 bp, Artificial Sequence
  Description of Artificial Sequence: Synthetic coding sequence
atgtacctgtggctgaagctgctggccttcggcttcgccttcctggatacagaggtgttcgtcacaggtcaatctcccaccccaagccctactggcgtatcttctgtacagacgccacacttgccgacccatgcggacagtcaaaccccatccgccggtactgatacacagacattttctgggtccgctgcgaacgccaaactgaacccaacacctggctcaaacgccatcagcgacgtgccaggtgagaggtccactgcatccacatttccgactgaccctgtgagtcctctcacaacaactctatccctggctcaccattccagtgccgcactgccggcccgcacaagtaacactactattacagccaataccagcgacgcatatttgaacgcatctgagaccacaaccctgtccccgtctggcagtgcagtcatatcaaccacaaccattgcaaccacaccgtcgaaaccgacctgtgatgagaagtatgccaatataaccgttgattacctgtataataaagaaactaagctgtttacagccaaactgaacgttaacgagaacgttgagtgcggaaacaacacatgtactaataatgaggtacacaatttaactgaatgtaagaatgctagtgtgtctatctctcataatagttgcaccgccccagataagaccctcatcctcgatgtgccaccgggcgttgaaaagttccagctgcacgattgcacacaggtagagaaagccgataccacaatttgccttaagtggaaaaacatagaaacctttacctgtgacactcagaatattacctaccggtttcagtgcggcaatatgatcttcgacaacaaggaaatcaagctcgagaatttagaacctgaacatgaatacaaatgtgattccgagatcctctataataatcataaatttaccaatgcttcgaaaatcattaaaacagacttcggttcacccggagagccacagattatattttgcaggagcgaggccgcgcaccagggagtgattacctggaacccgcctcagagatcattccataatttcacactttgctatatcaaagaaactgagaaggattgtctgaacttggacaagaacctaattaagtatgacctacaaaatctgaagccctatactaaatatgttctgtccctgcacgcttacatcatcgcaaaggttcaaagaaatggctccgcagccatgtgtcacttcaccacgaagtccgcccccccgtctcaggtctggaacatgacagtgagcatgacatcggacaattccatgcatgtaaaatgcaggccacctagggatcggaatggcccccacgaacggtaccatctcgaggtcgaggccggaaatacgctggtaaggaatgagagccacaagaattgcgactttagggtcaaggacctgcagtatagtactgactatacctttaaggcatactttcacaacggcgattacccaggcgaacctttcatcctccaccactctacttcatataactctaaggctctgatcgcttttctcgcttttctgattatagttaccagcatagcccttctcgttgtcctgtacaagatctacgacctgcacaagaaacgcagttgcaacctggacgagcaacaagagcttgtggaacgcgatgatgaaaaacaattaatgaatgtggagcctatccatgccgacatcctgctagagacctataagagaaaaattgccgacgaaggtcggttgttcctagccgagttccagtcaataccaagagtattttcaaagttcccgataaaggaggcgaggaagccattcaatcagaataaaaatcgttacgtagacatattgccctacgactacaaccgtgtcgagctgagcgaaattaatggggatgccggctccaattacataaacgcgagctacatcgacggatttaaggagcctaggaaatacattgcagcccagggaccccgcgacgaaaccgttgacgatttttggaggatgatctgggagcaaaaggccacagtgatcgtcatggttactagatgcgaggaggggaacagaaacaaatgtgcggagtattggccatccatggaagagggaacccgggccttcggagacgtggtagtcaagatcaaccagcacaaacgctgccccgattacatcatccaaaaattaaatattgttaattag

SEQ ID NO: 25891 - DNA, 3921 bp, Artificial Sequence
  Description of Artificial Sequence: Synthetic coding sequence
atgaccatgtacctgtggctgaagctgctggccttcggcttcgcctttctcgacaccgaggtgtttgtgacgggtcagagtcctactccaagtcccactggcctgacgacagccaaaatgccgagcgtcccccttagctcagacccccttcctacgcatacaacagcctttagccccgcctccacttttgagcgtgagaacgacttttcagagacgaccacctcactgtccccagacaatactagtacgcaggtgtctcctgacagcctggataatgcatcagctttcaatactaccggtgtgagtagtgtccagactccccacctacctactcacgctgactcccagacgccatcagctggtaccgatacgcagaccttctccgggtccgccgcaaatgcaaagctaaaccctacccctggctccaatgccatctccgacgtccccggggagcgctcaacggcgtcgacatttcctaccgatcctgtgagtcctttgactacgaccttgagcttagcacatcactctagcgccgctctgccggctcgcacatctaatactactattacggccaatacttcagatgcttacttgaatgcttccgagacaactacactgtcgcccagcgggtccgcagtgatttcaactaccactatcgctactactccttcaaaacctacatgcgacgagaaatatgcgaacatcactgtagactacctgtacaataaggaaaccaagctttttacagcaaagctgaatgtgaatgaaaatgtggagtgtggtaataatacttgcaccaacaacgaagtgcacaatctgaccgagtgcaagaacgccagcgtctctatctctcacaacagctgcactgcccccgacaagactcttatcctagacgtcccccccggcgtcgagaagtttcagctccatgattgcacacaggtggagaaagctgatacgactatctgtctgaagtggaagaacatcgagactttcacttgtgacactcagaatattacttaccggtttcagtgtgggaatatgatttttgacaacaaggaaattaagctcgagaacttggaacctgaacatgagtataaatgcgatagcgagatcctctacaataaccataagttcactaatgcctccaaaattatcaaaaccgatttcggatcacctggtgaaccacaaataatcttctgccggtccgaggcggctcatcaaggagtaatcacgtggaaccctcctcagagaagttttcacaactttactctgtgctacatcaaggagaccgaaaaagattgcctcaacctggataaaaacctgattaaatacgacctacagaacctcaagccttatacaaaatatgttctatccctccacgcttatatcatcgccaaggtgcagaggaacggatccgcggctatgtgtcactttacaactaagtccgcacccccatcgcaggtgtggaatatgacagtttccatgacttccgacaactccatgcacgttaagtgcaggcctcccagagatcgaaatggccctcatgagcgttatcatctggaagtcgaggccgggaacaccctagtgcggaacgagagccacaagaattgcgatttccgcgtgaaggatctgcagtactcaaccgactacaccttcaaggcctatttccacaacggagattatcctggcgagcctttcatactgcaccactccacctcatacaactcaaaggctctcatcgccttccttgcatttttgataatcgtcacaagcatcgctctactggtggtgctgtacaagatatatgatttgcataaaaagaggtcctgcaacctggatgaacaacaggagctggttgagagagacgatgaaaagcagctcatgaatgttgagcctatccacgcagatatcctgttagaaacttacaaacgaaaaatcgctgatgagggtaggcttttcctagcagagttccaatccatcccccgagtgttctccaaatttcccatcaaggaagccagaaagccctttaaccagaataagaatagatacgtggacatcttgccgtatgactataaccgcgtggagctcagcgagattaatggagacgctggctctaattacatcaacgctagctacatcgacggcttcaaagaaccgaggaaatacatcgctgctcaggggccgagggacgaaacggtcgacgatttttggagaatgatctgggagcagaaagcaaccgttattgtcatggttacccgctgtgaagaggggaatcggaacaagtgtgcagagtactggccatccatggaggagggaaccagagcctttggagacgtcgtggtaaaaatcaatcagcacaaacgatgccccgattatattattcaaaaacttaacattgtgaataaaaaagagaaagccacaggtcgcgaggtgacccatatccagttcacctcatggcctgaccatggggtacccgaagatccgcacttgctgctgaagcttcgccgcagggtcaatgcatttagcaatttcttcagcggaccgatcgtagtacattgctcagccggcgtcggaaggacgggcacgtacattgggattgatgctatgctcgaaggattggaggcagagaacaaggtggacgtatacggatacgtcgtaaaactgcggcgccagcgttgcctgatggtgcaggttgaggctcaatacatcttaatccatcaggcgctggtggaatacaatcagtttggggaaacggaagtcaacctatctgaactccacccatatctccacaacatgaagaagagagatcctcctagcgagccatcaccccttgaggccgagtttcagaggctcccgagctacagatcttggcgaacccagcacatcgggaaccaggaggaaaataaaagtaagaacaggaacagtaatgtgataccctatgattataatcgggtgcctcttaagcatgaactggagatgagcaaagagagtgagcacgattcggatgagtctagcgatgatgattccgacagcgaggagcccagtaagtacattaacgctagctttatcatgtcatactggaagcctgaggtgatgattgccgctcaaggccccctgaaagagaccatcggggatttctggcagatgatcttccagcgcaaggtaaaagtcatcgtcatgttaactgaactgaaacacggggaccaagaaatctgcgcccagtattggggcgaagggaagcagacttacggagacatcgaggtcgatctaaaagatacggataagagttctacctacactttacgggtgttcgaactccgacattccaagaggaaagactcccgtacagtctaccagtatcaatataccaattggtccgtggagcagctccccgctgaacccaaagaactgatctccatgatccaggttgtcaagcagaagctcccacagaaaaactcttctgaggggaataagcatcacaagagtacacccctgttaatccattgccgcgacgggtcgcagcagactgggattttctgtgcactgcttaatttgctcgagagcgctgagactgaggaagtggtcgacatattccaagtggtgaaggcgctgcgcaaggcacgtcctggcatggtgtccacatttgagcaatatcaatttctgtacgacgttatagcatccacttatcccgcgcagaacggccaagtgaaaaagaataatcatcaggaggacaaaatcgaatttgacaacgaggtggataaggtgaaacaagatgctaattgtgttaacccacttggcgcgccggagaagctccctgaggccaaggagcaagcggagggctctgagccaacaagtggtacagaaggtccagagcattcagtgaatggccccgcaagccccgccctcaaccagggttcttag

SEQ ID NO: 25892 - DNA, 441 bp, Artificial Sequence
  Description of Artificial Sequence: Synthetic coding sequence
atgtacctgtggctgaagctgctggccttcggcttcgccttcctggatacggaagtattcgtaacaggacagagcccgacgccatcacccaccgacgcgtacctgaacgcaagcgaaacaacgacgcttagcccttccggcagcgcagtgatttcaacgacaaccatcgcgaccaccccgtccaaacccacttgtgacgagaaatatgcaaacattacggttgattacctgtataacaaggagaccaaattattcaccgccaagctaaacgtgaacgagaacgtagaatgcggcaataatacttgcaccaataacgaggtgcacaacttaactgagtgtaagaatgccagtgtcagcatatctcataatagctgtaccgcccccgataagaccctcatcctggatgtccctcctggcgttgaaaagtttcaactccactag

SEQ ID NO: 25893 - DNA, 351 bp, Artificial Sequence
  Description of Artificial Sequence: Synthetic coding sequence
atgtacctgtggctgaagctgctggccttcggcttcgccttcctggataccgaagtctttgtgaccggccagtcacccaccccttcccccaccggactgaccaccgccaagatgccgagcgtgcctctgagttcggaccctctgcctactcacaccactgcttttagccctgcgagcacattcgagcgagagaatgatttttccgaaacaactaccagcctgagccctgataacaccagtacccaggtgtctccagattcactcgataacgcctccgcctttaacacaactggagtgtctagtgtgcaaactccccatcttccgacccacgcagattcccagacaccctag

SEQ ID NO: 25894 - DNA, 3915 bp, Artificial Sequence
  Description of Artificial Sequence: Synthetic coding sequence
atgtacctgtggctgaagctgctggccttcggcttcgccttcctggataccgaggtcttcgtcactggtcagtcacccaccccatcccccacagggttgaccaccgccaaaatgccttctgttcccttgtctagtgaccctcttcccacacatactaccgctttcagccctgcgtcaacttttgagcgcgagaacgatttcagcgaaacaactacatccctcagcccagataatacttccactcaagtttctcctgattcactggacaatgcctccgcgttcaacaccaccggggtgtcttctgtgcagactccccatctcccaacccatgcagatagtcagacgccttccgccggcaccgacacccagactttctccggaagcgcagccaatgccaagttgaatccaacaccagggtcaaatgctatatccgatgtccctggggagcgctcgaccgcctccaccttccccactgatccagtatcacctctgaccactaccctgtctttggcccatcactccagtgcagcactgcccgccagaaccagcaatactacgatcacagctaacacctcagatgcctacttgaatgcttcggagactactaccctctcaccctcgggcagtgctgtgatctccacaaccacaatcgcaaccaccccgtccaaacccacctgtgacgaaaagtatgctaacattaccgtagattacttgtacaataaggaaaccaagttgtttacagccaagctaaatgtgaacgagaatgtggagtgtggtaacaatacatgtactaataatgaggttcacaacctcaccgagtgtaagaatgcatccgttagtattagccacaattcctgcactgcccccgataaaactcttattctggacgtcccaccaggagttgagaagtttcagttgcacgactgcacacaggtcgaaaaagctgacaccaccatctgtctcaagtggaaaaacatcgagacgttcacttgtgatactcaaaacatcacctaccgatttcagtgcggcaatatgatcttcgacaacaaggaaatcaagctcgagaacttagagcccgaacacgaatacaaatgcgactctgagatactgtacaataaccacaaatttactaacgcatcaaaaatcattaaaacggatttcggctcccccggcgagcctcagatcatcttctgtcggtccgaggctgcacatcagggtgtaattacctggaacccaccccagcgatcatttcataattttactctttgctatattaaagaaacggaaaaagattgtctgaacctggataagaatttgatcaagtacgacctacagaaccttaagccatacaccaagtacgtgctgagcctgcacgcttacattatcgcaaaggtccagcggaatggctcggcagctatgtgtcacttcactaccaaatccgcccctccatcacaggtctggaacatgaccgtgtccatgacatctgataacagtatgcacgtgaaatgtagacccccccgcgataggaatggtccacacgagaggtaccacttggaagtcgaggccggtaataccctggtgaggaatgagagccataagaactgtgacttcagggtaaaagacctccagtactccaccgattacacttttaaggcctactttcacaatggggactaccctggggaacccttcatcctccatcacagcacaagttacaactcaaaggctctgatcgcctttctggcatttctgatcatcgtcacttctattgccttgctggtggttctctataagatctacgacctgcataagaagcgctcttgtaacctagacgagcagcaggagttggttgagcgggatgatgagaagcaactcatgaatgtggagccaattcacgctgacatcctcctagagacctacaaacggaaaatcgctgacgagggccgcctttttttggcagagttccagtcaatcccccgcgtcttcagtaagttccctatcaaagaggctcgcaagcctttcaatcagaacaagaacaggtacgttgacatcctcccctatgactacaacagagtggagttatctgagatcaatggcgatgcaggtagtaattacattaacgccagctatatcgatgggttcaaagagccacgcaaatacatcgccgcccagggtccgagagacgagaccgtagatgatttctggagaatgatctgggaacaaaaggctaccgtgatcgttatggtcacccgatgtgaggagggtaacaggaacaagtgtgccgaatactggccatctatggaagaggggacaagagcgttcggggacgtggtagttaaaatcaatcaacacaaaagatgcccggactacattatacagaaactgaacatcgttaacaaaaaggagaaagctaccgggagagaagtcactcacattcagtttacgtcatggcctgatcatggggtcccagaagatcctcacctgttactgaagctgagaaggcgagtcaatgcatttagtaactttttttctggtccgatcgtcgtccattgttctgccggagtaggccggacagggacatatatcggcatcgatgctatgttggaagggctcgaggccgagaataaggtggatgtctatggttatgttgtaaagttacgcagacaacgctgcctgatggtgcaggtggaggcccaatatatcttaatacatcaagctctggtggaatataatcagttcggagagacagaagtgaacttgagtgaactgcacccctacctgcacaatatgaaaaagagagacccgccgtctgagccttcacccctcgaggccgagttccagcggttaccctcatacaggagttggcgaacacagcacatcgggaaccaagaggaaaacaagtcaaagaatcgaaactccaatgtgattccctatgactacaatcgggtgcctttaaaacatgaattagaaatgtccaaggagagtgagcatgactcagacgagtcatctgatgatgacagtgactccgaagagccttccaaatacataaatgcttcatttattatgtcttactggaagccggaagtgatgatcgccgcgcagggtccgttaaaggagaccatcggcgatttctggcaaatgatatttcaaagaaaggtcaaagtgattgtgatgctgaccgaactcaaacacggtgatcaggagatttgcgctcagtactggggggaggggaagcagacatatggcgacatcgaagtggacctgaaagacaccgacaagtcaagcacctacaccctgagagtgttcgagctaagacactcaaagcggaaagattctcgcactgtgtatcagtatcagtatactaactggtctgtggagcagctgccagctgaacctaaagagctgatttcaatgatacaggtggtcaaacagaagcttccccagaaaaactctagcgaaggcaacaagcaccacaagtcgacgccgctattaattcactgcagggatggttcccagcagaccggcattttctgcgccctcctcaatctactggagtcagccgagaccgaagaagtcgttgacatcttccaagttgtgaaagccctcaggaaggccaggcctggtatggtatcgacatttgagcagtaccaatttctgtacgatgttattgctagcacctacccagcccagaacggtcaagtgaaaaaaaacaaccatcaagaggataagatagagtttgacaacgaggtagataaggttaagcaggatgctaattgtgtcaatccactcggggcccctgagaagctgccggaagctaaggagcaggctgagggatccgaacccacctcaggcaccgagggtccggagcactcagttaacggcccagccagcccagcattgaatcaggggagctag

SEQ ID NO: 25895 - DNA, 1797 bp, Artificial Sequence
  Description of Artificial Sequence: Synthetic coding sequence
atgtacctgtggctgaagctgctggccttcggcttcgccttcctggacacagaagtctttgtgacaggacaaagcccgaccccctctccaactggggtgtcctcagtccaaaccccacatctccccacccatgctgactcccagactccaagcgccggaactgacacccaaacatttagcggcagcgcagccaacgctaagcttaatccgacccccggttcaaacgctatcagtgacgcttatctgaacgcctccgagacaacaaccttgtccccttcagggagcgctgtgattagcaccacgacaatcgcaaccactccgtctaaacccacctgcgatgaaaaatatgccaatattacggtggactacctctacaataaggaaactaaactgtttacggccaaactgaatgtgaatgaaaatgtggagtgtggcaataatacctgcaccaataacgaggttcataatcttacagaatgtaagaacgccagcgtatccatatcacataatagctgcaccgcacctgataagacgctcattctcgatgtgccccccggagtggagaagttccagctgcatgactgcacacaggtggagaaagcagacacaaccatttgtctgaaatggaagaacatcgaaacgttcacctgtgacactcagaatattacctatcgcttccagtgcggtaacatgattttcgacaacaaagagattaagcttgagaatctggagccggaacatgaatacaaatgcgattccgagattctttataataaccataagtttactaatgcaagcaaaattataaagacagattttgggtcaccaggcgaaccccagatcatcttctgtcgctcagaagctgcccaccaaggcgtcattacatggaatccaccacagcgcagcttccataactttactttgtgctatatcaaggagacagagaaggactgcctgaacctggacaaaaatctgattaagtacgatctccagaaccttaagccctacactaaatacgtgctttccctacatgcatacataatcgctaaggttcagcgcaacgggagtgcggcgatgtgccatttcaccacgaaatctgccccccccagccaggtgtggaacatgaccgtctcaatgactagcgacaactcaatgcacgtcaagtgccgccctccgagagaccggaatggcccacacgagagatatcatctggaggtggaagcaggaaacactctggtgcgcaatgagagccacaaaaattgcgattttagggtcaaggatttgcaatacagtacggattacacattcaaagcatactttcacaatggggactaccctggcgagcctttcatactgcaccacagtacctcttacaacagcaaagccctgattgctttccttgctttcctgattattgtaacttctatagctctgctggtcgtactctacaaaatctacgacctgcataagaaacggagctgcaatctggacgagcagcaggaactggtggaacgagacgacgagaaacagctgatgaatgtggagcccattcatgccgatattctgctggaaacttataaacggaagatagcagacgaagggaggctgttcctggctgagtttcagtctatccctagagtcttctcaaaatttccgatcaaagaggctcgaaaaccttttaaccagaataaaaatagatatgtggacattctgccttacgattataatcgcgtggaactgtcagagattaacggcgacgctggcagtaactacataaacgcaagctacatcgactag

SEQ ID NO: 25896 - DNA, 2271 bp, Artificial Sequence
  Description of Artificial Sequence: Synthetic coding sequence
atgtacctgtggctgaagctgctggccttcggcttcgccttcctggatactgaggtgtttgtgaccgggcagtctccaaccccaagtccaaccggcctcacaacagcgaagatgccatccgtgcctctctcctccgatcctctgccgacacacactaccgccttctctcccgcgagcacctttgagagagaaaacgacttctctgaaactacaacctcactatctcctgacaacaccagcactcaggtgagcccagacagccttgataatgcctctgctttcaataccactggcgtatcgtcggtccagactccgcacctgcctacacacgccgacagtcagacaccatctgctggcacagacacacaaactttctcgggctcggctgctaacgcgaagctgaatccaacccctggatcaaacgctataagtgacgcgtatcttaacgcctctgagactacaacactgagtccatccggctcagccgtgatatccacaactactatcgccacaaccccgtctaaaccaacatgcgatgaaaagtacgctaatataaccgttgactatctttacaacaaagagactaaacttttcaccgccaaactgaacgtaaacgagaacgtcgagtgcggtaataacacgtgcacgaataacgaggtgcacaacctcaccgagtgcaagaacgcctctgtgtcaatttctcacaatagttgcactgcacccgacaaaaccctaatcctggacgtccccccgggtgtcgaaaagtttcagctacacgactgtacccaggtcgaaaaagccgataccactatatgcttaaaatggaagaatatcgaaacctttacatgcgatacccagaacattacctacagattccaatgtggcaacatgatctttgataataaagagatcaagctggagaacctggaacccgaacacgaatacaaatgcgattctgagatactctataacaatcataagttcaccaatgcctccaagatcatcaaaacggattttggatccccaggagaaccacagattatcttctgtaggtccgaggccgcccaccagggagttattacctggaacccgccccagaggtctttccacaacttcaccttgtgttacataaaggaaactgaaaaggattgccttaacctggataagaacctgattaaatatgatctgcagaacctcaaaccttatactaaatacgtcctatctctccatgcctacattatcgctaaggttcaacgcaacggttcagctgccatgtgccattttacaacaaagtctgctcccccctcccaggtgtggaacatgaccgtcagcatgacaagcgataattcaatgcacgtgaaatgcagaccccccagggacagaaacggccctcatgaaagataccacttggaggtggaggctggaaatacactcgtccggaacgagagccacaaaaactgcgatttcagggttaaagaccttcagtatagcacagactacacatttaaagcgtactttcacaacggcgactaccccggggagcctttcattttgcatcatagtacctcttacaactctaaggccctaattgcttttctggccttcctgattatcgtaacctcaattgcactgctggtggtgctgtacaagatttacgacctccataagaaaagatcctgcaatcttgacgaacagcaggaactggtggagcgggacgatgagaagcagctgatgaacgtcgaaccaatccatgcagacattctgttggaaacgtataagagaaagatcgctgatgaggggcgcctgttcctggccgaattccaatccattcctcgggtgttttccaagtttccgattaaggaagctcgcaaaccctttaaccagaacaagaacaggtacgtggatatccttccctatgactataacagggtggagttgagtgaaattaacggcgacgctggttcgaactacattaatgcatcctatattgatggatttaaagagccccgcaaatatattgctgcccaaggcccaagggatgagactgtggacgatttttggagaatgatttgggagcagaaggcaaccgtcatcgtcatggttacccggtgcgaagagggaaaccgcaataaatgtgcagaatactggccatctatggaggagggcacccgagcctttggcgatgtcgtggttaagattaaccagcacaaaaggtgcccagactatattatccagaaacttaatatcgttaataagcagaagagtaagtag

SEQ ID NO: 25897 - DNA, 1662 bp, Artificial Sequence
  Description of Artificial Sequence: Synthetic coding sequence
agcgactacatgatcatcaagaagaagagcaactacgaggtgctggaaaaggatgtgggcttgaaacggttttttcctaagtcactccttgactctgtgaaggccaagacactgcgaaaattgatacagcagactttcagacagttcgcaaacctgaaccgggaggaatccatcctcaagttcttcgagatcctgtctcctgtatatcggtttgacaaagagtgtttcaaatgcgccctgggaagctcttggatcatctcggttgagctggcgatcgggcccgaggaagggatctcttatctcacagataaaggctgcaatccaacccacctcgccgatttcacacaagtccagaccatccagtattccaactctgaggacaaggacagaaaaggcatgctgcagcttaaaatagccggggcccctgaaccgctcactgtgaccgctccatccctgacaatcgctgaaaatatggctgatctgatcgatgggtactgtcgtctggtcaacggaacctcgcagtctttcatcatccggccgcagaaggaaggtgaacgtgcactgccatccattcctaagcttgcaaattcggagaagcagggcatgcgaacacacgcggtgtctgtgtcagaaacagacgattacgctgaaattattgatgaggaggacacctatacaatgccctcaacacgcgattacgagatacagcgcgagcgaatcgaactggggcgttgtatcggcgaggggcaatttggtgacgttcatcagggaatctatatgagtccagaaaatcccgctctggctgtggcgattaagacttgtaagaactgcacgagtgacagcgtcagggagaagtttctgcaagaggcgtgccattacacctcactgcactggaattggtgtcggtatatttcagacccaaatgtggattgtcctgatccccggaatgccgaagtcaccatgagacagtttgatcaccctcatattgtaaaactgattggagtcattacggagaatcccgtgtggataataatggagctctgtactctcggggagcttagatcgtttttacaggtgagaaaatattctctggacctcgcctctttaatcctttacgcctaccagctcagcactgctttggcttacctggagtcgaaaagattcgtgcaccgggatatcgctgctcgcaatgtgctggtgtctagtaatgactgcgtaaaactcggtgattttggcctatccagatacatggaagatagtacatactataaggcctctaaagggaagctgcccatcaagtggatggcccccgagagtatcaactttcggaggttcacctccgcctccgacgtttggatgttcggcgtttgtatgtgggagattctgatgcatggagtaaaaccatttcagggggtgaaaaataacgacgtcatcggtcggattgagaacggggagaggctgcccatgccaccaaactgccctcccacgctgtactctctcatgacaaagtgctgggcttatgacccaagtcgccgccctcggtttaccgaactcaaggctcaactgtccttccagaatcccgcccagatgcttcccgcatccggccggctgccaaatcagccctgccccgaacgcgaaaactactcttttgcaacattctag

SEQ ID NO: 25898 - DNA, 2931 bp, Artificial Sequence
  Description of Artificial Sequence: Synthetic coding sequence
cggagcttcatcatcctgaaggccatcgtgagccagccccccggccctgtgctcagcggtatggagatgctgctaatgtcaggttacgagctccgcatccggtatctaccgaaaggtttcttgaaccaatttacagaagacaaacctacacttaacttcttctaccagcaggtcaaatctgattacatgttagagattgccgatcaggtggaccaggagatcgcactgaaactcgggtgtcttgagatcagacgttcttattgggaaatgcgaggcaatgccctggaaaaaaagagcaattatgaggtgctggagaaggatgttggactgaaaagattctttcccaagtcactgctggattccgtgaaggcaaaaacactgcggaaacttatccaacagacatttaggcaattcgcaaacttaaatcgcgaagagtcgatcctaaagttctttgagattctgtcgccagtgtaccgtttcgacaaggagtgctttaagtgtgctctgggatcctcctggattatcagcgtggaactggcaatagggcctgaggaaggcatttcatacctcacggacaaggggtgcaaccctacccacctggctgattttactcaggtccagaccattcagtacagtaactcagaagataaagatagaaagggcatgctccagctgaagattgccggagcccccgagcctctgacagtgacggctcccagcttgaccatagcagagaatatggccgatttgatcgacgggtattgccgcctcgttaacgggacttcccagagtttcatcatcaggccacagaaggagggcgaaagagctctgcctagcattcctaagttagcaaacagcgagaagcagggtatgaggacccatgctgtgagcgtgagtgacgagatacccggcgcagagacggatgattatgcagaaattattgatgaagaggacacttataccatgccttcaattaaaagctattgcatcgatgtcgctcgagattacgagattcagcgggagcgcattgaactcgggcgctgcatcggagaggggcaattcggcgacgtgcaccaaggcatatacatgtctcctgagaaccccgccctggccgtggcaatcaaaacctgcaagaattgtacgtcagatagtgtgagagaaaagtttttgcaagaggccttgacaatgaggcagttcgaccacccacacatcgtcaaacttattggtgtgataaccgagaaccccgtgtggatcattatggaattgtgcacgttaggcgagctgaggagctttttacaggtcaggaagtactctttggacctcgccagcctcattttatacgcctaccagcttagtactgcgttggcgtacctggagagtaagaggttcgtacaccgcgacattgccgcgcgtaacgtattggtgtcctccaacgactgcgtgaagctgggagattttggcctcagccggtatatggaggactccacttattacaaggctagcaaaggaaaactacccatcaaatggatggctcctgagagcatcaatttcagaagatttacctccgcatccgatgtgtggatgtttggtgtgtgcatgtgggaaatcctcatgcacggtgtgaaaccatttcagggtgttaagaataacgacgtgatcggccgcattgagaacggcgagcgcctgccaatgccgcccaattgtccacctacactatattctctcatgaccaagtgttgggcctatgaccccagcagaaggcctcggttcactgagttaaaagctcagctgagcaccattctggaggaggagaaggcccagcaggaagagagaatgagaatggagagccgacgacaggcaaccgtgtcatgggactccggaggatctgatgaggcgcccccgaagccctccaggcccggatatcccagtcctcgatcgagtgagggcttctacccaagcccacagcatatggtacaaacaaatcactaccaggtgtccggttacccaggctcccatggcatcactgcgatggcagggtccatctaccccggccaggctagccttctcgaccagaccgacagttggaaccacaggccacaggagatagcaatgtggcagccaaatgttgaggacagtacggtactggatttgagaggcatcggccaggtgctgccaacccacctgatggaagaaaggttgataagacaacagcaagaaatggaagaagaccaacgatggctcgagaaagaggaacgcttcctcaaacccgacgtgcgcctcagccgaggaagcatcgatagggaagatggcagcctccaagggccaatagggaatcaacatatatatcaaccagtcgggaaaccagaccccgccgcccccccgaagaagccaccacggcccggtgccccaggacacttggggtcattggcttctcttagcagccccgccgactcctataacgaaggtgtcaaacctttacgactccagccacaagaaatttctcctccaccgaccgctaacctggatcggtccaacgacaaggtctatgagaatgtgacaggactcgtgaaggcagtgatagagatgtcgtcaaaaatccaacccgcccccccggaagaatacgtgcccatggtgaaggaagtcgggctcgctctgcggactctcttggctaccgttgacgagaccatacccttgcttcctgcctctacccaccgggagatcgagatggcacagaaactcctcaatagcgatctaggcgaacttattaataagatgaagctcgcccagcaatacgtcatgaccagcctgcaacaggagtataagaagcagatgcttacggctgctcacgcactcgccgtagatgccaagaacctgctcgacgtgattgaccaagccaggttgaagatgttgggacaaactagaccacactag

SEQ ID NO: 25899 - DNA, 3024 bp, Artificial Sequence
  Description of Artificial Sequence: Synthetic coding sequence
aaggccgagtacgaccggtacctggccagcagcaagatcatggccgccgcatacctcgaccccaatctaaaccatactcctaaggagtggaagtacgaactgagaatccgatacctgcctaaaggatttctcaaccagtttacagaggataaaccgacactgaatttcttctatcagcaagtcaagagcgattatatgctggaaattgcggaccaggtggaccaggagatagcactgaagctcggttgtttagaaatccggaggtcctattgggagatgcgagggaatgctctggagaaaaaatcaaattatgaggtactagagaaggatgtggggttgaagcggttctttcctaaatctcttctggacagcgtgaaggctaaaactttaagaaaactcatccaacagacctttaggcaattcgccaacctaaatcgagaagagtccattctaaaatttttcgagatcctctccccggtctaccggtttgataaggagtgctttaagtgcgccttgggatcctcctggattattagcgtagaattagccattgggccggaagagggcatctcgtatctcaccgataaggggtgcaatcctacccatcttgccgactttacccaagtgcaaacaatccaatactcaaattcagaagacaaggaccgcaagggcatgctacagctgaagattgctggcgcacctgaacccctcaccgttacagcccccagcctgacgattgctgagaacatggctgacctcatcgacggatactgccggctggtaaatggcacttctcagtcatttataatccgacctcaaaaagaaggcgaaagagcactgccctctatccctaagctcgccaactcggagaaacagggcatgcgaacccacgcagtgtctgtgtccggtgtcagccactgccaacacaaagtcaagaaggcaagaaggttcctacccctcgtgttttgcagtcacgatccgccctccaccgacgagatttccggtgacgagaccgatgattatgccgagatcattgatgaggaggacacatacacaatgccatccattaaatcatactgcatcgatgttgctcgggactacgaaattcagagagagagaatcgagctcgggaggtgcataggcgagggccagtttggggacgtacatcagggtatttacatgtcacccgagaatcccgccttggccgtggccatcaagacatgcaaaaactgtaccagcgacagtgttcgggagaaattcctgcaggaggctcttactatgcgccaattcgaccacccccacatagtgaaattaataggggtcataaccgaaaaccccgtgtggatcataatggaattgtgcaccctcggagagctcaggtccttcttacaggttaggaaatactctttagacctcgcctccttgatcctgtatgcataccagttgtccaccgcgctcgcctacttggaatccaagcgattcgtgcaccgcgatattgcggcaagaaacgtactggtgtcatccaacgattgtgtgaagctcggggactttggcttgtcaaggtacatggaggattcaacgtattacaaggctagcaaagggaaactgccgattaagtggatggcgcctgaatctattaactttcgacgattcacatccgccagcgacgtgtggatgtttggagtgtgtatgtgggagatactgatgcatggcgtgaagccattccagggcgtgaagaataatgatgtcattgggcggatcgagaacggcgagcgtctaccaatgccgccaaattgccctcctacgctgtattccctgatgaccaaatgttgggcgtacgatccttctagaagaccaagattcaccgagctgaaggcccagttgagtaccatactggaggaggaaaaagctcagcaggaagagcggatgcggatggagtctcggcggcaggccaccgtgtcctgggactcaggagggagcgatgaggcccctccaaagccctctaggccggggtatccatcccctcggtcttcagaggggttctacccaagcccgcagcatatggtgcaaaccaatcattaccaagtctcagggtaccccggctcccatggcattaccgcaatggccggatcaatttacccaggccaggctagtctcctggatcagactgactcttggaatcacagaccccaggagatcgcaatgtggcaacctaatgtagaagattctactgtccttgatctccggggaatcggacaagttctgcctacccatctgatggaggagcgcttgattcgccagcagcaggaaatggaggaggatcagcggtggctcgagaaggaagagaggtttctgaaacctgacgttaggctaagcaggggctccattgacagggaagacggcagccttcaaggccctatcggcaatcagcatatttatcaaccagttgggaagcccgaccctgcagctcctccaaaaaaaccacctcgccccggggcgcccggtcacctgggaagcctggcatccttgtcatcccccgcggattcctacaacgagggtgttaagcccctgagactccagccgcaagagatcagtcctcctccaactgctaacctggacaggtctaacgataaagtctatgagaatgtgacaggattggtgaaagctgtcattgaaatgtcctctaagatccaacccgcccccccggaggagtatgtcccgatggtgaaggaagtgggcctagcactgaggaccctgctagcgaccgtggatgagacgatccctctgctccccgcatccacccaccgtgaaattgaaatggcccagaagctcctcaacagcgatctaggggagctcattaacaagatgaaactagcccagcagtacgtgatgacaagtctgcagcaggagtacaaaaaacagatgctaactgctgcccatgccttagccgtggacgctaagaacctcttggacgtgatcgaccaggccaggttaaaaatgctgggccagactagaccacactag

SEQ ID NO: 25900 - DNA, 3198 bp, Artificial Sequence
  Description of Artificial Sequence: Synthetic coding sequence
atggccgccgcctacctggaccccaacctgaaccacacccccaactcctctacgaaaacccacctcgggactggcatggaacggagcccaggggcaatggaacgggtgcttaaggtattccactatttcgagagcaattccgaacccaccacatgggcttccattatcagacatggcgacgctaccgatgtgcgtggcatcatccagaaaatcgtggactcacacaaagttaagcatgtggcctgttacgggttcagactctcccacttgagatccgaggaggttcattggctgcatgttgatatgggggtctccagcgtccgtgaaaagtacgaactggcacacccgcccgaggagtggaagtacgagctacgaatacggtatctgcctaagggattcttaaatcaatttaccgaggataagccaacgctgaatttcttttatcagcaggtcaaatcagattacatgctggaaatcgcagatcaggtcgatcaggagattgccctgaaactgggatgtttggagatccgtaggtcttattgggagatgcgcggcaacgctcttgaaaagaagtcaaattatgaagtgttagagaaagatgtggggctgaaaagattcttccctaagtctctgctcgatagcgtgaaagccaagaccctgaggaagctgatccagcagacctttcgccagtttgcaaatctaaatcgggaagagagcatcctgaagttcttcgaaatcttatcacccgtttaccgattcgacaaggagtgctttaaatgtgccctgggatccagctggatcatcagcgtggagttggcaatcggaccggaggagggtatttcatacctcacagataaaggctgcaatcccacacatctggccgatttcactcaggtgcagaccatacaatattcaaactccgaagacaaagacagaaaaggaatgttgcagctgaagattgcaggtgcccctgagcctctgaccgttacagctccaagcctgacgatcgcggaaaatatggctgatttaattgacggttattgccgtcttgtgaacggtacgagccaatcctttattattcggccacagaaagaaggcgagagggctctgccttctataccaaaacttgcgaactctgagaaacagggaatgcggacacacgcggtgtctgtctctgagactgacgactatgctgagattatagacgaggaagatacctacaccatgccctctactagggactacgagatacaaagagaaagaattgagctgggacggtgtataggagaaggtcagttcggcgatgtgcaccagggcatatacatgtcacctgaaaatcctgccctcgccgtcgccatcaagacttgcaaaaactgcacctctgattcagtgagagaaaaatttctgcaggaagccctcacgatgagacagttcgaccacccccacatagtgaaacttatcggcgtcattacagaaaatcccgtgtggatcatcatggagctgtgtaccctgggcgaactccgctctttcctgcaggttagaaaatactctctagacctggcgtccctgattctgtacgcctaccaactcagcaccgccttagcttatctcgagtccaaaaggttcgttcatcgcgacattgcagctcgcaacgtcctagttagttccaatgattgtgtgaagctgggcgacttcggtctttcacgttacatggaggactccacgtactataaagcatcaaagggcaaactgccaattaaatggatggctcccgaatcaattaacttcaggcgattcacaagcgcgtccgacgtttggatgtttggggtgtgtatgtgggaaatcttaatgcacggtgtaaaacccttccagggtgtgaaaaacaatgacgtgatcgggcggatcgagaacggtgaaaggctccccatgccaccaaactgtcctcccacactgtactcattgatgactaagtgctgggcttatgacccatcaaggagaccacggtttactgagttgaaggctcaattatccaccatactggaagaggaaaaagcacaacaggaggaaaggatgcgaatggaatcccgccggcaagccacagtgtcctgggattccggtggatctgacgaggccccaccaaaaccctctcgccccgggtatcctagcccgagaagcagtgaaggcttttacccttcgcctcagcacatggtgcaaaccaaccactaccaggtgtctggctatccaggtagccacgggattacagctatggccggtagcatttatcctgggcaagcctcattactggaccaaaccgactcatggaaccaccggccacaagaaatagccatgtggcagccgaacgtcgaagatagcacagtgttggacctccgaggcatcggtcaggtgcttccaactcacctgatggaggagagactcattcggcagcaacaggagatggaagaggatcagagatggctagaaaaggaggaacgcttcctcaaacccgatgtccgcttgtctagagggagtatcgatagggaggacggcagcctgcaggggcccatcgggaaccagcacatctatcagcccgtagggaagccaggcaaggaggagaagaattgggcagagcggaacccagcagcaccccccaaaaagccaccccggcctggcgcccccggtcacctggggtctctagccagcctcagctcccccgcagactcctacaacgaaggtgtcaagcctaaccaactccagccccaggagatttccccacctcccaccgcgaacctggaccgcagcaacgataaagtctacgagaacgtcaccggactggtgaaagctgtgattgagatgagctccaaaattcagcccgccccccccgaggaatatgtaccaatggttaaagaagtcgggctcgctctgcggactctactggcaactgtggatgaaaccattccattgttacccgcgtccacacaccgggagatcgaaatggcacagaagctcttgaactccgatctcggcgagcttatcaataagatgaagctggcccagcagtacgtgatgacatcattgcagcaggaatataaaaagcagatgctaaccgcagcacatgcacttgcagttgatgctaagaatctactggatgtaatcgatcaggcccgtctgaaaatgcttggacagacacggccgcattag

SEQ ID NO: 25901 - DNA, 2253 bp, Artificial Sequence
  Description of Artificial Sequence: Synthetic coding sequence
atggccgacctgatcgacggctactgccggctggtgaacggcaccagccaaagctttattattaggccgcagaaggagggagaaagggccctaccatctattcctaagctggccaatagcgaaaaacaggggatgcgcacccatgccgtttccgtaagcggtgtgagccattgccaacacaaagtgaaaaaggctcgcagatttctgccccttgtcttctgctcgcatgatccccccagtactgatgaaatttcaggagatgaaactgacgactacgccgagatcatagatgaagaagatacatacactatgcccagcacgcgcgactacgagattcaacgagaaagaatagagcttgggcgctgcatcggcgagggccagttcggggacgttcaccaagggatttatatgtccccagagaatcccgccttggcggtcgccattaagacttgtaagaactgcacctctgattctgttcgggaaaagtttctgcaggaggccctcactatgcgccagtttgatcacccacatatcgtaaagctcatcggtgtgatcacagagaaccctgtgtggatcataatggagctgtgtaccctgggtgagctgcggtccttcttgcaagtgaggaaatatagcttggacctagcgtccttgattctctacgcatatcagctgtccaccgccctggcctatctggaatctaagaggtttgtgcaccgggacattgcagcccgtaatgtccttgtgtcctcaaacgattgtgtgaaactgggtgacttcggtctctcccgatatatggaggactcaacttactataaagcgagcaagggaaaattgcccattaaatggatggcgcccgaatctataaactttagacgattcacctccgcctcagatgtgtggatgtttggcgtgtgtatgtgggagatactcatgcacggagtaaagccctttcagggtgtgaagaataatgacgttatcgggcgcatcgagaacggcgaacgactccctatgccccccaattgtccccctaccttgtactcactcatgacaaagtgttgggcctatgacccctcccgaaggcctcggtttacagaactgaaagcacaactgagcaccattctcgaagaggagaaggcccagcaagaagaaaggatgcgcatggagtccagacgtcaggccacagttagttgggatagcggcggcagtgacgaagcaccacctaagccaagccgtcctggctatccttctccccggtcaagcgagggattctacccatcgcctcagcacatggttcagacaaaccattatcaggtatctgggtatcccggcagccacggaataacggctatggcaggaagcatctatccagggcaggcaagcttactggaccaaacggacagctggaatcatcggccacaggaaatagccatgtggcagcccaacgtggaggactcaacagtgttggacctgcgcgggatcgggcaagtgctgccgactcatctaatggaagagcgtctgattcgccagcagcaggagatggaggaggatcaacggtggctggagaaagaggagagatttctcaaacctgatgtaagactgagcagaggctctattgatcgggaggatggctcgctccaagggcccatcggtaaccagcacatataccagccagtgggaaagcccgatccggcagccccacccaagaaacctccaaggcccggcgcccccggacatctgggttccctggcctccctgagcagccccgcggactcttacaacgagggcgtgaagccttgccggctgcagccccaggaaatcagccccccacccacagctaacctggatcgctctaatgataaagtgtacgagaatgtgaccggcctggtcaaagctgtgatcgagatgagttcaaaaatccaaccagcccctcccgaagagtatgtcccaatggtgaaggaagttggtcttgccctgagaacattacttgctacggtggatgaaaccatccctttgttgcctgcctccactcaccgcgagatcgaaatggctcagaaactattaaactctgacctgggtgagcttattaacaagatgaagttggcccagcaatatgtcatgacctcactgcagcaggaatacaagaaacagatgttaactgcggcccacgctctggctgtggacgccaagaacctgctggatgtgatcgaccaggctaggctgaagatgttaggacagacacggccacactag

SEQ ID NO: 25902 - DNA, 1089 bp, Artificial Sequence
  Description of Artificial Sequence: Synthetic coding sequence
atgcggatggagagccggcggcaggccaccgtgagctgggacagcggtggcagcgacgaagcgccaccaaaaccgagccgcccaggctaccctagtccccgttcatccgaaggtttctatcctagtccacagcatatggtgcagactaatcactatcaggtcagcggatacccaggaagccacggcattacagccatggctggatctatctaccccggacaagcaagcctactagatcagactgattcttggaatcacaggccccaggaaattgctatgtggcagccaaacgtggaggacagtaccgtgcttgaccttcgcggcattgggcaggtgctaccaacacatttaatggaagaaaggcttatacggcagcagcaagaaatggaagaagaccagcggtggctggagaaagaagaacgattccttaaaccagatgtgcggttatcacggggcagcatcgatcgtgaagatggcagccttcagggccctattggcaatcagcacatctaccagcctgtgggcaagcccgacccagctgccccaccaaaaaaaccgcctcggccaggcgcgcctgggcatttgggatctcttgcatccctgagtagccctgccgactcatataacgaaggcgtgaaattgcaaccgcaggaaataagtcctcccccgaccgccaatctcgatcgcagcaacgataaggtgtacgagaacgtaaccggactagttaaggccgtgattgagatgtcttctaaaattcagcccgctcccccagaagagtacgtgccaatggttaaggaagttgggctggcattgaggaccctgcttgcaactgtcgatgagactatcccgctgctgccggcatcaacccacagagagattgaaatggcccagaagctgctgaatagtgatctaggcgagttgattaataagatgaagttggcccagcagtacgtcatgacgagccttcaacaggagtataaaaaacagatgctgacggctgcccatgcgctggccgtagatgctaaaaacctgctggacgtaatagaccaggcccgcctgaaaatgcttggacagacaaggccccattag

SEQ ID NO: 25903 - DNA, 354 bp, Artificial Sequence
  Description of Artificial Sequence: Synthetic coding sequence
atggccgccgcctacctggaccccaacctgaaccacacccccaacagctccactaagacacacctgggaacgggcatggaaagaagccccggagccatggaaagggtgttgaaagttttccattactttgagtcgaacagcgagcctacaacctgggccagcatcatccggcacggagatgcgaccgatgtgaggggcatcattcagaagattgtcgactcacacaaagtcaagcacgtggcgtgctatggtttccgactctctcatctgagatcagaggaggtccattggctgcacgttgatatgggggttagttcagtgcgcgagaaatacgagcttgctcacccaccttag

SEQ ID NO: 25904 - DNA, 3291 bp, Artificial Sequence
  Description of Artificial Sequence: Synthetic coding sequence
atgctgctggagctggccggccaggaggccctgaagcccgccggcgctatctacatggaaaaaagcggttgctcaccgtttcctgtctgttgggccaaagaatacgataggtacctggcgtccagcaagatcatggccgcagcctacctggatcctaacttgaaccacacgccaaatagctctacaaagacacacctgggtactggcatggagagaagccctggcgcaatggagagagtgctaaaggtatttcactatttcgaatccaactccgagcccactacatgggcctcaattatcaggcacggcgacgcaaccgacgtgagagggatcatccagaagattgtggacagccacaaggttaagcatgtggcttgctatggctttaggctctcgcacttacgatccgaggaagtgcattggctgcacgtggacatgggtgtatcctcagtgcgtgagaagtacgaactcgcccatccccctgaggagtggaagtacgaactgagaattagatatttgcctaaggggttcttgaaccagtttaccgaggacaaacccacactcaacttcttttatcaacaggttaagtctgactacatgctggaaatcgccgaccaagtcgaccaggagatcgccctgaaactgggatgcttggagatcaggcggtcatattgggaaatgcggggcaatgctctcgagaagaagagcaattacgaggttctggagaaagacgttggattgaagcgattttttccgaaatccctgctcgacagcgtcaaagctaagactctccgcaaactgatccaacagacattcagacagtttgccaatctgaatcgggaggagtctatactgaaattttttgagatcctgtctccggtctaccgcttcgataaagaatgctttaaatgtgcccttggctcctcatggataatctctgtcgaattggccattgggccagaagaaggaattagctatcttacagataagggctgtaatcccacacatctcgcagatttcacacaggtgcagaccattcaatactcgaactctgaagataaggacaggaaaggcatgttgcagcttaagattgcgggggcaccagagcccctgaccgtgaccgcgccatccctgactatcgccgagaatatggctgacctaatcgacggctattgcaggctggtaaatggcacctcacagtctttcatcatccgaccgcaaaaggaaggcgagagggccctccctagcatccccaagctcgcaaacagcgaaaaacaaggcatgcggacccacgccgtgtcagtttctgagactgatgattacgccgagatcatcgatgaggaagatacatacaccatgccctccacgagggattacgaaattcagagggagagaattgagttgggacggtgtatcggcgagggacagttcggggacgttcaccaaggcatctacatgtctcccgagaacccagccctagctgttgccataaagacctgcaagaattgtaccagcgattcggtcagggagaagtttttgcaggaggccctgaccatgagacagtttgatcacccacacatcgtaaagctaatcggggtgatcactgagaatccggtctggatcatcatggagctctgcactttaggggaactgagatcgttcctccaggtcagaaagtactccttagacctcgcctccttaatcctatacgcataccagctctctacagcactggcgtacctggaaagcaagagattcgtgcacagggacatcgctgcaaggaatgtccttgtttccagcaatgattgcgtaaagttgggcgattttggattgtctagatacatggaggactctacctattataaagccagcaagggcaagctccccattaaatggatggccccggaaagtatcaattttcggcggttcacaagcgcctcagatgtgtggatgtttggggtctgtatgtgggaaatactaatgcacggggttaaaccattccagggagtgaaaaataacgatgtgatagggagaatcgagaacggtgaaagattgcctatgcccccaaactgtcccccgacactttactccctgatgacaaaatgttgggcctacgacccttcccggcgtccccggttcaccgagttaaaagctcagctttcaacgatcttggaggaggaaaaggcccagcaggaggagcgcatgaggatggaatcaaggcggcaagctacagttagttgggattctggaggatctgatgaggccccacccaagccttctcggcctggctacccttcacctcggtctagtgagggcttttatccatcaccgcagcacatggtgcagactaaccattatcaggtgtcaggctaccccggaagccatggcattaccgctatggccggtagtatctatccaggccaggcatcactgcttgaccaaactgatagttggaatcatagacctcaggagatcgcaatgtggcagcccaatgtggaagactctaccgttctggacctgcgcggcattgggcaggtcctgcctacacatcttatggaagagagactcatccgccagcagcaggaaatggaggaagaccagcgctggttggagaaggaagagcgatttctcaagcctgatgtacgactcagcagagggtccatcgacagggaagacggcagtttgcagggtcccatcggcaatcagcacatttatcaacctgtcggcaaacccgacccagcagcaccaccaaaaaagccacccaggccgggtgcacccggacatctggggagcctggcatcactttcatccccagccgatagctataatgagggcgtgaaactgcagcctcaggagatctcccctccccctactgccaaccttgatcgctctaatgacaaagtgtacgaaaacgttacagggttggtcaaggccgtcatcgaaatgtcctccaaaatacaaccagctccgccggaggagtacgtccctatggtcaaagaagtggggctggcccttcgaactctcctggccactgtcgacgagaccatcccgctgttacctgccagtacccacagagaaatcgagatggcgcagaagttactcaacagcgatctgggagaacttatcaataagatgaagctggcgcaacaatacgttatgaccagcctgcagcaagaatacaagaagcagatgctgactgctgcgcacgctctggccgttgacgccaagaaccttctggatgtcatcgaccaagcccgcctgaaaatgttaggtcaaacccgcccccattag

SEQ ID NO: 25905 - DNA, 3291 bp, Artificial Sequence
  Description of Artificial Sequence: Synthetic coding sequence
atgctgctggagctggccggccaggaggccctgaagcccgccggcgctatttatatggagaaatccggatgctctcctttccccgtctgctgggctaaggaatacgataggtaccttgcgtctagtaagataatggccgcagcatacctggacccgaacctcaatcacaccccaaactcctcaactaagactcatctgggcactggtatggagcggagtcccggcgctatggaaagggtgctcaaggtgttccactatttcgaaagtaatagtgagcctacaacctgggcgtctataatacgtcacggagacgccacagacgttagaggcatcatccagaaaattgtggatagtcacaaggtaaaacacgtcgcctgctacggatttcggctaagccacctaaggagcgaggaggtgcactggcttcatgtggacatgggcgtgagttccgtgagggaaaagtatgagcttgctcaccccccggaggaatggaaatatgagttgaggatcaggtatcttcctaaggggttcctgaatcaattcactgaagacaagccaacactgaacttcttctaccagcaggtgaagtcggattacatgctggaaatagcagatcaggtggaccaggaaattgcactgaagctgggatgtctcgagattcggagaagttactgggagatgaggggcaatgctctggaaaagaagtccaattatgaggtcctggagaaggatgtgggtttgaaacgattcttcccaaaaagcctgttggatagcgtcaaagctaagacgctgcggaaattgatccagcaaactttcaggcagtttgctaacctcaaccgggaggagagtatcttaaaatttttcgagatcctgtcgccagtctaccgttttgataaggagtgctttaagtgtgcactgggatcctcctggattatcagtgttgagctggcaatcggccccgaagagggcatatcatacctcacagacaagggatgtaaccccacccatctggccgacttcacacaagtgcagaccatacagtattcgaattccgaggataaagaccgaaagggaatgctgcagttgaagatcgccggcgctccggagccattgactgtgacggcaccgagcctgaccattgccgaaaacatggctgaccttattgatgggtattgtagactagtcaacgggacttctcagtcctttatcattagaccgcagaaagagggcgaaagagccctgcccagcattcctaagctcgctaattccgaaaaacaggggatgcgcacccatgctgtgtcagtttcagagaccgacgattacgccgagatcattgatgaggaggacacatacaccatgccgagcacacgagattatgagatacagcgcgaacgaattgagctcggcaggtgcatcggagaaggacagtttggtgacgtgcaccagggtatctacatgtctccagagaaccccgccctcgcagtcgcaataaagacgtgtaagaactgcacgagtgactccgtccgtgagaagtttcttcaagaagccttgacaatgcggcagtttgaccatccgcacatagtaaaacttatcggcgtaatcacagagaatccggtctggatcatcatggaactctgtacccttggcgagctgcggagtttcctgcaggtgcgcaaatactccctggatctcgcctcattaatactttatgcctaccaactgagtaccgccctcgcatatctcgagagtaaacggttcgttcatagagatattgctgctaggaacgtcctggtgagcagcaacgactgtgtgaagctgggcgatttcggactgtctaggtatatggaagattctacgtactataaagcttccaaaggtaagttgccaatcaaatggatggccccagagtcaatcaatttccggcggtttacaagcgctagcgacgtctggatgttcggcgtgtgcatgtgggaaatcctgatgcacggcgtaaagcctttccagggtgtgaagaacaacgacgtaattggcaggatagagaacggagaaagattgcccatgccccccaactgtccacccaccttatactccctcatgactaagtgctgggcctatgatccctccagacggcctaggtttacagaattaaaagcacagctgagtacaatcctggaggaagaaaaggcacaacaggaagaacggatgcgcatggagtctagacgccaggcaaccgtgtcctgggactccggagggtccgacgaggcacctccgaaaccttccaggcctggctatccatcccctcggtcatccgaggggttctacccttccccccagcatatggtccagactaatcattaccaggtgtctggatatccgggttcccatggaatcacagcgatggctggttctatctatcccggtcaggcttcactactcgaccagaccgattcttggaaccacagacctcaggagattgccatgtggcaaccgaatgtggaagatagtactgtcctcgatctccgaggcatcgggcaggtcttgccaactcatctcatggaggaaaggttgatccggcagcagcaggaaatggaagaggaccaaagatggctggagaaggaagagcggtttctgaaaccagacgttcgcctgagcagaggatcaattgaccgcgaggacgggtcactgcagggtcccatcgggaatcagcacatttatcaacccgtgggtaaaccagacccggcagctcctcccaaaaaacctccccgtcctggcgctccaggacacctgggtagtctggcaagcttgtcctccccagccgactcctataacgaaggggtcaagctgcagccccaggaaatttccccacccccaactgccaatctagacaggtcaaatgacaaggtttatgagaatgttacaggactggtcaaggctgtcatcgagatgtcatctaaaatacagcccgcaccgccggaggaatatgtacctatggttaaagaggttggactggcgttacgaacacttctcgcaacagtggatgagactattccattattgcctgctagcacacatcgcgagatcgaaatggcgcagaagctattgaactcagacctaggggagttgattaacaagatgaaacttgcacaacaatacgtgatgacctcccttcagcaggagtacaagaagcagatgttaacggctgcgcacgctttggccgtggacgccaagaacctcttggacgtgatcgaccaggccaggctgaaaatgctgggacagactcgcccacattag

SEQ ID NO: 25906 - DNA, 2043 bp, Artificial Sequence
  Description of Artificial Sequence: Synthetic coding sequence
atgaagtaccaggaggtgcggtgcctgaccagcttcaacatcagcgtctcatttccagcggagaccgacgattatgctgaaattattgacgaggaggatacctatacgatgcctagtacacgtgactatgagattcagcgagagaggatcgagctcggtcgatgcataggcgaaggacagttcggtgacgtgcaccaggggatctatatgagtcctgagaatccggcgctggctgtcgccatcaagacatgtaaaaactgcacaagcgattcagtgagagaaaagtttctgcaggaggctcttacaatgcggcaatttgaccacccacacatagtcaagctgataggggtgatcacagagaatcccgtatggataattatggagctgtgtactcttggcgaattgcgctcatttctccaagttcgcaaatacagcctggacctcgcctccctcattttatatgcctaccagctgagtacagcactggcttacctcgagtccaaacgctttgtccacagggatattgctgcgcggaacgtactcgtatcctcaaatgactgcgttaaactgggagattttggtctgagtcgctacatggaagacagcacctattacaaagcctcaaagggaaaattgcccattaagtggatggctcctgagagtattaattttcgtagatttacttctgcatcagacgtgtggatgtttggcgtttgcatgtgggaaatactcatgcacggcgtcaaaccattccagggagtcaagaacaatgacgtgattggccgcattgaaaacggcgaaagacttccaatgccccccaactgtccccctacattgtactccttgatgaccaaatgttgggcctatgacccttcccgacgcccaagattcacagaattaaaggctcagctttccacaattctggaggaagagaaggcccagcaggaagaaaggatgcgcatggagtcccgcagacaggccaccgtgagttgggactctggcgggtctgatgaggctcccccaaaaccctcccgcccagggtatccttctcccagaagctctgagggcttttatccgtcccctcagcacatggtgcagacaaatcactaccaggtgtccggttatcctggaagtcatggtataacagcaatggccggttcaatttatcccggacaggcctcgttgctagaccagaccgatagctggaatcacaggcctcaagagatcgcaatgtggcagcctaatgtggaggattcaacagtgttagacctcaggggcattggccaggtccttcccacacacctgatggaggagcggttgatacggcagcagcaggaaatggaagaggatcagcgctggttggaaaaggaggagagatttcttaagcctgacgtgagactgtcacgaggatccatcgacagagaggatggaagcctgcaggggcccatcggtaaccagcacatttatcagcccgtgggaaaaccagaccccgccgcccccccgaagaagcctccaagacctggtgctcccgggcaccttgggtcactggcctccttgagcagtccagcggatagctataatgagggtgtgaagctgcaacctcaggagatttccccgcccccgacggccaacctcgatcgctccaatgacaaggtgtacgaaaatgtcacgggacttgtcaaagccgtcattgagatgagttctaaaatccaaccagcgcctcctgaggagtatgtgcccatggttaaggaggtgggcctggccctgaggacattacttgctactgttgacgagacaataccgttattgccagcctccacccaccgggagattgaaatggcccagaaacttctaaactcagatctgggcgagctgattaataaaatgaagcttgcacagcaatacgtgatgacatctctgcagcaagagtataaaaagcaaatgcttacagcagctcatgccttggccgtggatgctaaaaaccttctcgatgtcatcgaccaggccaggctgaagatgctcggccagacacgcccacattag

SEQ ID NO: 25907 - DNA, 3054 bp, Artificial Sequence
  Description of Artificial Sequence: Synthetic coding sequence
tgatacgaccggtacctggccagcagcaagatcatggccgccgcctatctggatcccaatttaaaccatactcctaactcttcaactaagacgcatttggggacgggcatggagaggtcaccgggggctatggaacgggtgttgaaggtattccattactttgagtctaattccgagcctaccacatgggcctctatcatccgccacggtgatgctacggacgtgcgagggataatccagaaaatcgtagactcacataaggtaaagcacgtagcttgttacggcttccgtctctcccatctgcggagcgaagaagtgcactggctccacgtcgatatgggagtcagttctgtaagggaaaagtacgaactggctcacccccctgaagagtggaaatacgagctccgaattagatatctacctaaggggtttctcaaccagtttactgaggacaagcccacacttaacttcttttatcagcaggtgaaaagcgactacatgcttgaaatcgccgaccaggtggatcaggagatcgctctcaaactcggctgtcttgaaatacgccgctcctattgggaaatgcgaggtaatgccctcgagaaaaagtccaattacgaagttctggagaaagacgtagggctcaagagattctttcctaaatctctgctggattctgtcaaggcaaagaccttgcgtaagctcatccagcagactttccggcagtttgccaatctcaacagagaggagtccatccttaaattcttcgaaatcctgagcccagtgtaccgtttcgacaaagaatgttttaagtgtgcccttgggagtagctggatcatctcagtggaattagctattggtccagaagaggggatttcctatctgaccgacaaaggctgcaacccgacccacctcgccgattttactcaagtgcaaactatacagtattccaatagtgaagacaaggaccggaagggaatgcttcaattaaaaatcgcaggggcacccgaaccactgacagttaccgccccttccctaacaatcgcagagaacatggcagatctcatagacggatactgtaggcttgtgaatggaacaagccaaagcttcatcatacggccccagaaggaaggtgaacgggccttgccaagcatacccaaattggctaacagcgaaaagcaggggatgcgaactcacgctgttagcgttagtgaaacagacgactatgccgagatcatcgacgaagaggacacttataccatgccaagcactagggactacgagatccagcgtgaacgcatcgaattgggccgttgtatcggtgaaggacaatttggggatgtgcaccagggaatctatatgagtcctgagaaccctgccttggccgtcgccatcaaaacttgtaagaattgtaccagcgattccgtccgcgagaaatttctacaggaggcactcacaatgaggcaatttgatcacccacacattgtgaagcttatcggcgtaataactgagaaccctgtttggattattatggagctttgtaccctaggcgagctacgcagtttccttcaagtccgaaagtattcacttgacctggccagtctgatcctttacgcttaccaactgtcaactgctctagcttacctggagagcaaaagattcgtgcacagggacattgcagcgcgtaatgtgttagtgtcttctaatgattgtgtcaagctgggcgattttgggttgtctcgatacatggaggattcaacttactacaaagcctctaaaggcaagctgcccatcaagtggatggcccctgagtcaataaacttcaggagattcactagtgcatccgatgtgtggatgttcggggtatgtatgtgggagattctgatgcacggagttaaaccattccagggagttaagaacaacgatgttatcggtcgcatcgaaaacggggagcggcttccaatgccccctaactgtccccctactctgtattctcttatgacaaagtgttgggcctatgacccaagtcgccgacccaggtttactgagctgaaggcccagctgagcactatcttagaagaagaaaaggcccagcaggaagagaggatgagaatggaaagtcgtagacaggccactgtcagctgggattctggcgggtcagatgaggccccccccaaacctagccgacccgggtatccaagtccacgctcctcggagggcttttaccctagcccacagcacatggtccagacaaatcactaccaagacagcaccgttctagacctgcgcggaataggccaagtgctgcctactcacctcatggaggagcgcctgatacgccagcaacaggagatggaggaagaccaacgctggcttgaaaaagaggagagattcctgaagcctgacgttcgtctatcccggggatctatcgaccgggaagacggctccctccagggcccgattgggaaccaacatatttaccagcccgtcgggaagcccgatccggctgcaccacccaagaagccccccagaccaggagctcctggacacctggggtcactggcatccctgagttcacctgctgactcttacaatgagggtgtgaagcttcaaccgcaagaaatatcacctccacctacagccaatcttgatcgcagcaacgataaggtctacgagaatgtgacaggcctggttaaggccgtcatcgagatgagcagtaagatccagcctgctcctccagaggaatatgtacccatggtcaaagaagttgggctagcattgagaaccttgctcgccacagtggacgagaccatccccttgctgcccgcttcaacccatagagagattgaaatggcccagaagttactcaacagtgacctgggcgaactcattaacaagatgaagttagctcagcaatatgttatgacctccctacagcaggagtacaaaaagcagatgcttacggcggcccacgcccttgcagtcgacgccaagaacctgttggatgtgattgatcaggctagactgaagatgctcgggcagactaggccgcactag

SEQ ID NO: 25908 - DNA, 354 bp, Artificial Sequence
  Description of Artificial Sequence: Synthetic coding sequence
atggccgccgcctacctggaccccaacctgaaccacacccccaactcgagtaccaaaactcaccttggcactggcatggaaaggtcacccggtgcaatggaaagggttctgaaggtgtttcactactttgagagcaattcagaaccaacaacatgggccagcatcataagacacggcgacgcaaccgacgtgcgcggaattatccagaagatcgtagattcccacaaggttaagcatgtggcctgctacggattcaggctgtctcatttgaggagcgaggaagttcattggctgcacgtggatatgggagtgagttctgtacgcgaaaagtatgaattggcccaccctccttag

SEQ ID NO: 25909 - DNA, 471 bp, Artificial Sequence
  Description of Artificial Sequence: Synthetic coding sequence
atggccgccgcctacctggaccccaacctgaaccacacccccaactccagcactaaaacccacctcgggaccgggatggaaagatcccccggcgctatggaacgggtgcttaaggtcttccactacttcgaatcgaactctgaaccaacaacctgggctagcatcattcgccacggggacgccaccgacgtaaggggaatcatacaaaagatagtggacagtcacaaggtcaagcacgtggcatgctacggatttagacttagccacttaaggagtgaggaagttcactggctccatgttgacatgggagtctccagcgtcagggaaaaatatgagctggcacaccctcctgaggagtggaagtacgagctgagaatacgctacttgcccaaaggttttcttaatcagttcaccgaagataaacccacactgaactttttttaccaacaagtcaagagcgactatatgtag

SEQ ID NO: 25910 - DNA, 3159 bp, Artificial Sequence
  Description of Artificial Sequence: Synthetic coding sequence
atggccgccgcctacctggaccccaacctgaaccacacccccaactccagcacaaagacccatcttggcactggaatggaacggtctcctggggctatggaacgggtgctcaaggtgttccattacttcgagtcaaatagtgaaccaacaacatgggcttctataatcagacatggggacgctacggacgtacgggggatcatacaaaaaatcgttgatagccataaagtgaaacacgtggcgtgctatgggtttcgcttgagccacctccgctctgaagaagtgcattggctccatgtggatatgggcgtgagcagtgtgagggagaagtacgaactggcgcatcctccagaggaatggaagtacgagctccgcatccggtatctgcccaagggctttttgaaccagttcactgaagataagcccacactcaattttttttatcagcaagttaaatccgattatatgctggagattgcagatcaagtcgaccaggaaatcgctttgaagctgggatgtttggaaatccgtaggtcatactgggaaatgaggggtaatgccttagagaagaagagcaactatgaggtcctcgaaaaagacgtaggcctcaagaggttctttccaaagtcgctgttagattctgtgaaggccaagactctgaggaaattaatacaacagacatttcggcagtttgcaaacctcaatcgggaagagtccatattgaaattcttcgaaatcctgagccctgtctaccgctttgataaggaatgtttcaagtgtgcactcgggtctagttggatcattagcgttgagctggcaattggtcccgaggaagggattagttaccttacggacaagggttgtaacccgacacacttggctgatttcacccaggtccagactatacagtactcgaacagtgaagataaggataggaaagggatgttgcaactgaagatcgccggggctcctgaaccgctgacagtaacagccccttcactcaccattgccgagaacatggctgacctgatcgacggttattgccggctggttaacgggacttcccagagttttataataagaccgcagaaggaaggagaaagggctctgccgtccattcccaagttggccaacagtgagaaacagggcatgcgcacacatgccgttagtgtgtccgaaaccgacgactatgccgaaattattgatgaggaggatacctacaccatgccctccactcgggattatgagattcagagggagagaatcgaactgggcaggtgcattggggagggacagtttggagacgtgcatcaggggatctacatgtctccagagaaccccgcactcgcagtcgccattaaaacctgcaagaactgtacatctgactccgttagagaaaaatttcttcaggaggctctgactatgagacagtttgatcaccctcatatagtgaagctcatcggagtcatcacggaaaatcctgtgtggatcattatggagttatgtactctgggcgagctgaggtcttttctgcaggtacgcaaatacagtcttgacctggcctcactgatactctacgcttaccagcttagcacagcactggcctaccttgagtctaagagattcgttcaccgtgatattgctgcacggaacgtgctggtttcaagcaacgattgtgtaaaactgggcgattttggcctgtctcgttacatggaggatagcacttactacaaggcctccaaaggcaaacttcccatcaagtggatggcccctgaatctatcaattttagacggtttacctctgcaagcgacgtctggatgttcggcgtctgtatgtgggaaatcctgatgcacggcgttaaacccttccagggtgtgaagaataacgatgtgattgggcgcatcgaaaacggcgaaaggctccctatgccacccaactgcccacccaccctgtatagtctcatgaccaagtgttgggcttatgacccctccaggcgtcctcgttttaccgagctgaaggctcagctgtccaccattctggaggaggaaaaggcacagcaggaagagcgtatgcgcatggaatcccgtagacaggcaaccgtgtcctgggattcaggcgggtcggatgaagctccgccgaaacccagcagacctggctatccttcaccacgatcatccgaaggattctaccctagtccacagcacatggttcagacgaatcactaccaagtgagcggttaccccggttctcatggcatcacagccatggccggctcaatctaccccggtcaggcatccctgctggaccagacagattcatggaatcaccggccccaggagattgcgatgtggcagcccaacgtcgaagatagtacagtgcttgaccttcgcgggattgggcaggttctccctactcacctgatggaggaacgactcatcagacagcagcaggagatggaggaagatcaacgttggttagagaaggaggaacgatttctcaaacctgatgttcggctgtctcggggctctatcgacagggaagacgggtccttgcagggaccgatcggcaaccaacacatctaccaacctgttggaaaaccagatccggccgcccctccaaaaaaacctcctagaccaggggcccccgggcatttgggcagccttgcctcactgagtagcccggctgacagctacaacgaaggagtcaagctgcaaccacaggagatctcacctccccctactgccaacctggaccgaagtaatgacaaagtgtacgaaaacgtaactggtctggtgaaagctgtgatagagatgagcagcaaaatccagcccgcccctcccgaagagtacgtgcccatggtaaaagaagtagggctcgccctcaggaccctcctggcaaccgtggatgagacaatccctctcttgcctgcaagtacccaccgggagattgagatggcgcagaaattgcttaactccgaccttggggagttgatcaacaaaatgaagctggcgcaacagtatgtgatgacttcccttcagcaagaatataaaaagcagatgctgactgctgctcacgcactcgctgtcgacgctaaaaacctgcttgatgtgattgaccaggcgaggctcaaaatgctgggccaaacccgaccccactag

SEQ ID NO: 25911 - DNA, 198 bp, Artificial Sequence
  Description of Artificial Sequence: Synthetic coding sequence
atggccgccgcctacctggaccccaacctgaaccacacccccaactcgtccaccaagacccacctaggaacaggtatggaacgtagcccaggagctatggagcgcgtcctaaaagtctttcattacttcgaaagcaacagcgagcctactacctgggcgtcaatcattcgccacggtgacgctacagatgttcggtag

SEQ ID NO: 25912 - DNA, 324 bp, Artificial Sequence
  Description of Artificial Sequence: Synthetic coding sequence
atggccgccgcctacctggaccccaacctgaaccacacccccaactcctccactaaaacgcacctcggaaccggcatggaaagatctcccggtgcgatggaaagggtgctgaaggtgtttcactatttcgagtcaaactccgaaccaacaacatgggcatctattatacgccatggggacgcgaccgatgtgcggggtattatccagaaaattgtggacagccataaggtgaaacatgtggcttgctacggcttccgtctgtcccatctacgatctgaagaggtgcattggttacacgttgatatgggagtgtcgagcgtttag

SEQ ID NO: 25913 - DNA, 360 bp, Artificial Sequence
  Description of Artificial Sequence: Synthetic coding sequence
atggccgccgcctacctggaccccaacctgaaccacacccccaactcttctaccaagactcatttaggaaccggcatggaacgatcccctggagcgatggagcgggtcctgaaggtgttccactactttgaaagtaactccgaacctaccacttgggcctccatcattcggcatggagatgccacggatgtcaggggaattatccagaaaatcgtagacagccacaaagtcaaacacgtggcctgctacggtttcaggttgagccacctgcgatccgaagaagtgcattggctccacgtggacatgggcgttagttctgtgagagaaaaatatgagctggctcatccccctgaggagtag

SEQ ID NO: 25914 - DNA, 2262 bp, Artificial Sequence
  Description of Artificial Sequence: Synthetic coding sequence
gccgagaacatggccgacctgatcgacggctactgccggctggtgaacgggaccagtcaatcattcattattagaccacaaaaagagggcgaaagagctcttccctcaatacccaagttggctaattccgagaagcagggcatgcgcactcacgctgtctcggtatccggtgtatctcattgccaacataaggtcaagaaggcacgacggttcctgcctctggttttttgctcgcatgaccccccatctaccgacgagatttctggggacgaaaccgatgactacgcggaaatcattgatgaagaagatacatacaccatgccttctactcgcgattatgaaattcagcgggagaggatcgagctgggacgatgtatcggggagggacagtttggtgacgtccaccaggggatctacatgagcccagagaaccccgcattagccgtcgctattaagacctgcaaaaactgcacgtcagacagtgtaagagagaagtttctccaggaagcgctgactatgcgccagttcgatcatccacatattgtgaaactgatcggagttatcactgagaatccagtctggattattatggaactgtgcactctcggcgaattgaggagcttcctccaggttcggaagtatagcctggatctggcgagtctcatactctacgcatatcagctgtctacagctctggcgtacctcgagagcaaacgattcgtgcacagagacattgcggcccgcaatgttctcgtcagttcaaatgactgcgtgaagctcggcgactttggtttgagcagatacatggaggactccacctattataaggcatccaaaggaaaattacccattaagtggatggccccagagagtataaatttcaggaggtttactagcgcatctgacgtgtggatgttcggcgtgtgtatgtgggaaatcctgatgcatggagttaaacctttccagggtgtcaagaataatgacgtaattggtcgcattgagaacggagagcgactccccatgccaccaaattgccctcctacactgtattcgctgatgaccaaatgttgggcttatgaccccagtcgccgtcccagattcaccgagcttaaggcccagctctctactatcctcgaagaggagaaggcccaacaggaggagcggatgcggatggagtcaagaaggcaggccacagtgtcttgggattctggaggaagcgacgaggcccctcctaaaccctctaggccaggttacccgtctccacggtccagcgaaggtttctacccgagcccccagcatatggttcaaactaaccattaccaggtgagtggatatcccgggtctcatgggatcacagcaatggccggaagtatttacccgggccaggcgtccctgcttgatcagacagatagttggaaccaccggcctcaggaaatcgcaatgtggcagccaaatgtggaagacagcaccgtgctggatctgcgtggaatagggcaggtgctgcctacccatttgatggaggagaggctgattcgccagcaacaggagatggaagaggaccagagatggttggaaaaggaagaacgattcctgaagcctgacgtgagactgagccggggtagtattgacagggaagacggatctttgcaaggcccaatcggcaaccagcatatttaccaacctgtgggtaagccggacccagcggccccccccaagaaacccccacgtcctggcgctcctggacacctcggcagcctggcatccctgtcctcccccgcggacagttacaacgaaggtgtaaagccttggcgacttcaaccccaggagatcagtcccccgcctacagcaaacctggatcgatccaatgacaaggtatatgaaaatgtgacaggccttgtaaaagccgtaatcgaaatgtcctcgaagatccagcccgcgccccccgaagaatatgtcccaatggtgaaagaggtcggcctggccctgaggactttactagctaccgtcgacgagacaattcctctgcttcctgcctctacccatagggagatcgaaatggcccagaagctactgaacagtgacctgggcgaactgattaacaagatgaaactcgcccaacagtatgttatgacttctctgcaacaggaatataagaagcagatgcttacagccgcccacgccttggccgttgacgccaaaaatctgttggatgtcatagaccaggccaggttgaagatgctgggccagacccggcctcactag

SEQ ID NO: 25915 - DNA, 3159 bp, Artificial Sequence
  Description of Artificial Sequence: Synthetic coding sequence
atggccgccgcctacctggaccccaacctgaaccacacccccaacagcagcacaaagacgcatctcggtaccggcatggagcgatcaccgggagctatggaacgagtactcaaagtcttccactactttgaatctaatagtgaacctacaacgtgggctagcatcatccggcatggggacgccacagatgtgcgcggtataatccagaagattgtggatagccacaaagtgaagcatgttgcttgctatggatttaggctttctcacctgaggtcggaagaggtgcactggcttcacgtggacatgggggtatcttccgtgcgggaaaaatatgagctggcccatccgcccgaggaatggaaatatgaattgcgaattaggtacctgcctaaaggctttctgaaccagtttaccgaagacaaacctaccctcaacttcttctaccaacaggtaaagtccgactatatgctggaaatcgctgatcaggtggaccaggagatcgcgctgaagctggggtgccttgaaattagacgaagctattgggaaatgcgaggcaatgccctggagaaaaaaagtaactatgaagtgctggaaaaagacgttggattgaaacggtttttccccaaatctctcctggattcggtcaaggctaaaacgttacggaaactgatccagcagacctttcgtcagtttgctaacctgaatagggaggagtctattctgaaatttttcgagattctgagtcctgtttaccgatttgacaaagaatgtttcaagtgcgcattagggtctagctggatcatcagcgtcgagctggctataggacctgaggaaggcattagttatctgactgataaaggttgcaaccccacccacttggccgactttacgcaggtccagacaattcagtactctaattccgaggataaagataggaaaggaatgctacagctgaaaatcgcaggggcaccagagcccttgacagtgactgcacccagcctgactatcgctgaaaatatggctgatctgatcgacggatactgccgactggtaaacggcacaagccaatcctttatcatccgcccccaaaaggagggtgaacgcgccctgccgtccatccccaaactggcaaattcagaaaagcaggggatgcgcacgcatgccgtctccgtgtctgagaccgacgactacgccgagattattgacgaggaagacacttatacaatgcctagcactcgggattatgaaattcagcgcgaacgcatcgaattaggccgctgtattggcgaaggacagttcggagacgtgcaccagggcatttacatgtcgcctgaaaatccggcactggctgttgctatcaagacatgcaagaattgcacatcagactctgtgcgcgaaaaatttctgcaggaggcattaaccatgagacagttcgatcacccccatatagtgaagttgatcggagttatcaccgagaatcccgtgtggattatcatggagctgtgcactctgggcgaactccgaagttttctccaggtcagaaagtattctctcgacctcgcgagcttgattctatatgcgtatcagctgagcactgctctggcttacctggagtctaagcgattcgttcatcgagatattgccgccaggaacgtgctcgtttcctctaatgactgtgtaaagttgggagatttcggtcttagtcgttacatggaggattccacttattataaagcctccaagggtaaattgcccatcaagtggatggcccctgagagcatcaacttccgtcgctttactagcgctagcgacgtctggatgttcggtgtgtgcatgtgggagatcctgatgcacggcgtcaagccttttcaaggtgttaagaacaacgatgtcatcggccggatcgaaaacggcgagcgactgccaatgccccctaattgccctcctacattatattctcttatgactaagtgttgggcctacgacccaagcagacggcctcgcttcaccgagctcaaggctcagctgagcacgattctcgaagaggagaaggcccagcaggaagagaggatgagaatggaatcccggcgccaggctacagtcagctgggatagtgggggctccgatgaggccccccctaagccaagtcggccgggatatcctagcccaagatcttctgagggtttttacccaagtccacaacacatggtgcagacaaatcactatcaagtgtctggctaccccggtagccacgggattactgctatggcgggatcaatctatcctggtcaggcgagcctcctggaccagaccgattcttggaaccacagaccacaggagatagctatgtggcagcctaacgtggaggacagtacagtgctcgatcttaggggtatcggacaggttctccctacccatctgatggaggagcgccttataaggcaacagcaggagatggaggaggatcagcgctggttagagaaggaagagcgcttcctcaagccagacgtgcgcctttctaggggctcaattgaccgggaagacggctctttacagggtcctatcggcaaccagcacatttatcaaccagttgggaagcccgaccccgcagcgccacctaaaaagcctccaagacctggtgctcccgggcaccttggatctctggccagcctttcgagccccgctgacagttacaatgaaggggttaaactccaacctcaggaaatcagtccacctcccaccgctaaccttgataggagcaatgacaaggtatacgaaaatgtgacaggtctggtaaaagcagtaatagaaatgagttccaagatccagcccgctccccctgaggaatacgtccccatggtcaaggaggtggggttggctctgaggacactcctagctacagttgatgaaacaatccctttactgcctgcttccacacaccgcgagatcgaaatggcacagaagttgctgaattctgatctgggagagctgatcaataaaatgaagctggctcagcaatatgtgatgacctctctgcagcaggaatataaaaaacaaatgctcactgctgctcacgctctggctgttgatgccaagaatttactcgacgtgatcgaccaggcgcgcctgaaaatgctgggccagacccgtccacactag

SEQ ID NO: 25916 - DNA, 2175 bp, Artificial Sequence
  Description of Artificial Sequence: Synthetic coding sequence
atcgccgagaacatggccgacctgatcgacggctactgccggctggtgaacggtacaagtcagagtttcattatccggcctcaaaaggagggtgaacgggccttgccctcaatcccgaagctcgctaatagtgaaaaacaaggtatgaggacgcacgcagtgtcagtgtctgagacagatgattacgccgagatcattgatgaggaagacacatacaccatgccctccaagtcttacggtattgacgaagcccgcgattatgagatccaacgtgagagaatcgaacttggtcgatgcattggcgaagggcaatttggcgacgtgcatcaaggtatttatatgagtccggagaatccagcactggccgtagccatcaaaacatgcaaaaattgcacatccgatagcgtgcgcgaaaaattccttcaggaagccttgaccatgcggcagttcgaccacccacacatcgtaaagcttatcggcgtaattaccgagaatccagtgtggatcattatggaactgtgtactctcggagaactgcggagttttttacaagtgagaaagtacagtcttgacctggcctccctgattttatacgcctaccagctgagcacggccctggcctacctggagtcaaagcgtttcgttcatcgtgatatagcagctaggaacgtactcgtgtcttccaacgattgcgtgaagctaggtgactttggcctcagtaggtatatggaggattcaacgtattataaggccagcaagggcaagctgcctatcaagtggatggctcccgagtccatcaatttccgccgcttcacttcagcttccgatgtctggatgttcggcgtgtgcatgtgggaaatcctcatgcacggcgtcaaacctttccaaggtgttaaaaacaacgatgttattggcaggatcgaaaatggagagcgccttcctatgccccctaactgccctcccactttgtactcccttatgaccaagtgctgggcttatgacccgtcccgccggccacgattcacggaattgaaggcccagctgtctactatattagaggaggaaaaggcacaacaggaagaaaggatgcggatggagtcacgacgacaggccaccgtgtcatgggattcaggagggagtgacgaggcacctccgaaacctagcaggccaggatatccatctccacggtcaagtgaaggattctacccgagcccccaacacatggtgcagactaatcactatcaagtcagtgggtatcccggctcccatggtattacggcgatggccgggtctatttatccgggccaggcctccttactggatcaaaccgactcgtggaaccaccggccgcaggagattgctatgtggcagcccaacgtggaagactccacagtgctcgacctgagaggtatcggacaggtgttgccgacccatcttatggaggaacggctaattagacaacagcaggagatggaagaggaccaaaggtggctcgagaaggaggagcgttttctgaaaccagatgtaagactgagtcgcggatccatcgaccgcgaagacggatcgttacagggtccaattgggaaccagcacatttatcagcccgtagggaagcctgatcccgctgccccacccaagaagccgcctagacccggtgcacccggccatttgggcagtttggcttccttaagtagcccggctgactcgtacaatgagggcgtgaaactccagccccaggaaataagtccaccacctacagccaacttggacagatccaatgacaaagtatacgagaatgtaaccgggcttgtgaaggccgtgattgagatgagctctaaaatccagccagcccctccggaagagtatgtcccaatggttaaagaggtgggcctggctcttagaacccttctggctaccgtcgacgagacaattcccttactgcctgccagcactcacagagaaattgaaatggcccaaaagctgctgaactctgatctcggcgaactgataaataagatgaagcttgcgcagcagtacgttatgacttctctgcaacaggagtataaaaagcagatgctgaccgccgctcacgctctggcggtagatgctaagaatctactggatgtcattgaccaggctcgcttaaaaatgttggggcagactagaccgcactag

SEQ ID NO: 25917 - DNA, 363 bp, Artificial Sequence
  Description of Artificial Sequence: Synthetic coding sequence
atggccgccgcctacctggaccccaacctgaaccacacccccaactcatctactaagacccacttaggaactgggatggaacggtcaccaggagcaatggaacgcgtgcttaaggtcttccattattttgagtccaactccgaaccaactacctgggctagcataattaggcatggcgacgccaccgacgtccgcgggattattcagaagatcgtagatagtcacaaagtgaaacatgtcgcctgttacggattcaggctgagccatctcaggtctgaggaggtgcactggttacatgttgatatgggggtttcatccgtgcgcgagaagtacgagctggcacatccccctgaggaatggtag

SEQ ID NO: 25918 - DNA, 156 bp, Artificial Sequence
  Description of Artificial Sequence: Synthetic coding sequence
atggccgccgcctacctggaccccaacctgaaccacacccccaactctagcactaagactcacctgggaactgggatggaacgctcacctggggccatggagcgggtactgaaagtgtttcactacttcgagtcaaactccgagccaaccacctag

SEQ ID NO: 25919 - DNA, 3021 bp, Artificial Sequence
  Description of Artificial Sequence: Synthetic coding sequence
atggccgccgcctacctggaccccaacctgaaccacacccccaacagttctactaaaacccacttaggtaccggcatggaacggtcccccggggcgatggaacgtgtactgaaagtcttccactatttcgaatctaacagcgagccaacaacttgggccagcatcatcaggcatggcgacgcaactgatgtccgtggaatcattcaaaaaattgtggactctcacaaagtcaagcatgtggcgtgttatggatttcggctgtcccatctcagaagtgaggaggtccactggctgcacgtggatatgggagtttcaagcgtgagggagaaatatgagttggctcacccaccagaggagtggaagtacgagctgaggataaggtacttaccaaaaggcttcctgaatcagttcacagaggataaacctactcttaattttttttaccagcaggtgaagtccgattatatgcttgaaatcgctgatcaggtggaccaagaaattgccctgaagctcggttgtttagagatccggcggtcctattgggaaatgaggggcaacgcactggaaaaaaagtctaattatgaggtacttgaaaaggacgtgggcctcaagcgattctttcccaaatctctactcgattctgttaaagctaagacccttcgaaagctgatccagcagacatttcgtcagtttgcaaacttaaacagggaggaaagtatcttgaaattttttgaaatcctcagtccagtctatcggttcgacaaggagtgttttaagtgtgccctcggaagctcttggattatctcagtcgaactggccatcggaccagaggaaggaatttcttacctgaccgataagggctgtaatcccacacacctggccgactttactcaggtgcaaactattcagtacagtaatagcgaagataaagaccgcaagggcatgctgcaactgaaaattgctggcgccccggagcctctgacggtgaccgccccctcccttacgattgctgagaacatggctgatttgatagacggatactgtaggctggttaacggcactagtcagagcttcattatccggccacagaaagagggagagcgagcactacccagcataccaaaattagctaactccgagaagcaaggcatgcgcacccatgccgtgagcgtttccgaaaccgacgactatgcagagatcattgacgaggaagatacgtacaccatgccttccacgcgtgattacgagatccagcgtgaacggatagagcttgggcgatgcattggagaagggcaatttggggacgtgcaccagggcatctatatgtccccagagaaccccgccctggccgttgccattaaaacatgcaaaaactgtacgtcagacagcgttagggaaaaattcctccaggaggctctcaccatgaggcagtttgatcaccctcacattgtgaagttaatcggagtgataactgaaaatcccgtgtggatcataatggagctgtgtactttgggcgaattgaggtcttttttacaggtgaggaagtactccctcgacctcgcctcactaatcctatatgcttaccagctctccaccgccctcgcctacttagaatccaagagatttgtgcaccgcgatatagccgcccgcaacgtcttagtcagttccaacgattgcgtcaaactgggcgactttgggttaagtcgctatatggaggattcaacctattacaaggccagtaaaggtaagttgcctatcaagtggatggcccccgaaagcatcaatttcaggagatttaccagcgcctccgacgtctggatgttcggcgtgtgcatgtgggaaattcttatgcacggggtcaagccattccagggcgttaagaacaacgatgtaatagggcgtatagagaatggcgagcgactacccatgccgcccaattgccccccgaccttatatagccttatgactaaatgctgggcttatgacccctcacgccgccccagattcacagaactgaaagcacagctgtctaccatcctagaggaggaaaaagcccagcaggaggagcgcatgcgcatggagtctagacgacaggccacagtgtcttgggactctgggggctccgacgaggctcccccaaaaccgtcacgacctggttatccctctcctaggtcctctgaggggttctatccttctccacagcacatggtccaaactaatcactatcaggatagcactgtgttggatctgagaggaattggacaggtactgcccacccacctcatggaagaaagactgatccgccagcagcaagagatggaagaagatcagaggtggcttgaaaaagaagagcgctttctcaaacccgacgtacggctttctagaggatccatcgaccgggaggatggctctttgcaaggtcccatcgggaatcagcacatataccagcccgtaggaaagccggaccctgccgccccgcccaaaaaaccgccacggcccggtgccccagggcatctaggctctctggcttctctgtcctcccccgccgactcatataacgagggagtgaagttgcaaccacaggaaatcagcccccctcccacagcgaatctggatcgcagcaatgacaaggtgtatgaaaacgtgactggcctggtgaaggctgtgattgagatgagttccaaaatccagcccgcccccccagaggaatacgttccaatggtcaaggaggtgggtcttgccctccgtactctcttggctactgtggacgagaccattcctttgctgcctgcaagtacacaccgcgagattgagatggcgcaaaaactcctaaattctgatcttggagaacttatcaacaagatgaaactggcgcagcagtacgtcatgacaagtctgcaacaggagtacaaaaagcagatgctgacagcagctcacgcactcgcagtggacgcaaagaacctcttggatgttatcgatcaggcgcgcctgaaaatgcttggccagactcgacctcactag

SEQ ID NO: 25920 - DNA, 2163 bp, Artificial Sequence
  Description of Artificial Sequence: Synthetic coding sequence
atggccgacctgatcgacggctactgccggctggtgaacggcaccagccaatccttcatcatccgccctcagaaagagggcgaaagggctctgccatccattcccaaactcgccaattctgagaaacagggcatgcgaacccacgccgtgagcgtgtcagagacagacgactatgccgagatcatcgatgaggaggacacctacaccatgccttccaagagctatggaatagatgaagcacgcgattacgagatccagcgggagagaatcgagctgggcaggtgtattggcgaggggcagtttggggacgtgcatcagggaatttatatgtctcccgagaaccctgcactggctgtggcaatcaaaacctgcaaaaactgcacgtctgattccgtgcgggagaaattccttcaagaggctctcactatgaggcagttcgaccatccgcatatcgtcaaactgattggtgtgattaccgaaaatcccgtgtggattattatggaactgtgtacactaggtgagctgagaagtttcctccaggtgaggaagtattctctggacttagcctcacttatcctatacgcctatcaactctctaccgccctcgcatatttagagagtaaacggtttgtccatcgcgacatcgccgccaggaacgtcctggtgtcaagcaatgattgcgtgaaacttggcgatttcggcctgagccgctatatggaagattcgacttattataaagctagtaagggtaagctgcccatcaagtggatggcacccgaatcgatcaatttcagacgattcacatccgcgtctgatgtttggatgttcggagtttgcatgtgggagatcttgatgcacggggttaaacccttccagggcgtgaagaataatgatgttattggcagaatcgagaacggtgagcgattaccaatgccgccgaattgtcctcccacattatattccctcatgacaaagtgctgggcctatgacccgtctcgccgccctcgattcacagaacttaaggctcaattgagcaccatactcgaggaagagaaggcacagcaggaagaaagaatgcgcatggaatctcgccggcaagctacagtgtcgtgggactcaggcgggtccgacgaggcgccacctaagccatcccggccgggctatccctctccacggagctccgagggcttctatcccagcccgcaacatatggtccagaccaaccactaccaggtctccgggtaccccgggagtcatgggatcacagctatggctggtagtatttacccgggacaggcctccttgctggatcagaccgactcttggaatcacagaccgcaggagatcgccatgtggcagcccaacgtagaggattcaactgtccttgacttacgtggaatcggacaggtcctgcccacccaccttatggaagagagactgatccggcagcagcaagagatggaggaagaccagcggtggttggaaaaagaggagcgctttctgaagcccgacgtgagattgtcacgagggtctattgaccgggaggatggctcattgcagggtccaattgggaatcagcatatttatcaacctgttggcaagccggatccggccgctcctcctaaaaagcccccacggcctggtgcccctggccaccttggctccctggcgtccttatcatctcccgccgatagctataacgaaggggtgaaattgcaacctcaggaaatctcacctccccccaccgctaacctggacagaagcaacgataaggtctacgaaaatgtcactggcttagttaaggctgtaattgagatgtccagtaaaatacagccggcgccacctgaagaatatgtgccaatggtcaaagaagtaggtctcgcactgaggaccctcctcgccaccgtcgacgagactatccctctgctccccgcttcaacacacagagaaattgagatggctcaaaaacttctgaatagcgacctgggagagctgattaacaagatgaaacttgcccagcagtatgtgatgacatctctacaacaagagtacaaaaagcagatgctcaccgccgcccacgccttagcagtggatgcaaagaacctgctggacgtgatcgatcaggcccggcttaagatgctcggtcaaactcgccctcattag

SEQ ID NO: 25921 - DNA, 3198 bp, Artificial Sequence
  Description of Artificial Sequence: Synthetic coding sequence
atggccgccgcctacctggaccccaacctgaaccacacccccaacagcagcaccaaaacccatctgggaactgggatggagcggtcaccaggagctatggaaagggtgctgaaagtgttccactatttcgaaagcaactcggagccgacaacctgggcttcaatcatcaggcacggggacgccactgatgttaggggcattattcagaagattgtggacagccataaggtgaaacatgttgcttgctacggattccgattgagccacctgagaagcgaggaagtccactggttgcacgtggacatgggcgtctctagcgtgagagaaaagtatgaattggcgcacccgcctgaggagtggaaatatgaactccggatccggtaccttcctaagggtttcctcaaccagtttacagaagacaaaccgacattgaatttcttctaccaacaggtcaagagcgattacatgctggagatcgccgatcaagtggatcaggaaatcgccctgaaactgggttgcttggagatccgacgctcttactgggaaatgagaggtaacgcactggagaagaagagcaattacgaagtgctggagaaagacgttggcttgaagcgattcttcccgaaatctctgctggatagtgtgaaggctaaaaccttgcgcaagttaattcagcagacatttcgccagtttgcaaatctgaacagagaggagagcattcttaaattctttgagatcctgtcccccgtgtacaggtttgataaggagtgctttaagtgtgccctgggatcttcatggatcatctccgtcgaactggccatcggaccagaagaagggatcagttacctgacggataaaggctgtaatcccacccacctagcggacttcacccaggtacagactatccagtactctaacagcgaagataaagatagaaagggcatgctacagcttaagattgctggagccccagaaccgctgactgttacagcccccagcttgaccatcgccgagaatatggcagatctcatcgatggatattgtcgactcgttaacggaacaagtcagtcatttattataaggccacagaaggaaggggaacgagctttgcctagtatccctaaactagccaatagtgagaagcaaggtatgagaacccacgctgtaagcgtatccgagaccgacgattatgccgaaataatcgatgaggaggatacatataccatgcccagtacacgagactacgaaatccagagggagcgcatcgagctcggccggtgtattggggagggacagtttggagatgtgcatcaaggtatttacatgtctcccgaaaaccccgctctggcagtggccatcaagacttgtaagaactgcacatcagacagcgtccgcgaaaaattcctgcaggaggctctcacaatgagacaattcgaccaccctcatatcgtgaagctgatcggcgttattactgagaacccggtgtggatcattatggaattatgtaccctcggggaattgcgtagtttccttcaggtccggaaatactcgctagacctggcctccctgatcctgtacgcctatcaactttctactgccctggcatacctggagtcaaaacgtttcgtgcatagagatattgcagctcgcaacgtcctcgtgagctctaatgattgcgtgaagctgggagatttcggcctctccagatacatggaagatagcacatattataaagcttcaaaaggtaagttacccataaaatggatggctccagaaagcattaacttcaggcggttcacatccgcttctgacgtgtggatgttcggggtgtgcatgtgggaaatcctgatgcatggtgtgaagccttttcagggagttaaaaacaatgacgtgattgggcgaatagagaatggggagagactgcctatgcctccaaattgcccaccgacactatacagcctgatgaccaagtgttgggcttatgacccaagccgccggccacgattcactgagctgaaagcgcagttgtccactatcctggaggaagaaaaggcccaacaagaggagcgaatgcgcatggagagtcgacgtcaggcaacggtgtcatgggacagtggtggaagtgacgaagcacctcccaaaccttcacgacccgggtaccctagtcctcgctcgagcgaagggttttacccctccccccagcacatggtgcagaccaaccactaccaagtgagtggataccctggttcacatggcattactgccatggccgggagcatataccccggacaagcatcgctacttgatcagactgattcttggaaccaccggccgcaggagatcgctatgtggcagccaaacgtggaggactcaacagtgttagacttgcgcgggatcggtcaagtgctgcctacccacctgatggaggagcggcttatacgacagcagcaagaaatggaagaggaccagcgatggctcgaaaaggaagagcggttcttgaagccggatgtcaggctttcccgcggctcaatcgatagggaagacggaagcttgcaaggccccataggcaatcagcatatctaccagccagtcgggaagccaggcaaagaggaaaagaattgggctgaacgcaatccagcggcccctccaaaaaagccgccaagacccggcgcacccgggcatcttggcagcctggcttcactatcaagcccagccgacagttataatgaaggcgtgaaaccctggcggcttcagcctcaagagatctctcccccccccactgccaatctcgatagaagtaacgataaagtctatgaaaacgtaactgggctggttaaggctgtgatcgagatgtcctcaaagattcagcctgcccctcccgaagagtacgtgcctatggtgaaagaggtcggcctggctttgcggactcttttggcgactgtcgatgagaccatacccctattaccagcatccacccaccgcgagattgaaatggcccagaaattactcaattctgatctgggggagctcataaataaaatgaagttggcacagcagtacgttatgaccagcctccagcaggagtacaagaaacagatgctcaccgccgcccatgccttggccgtcgacgctaaaaatctgctggacgtcatagatcaggctcgcctgaagatgctgggacagacccgaccacactag

SEQ ID NO: 25922 - DNA, 2904 bp, Artificial Sequence
  Description of Artificial Sequence: Synthetic coding sequence
atgagcggcgtgagcgagcccctgagccgggtgaagctgggcaccctgcggagacccgagggccctgctgagcctatggtggtggtacctgtcgacgtcgaaaaggaggatgtgcggattttgaaggtgtgtttctattccaattcttttaaccctggtaagaacttcaaattggttaaatgcactgtgcagactgagattcgcgagataatcacctctatccttctctctgggcggataggccccaatattagactggccgagtgttacggactgcgcttgaaacacatgaagtcagatgaaattcattggcttcatcctcagatgaccgtgggtgaagtgcaagataagtacgagtgtctgcacgtggaagccgaatggcgctacgatttgcagatccgatatctcccagaagactttatggagagcctgaaagaggaccgtacaaccctgctgtacttctaccagcagctccgaaacgattatatgcaacgctacgccagtaaagtgagtgaagggatggccctccagcttggatgtttggagcttaggcgattctttaaggacatgccccataacgctctggacaagaagagcaactttgaattgctcgaaaaggaggtgggcctcgacttattcttccccaagcagatgcaggagaaccttaagccaaaacaatttcgcaagatgatccagcagaccttccagcaatatgcgtcattacgtgaggaggaatgtgtcatgaagttcttcaacactctggccgggtttgctaatatcgatcaggagacgtacaggtgcgagcttatccagggctggaacattactgtcgatctggtcatcggcccaaagggaatcagacaattaaccagtcaggacgctaaacctacatgtctggccgagtttaaacaaatcagatcaattcgatgccttccacttgaggaaggacaagcagtgctccagctgggcattgaaggagcacctcaggctctctcaattaaaacatcgtccctggcagaggccgaaaacatggccgacttaatcgacgggtattgtaggctgcaaggcgaacaccagggaagcctgataattcaccctcgcaaagatggcgaaaaaaggaatagcctgccccagatccctatgcttaatctcgaggccagaaggtcccacctgtccgagtcttgttctatcgaatcagacatatatgcagaaatccctgacgagaccctccggagacctgggggtcctcaatatgggatcgcgcgcgaagacgttgtgctgaaccgcatactgggcgaggggttcttcggcgaggtgtacgagggggtttatacaaaccacaagggagaaaaaatcaacgtggccgtcaagacttgcaaaaaggactgtacactggacaacaaggaaaaattcatgtcggaggccgtgataatgaagaacctcgatcatccccacatcgttaaactgatcggcataatcgaagaagaacccacgtggatcatcatggaattatacccttacggggagttgggccattaccttgaaagaaacaaaaatagtctgaaagtgcttactctcgtgctgtatagcctccagatatgcaaggctatggcctacctagaatcgatcaactgcgttcatcgcgatattgcagtgaggaatatccttgtcgccagccctgagtgtgtgaagctgggggacttcggtctctctaggtatatcgaagatgaggactattacaaagcaagcgtgaccagactcccaatcaagtggatgtctcctgagtcgatcaatttcagaagatttaccactgcctctgatgtctggatgttcgctgtttgcatgtgggaaatactctcattcggcaagcagccatttttttggctcgaaaataaggatgtgatcggcgtgctggaaaagggcgacagacttccaaaaccagacctttgccccccagtgctgtatacgcttatgacccggtgctgggactatgaccccagtgatcgaccaagattcaccgaactggtctgctcactgtctgacgtgtaccagatggaaaaggacatagcaatggagcaggaacggaatgcccgctaccgaaccccaaaaatactggagcctacagctttccaggagccacctcccaaaccttctaggcccaagtatcgacctccgccccagacaaacctcctggcgccaaagcttcagttccaggaggaggatttcattcagccttcgtccagagaagaggcccaacagctttgggaagctgagaaggtgaagatgcgccagattctcgataagcaacagaagcagatggttgaggactaccagtggttgaggcaagaggagaaatcgttggatccaatggtatacatgaacgataagagtcccctgacacctgaaaaagaagtgggctacctggagtttacaggcccccctcaaaagcccccccgcttgggtgcacagagtatccaacctactgccaacttggatagaaccgatgacttggtttacctgaacgtgatggagctggtgagggcagtactggagttgaagaacgagctgtgtcaactgccacctgagggatacgtggtagtagttaaaaatgtggggttgacattgaggaaactgatcgggtccgtagacgatcttctgccctctctgccaagtagcagcaggacagagattgagggcacacaaaagctgcttaacaaagaccttgctgagttgataaacaagatgagattagcacagcagaatgctgtcacctccttaagcgaagagtgcaagagacagatgctgacagctagtcatactcttgctgtggatgctaagaacctcctggacgccgtggatcaagcaaaagtgctggccaacctcgcacatcctcctgctgagtag

SEQ ID NO: 25923 - DNA, 3030 bp, Artificial Sequence
  Description of Artificial Sequence: Synthetic coding sequence
atgagcggcgtgagcgagcccctgagccgggtgaagctgggcaccctccgccgccccgaagggccagccgagccgatggtggttgtgccagtggacgtggagaaggaggacgtgaggatcttgaaagtgtgtttttactccaattcctttaacccaggaaagaacttcaagctcgtgaagtgcacagtccagacggaaataagggagattataacatccattctgctctctggccgtattgggcccaatattcggctcgccgaatgttatggtctcagattgaagcatatgaagtctgacgaaatccactggcttcaccctcagatgacagtgggagaagttcaggataaatacgagtgtttacacgttgaagcggaatggcggtatgacctacagatcagatacctcccagaagatttcatggagtccctgaaagaggataggactactcttttgtacttttaccagcagttacggaatgactatatgcagagatacgcaagcaaggtctccgaaggtatggcactgcaactgggttgcctcgaactccgtagatttttcaaggacatgccccataacgcacttgacaagaaaagcaatttcgaactgctcgagaaggaagttggcttggacctgttctttcccaagcaaatgcaggagaaccttaagcctaagcagtttagaaagatgattcagcaaacatttcagcagtacgcatcactgagggaagaagaatgcgtgatgaagttttttaacactctggctggttttgcgaacatagaccaggagacctataggtgcgagttaatacagggttggaatatcaccgtggacttagtaattggacctaaagggatccggcagcttacatcgcaggatgccaaaccaacctgtttggctgagttcaaacagataaggagtattagatgtcttcccctagaggaaggccaagctgtgctgcaattgggaatcgagggggcccctcaggctctgtccattaagacgagttccctggccgaggctgagaacatggcggatctcattgacggatattgtcggctgcagggagaacaccaagggtcgctgattattcatcctagaaaagacggcgaaaagaggaacagtctcccgcaaatacccatgttaaacttggaagctagacgctcacatttgtctgagagctgttctattgaatcagacatttatgccgagattcctgacgaaacgttgagacgaccgggcgggccccagtacgggatcgccagagaggatgtggtgctgaaccggatcctaggggagggcttctttggtgaagtctacgagggagtctacactaaccacaaaggtgagaagatcaacgttgcggtgaaaacctgcaaaaaggactgtacactcgacaacaaagagaaattcatgtccgaagctgtgatcatgaaaaacctagatcacccccacatcgttaaattaatcgggatcattgaggaagaacctacgtggattatcatggaactgtatccatacggcgagcttggacactatctggagaggaataaaaattctctgaaggtgctgacccttgtcctctacagcctccaaatttgtaaagctatggcctacctggaaagcatcaactgcgtgcaccgtgacattgctgtgaggaacatcctcgtcgctagtcccgagtgcgtgaagctcggcgattttggactcagcaggtatatagaagatgaggactactataaggcctcagtcacgcggttgcccattaaatggatgagtccggagtcgatcaactttcggagatttaccactgcaagcgacgtctggatgttcgccgtgtgcatgtgggaaattcttagcttcgggaagcaacccttcttttggctggaaaacaaggatgtcatcggcgtgctggagaagggcgatagactacccaaaccggatctgtgtcccccagtgctgtacaccctgatgacaagatgttgggattacgacccctcagatcgaccgcgctttacagaactggtatgtagcctgtccgacgtttaccagatggagaaggacattgctatggaacaggagcgaaacgcacggtatcgaactcctaaaatacttgaacctaccgccttccaagagccaccacccaagcccagcaggcccaagtatcgcccccccccacagacgaacctccttgcgcctaagctgcagtttcaggtcccggagggtctgtgtgccagttcacctacactgacctcaccaatggaatatccgtctcccgtcaactcccttcacacgcctcctttgcacaggcacaatgtgtttaagcggcattctatgcgcgaggaggacttcatccagccctcttcacgggaggaagctcagcagttatgggaggcagaaaaagtgaagatgcgtcagatactggacaagcaacagaaacagatggtggaggactaccagtggctccggcaggaggaaaagagcctggaccccatggtgtacatgaatgataagtctccgctgacccctgaaaaagaggtcggatacctggaatttacaggcccaccccaaaagccacctcgcttgggtgcccagagcattcagccaaccgctaatctcgaccgaacagatgatctggtgtatctgaacgtgatggagctcgtgcgcgccgtgcttgagctcaagaacgagttgtgtcaactgcccccagaaggctatgtcgtcgttgtgaagaatgttggtcttacgctgcgcaagctcatcggatcagtcgatgatctgctgccttcactaccttccagtagccggaccgaaattgagggcacccagaaactgctcaataaggacctagcagaactgattaacaagatgaggctagctcagcagaacgccgtcacttctctgagtgaggagtgtaaacggcagatgttgacagctagccacaccctggcagtggatgctaagaatcttctcgacgccgtcgaccaggcgaaggtgttggccaacttagcacacccccctgctgaatag

SEQ ID NO: 25924 - DNA, 3030 bp, Artificial Sequence
  Description of Artificial Sequence: Synthetic coding sequence
atgagcggcgtgagcgagcccctgagccgggtgaagctgggcaccttacgacggcctgaaggccctgccgagcccatggtggtcgtgcccgttgatgtggagaaagaagatgttcgcatactgaaggtctgtttctattctaactcgttcaatcctggtaagaatttcaagttggtgaagtgcaccgtccagacggagatccgagagattatcacttctattctgctttcgggcaggattggtcccaacatcaggctggcagaatgttacggtctcagactcaaacacatgaaatccgacgaaatacattggctgcatccacagatgaccgtgggagaggtgcaggataaatatgagtgcttgcacgtcgaggccgaatggagatatgacttacagatcagatatctgcctgaggacttcatggaaagcctgaaggaagatcggaccacgcttctgtatttctatcagcaactgagaaatgattacatgcaacgatacgcatctaaagtctcggaagggatggctctacagctgggatgcctcgaactccggcgtttcttcaaggatatgcctcacaatgctctagataagaaaagtaactttgaattgctggagaaggaggtgggcctggacctgtttttcccgaagcagatgcaagagaatctgaagccgaagcaatttcggaagatgatccagcaaacgtttcagcagtacgcaagcctgcgtgaagaagagtgcgtgatgaagtttttcaacaccctggccggctttgccaatatcgaccaggagacttacagatgtgaactcatccaagggtggaatattacagtcgatcttgtaatcgggccgaaggggatccggcagcttacctcccaggatgcaaagccgacatgcctagcagaattcaagcagatcaggagtatacggtgtttaccattggaagaagggcaggccgtcctgcagctggggatcgagggagccccccaggctctctcaataaagaccagcagtctcgccgaggccgaaaatatggctgatcttatcgatggatactgcagattgcagggagagcaccagggaagcttaattattcacccaagaaaagacggggaaaaacggaattctttaccccagatccccatgctgaacctggaggcacgacgctcccatctgtcggagagttgcagtattgagtccgatatttacgccgagattccggacgagaccctgaggcgcccgggcggcccccagtatggaattgcccgcgaagatgtggtactgaatcgcatcctcggtgagggattttttggagaggtgtatgaaggcgtgtataccaatcacaaaggagaaaaaatcaacgtcgctgtcaagacatgtaagaaagactgtaccctcgataataaggagaaattcatgtctgaagctgtgatcatgaaaaacctggatcatccccatattgtgaaactcatagggattatcgaggaagagcccacctggattatcatggagctgtacccatatggagagctgggacactacttggagagaaataagaattcgctcaaagtactgaccctggtgctgtacagtttgcagatctgcaaggccatggcctatttggagtccatcaattgcgtacatagagatattgctgtcagaaatattctggtagccagtccagagtgcgtgaaactgggagactttggcttaagccgctatatcgaggacgaagattactataaagcttctgtgacaagactccccataaagtggatgagcccagaaagcatcaactttcgtcgcttcacaaccgcttccgacgtgtggatgtttgctgtttgcatgtgggaaatcctgtcttttgggaagcagccattcttttggctggaaaataaggatgtgataggggtgctggaaaagggtgatagactccccaaaccagatctgtgtcccccagtgctgtataccctcatgacacggtgttgggactacgacccatccgaccgacctcggttcacagaactggtgtgcagcttgagcgatgtgtatcagatggaaaaggacattgcaatggagcaggagcgcaatgctagatataggacacctaaaattctggagcccaccgcatttcaggaaccccccccaaaacctagcagacccaagtaccgtcctccaccccagactaaccttcttgcacccaaactgcagttccaggtccctgaaggactgtgtgcgtcatcgcccaccttgaccagccccatggagtacccaagcccagtgaattcgttacatactcctcctttgcaccggcacaacgtcttcaagcgccactctatgcgggaagaagatttcattcaaccctcctcacgggaggaggcccaacagctgtgggaggccgagaaggtgaagatgcggcagattcttgacaagcaacagaaacagatggtggaggattaccagtggctgaggcaggaagagaagtctttggaccccatggtgtatatgaacgacaagagcccactgacccccgagaaagaagtgggttatctggagttcaccggccccccacagaaacctccgaggttgggggcacagtctatccaaccaaccgccaatttggatagaactgacgatctcgtgtatctcaacgttatggagttggtgcgtgcagtactggagctgaagaacgaactgtgccagcttccccccgaaggttacgttgttgtcgtgaaaaacgtgggcctcaccttgaggaagcttattggttcagtcgacgacctgctgccaagcctcccatcgagctcacgtacagagatcgaaggaacccagaagctgctgaataaggatctggcagagctgatcaataagatgcggttagctcagcaaaacgcagtaacctcgctgagtgaggagtgcaagcgccagatgctgaccgccagtcacacactcgccgtggacgccaaaaatctcctcgatgccgtagaccaagccaaggtgttggctaacctggctcacccccccgccgaatag

SEQ ID NO: 25925 - DNA, 2904 bp, Artificial Sequence
  Description of Artificial Sequence: Synthetic coding sequence
atgagcggcgtgagcgagcccctgagccgggtgaagctgggcaccctacgacggcccgagggaccagccgaacccatggtggtggtgcctgttgacgttgagaaagaggatgtgcggatcttaaaggtttgcttttattcaaacagcttcaaccccggtaagaactttaagcttgtcaagtgtacagttcagacagagatccgcgaaatcatcacttccatccttctgtcaggccgaatcggcccgaacatcagactggcggagtgctacggcctccgcctgaaacatatgaagagcgacgagatccactggctgcaccctcaaatgactgtgggtgaagtgcaggataagtatgaatgtctgcacgtggaagcagaatggcgctatgacttgcagattcgatacctgcctgaagactttatggagtccttaaaagaagatagaacgacccttttgtacttttatcaacagctacgcaacgactatatgcagcgttatgccagcaaggtctctgagggcatggcgctccagttgggctgtctggagttgagaaggttcttcaaggatatgcctcataatgctctagacaaaaaatcaaatttcgagctgttagagaaggaggtgggcctggatctgttctttccaaagcagatgcaggagaatctgaagccaaaacaattccggaagatgattcaacagacatttcaacagtacgcttccttgagggaagaagagtgcgttatgaaattcttcaacactcttgcaggctttgcaaatatcgaccaggagacatacaggtgcgagctgattcagggatggaatataactgtcgaccttgtgatcgggcccaagggtatccgccagctgacatcccaggacgccaagcccacatgtttggccgaattcaagcagatcaggtcaataagatgcctgccactggaggaggggcaggccgtgctgcagttaggaatagagggtgccccccaggccttgtctatcaaaacgagttctctggccgaagctgagaatatggccgacctgatcgacggctactgtcgcctgcagggggagcatcagggttccctgattatccaccccaggaaagacggagagaaacgcaactcactgcctcagatcccgatgctcaatctggaggcaagacggtcgcatctgtcagagtcatgtagcatcgagtccgacatctacgccgaaattcctgacgagacgctgagaagaccaggaggacctcagtacggcatcgccagggaagatgttgttttgaatagaatcctgggagagggcttcttcggcgaagtctacgagggtgtttacaccaatcacaagggggaaaaaattaacgtggccgttaagacatgcaaaaaagactgcacactcgataacaaagaaaaattcatgtccgaggcagtgatcatgaagaatttagatcatcctcacatagtgaagctgatagggatcatcgaggaggagccaacttggatcattatggaactttacccctatggagagctgggacattatttggaacgaaataaaaatagcctcaaagtgctgacccttgtgctgtactcactccagatatgtaaggcgatggcctacctggagtccataaattgcgttcatcgggacattgccgtgaggaacatactggtggcttctcccgagtgcgtgaagcttggcgacttcgggcttagtagatacatcgaggatgaggattattataaggcgagcgtaactcgcctgcccatcaagtggatgagtcctgaatccattaactttcgacgcttcacaaccgcctccgacgtttggatgtttgccgtgtgtatgtgggaaatattatccttcggcaagcaaccctttttctggctcgaaaacaaagatgtgatcggagtgctggagaagggagaccggcttccgaagccagacttatgccctccagttctttacacactcatgaccaggtgctgggactacgatcccagcgacaggccccgatttaccgaactagtctgttctctgtcagacgtatatcagatggagaaggatattgccatggagcaggagcggaacgccaggtaccgcacacctaagattcttgagccaaccgccttccaggaaccacctcctaagcccagcagaccaaagtaccgaccaccgcctcagactaacctactggccccaaagctgcaattccaggaagaagactttattcagccatcaagcagggaggaagcacagcagctctgggaagcggaaaaggtaaagatgcgacagatcttagataaacagcagaagcagatggtcgaggattaccagtggttgagacaggaggagaaatctctggatccaatggtgtacatgaacgacaagagccctctcacaccagaaaaagaggtcgggtatctggagttcacggggccacctcagaagccaccccgcttgggtgctcagtctattcaacccaccgccaatctcgatcgcacagatgatctggtctacctgaatgtcatggagttagtgcgggccgtactagaactgaaaaatgagctgtgtcagcttcctccagagggatatgtggtggtggtgaaaaatgtgggactcacattacgcaaactcattggctccgtagatgatcttttaccgagtctgccctctagcagtcgaaccgaaattgaggggacccagaagctgctgaacaaggatctggccgaactgatcaacaagatgaggttggctcagcagaacgccgttacttccctgagcgaggaatgcaagcgccagatgttaaccgcctctcacaccctggccgtggacgcgaagaatctgctggatgctgtggaccaggccaaggtcctcgccaacctggcacatccaccagccgagtag

SEQ ID NO: 25926 - DNA, 2904 bp, Artificial Sequence
  Description of Artificial Sequence: Synthetic coding sequence
atgagcggcgtgagcgagcccctgagccgggtgaagctgggcaccctgcgacgaccggaaggtccagctgagccaatggtcgttgttcctgttgacgtcgagaaagaggatgtgcggattctgaaagtttgtttctatagtaacagctttaaccctggaaagaactttaaacttgtcaaatgtacagtccagactgaaatcagagagattatcactagtattctattaagtggccggattgggccaaacatccggttggctgagtgttatgggcttaggctaaaacacatgaagtcggacgaaatccactggcttcatccacagatgaccgtcggggaggttcaagataaatacgaatgtctgcacgtggaggccgaatggagatacgaccttcagatcagatacctgcctgaagattttatggagtcgctgaaggaggatcggactaccctgctgtacttctatcaacagctgagaaacgattacatgcaaaggtatgccagtaaggtgtccgaaggaatggctctacagctgggttgtcttgagttacgtcgattctttaaggacatgccccacaatgctcttgacaaaaaatcaaacttcgagctgttagagaaggaggtaggactcgatctcttctttccaaaacagatgcaggagaacctgaaacccaagcagtttaggaagatgatccagcaaacattccagcagtatgcgagtctgagggaagaggaatgcgtgatgaagttcttcaatactttagctggattcgctaacatagaccaggaaacgtacaggtgcgaacttattcagggatggaacattacagtcgatcttgtgattggccctaaagggatcagacagttaacgagccaggacgctaagccaacatgcctcgcagaatttaagcaaatcagaagtatcaggtgcctcccgttggaggaaggccaagcagttttgcagctcgggatagagggtgctccacaagccctgagcatcaaaaccagcagtctggccgaggcagaaaatatggcagatctgatagacgggtactgtagattacagggcgagcatcagggttctctcatcattcatccgcgcaaagatggcgagaaaagaaactccttgccgcagatacccatgctcaatttagaagctagacgtagtcacctaagcgaaagctgctccattgagtcagatatctacgctgaaatcccagatgagacactcagaaggccaggaggcccgcaatacggcatagcccgggaagatgtggtgctgaacagaattctgggagaaggcttcttcggcgaagtgtatgagggcgtgtacacaaatcacaaaggcgagaagataaacgtggccgtcaagacttgcaaaaaagactgtacactagacaacaaggagaaattcatgagtgaggccgtcataatgaaaaacctggatcatccacacatcgttaagctcattggcataatcgaagaagaacctacctggatcatcatggaactgtacccttacggcgagcttggacattatctcgaaaggaacaagaacagcctcaaagtgctcactctagtgctgtatagtctccaaatctgcaaagcgatggcttacctcgagagcatcaattgcgttcatagagacatagcagtgcgtaacatattagtggcgtcccctgagtgtgtgaagttaggggacttcggccttagcaggtatatcgaggacgaagactactataaggcatccgtgacaagactgccaatcaaatggatgtcccctgagtccattaacttcagacggtttaccaccgcctctgacgtgtggatgtttgctgtatgtatgtgggagatactgagcttcggaaaacagccttttttttggctggaaaacaaggatgttatcggcgtgcttgaaaaaggtgataggctaccaaaaccggacctgtgccccccagttctctacaccctgatgacaaggtgttgggactacgacccaagcgacaggccacgctttacagagttggtgtgttctttgtcagatgtataccaaatggagaaggatattgctatggagcaggagcgcaatgcccgctaccggacacccaagatcttggaacccacagccttccaggagcccccccccaagcccagccgacccaagtaccgacctcccccccaaaccaacctgcttgcccccaagcttcagttccaggaggaggacttcatacagccgagtagccgtgaggaggcgcagcagctgtgggaggcagaaaaggttaagatgcggcaaattctcgataaacagcagaagcaaatggtggaagattaccagtggctgcggcaggaggagaagagcctggaccccatggtgtacatgaacgacaaatccccccttactcccgagaaagaggtgggctacctcgaatttacaggcccaccccaaaaaccacctcggttgggagcccagagtatccagcctaccgcaaatctggatcgaaccgacgacctggtctatctgaacgtcatggaattggtccgcgccgttctcgagctcaaaaatgaactgtgtcagttgcctccagagggatatgtggtggtggtcaagaacgtcggcctcactctgaggaaattaattgggtcggtggacgacctgctgcccagcctgccatctagctcccgcacggaaatcgaagggacgcagaagctgctgaacaaggatctggctgaattaatcaacaagatgagattagctcagcagaacgccgtgaccagtttgtctgaagagtgtaagagacagatgctaactgcctcacataccctcgcggtcgatgcaaaaaacctcctggacgcggtggaccaggccaaggttttggccaatcttgctcaccctcctgccgagtag

SEQ ID NO: 25927 - DNA, 2409 bp, Artificial Sequence
  Description of Artificial Sequence: Synthetic coding sequence
ctgctgcccgagcggatgagcggcgtgagcgagcccctgagccgggtgaagttaggcaccctacggcgccccgaaggtcctgccgaacctatggtggtggtccccgtggacgtcgagaaggaagatgtgagaatactgaaggtgtgtttctattccaattcatttaatcccggcaagaacttcaaactcgtcaagtgtactgtccaaacagagatcagagaaatcatcacctctatcctcttatccggtaggatcggtccaaatatcaggctggcagagtgctatgggctacggttaaagcatatgaagtctgatgagatccactggctgcacccgcagatgaccgttggggaggtgcaggacaaatacgaatgcctgcatgtcgaggcggagtggcggtatgacttacagatcagatacctgcccgaggacttcatggagtccttgaaagaggaccggactactctactctatttttaccaacagctcagaaatgactacatgcagagatacgctagtaaggtgtcagagggcatggcccttcagctgggatgtctggaactccgcagattcttcaaggatatgccccacaatgctttagataagaaatcgaactttgagttactggagaaggaagtggggctcgatttgttctttcctaagcagatgcaggagaatctcaaacccaagcagttccgcaaaatgattcaacaaacttttcagcaatacgcctcattacgcgaggaagaatgcgttatgaagttttttaataccctagcaggtttcgccaatattgatcaagaaacctaccgctgcgagctgatacaaggttggaatattacagtcgatttggtgatcggaccaaagggcatccgacaattgaccagccaggacgcaaagccaacatgcctggcggagtttaagcagatccggtctatcaggtgcctgcctctggaggaggggcaagcagtactgcagctcgggattgaaggcgccccccaggccctatccataaaaactagttcgctggccgaggccgaaaatatggccgatctgattgacggttattgtcgactccagggagaacatcaagggtcactgattatccatccacggaaagatggcgaaaagcgaaactccctgcctcaaatcccgatgcttaacctggaggctaggcggtcccacctgtctgagtcctgttctatcgagtccgacatttacgccgaaattcctgacgagaccctgcggcgccccggaggccctcagtacgggattgctagggaggatgttgtgctgaaccgcattctgggcgagggattctttggagaggtgtacgagggagtctacactaaccataaaggagaaaagattaatgtcgcagtgaaaacatgcaaaaaagattgcacccttgacaataaggagaaattcatgtccgaggctgtcatcatgaagaacttggaccatccccacattgtgaagctcatcggaataattgaagaggagccgacgtggatcatcatggaactctacccatacggggagcttggccattatttagaacggaacaagaattccctgaaggtgttgaccttagtactgtatagtttgcagatctgtaaggcaatggcctatcttgagagtatcaactgtgtccatcgcgacattgccgtccgcaacattcttgtagcgtcccctgaatgtgtaaagttgggcgattttgggctgagtcggtacatagaggacgaggactactataaggctagtgtgacccgtttgcctataaagtggatgtcacccgagtccattaactttagaagatttactactgcttctgatgtctggatgttcgctgtgtgtatgtgggagatcctttcttttgggaagcagccttttttttggctcgagaataaggacgttatcggagtgttggagaagggcgataggttgccgaagcccgacctgtgtccacccgtgctgtacacccttatgacgagatgctgggactacgaccccagcgatcggcctagattcacagaactcgtttgttcccttagtgacgtgtaccaaatggaaaaggatatcgctatggagcaagagaggaatgcacggtaccgaactccaaagattctggagccaacagcctttcaagaaccacccccaaagccctcacgccctaagtaccgcccgcccccacagactaacctcctggcacctaagttgcagttccaggtaccagagggtctctgtgcaagctcccctacattgacttcacctatggagtatccttctcctgttaactctctgcacactcccccactccataggcataacgtctttaagaggcatagtatgcgggaggaagacttcattcaaccctcatccagggggcccgctgccgttggcggctag

SEQ ID NO: 25928 - DNA, 3030 bp, Artificial Sequence
  Description of Artificial Sequence: Synthetic coding sequence
atgagcggcgtgagcgagcccctgagccgggtgaagctgggcaccttgcggcgtccagaaggccccgccgagcccatggttgttgtgcccgtggacgtggagaaagaagatgtgaggattctaaaagtatgtttctattcaaactcatttaatccgggcaagaattttaagctcgtaaagtgtaccgtacagacggagatcagggaaatcataacaagtatcctgctttccggacggattgggcctaatatccggctcgctgaatgctacggtttgcggctaaagcacatgaaatcagacgaaattcattggttgcacccacagatgaccgtgggtgaggttcaggataagtatgaatgtttgcatgttgaggcagagtggcgatacgacttgcagatcagatacttaccagaagattttatggagtcactgaaagaagatagaaccactctgctgtacttctaccagcagttgagaaacgattacatgcaaaggtacgcttcaaaagtgtcagaggggatggctttgcagctgggatgtctcgaactgcgccggtttttcaaagatatgccccacaacgctcttgacaaaaagtctaatttcgagctacttgagaaagaagtgggcctcgacttgttttttcccaaacagatgcaggagaacttgaagcctaagcaatttcgcaaaatgatccagcagactttccagcagtacgcttccctgcgagaggaggaatgcgtcatgaaattttttaataccctggctggttttgccaacattgaccaggaaacttaccggtgcgagctgatccaggggtggaatataaccgtggatctggtgattggccctaaggggattcgacagttaaccagccaggatgccaaacccacgtgcctggctgagtttaagcagattcggtcaatccggtgcctgccactggaggaggggcaggccgtcctgcagctgggtatagaaggagctcctcaggctctttccatcaaaacatccagcctggccgaggccgaaaacatggccgacctgattgacggctattgtagattgcagggagaacaccagggctcgttgataattcaccccagaaaagacggcgaaaaacggaatagtctgcctcagatacccatgctgaacctggaagccagacgcagtcacctgtcggaaagctgctctatcgaatctgatatatatgcggagattccagacgagacactgaggcgacccggcggcccacagtatggtattgcccgggaagacgtcgtgttaaaccgaatcctgggagagggtttcttcggcgaggtctacgaaggcgtatataccaatcataaaggagagaagattaatgtcgccgttaaaacctgcaaaaaagattgcaccttggacaataaggaaaagtttatgtcagaggcggtgatcatgaagaacctcgaccatccccacatcgtgaaactgatcggcattatcgaggaggagcctacctggattatcatggaactgtacccatacggagagttgggccactacctggagcgaaacaaaaattccctgaaagtactcaccctggtgctgtactcactacaaatatgtaaggccatggcatatctcgaatccattaattgtgtacatagggacatagctgtccgtaacatcttggtcgcatcgcctgagtgcgtgaagcttggggacttcggtctgtctagatatattgaggacgaagattattacaaagcttccgtgacacgcctgcccattaaatggatgagccctgagagtattaattttcggagattcacgacggctagcgacgtctggatgttcgccgtttgcatgtgggagatcttaagctttgggaaacaaccatttttttggctagaaaataaagatgtaataggagtcctggaaaaaggtgatagactgccaaagcctgatctgtgccctcccgtgctgtacaccctcatgaccaggtgttgggactacgacccttctgataggccgagatttaccgagctggtctgcagccttagtgatgtgtaccaaatggaaaaggatattgcaatggaacaggagcgcaacgcccgctataggacccccaagatcctggaaccaaccgctttccaggagcctccccccaagccctcccgccccaaataccgcccaccaccacagactaacctgcttgcgcctaagctgcagtttcaggtgcccgagggactctgtgcaagtagtccaacactgacgagcccaatggagtacccatcacccgtgaatagtctccacactcctcctttgcatcgccacaacgtcttcaaacggcattctatgcgggaggaggattttatacaaccatcctctcgagaggaagcacagcagctgtgggaggcagagaaagtcaaaatgagacaaattctggacaagcagcagaagcagatggtagaggattatcagtggctgaggcaggaggaaaaaagcctagatcctatggtttacatgaacgacaagtcacctcttacccccgagaaggaggtggggtatctcgagtttaccgggccacctcagaaacccccacgtctgggagcgcaaagcatccagcccactgctaatctggatcgaacagatgacctcgtttatctgaatgtgatggagctggtgcgcgcggttttggaactcaaaaatgaactctgtcagctgcctcctgaagggtacgtggtggtggtaaaaaacgttgggctaacacttagaaagttgattggttccgtggatgatttactgccatctctgccctctagcagccgaaccgagatagaaggtacccaaaagctcctgaataaggacctggctgaactaatcaacaagatgcgacttgctcagcagaacgctgttacctccctgtcagaggagtgcaaaagacagatgttgactgcttctcatacactggcagttgacgctaaaaatctgctcgacgcggtggaccaggctaaggtgcttgccaacctcgcccaccccccagctgagtag

SEQ ID NO: 25929 - DNA, 969 bp, Artificial Sequence
  Description of Artificial Sequence: Synthetic coding sequence
atggccgaccgggacagcggcagcgagcagggcggcgccgccctggggagcggggggagtctcgggcaccctggatcagggtccggcagtgggggagggggcggaggaggaggtggcggggggggtagcgggggcggcgggggcggtgccccgggaggactgcagcatgaaactcaggagctcgcttcgaaacgggttgatatacagaacaagagattctatcttgatgtgaagcagaatgccaaaggacgcttcctgaaaattgctgaggttggagccgggggcaacaaaagcaggctcaccttgtccatgtctgtagcagttgagtttcgtgactatttaggggactttatcgaacactacgctcaactgggtccttcccagcccccagatttggcccaggcacaggacgaaccacgccgcgctctcaagagcgaatttctggtgagagagaataggaaatactacatggacttaaaagaaaatcagcggggaaggttcctaagaatccgacaaacggttaatcggggccctggcttaggatccactcagggccagaccatcgccctgccagcgcagggcttgatagaatttagggacgccctggcgaagctgattgacgattacggggtggaggaagaacccgcggaattgccggaaggaaccagcctgacggttgacaacaagcggtttttttttgacgttggatccaacaaatacggagtctttatgcgggtgagcgaggttaaaccgacctaccggaatagtatcacagtcccatataaagtatgggctaagttcggacataccttctgtaaatatagcgaggagatgaaaaaaatccaggaaaaacagcgcgaaaagagagctgcatgtgagcagctacaccagcagcagcagcagcagcaggaagagactgcggcagccaccttgctcttacaaggggaggaagagggcgaagaggattag

SEQ ID NO: 25930 - DNA, 588 bp, Artificial Sequence
  Description of Artificial Sequence: Synthetic coding sequence
atgggccgggcccgggacgccatcctggacgccctggagaacctgaccgcagaggagctcaaaaaatttaaactcaaactgctatccgtgccactcagagagggctatggccgcattccccgcggggcgctgctgtctatggatgccctcgacctcacggacaagctggtttctttctacctggagacctacggcgctgagctgacggccaatgtgctgcgtgacatgggcctgcaggaaatggcaggccaactgcaggcagcgacccatcaaggctctggtgccgcccctgccgggattcaagcgccacctcagtccgctgccaaaccaggactgcacttcatagatcagcatagggcagcactaattgcccgggtgacaaacgtcgaatggcttctggacgcactgtatggaaaagtgctcaccgacgagcaatatcaggccgtgagagcagaacccaccaatcctagtaagatgaggaagttattctcatttacccccgcctggaattggacctgcaaggatctgttgctgcaagctttacgggagtcccaaagttacctcgtggaggatctcgaacggagctag

SEQ ID NO: 25931 - DNA, 531 bp, Artificial Sequence
  Description of Artificial Sequence: Synthetic coding sequence
atgggccgggcccgggacgccatcctggacgccctggagaacctgacggcggaggagctcaagaaattcaagctgaaacttctgagcgtgccgttgagggagggctacggccggattcccagaggtgctctcctcagtatggatgccttggatctgacagacaagttggtatcattctacttggaaacttacggagcggaattaaccgcaaatgttctcagggacatggggttgcaggagatggccggccagcttcaagctgcaactcatcagggactgcacttcatcgaccagcacagggccgcactcattgcacgtgttactaacgttgaatggctactcgatgcactctacggcaaggttcttactgacgaacagtaccaggcagtgagggcagagccaaccaatcctagcaaaatgagaaaattattcagttttacacctgcttggaactggacatgtaaagatcttttactgcaggctttgcgtgaatcacagtcttatcttgtggaggatcttgagagaagctag

SEQ ID NO: 25932 - DNA, 408 bp, Artificial Sequence
  Description of Artificial Sequence: Synthetic coding sequence
atgggccgggcccgggacgccatcctggacgccctggagaacctgaccgccgaggaattgaaaaagttcaagctacaggctgctactcaccaaggaagtggggctgccccggccggtattcaggcgcctcctcaaagtgccgctaagccaggcctccattttatagaccagcatcgagccgccttgatcgcgagagtgactaatgtggagtggctcctggacgccctctacgggaaagtactgacagacgagcagtatcaagccgtgcgcgccgagcccactaacccttccaagatgcggaagttattttccttcacaccagcctggaattggacatgcaaggaccttctccttcaggctctaagggagtctcagagctacctcgtcgaagacctggagcgcagttag

SEQ ID NO: 25933 - DNA, 1311 bp, Artificial Sequence
  Description of Artificial Sequence: Synthetic coding sequence
atgcggctggcccggctgctgcggggcgccgccctggccggccccggtcctggtttgagggcagcgggtttttcacgctctttttcatctgacagtggtagctcacctgctagcgaacggggggtgcctggccaagttgacttttatgcaagattctctccctcccctttgtccatgaaacagttcctggacttcgggtctgtgaacgcctgcgagaaaacctccttcatgtttctgaggcaggaactgccagtgcgcctagctaacattatgaaggagatttctttactgccagacaacctgctaagaacgccctccgtgcagttagttcagagctggtacatacagagcctgcaggagctgcttgactttaaagataaatcagccgaggacgctaaggcaatctatgatttcaccgacacggtaatccgcattagaaatagacataacgacgtaatcccgaccatggcacagggggtgatcgagtacaaggaatcattcggagtggacccggtcacttcccagaatgtgcagtactttcttgatcgcttttatatgtcccggatcagcattagaatgttgctgaaccaacattcactgctgttcggggggaaaggaaaggggtcgcccagtcacagaaaacatattgggtcaattaatcccaactgcaacgtgcttgaggttataaaggacggctatgaaaatgcaagacgactctgtgacttgtactatattaactctcctgagctggagctggaggagctgaacgcgaaaagtcccggacagcctatccaagtggtctacgtgccatcccatctctatcatatggtgttcgagctcttcaagaatgccatgagggccacgatggaacatcatgctaaccgaggggtttacccaccaatccaggtgcatgtcacattgggaaatgaggacctgactgtcaagatgtctgatcgcggaggaggcgtccccctcagaaaaatcgatcgactcttcaactatatgtattctaccgcaccccggcccagagtcgagacttcgcgggcagtgcctttggctggctttgggtatggcttgcccatttccagattgtacgcgcaatacttccaaggagacctgaagctgtactccttagagggctatggaaccgatgctgtgatatacatcaaagccctaagcacagatagcatcgaacggctacccgtttacaataaagctgcctggaagcactacaacaccaaccacgaagcggacgactggtgtgtgccgtcccgagagcccaaggatatgaccacttttagatctgcttag

SEQ ID NO: 25934 - DNA, 1371 bp, Artificial Sequence
  Description of Artificial Sequence: Synthetic coding sequence
atgcggctggcccggctgctgcggggcgccgccctggccggccccggccccggcctgagggccgcggggttttctcgaagtttttcgagcgacagcggtagttcgccagcttctgaacgtggagtgcctggccaggtggatttttatgcgcgattttcaccttcgcccctctctatgaagcagtttctggacttcggcagcgtgaacgcatgtgagaagactagctttatgtttctgcggcaggagctccctgtaagactggctaacatcatgaaggaaatctctctgctgccagataatctcctacgaactccatcagtgcaacttgtgcagtcctggtacatacagtccctgcaggaactgttggatttcaaagataaatctgccgaggacgcaaaggctatctatgaacgcccacgtaggacatggctgcaggtaagctccctttgttgtatggcttgcaagatgatcttcacagatacggtaatcagaattcgcaaccgccacaatgacgttattccaacaatggctcaaggagttattgaatacaaggagagttttggcgtcgatccggtcactagccagaatgtgcagtactttttggacaggttttacatgtcaagaatatctatccgcatgctactgaaccaacattctctcctgttcggtggtaaaggcaaagggtccccctcccaccggaagcacataggcagtattaatcccaactgtaatgttctggaggtgataaaagacgggtatgagaatgcaagacgcttgtgtgacctctactacataaatagccccgaattggagctggaagagttgaacgccaagtcccctggacaacccattcaggtggtatatgtgccttcccacctgtatcacatggttttcgagctgttcaaaaacgctatgcgcgccacaatggaacatcacgccaacagaggagtgtatccccccatacaagttcacgtcaccctgggtaatgaagaccttacggttaaaatgagcgatagaggaggcggcgtgccactgcgcaaaattgacagactcttcaattacatgtactctactgcgccgcggcctagggttgagacgtcgagggccgtccccttagccggctttggatatggtttgccaatatcccgtctctatgctcagtactttcagggcgatctgaagctgtattcgctggaggggtatggcaccgacgccgtgatctatatcaaagcgctgagtacagacagcatagaacggcttcccgtctataacaaggccgcctggaagcattataacacaaatcacgaagctgatgattggtgcgtcccttcgcgggaacccaaggatatgacaacctttcgcagtgcgtag

SEQ ID NO: 25935 - DNA, 1311 bp, Artificial Sequence
  Description of Artificial Sequence: Synthetic coding sequence
atgcggctggcccggctgctgcggggcgccgccctggccggccccggccctggtctgagggcagccgggttctctaggtctttctctagcgactctggcagctcccccgcatctgagaggggtgttcccggccaggttgacttctatgcccggttttctcctagtcccctttccatgaaacagttcctggatttcgggtccgtgaacgcatgcgagaaaacctccttcatgtttctgagacaggaattacctgtgagattagccaacatcatgaaagaaatctccttattgccagacaatttactgcggaccccttccgtgcagttggtacagtcctggtatatccagtccttacaggaactgctcgattttaaggacaagtcagcagaagacgctaaagcaatctacgatttcactgataccgtgatacgtattcgcaataggcacaatgatgttattccgaccatggcccagggggtaatcgaatacaaagagtcttttggtgtggacccagtgacatctcaaaacgtgcaatactttcttgatagattctatatgtccagaatttccatccgaatgctactgaatcagcactcactattgttcggaggcaagggaaaaggaagtccttctcacaggaagcatatcggttccattaatcccaactgcaacgttcttgaggttatcaaagacgggtatgaaaatgcgcggcggctgtgtgacctgtactatatcaactctcctgaactggagcttgaggaactgaacgctaagtcaccaggccagcctatacaagtcgtgtacgtgccctcacacctgtatcacatggtctttgaactattcaagaatgctatgcgggctacaatggaacatcacgcaaatcggggagtctacccccccattcaggtccatgtgaccctggggaatgaagacctcaccgtcaaaatgagcgatcggggtggcggtgtcccattacggaaaatagaccggctgtttaactacatgtattcgacagccccacggcccagggtcgagacaagtcgcgccgtccccctagccggattcggatatggtcttcctattagccgtctgtacgcacaatattttcagggtgatttgaagctttatagtctggaaggttacggcaccgatgctgtgatctacatcaaagcactctcaaccgacagcattgagcgtctgcctgtctataacaaggctgcgtggaaacactacaacaccaaccacgaggccgacgattggtgcgttccatcccgggagccaaaagatatgacaacttttcgatccgcctag

SEQ ID NO: 25936 - DNA, 1083 bp, Artificial Sequence
  Description of Artificial Sequence: Synthetic coding sequence
atgttcctgcggcaggagctgcccgtgcggctggccaacatcatgaaagagataagtctgctgcctgataatcttctgcgcacaccctcggttcagctggtccagagttggtacattcagtcactgcaggaactcctggacttcaaagataagtccgcagaagatgctaaagcaatctatgacttcaccgatactgtgattaggatccggaaccgccacaatgacgttattccaacgatggcccagggtgtgatcgagtataaagagagcttcggcgtggatcctgtgaccagccagaatgtgcagtatttcctcgatcggttctacatgtcgagaatatccatccgcatgttgctaaaccaacattctctcctcttcggaggtaaaggcaaaggttcaccctcacatcgcaagcacattggctctattaaccctaattgcaatgttctggaagtgatcaaagatggatacgaaaacgcaaggagactctgtgatttatactatattaatagtcccgagttagaacttgaggaattaaatgcaaagtcccctgggcaaccaattcaagtcgtatacgtcccatctcacttgtaccatatggtgttcgagttgttcaagaatgccatgagagcaacaatggaacatcacgccaatcgcggtgtttaccccccaatccaggttcatgtgactctgggaaacgaggacctcacagtcaaaatgagcgacaggggaggaggggtccctctacgaaaaatagatcggctgtttaattacatgtactctacagctcctagaccaagggtcgagaccagccgggccgtgccgttagctggtttcggatacggcctacccatatcacgtctgtacgcacaatacttccagggcgatctgaagctgtactcactggagggttatggcacagatgcagtcatctatatcaaggctctttctaccgactctatcgaacgccttcccgtttataataaggccgcttggaagcactacaatactaaccacgaggccgatgactggtgtgtcccgagtagggagccaaaggacatgacaacatttcgaagcgcatag

SEQ ID NO: 25937 - DNA, 846 bp, Artificial Sequence
  Description of Artificial Sequence: Synthetic coding sequence
atggcccagggcgtgatcgagtacaaggagagcttcggcgtggaccccgtaacttcccaaaatgtgcagtactttcttgacaggttttatatgtccagaatctctattaggatgcttctcaaccaacacagtttgctttttggaggcaagggcaaagggtccccctcccacaggaagcacattggctcaattaatcccaattgtaacgtattggaggtgatcaaagacggctacgaaaacgcccggcgcctctgtgatctctactatatcaattcaccagaattagagctggaagagttaaatgctaagtccccaggtcagcctatccaggttgtctatgtgccgagtcatctgtaccacatggtcttcgagctgttcaaaaacgccatgcgggccaccatggaacaccacgccaaccggggcgtctatcctccaattcaggtgcacgtcactcttggtaatgaagatctgactgttaagatgtccgataggggaggaggtgtgcccctgaggaaaatcgataggctcttcaattacatgtacagcacggctcccagacctcgggtggagacaagtcgggcagtgccactagctggctttggttatggcttacccataagccgcttgtacgcacaatacttccagggagacctgaagctgtacagcttagaggggtacgggacggacgccgtgatctacatcaaggcgcttagcaccgacagcattgaacgcctgccagtatacaacaaggcagcttggaaacactacaacacgaatcatgaggccgacgattggtgcgtaccgagtcgcgaacccaaagatatgactacattccgctccgcatag

SEQ ID NO: 25938 - DNA, 1032 bp, Artificial Sequence
  Description of Artificial Sequence: Synthetic coding sequence
atgaaggagatcaacctgctgcccgaccgggtgctgagcacccccagcgtccagctcgtgcagtcctggtacgtgcagtcactcctcgacattatggagtttctggacaaagaccccgaggaccatcggacgctttcacagttcacggacgccctagtgactatccggaatcgacacaatgacgtcgtgcccacgatggcacagggggttcttgagtacaaggatacatacggggatgatcccgtgtccaaccagaacatacaatacttcttagacaggttctatctcagccggatttctataaggatgctcattaaccagcacacactgatctttgacggatctacaaatcccgctcaccccaagcacatcgggagtattgaccctaattgtaacgtatcagaggtggtcaaagacgcgtatgatatggccaagttactgtgcgataagtattatatggcttcacctgatctcgagatccaggagatcaacgccgccaactccaagcaacccatacatatggtgtacgtgcctagccatctgtaccatatgctgtttgagctcttcaagaatgccatgcgagctacagtcgagtcccatgagtctagcttaatcctgcccccaatcaaagtgatggtggctctgggtgaggaagatctgtcaataaagatgtctgatcggggaggcggcgtgcctcttaggaagattgagaggcttttttcatacatgtactccaccgcgcccacccctcagcctggcactggtggtactcccctagccggcttcgggtatggattgccgatatccaggctgtacgctaagtattttcagggtgatttgcagcttttttcgatggagggattcggcaccgatgccgtgatttatctcaaagcactctccacggattcagtggaacggttacctgtctacaataagagcgcctggagacattaccaaaccatacaggaggctggcgactggtgcgtgccgagtacagagccgaagaacacatccacgtaccgggtgtcgtag

SEQ ID NO: 25939 - DNA, 1224 bp, Artificial Sequence
  Description of Artificial Sequence: Synthetic coding sequence
atgcggtgggtgtgggccctgctgaagaacgccagcctggccggcgcaccgaagtacatcgagcacttctcaaagttctctccgtcccctttgtccatgaagcagtttttagactttgggtcctcaaacgcttgtgaaaaaacaagttttacatttttgcgacaggagctgccagtgcgattggccaacataatgaaagaaatcaatctcctccctgatcgagttctgagtacaccttccgtgcagctcgtgcaatcttggtacgtgcagtcccttttggacataatggagtttcttgacaaggaccccgaagatcaccgcacactgagccagttcacggacgcgctggtgactatacggaaccggcataatgatgtcgtccccacgatggcacagggggttcttgaatataaagacacttacggcgatgacccagtcagcaaccaaaatatccaatattttctggaccgattctacctctcgcgcatctccatccgaatgctgattaaccagcacacactcatttttgacgggtccacaaaccccgcacaccctaaacacatcggaagcatagaccccaactgcaacgtttcagaggtagtcaaagatgcatatgacatggcaaagctgctatgcgacaagtattatatggccagtccggatctcgagattcaggagattaacgctgccaatagcaaacagcctattcatatggtatacgtccctagccacctctatcacatgttgtttgaactctttaaaaacgctatgcgcgccactgtagaatcacatgagagctcactgatcctacctcctatcaaagtaatggttgctttgggagaggaggacctcagcataaagatgtctgatcggggaggcggcgtccccctgcggaaaattgagaggctgttcagctacatgtatagtactgctcccactcctcagcccggtacggggggaacccccctggccggcttcggatacggacttcctatctcgcgactatatgcaaaatatttccaaggcgatttacagctcttttctatggaagggttcggtaccgacgccgtgatctacttgaaggcactgtcaacagacagcgtcgaacggctgcctgtttacaataagagcgcttggagacattaccagacaattcaagaggctggggactggtgtgtgccttctaccgagcccaagaataccagcacttacagagtgagctag

SEQ ID NO: 25940 - DNA, 849 bp, Artificial Sequence
  Description of Artificial Sequence: Synthetic coding sequence
atgcccctgctgacccagcagatccaggacgaggacgaccagtactcccttgttgctagcttggataacgtacgaaacctaagcacaatcctgaaggcgattcacttccgggaacatgctacctgctttgccaccaagaatggcatcaaggtgaccgtcgaaaatgcaaaatgtgttcaagccaacgcttttatccaagccgggatcttccaagagtttaaggtacaggaagagtccgtcacgttccggatcaatctgactgtgctccttgattgtctttcaatttttggatcatctcccatgccggggaccctaacagccctgagaatgtgttaccagggctatgggtatcctctgatgctctttttggaggaagggggtgtagtcaccgtatgtaagattaacacacaagaacctgaggagacactggacttcgacttctgttcaacgaacgtgattaacaagataatcctgcaatccgaagggctgagggaagccttctccgagttagacatgactagcgaggtgcttcagattacaatgagcccagacaaaccatatttccggctgtccacattcgggaatgccggtagcagtcacctggattaccctaaggattctgatctgatggaggcatttcactgtaatcagacccaggtcaatagatataaaattagcttacttaagcctagcacaaaagcgctcgtcctctcctgtaaagtgtccataagaactgacaatcggggattcctgagtctgcaatacatgatccgcaatgaggatggccagatctgctttgtggagtactattgttgccctgacgaagaggttcccgaaagcgaaagctag

SEQ ID NO: 25941 - DNA, 849 bp, Artificial Sequence
  Description of Artificial Sequence: Synthetic coding sequence
atgcccctgctgacccagcagatccaggacgaggacgaccagtacagcctggtggcgagtctggataacgtgcggaatttgagtactattctcaaggccatacattttagagagcacgctacatgctttgctaccaaaaatggaatcaaagtcactgtggagaatgctaaatgtgttcaggctaatgcattcatccaggcaggcatttttcaagaattcaaggtgcaggaggagtccgtgacatttcgcatcaaccttaccgtgctgctggactgcctcagcatctttggatctagcccaatgcccggaactctgactgccctaagaatgtgctatcaggggtacggttaccctctgatgttgtttctggaagaaggtggagtcgtgactgtctgcaaaattaatacccaggaaccagaggaaaccctggatttcgatttttgttctacgaatgtcatcaacaagatcatcctccagtctgagggactgagagaggcctttagtgaattggatatgacctcagaagttctgcagattactatgagccctgacaagccatatttccggctgagcaccttcggcaatgcaggctcaagccacttggactaccccaaggattccgatctaatggaagccttccattgcaatcagacacaggtgaataggtataaaatctctctcctgaaacctagcaccaaagcacttgttcttagctgcaaagtgtcaatacgtaccgacaaccgcgggttcctgagcctccaatatatgatcaggaatgaagacggtcagatttgctttgtggagtattattgttgccccgacgaagaggttcctgagtcggagagttag

SEQ ID NO: 25942 - DNA, 741 bp, Artificial Sequence
  Description of Artificial Sequence: Synthetic coding sequence
atgcccctgctgacccagcagatccaggacgaggacgaccagtactcattggtcgccagcttagataatgtcagaaacttgagcaccatattaaaagccattcacttcagagaacacgccacatgcttcgccaccaaaaacgggataaaagtgacggtggagaatgccaagtgtgtccaggcaaatgccttcatccagggcacacttactgcactgagaatgtgctatcaagggtatggataccctcttatgttgtttctcgaagaaggtggcgtggtgactgtctgcaaaattaacacccaggagcctgaagagactttggacttcgacttctgcagcactaacgtgatcaataaaattatcttgcagtctgaagggttaagggaggccttctctgaactggatatgactagcgaggtgttgcagatcactatgtcccccgacaagccgtattttagactgagcacattcggcaacgcaggaagctcgcatctagattaccccaaagactccgacttgatggaggcatttcactgcaatcaaactcaggtgaatagatataagatctcactactgaaaccctccacaaaggctttggttctctcttgcaaagtgagcatccgaactgacaaccgtgggttcctctcacttcagtacatgatccggaacgaagatggccaaatatgctttgtcgagtactactgttgcccggatgaagaggtgcccgagtccgaatcctag

SEQ ID NO: 25943 - DNA, 1755 bp, Artificial Sequence
  Description of Artificial Sequence: Synthetic coding sequence
atgaaccagcacgagctggccgtgcacaagaagaagatcgaggaggtggaaacttggctcaaagctcaggtactggagcggcagccgaaacagggtgggagcatcctgctcatcactgggccccctggatgtgggaaaactacaactctcaagatcctctcaaaagagcatggcatccaagtgcaagagtggatcaatcctgtgcttccagatttccaaaaggacgattttaaaggcatgttcaataccgagtccagttttcatatgttcccataccagagccaaatcgctgtgttcaaggagttcctcctgcgggccacaaagtacaataaactgcagatgctgggagacgatctgaggaccgacaagaaaatcatcctcgtggaggacctccctaaccaattctacagagatagtcatacactccacgaagttctcaggaagtacgttagaatcggccggtgtcctctcatctttataatctccgacagcttgtcaggggataacaatcagcgactcctatttcccaaggaaatccaggaggagtgcagtatttccaacataagctttaatccagtggcccccacaatcatgatgaagttcttgaacagaatcgtcacaatcgaggccaacaagaacggtggaaagatcacagttcctgacaagacctcactcgagctgctctgccaaggctgcagcggcgacatacgtagcgctatcaacagtctgcaattctcctcctctaaaggagagaataatttacggcctagaaagaagggcatgtccctgaaatccgatgccgttttgagtaagtctaagagaagaaagaaacccgacagagtgttcgaaaatcaggaagtccaggcaataggaggcaaggacgtttcactctttctatttcgcgctctgggcaagatactgtactgcaagagagcctccctcacagagctcgacagtccccgattaccatcccacctcagcgagtatgagcgggacactctgctagtggaacctgaggaagttgtggaaatgagccatatgcccggggatctgttcaacctctacctgcatcagaattatattgacttctttatggagattgatgatattgtgcgggcatctgagtttctgtcctttgcagacatactgtccggagactggaatacaaggtccctactccgggagtactccacatccatcgcaacacgaggcgttatgcactccaataaagcgaggggatacgctcactgccagggcggggggtcttcgtttcggcccctgcacaaaccacagtggttcctcatcaacaagaagtatagggaaaattgccttgcggccaaggccctatttcctgatttctgtctcccggcactttgtctgcaaacacaactcctcccctacctggctttgcttaccatccctatgaggaaccaggctcaaatctcattcattcaggacatcggacgcctgcccttgaaacgacacttcgggagactcaaaatggaagcgttgacagatcgggagcatggtatgattgacccagattcgggcgacgaggcacagctcaatggtggccattccgccgaggaaagcttgggggagccgacccaggccacagtgcccgagacatggtccctcccacttagccagaacagcgcttctgagctgcccgcatcacagcctcagcccttttccgcccagggcgatatggaagaaaacattattattgaagattacgagtccgatgggacctag

SEQ ID NO: 25944 - DNA, 2013 bp, Artificial Sequence
  Description of Artificial Sequence: Synthetic coding sequence
atgaaccaggtgaccgactgggtggaccccagcttcgacgacttcttggaatgcagtggagtatctactattacagccacatccctgggcgtcaataactctagccaccgcagaaagaacggaccatctaccctggagtccagtagattccccgctaggaaacgagggaaccttagttctcttgagcagatctatggcctcgaaaactctaaagagtacctttcagagaacgaaccttgggtcgacaagtacaagcctgaaacacaacacgagctggcggtccataaaaaaaagatagaggaggtggagacatggctcaaagcacaggttctcgagcgacaacccaaacaggggggcagcatcttgctgatcactggaccacccggctgcggcaagactactaccctcaagatactgagtaaggaacatgggatccaggtgcaggagtggattaatccagtcctgccagactttcaaaaggatgactttaagggtatgtttaatacagagtcgtcttttcatatgtttccctatcaaagccagatcgctgtgtttaaggagttccttctaagagcgaccaagtacaacaaactgcaaatgctgggcgacgatctgaggacagataagaagatcatcctcgtcgaagatctgcctaaccaattctaccgggattctcatacgctacacgaggtccttcggaagtatgtccggatagggcgatgtcctttgatctttattatttctgattccctgagtggcgataataatcagcggctgctgttcccaaaagagatccaggaggagtgctcaatctcaaacatctccttcaaccctgtggctcctactattatgatgaagtttcttaacaggatcgttactatagaggctaataagaatggcgggaagataactgtgccggataaaacatctttggagttactgtgtcaagggtgtagcggagacatccgcagcgctatcaattcgctccaattttcttcatcaaagggcgagaacaatctgcgcccgagaaaaaagggaatgtccttgaagtcagacgccgtgctaagcaagagcaagagaagaaagaagccagatagggtgttcgaaaatcaggaagtgcaagccatcggcggcaaggacgtgagcctgtttctctttcgggccctgggcaagatcctgtattgtaaacgggccagtctaaccgaactcgactcgccccgtctgcccagccaccttagcgaatacgaaagagatactttactggtggaaccagaggaagtggtggaaatgtcccacatgccaggagacctgttcaatctgtatctgcaccagaattatattgattttttcatggagatcgacgacattgtgagagctagcgagttcctctcttttgctgacatcttatccggcgactggaataccaggagtttgttaagggagtactcaaccagtatcgccactcggggggttatgcatagtaacaaggcccgaggatatgcacactgtcagggtggcggaagttcctttcggcctttgcataagccccagtggttccttattaacaagaagtatagagagaattgtctcgccgcaaaggctttgtttcctgatttctgtctgccagccttatgcctccagacccagcttctgccgtatctggctcttcttacaatccctatgcgaaaccaggcacaaatttcatttattcaggacattggccggctacctctgaaacgacatttcggaagactgaagatggaggccctgaccgaccgcgaacacgggatgattgaccccgactcaggagacgaagcccagctcaacggtggacactctgcagaggagagcctaggggaaccaacacaggccaccgtgcctgaaacctggagcctccctctcagccagaattcagctagtgagctgcccgcttctcagccccaaccgttctcagcccagggagatatggaggaaaatatcattatcgaggactacgagtctgatgggacctag

SEQ ID NO: 25945 - DNA, 2013 bp, Artificial Sequence
  Description of Artificial Sequence: Synthetic coding sequence
atgaaccaggtgaccgactgggtggaccccagcttcgacgacttcctggaatgctctggagtgagcacaatcacagctacgagtctgggggtgaacaatagctctcaccggcggaagaacgggccctccacgctggaatcatcaagatttcccgcccgcaagcgggggaacctgtccagcctggaacaaatatacgggctggagaactcaaaagagtatctgtctgagaatgaaccctgggtggataagtataagccagagacccagcatgagcttgctgttcacaagaagaagatagaggaagtcgaaacctggctgaaagcacaggtcctcgagagacagcccaaacagggaggaagtatcctgctgatcactggccccccaggctgcgggaaaacgacaactctcaagatactatccaaagagcacggcatccaggttcaggaatggataaaccccgtccttcccgactttcaaaaagatgacttcaagggaatgtttaataccgaatccagctttcacatgttcccttatcagagtcagatcgcggtatttaaagaattcctcctgagggctacaaaatacaacaaactccagatgctgggggatgacctgcggactgacaaaaaaatcattctcgttgaagacctgcctaaccaattctaccgggatagccataccctccacgaagtgctccgcaagtacgtgcgtatcggccgctgccctctaattttcattatttccgacagcttgagtggcgacaacaaccagcggctgcttttccccaaagagatccaggaagaatgctccatctcaaatatctctttcaaccctgtggctccaacgattatgatgaaatttctgaatcgcatcgtgacaatcgaggcaaataagaatgggggtaaaattaccgttcccgacaaaacatcgttggaactattatgtcaaggctgctcgggcgacatcaggagcgccataaatagcctccaattctcctcgagcaaaggtgagaacaacctcagacctcggaaaaaaggcatgtctctcaaatctgacgcagttctgagtaaaagtaaacggagaaagaaaccggatagggtctttgaaaaccaggaggtccaggcaattggaggaaaagacgtctccctgttcctgtttagggctctgggcaaaattctctattgcaaaagagccagcttaaccgaactggattcacccaggttaccatcacatttgtcagagtatgagagagatactctactggtggagccggaagaagtggtggagatgtcccatatgccaggcgatctattcaacctatatctacaccagaattatattgacttcttcatggaaatcgacgacatagtccgagcctctgagttcttgagctttgctgacatcttaagcggcgactggaatacccgcagtcttctcagggagtattctacctccatcgcaacacggggcgttatgcactcaaacaaagcccgggggtacgcgcactgccagggcggaggttcttcttttcgaccacttcacaagccacagtggttcctgataaacaagaagtatagagagaactgcctcgccgctaaggctttgttccctgatttttgtttgccagctttgtgcctccagacgcaactcctgccatatttagcattgctgacaattcctatgcgcaaccaggcgcagatcagttttattcaagacatcggacgcttgccgctgaaaagacatttcgggaggctgaaaatggaggccctcactgaccgcgagcacggtatgattgatcctgactctggggacgaagcccaacttaatgggggccactcggccgaggaatccctcggcgagcctactcaagccaccgtgccagagacatggtctctgcctttgtcccagaactcagcttcagaactgcccgccagtcaacctcagcccttttctgcgcagggtgatatggaggaaaacataattatcgaggattacgaatcagatgggacttag

SEQ ID NO: 25946 - DNA, 2013 bp, Artificial Sequence
  Description of Artificial Sequence: Synthetic coding sequence
atgaaccaggtgaccgactgggtggaccccagcttcgacgacttcctagaatgtagcggagtttctaccataacagccaccagcctgggtgttaataattcaagccatcgccggaaaaatggaccttccacactagagtcttcccgtttccctgcccggaaacgcggtaatttgtcctctttggagcagatttatgggcttgagaatagcaaggaatatctttcagagaatgaaccttgggttgacaagtataagccagaaacacagcacgaactggctgtccacaaaaagaagattgaggaagtggagacctggctaaaagctcaggtgttggaaaggcagcctaaacagggaggttcaattctgctgattacagggccgcctggctgtgggaaaaccactacactcaaaatcctaagtaaagaacatggcatccaggtgcaggaatggattaaccctgttctccccgatttccagaaagatgattttaaaggcatgtttaacaccgaaagtagcttccatatgttcccatatcagagtcagatcgcagtattcaaggagttcctgctgagggccaccaagtacaacaagttacagatgctgggcgatgacctgcgtacagacaagaaaatcattctagttgaggatctgcctaaccagttctatagagactcacacactctgcatgaagtcctccggaagtacgttcggatcggtagatgtcctctgatatttatcattagcgattcccttagcggcgacaacaatcagcgcctcttattccccaaagagatccaagaagaatgcagtatcagtaacatcagttttaacccggtggctccaaccattatgatgaagttcctaaatcggatcgtaaccattgaggcaaacaaaaacggaggtaagatcacagtgcctgataaaaccagccttgagctgttgtgtcagggatgctcaggtgacatccggtcagctatcaactctcttcagttcagtagtagtaagggcgaaaacaacctccggcccaggaaaaaaggtatgagcctgaagagtgatgccgtgttatctaagtctaagcgtagaaaaaaaccagaccgggtgttcgaaaatcaggaggtgcaagcaattggaggaaaggacgtgagtctctttttattcagagcattgggtaagatcctatactgcaagcgcgcatctctgaccgagttggatagtccaagactcccgtcacacctgtctgagtatgagcgggatactctactggttgaaccagaagaggtcgtggagatgtcccatatgcccggagacttgtttaatctttacctgcatcaaaactatatcgacttcttcatggaaatcgacgacattgtgagagccagcgaattcttgagctttgcagacattctgagtggggattggaatacccgctctttgctccgagaatactcaaccagtatcgctacgaggggagtgatgcactctaataaggcgcggggctacgctcactgccagggtggagggtcatccttcaggcccctccacaagccccaatggtttctcattaataagaagtaccgggagaattgtttggccgctaaggctttattcccagatttctgtctgcccgccctctgcttgcagacacagctgctgccctatctggccctcctgactatacccatgaggaatcaggcgcagatcagctttattcaggacatcggtaggctgccactgaagaggcattttgggagactgaagatggaagcgctaactgaccgggaacacgggatgattgaccctgactccggagatgaggctcaactcaatgggggtcactccgctgaggaatctcttggggaacccacacaggccactgtgcctgagacctggtctctccctctgagccagaatagtgcgtcagaattgcctgctagtcagccccaaccattttcagcgcaaggcgacatggaggaaaacatcattatcgaagactacgagtctgatggtacctag

SEQ ID NO: 25947 - DNA, 2013 bp, Artificial Sequence
  Description of Artificial Sequence: Synthetic coding sequence
atgaaccaggtgaccgactgggtggaccccagcttcgacgacttcctggagtgctcgggtgttagcaccataaccgcaacttctttgggggttaacaacagtagccatagacggaagaatggtcctagcacattagagtcaagcagatttccagctcgtaagcgcgggaacctgagttcgctggagcagatttatgggctagagaatagtaaggaatatctttctgagaatgaaccctgggtggacaagtataaacctgaaacccagcacgagctagctgtacacaagaagaagatagaggaagtggagacatggcttaaagcacaagtcctggaaaggcagccaaagcaagggggcagtatcctcctgattacgggtccgcctggatgcggcaagacgacaaccctgaagatactctccaaagaacatggcattcaagtgcaggaatggatcaatcctgttctacccgatttccagaaagacgattttaaggggatgttcaacaccgagagctcctttcatatgttcccataccagagtcagattgcagtcttcaaagagtttctgctccgggcaaccaaatacaacaagctccagatgctgggagatgacctgcgcacagacaagaagataatactcgtagaggatctgcccaaccagttttaccgggactcacatacgttacacgaagtcttgcggaagtatgtgaggattgggcgctgccccctgattttcatcatctccgatagcttatctggcgacaataaccaaaggctgctgttccctaaggagattcaggaagaatgcagtatttcgaatatctcctttaaccctgtcgcccctacaatcatgatgaaatttctgaatcggatcgtcacaatcgaagcaaataaaaatggtgggaagattactgtacccgacaagactagtttggaactgctgtgtcaggggtgttcgggcgacatccggagtgccataaatagcctgcagttttctagcagcaagggggaaaacaatctgaggcctaggaaaaagggtatgtcattaaaatctgacgcagtcctgtcaaaatccaagcggcggaagaaaccagaccgtgtttttgaaaaccaggaagtgcaggccatagggggcaaggatgtatcattatttctattccgcgctttgggcaagattttatactgcaagcgggcttccctgaccgagctcgacagtcctcgcctcccgtctcatctgtctgagtatgaacgcgataccctgctggttgaaccagaggaagtggttgagatgagtcatatgcccggggatctctttaatctatacctacaccaaaactacatagattttttcatggagatcgacgacatcgtaagggcctccgagttcctgtctttcgctgatatcttgtcgggcgattggaatacaagaagccttcttagagaatactccacttctatagctacacggggagtgatgcattccaataaggctaggggctacgcccattgccagggaggaggaagttcgttccggcccctccataaaccccagtggtttctcatcaacaagaaatatagagaaaactgcttggctgcgaaagccctgttccccgacttttgcctgccagcgctgtgcctgcagacacagttgcttccataccttgcccttttgaccataccgatgagaaatcaagcgcagatctcattcatacaggatatcggcaggctgccactaaaaagacactttggaagactgaaaatggaggccctgacggatagagagcatggaatgattgaccccgactcaggcgatgaagcccaactaaacggcggtcatagcgctgaggagtccttaggggagccaacgcaagcgactgtcccagagacatggtctttgccactgtcccagaattccgcctctgaactgccagctagtcagccgcaaccttttagtgctcagggtgatatggaagagaacataatcatcgaggattacgagtcagacggaacttag

SEQ ID NO: 25948 - DNA, 1518 bp, Artificial Sequence
  Description of Artificial Sequence: Synthetic coding sequence
atgttcaacaccgagagcagcttccacatgttcccctaccagagccagatcgcagtcttcaaggagtttttactgcgggctaccaagtataacaaattacagatgctaggggatgacctgcgcacagataaaaagatcattcttgtggaagacctgcctaaccagttctaccgggattcgcacacactccatgaagtgctcaggaagtacgttcgaatcggcaggtgtcccttaatcttcatcatctccgattcactctcaggtgataataaccagaggctcctgttcccaaaggagatccaggaggagtgtagcatatccaacataagcttcaatcccgtcgcgcctacaattatgatgaagtttctgaatcgtatagttaccattgaggccaataaaaatggcggcaagattaccgttcccgataagacatctctcgaacttctgtgccaaggctgcagcggcgatatccgtagtgcaatcaattctctgcaatttagtagcagcaaaggcgagaataacctgcgcccccgcaaaaaaggcatgtctctcaaaagtgacgctgtgttgagcaagagtaagcgaagaaagaagccagaccgggtgttcgagaatcaggaggtacaggcaatcggtggaaaagatgtcagtctgtttctgttcagagcactggggaaaattctttattgcaagcgtgcctctctgactgagcttgactccccacggctgcctagccacttgtcagaatatgagcgcgatactctgctggtggagcccgaagaggtggtggagatgtcacacatgcccggagacctgttcaatttgtatctgcaccagaattatattgacttctttatggaaatcgacgatattgtccgggctagcgaattcctgagcttcgcagacatcctctccggtgattggaacacgcgctctctgctgagagagtactcaacctccatcgctaccaggggggtcatgcactccaacaaagcccgaggctatgcccactgtcagggcgggggctctagcttcagaccattgcacaaaccacagtggttcttgatcaataaaaagtatcgcgaaaattgtcttgcagccaaagcgttgtttcccgatttctgcctgccagccttatgcctccagacgcagctgcttccctacctcgccctgttgacaatcccaatgcggaatcaagcacagataagcttcatacaggatatcggccgactgcctctgaaaaggcacttcgggagactcaagatggaggccctgaccgacagagagcatggaatgatcgaccccgacagcggcgacgaagctcagcttaatggcggacactccgccgaggaatctctcggggaaccaactcaagctaccgtccctgagacttggtccctgcctttgagtcagaactcggccagtgagctccccgctagccagccccagccattcagcgcacaaggagatatggaagagaatattattattgaggactatgagtctgacggaacctag

SEQ ID NO: 25949 - DNA, 2013 bp, Artificial Sequence
  Description of Artificial Sequence: Synthetic coding sequence
atgaaccaggtgaccgactgggtggaccccagcttcgacgacttcctggagtgcagtggcgtgtctacgatcaccgcgacttctctgggtgtgaacaattctagccacagaagaaagaatgggccctccaccctggaaagctctagatttcccgctcgtaagagaggcaacctgtcatccttagaacagatctacggccttgagaactcaaaagagtacttgtcagagaacgagccttgggtagataaatataagccagaaacgcaacatgagttggccgtgcataagaaaaaaatcgaggaggtcgaaacttggttaaaagcccaggtcctagagcgccagcccaagcaggggggcagcatccttctgatcaccggtcctccggggtgcgggaagactactaccctgaaaatcctgagtaaggagcatgggatccaggtacaggaatggattaacccggtgctacctgattttcagaaggatgatttcaagggcatgttcaatacagaatccagtttccacatgttcccttatcagtctcagatcgccgtgttcaaggagtttctgcttcgcgctaccaagtataacaagctgcaaatgttgggagacgaccttcgcaccgataagaaaataatcttggtcgaggatctccccaatcagttctatcgagatagtcatactttgcacgaagtcttgaggaagtacgtgcggatcggccgatgtcccctaatcttcataatttctgactcactgtcaggggacaacaaccaaagactgcttttccctaaggaaattcaggaagagtgttctatttctaacatatccttcaatccggttgctccaaccattatgatgaaatttctaaatcggatcgtcacaatcgaggccaataagaatggcggcaaaatcacagtgcccgacaagacgagtctcgagctgctctgccagggctgttccggtgacatccggtcggctattaactccctccagttttcaagctctaaaggagaaaacaacttacggccccgtaagaaaggtatgagcctgaaatccgacgctgtgcttagcaaaagcaagcgtcggaaaaaacccgacagagtgttcgagaaccaggaagtccaagccattgggggcaaagatgtgagcctgttcctcttccgcgcactgggtaagatcctctattgcaaaagagcctcgctgacggaactagacagcccacgcttgccctcccatctatctgaatacgaaagggacacactgctagtcgagccagaggaagtggttgagatgagtcacatgcccggcgacctgtttaatctgtacctgcaccagaattatatcgactttttcatggaaatagatgacatcgtgagagccagcgaattcctgagttttgcggacattttgtccggtgactggaatacgagatccttgttgcgcgagtatagtacgtctatcgcaacacgcggcgttatgcatagcaacaaggccagggggtatgctcattgtcaggggggagggtcatctttccggcctctgcacaaaccacaatggttccttattaacaagaaataccgggaaaattgtctcgcagccaaggccctgttccctgacttctgtctccccgcgctgtgtttacagacacaactgcttccgtacctagcccttctcaccatcccgatgcgtaatcaggctcagatctcattcatccaagatatcggaagattacctctgaagaggcactttggtagattgaaaatggaagccttaacagacagagagcacgggatgatcgaccctgattctggagacgaagctcagctcaacggaggccacagcgcggaggagtcactcggcgaacccacccaggcaacagttccggagacttggagtctgcctttatctcagaattctgcctccgaactcccagctagccagcctcagcccttctctgcccagggcgatatggaggaaaacattatcattgaggactacgaaagcgacgggacatag

SEQ ID NO: 25950 - DNA, 2046 bp, Artificial Sequence
  Description of Artificial Sequence: Synthetic coding sequence
atgagcaagaccttcctgcggcccaaggtgagcagcaccaaggtgactgattgggtggatccatcattcgacgattttctggaatgctcaggagtaagcaccataacggctacttccctaggcgtgaacaattcttctcatcgtagaaagaacggaccctccacacttgagtcatctcgatttcctgcccggaagagagggaacctgagttctctggaacagatttacggcttggagaacagtaaagagtacctgagtgagaatgaaccatgggtggacaagtacaaaccggaaacacagcatgaactcgcagttcacaaaaagaagatcgaagaggtggaaacctggttgaaagcccaggttctcgagagacagccgaaacaggggggttctattcttctgattaccggcccgcctggatgtggcaaaacaacaaccttgaaaatactgagcaaggagcacggtatacaggtgcaggaatggattaatcccgtgctaccggacttccagaaagacgattttaagggcatgttcaataccgagtccagttttcacatgttcccttaccagtcccagattgctgtgtttaaagaatttctcctaagagccactaagtacaataaactccaaatgttgggggatgacctgcgcaccgacaaaaaaattattctcgtcgaagatttgcctaaccagttctaccgggactcccacaccctccatgaggtgcttcgaaaatacgtccggattggccggtgtcccctgatttttatcatcagtgattccctctcgggagacaataaccagcgcctgctcttcccaaaagaaatacaggaggagtgctcaatcagcaatataagttttaaccccgttgcacctacgataatgatgaagtttttgaaccgtatcgtcaccattgaagctaataagaatggtggaaagattacagtgcccgacaagaccagcctcgagttgttgtgccagggctgctctggtgatatacgcagtgcaattaactcactacagttctccagttcgaaaggggaaaataatctgagacctaggaaaaagggaatgtctctgaagtccgacgctgtcctcagtaaatcaaagcgccgaaaaaagccggacagggtcttcgagaaccaggaggtacaggcaatcggcgggaaggacgtcagcctatttctctttagagccctgggcaagatactctattgtaagagagctagcctgacggagctagacagccccagactgccctcacacctcagcgagtacgaaagggacactctgttggtggagcctgaagaagtagtcgaaatgagccatatgccaggcgacttgttcaatctctatcttcatcaaaactatatcgacttcttcatggaaattgacgacattgtgcgggcatcagagtttctcagcttcgcagacatcctgagcggagactggaacaccaggtctttactcagggaatattccacctccatcgcaacacgaggtgtcatgcacagcaacaaggctagaggctacgcacactgtcaggggggaggctcgtcgtttcggccgctccataaaccccagtggttccttattaataagaagtaccgggagaactgcctagccgctaaggctctgttcccagatttctgccttccagccttgtgcctgcagacgcagctgctgccatacctggcccttctgactattcctatgcgcaaccaggcccagatcagctttatccaagatattggccggctaccccttaagcggcatttcggcaggctgaagatggaagctctcactgaccgcgagcatggtatgattgacccggatagtggagatgaagctcaactgaacggaggacacagcgcagaggagagcctgggagaaccaacccaggctacagtccccgaaacatggtcgctgccactttcccagaattctgccagtgagctccctgcttcacagccacagcctttttctgcccagggagacatggaggagaacatcattatcgaggattatgaatcggacggtacttag

SEQ ID NO: 25951 - DNA, 510 bp, Artificial Sequence
  Description of Artificial Sequence: Synthetic coding sequence
atgaaccaggtgaccgactgggtggaccccagcttcgacgacttcctagaatgtagcggcgtctctacaatcacagcaacaagcctgggggtgaacaactcgagccatcggcggaaaaacggaccctctaccctggagagttccagatttccagctcgtaaacgcgggaatttgagctcactagagcagatttacggactggagaatagcaaagaatatctgtcagagaatgagccatgggtggataaatacaaaccggaaacacaacacgaactcgctgtgcacaagaagaagatcgaggaagtggagacatggctcaaggcccaggtgctggagagacagcctaaacagggcggttccatactcctgataactgggcccccaggttgcggcaaaactacaacgttaaagattttaagtaaggaacacggaatccaagtgcaggagtggataaacccagtactgcccgacttccaaaaggacgatttcaagggcatgtttaacacctag

SEQ ID NO: 25952 - DNA, 66 bp, Artificial Sequence
  Description of Artificial Sequence: Synthetic coding sequence
atgaaccaggtgaccgactgggtggaccccagcttcgacgacttcctggagtgcagtggagtctag

SEQ ID NO: 25953 - DNA, 2046 bp, Artificial Sequence
  Description of Artificial Sequence: Synthetic coding sequence
atgagcaagaccttcctgcggcccaaggtgagcagcaccaaggtgaccgactgggtcgaccccagcttcgacgactttctggagtgttccggcgtctccacaatcacggccacatctctgggagttaacaattctagtcaccggagaaagaatggcccaagcacactggaatccagcaggttcccagcccgcaaaagaggaaaccttagttctctagaacagatttacgggttagaaaactccaaggagtacctctcggaaaatgaaccctgggtggacaaatacaaacctgaaacccagcatgagctggctgtacacaagaaaaagatcgaagaggtagagacctggctgaaagcccaagtgctagagcgccagcccaagcagggggggtctattttgctcatcacaggacctccaggctgcggaaaaaccacaacactcaaaatactgtcaaaggaacatggcattcaagttcaggagtggattaaccctgtcctcccagattttcaaaaagacgattttaagggtatgttcaataccgaaagtagcttccatatgttcccttatcagagccagatcgcggtgttcaaggaatttcttctgcgcgccaccaaatacaacaagctacagatgttgggcgacgatctccgcactgacaaaaagattatcctcgtggaagatctgcccaatcagttttatcgcgattcgcacacgctccacgaggtcctgagaaagtacgttcgaattggccggtgcccactgatcttcattatctctgatagcttaagcggcgacaacaatcaaagactattgttcccaaaagaaatccaggaggagtgtagcatctcgaacatctccttcaatcctgtcgcccccactattatgatgaagtttctcaatcgcattgtcacaattgaagccaacaaaaacggcggtaaaattaccgtgccagacaaaacctcacttgaactgctctgtcagggctgcagtggtgatataagaagcgccatcaactcacttcagtttagttcttcgaaaggggagaataacctgcgcccacggaaaaagggaatgtcgctgaaatctgacgctgtgctttctaagtccaagcgtagaaagaaacccgaccgagtgttcgaaaaccaggaggttcaggctatcggcggaaaagacgtttcactctttctgtttagggctcttggcaagattctttattgtaaaagagccagcctgactgagctagacagcccccggctcccctctcacctcagcgaatatgagcgcgacacattgttagtcgaacctgaagaggtggtggaaatgtcccacatgcctggagatctctttaacctgtacctacatcagaactacattgacttttttatggagatcgacgatatcgtgagggcctctgaatttcttagtttcgcagatatattaagcggcgactggaacacccgctcgttacttcgggaatacagcacaagcatcgccacccgtggagtgatgcactctaacaaagcaagggggtacgcccactgtcagggtggcggatcgagctttagaccactgcataaacctcagtggttccttattaacaaaaaatacagggagaattgtcttgctgccaaggcacttttccctgacttttgtctccctgcattgtgtctgcagacccagctcctgccctatttggcactactaactatccccatgaggaatcaagctcagatttctttcatccaggatattggtcgcctgccgctgaagagacattttgggaggctcaaaatggaagcactcactgatcgcgagcatggcatgatcgaccccgattcgggtgatgaggctcagctaaatggaggccactccgcagaagaatcactcggcgaaccaacccaggctacagtacctgagacatggtcactgcctttgagccaaaattcggcttccgaactccccgcaagccaaccgcagcccttctctgcccagggagacatggaagagaacatcatcattgaagactatgagtctgatggcacatag

SEQ ID NO: 25954 - DNA, 1518 bp, Artificial Sequence
  Description of Artificial Sequence: Synthetic coding sequence
atgttcaacaccgagagcagcttccacatgttcccctaccagagccagatcgcagtctttaaggaattcttgttgcgggccactaagtataataagttgcagatgcttggcgacgacttacggactgataagaagatcattttggtcgaagatttacccaaccagttctatcgggacagtcatactctccacgaggtgctgcggaaatacgtgagaattggacgatgtccgttgattttcatcatcagcgactccctcagcggcgacaataaccagaggcttctcttccccaaggagatccaggaggaatgttccattagtaacatctctttcaatccagtggcccccacaatcatgatgaagttccttaaccgcattgttaccattgaggccaacaaaaacggaggtaaaataaccgtgcccgacaaaacttctttagagctgctctgtcaagggtgctccggtgacattcggtctgctattaacagcctccagttctcctctagcaagggggagaacaatctgaggccacggaaaaaggggatgtctctaaagagtgatgctgtactgagcaaaagtaagagaagaaagaaacccgatagggtattcgagaaccaggaagttcaagcaataggtggaaaggacgtgtcccttttcctttttagggcactgggaaaaattctatactgcaagcgtgcctccctcactgagttggatagtccacggctcccgtcacacttgtctgagtatgagcgcgatacactcttggtggaacccgaagaggtggtcgagatgtcgcacatgcctggagatctgtttaacctgtatctgcaccagaactacatagattttttcatggagatcgacgacattgtccgagcgtctgagttcctcagcttcgccgatatattgtctggggactggaacactcgatctttactgcgggaatacagcacctctatcgccaccagaggggtgatgcacagcaacaaggcacgcggatatgcccactgccagggcgggggcagttccttccggccactgcataaaccgcagtggtttttaatcaataagaagtacagagagaactgcttggccgctaaggcccttttcccggatttttgtctgcccgctctgtgcctgcagactcagctgctcccttatttggccctcctgacgatcccaatgagaaaccaggcccagatatcgtttatccaggacattgggcggctcccgctcaaacgacactttgggagattgaaaatggaggcactcacagacagagaacatggaatgatcgatcctgattccggagatgaggctcagctgaatggcggtcactccgctgaagagagcctgggcgaaccaacacaggctacggtgcctgagacctggagtctgccgctgagccagaacagtgcatccgagctgcccgccagccagccccagcctttttccgcccagggcgatatggaggaaaacataattatcgaagactatgaatccgacggcacgtag

SEQ ID NO: 25955 - DNA, 1488 bp, Artificial Sequence
  Description of Artificial Sequence: Synthetic coding sequence
atggacagcctggccgagagccggtggccccccggcctggccgtgatgaaaactatcgatgacctgttgcgatgtggcatctgtttcgagtacttcaacatcgccatgattatcccccagtgtagccacaactactgctccctctgcatcagaaagtttctctcgtacaagacacaatgccccacctgttgcgtcacagtcaccgagcccgatctgaagaataatcgcatcttagacgaacttgtcaagagtctcaatttcgccagaaaccaccttctgcagttcgccctggaaagtccggctaagagcccagctagtagcagttccaaaaatctcgcggtgaaagtctacacacccgtggcttcaaggcagtcactcaaacaggggtccagattgatggacaatttcttaattcgcgaaatgagcggttctaccagcgagcttctgatcaaagagaacaagtccaagttttcaccacagaaagaagcttctccggctgctaaaaccaaggagacccggtctgtggaggaaattgcacccgacccatcagaagcaaaaagacctgaacccccttctaccagcaccctgaagcaggtgaccaaagtggattgtccagtgtgcggcgttaacattcccgaaagccatatcaataaacatctagacagctgcttgtcaagggaggaaaagaaggaatcccttagatcatcagttcacaagcgcaaacccttaccaaaaaccgtgtataatcttctgagtgaccgtgacctcaaaaaaaaactgaaagagcacgggctctctatccagggcaataaacagcaactgattaagcggcaccaagaattcgtccacatgtataatgctcaatgtgacgcgctccatcccaagtccgccgcagagattgtccgggagatcgagaatattgagaagacccgtatgaggttggaagcaagcaagttgaacgagtccgttatggtgtttacaaaagatcagacagagaaggagatcgacgagatccactccaaatatcggaagaaacacaaatccgagttccagctgctcgtggatcaagctcgaaaagggtataaaaagattgcggggatgtcacagaagaccgtgactatcaccaaggaggacgagtcaacagaaaagctgagtagcgtgtgcatgggccaggaggacaacatgacttctgttaccaatcacttcagccagagcaagctggatagtccagaggaactcgaacctgaccgagaagaagactcgtcaagctgtatagacatccaggaggttctttcttctagtgagagcgactcatgcaactcttcctcctccgacattatccgggatctgctggaagaggaagaggcatgggaggcctctcataagaacgatttgcaggacacggaaatatccccccggcagaatagaaggacgagggcagcggagagcgcggaaattgaacctcgcaacaaaagaaatcggaactag

SEQ ID NO: 25956 - DNA, 279 bp, Artificial Sequence
  Description of Artificial Sequence: Synthetic coding sequence
atggacagcctggccgagagccggtggccccccggcctggccgtgatgaaaactattgacgacttactgcgatgcggcatttgctttgaatatttcaatatcgccatgataatcccacaatgcagtcataactactgctctctttgtattcgcaagtttctctcctacaagacacaatgccctacttgctgtgtgacggttactgagccagacctcaaaaacaaccgcattctcgatgagctggtgaaaagcttgaacttcgccaggaaccacctatag

SEQ ID NO: 25957 - DNA, 1092 bp, Artificial Sequence
  Description of Artificial Sequence: Synthetic coding sequence
atggccgtgaccatcaccctgaagaccctgcagcagcagaccttcaagattagaatggaaccagacgagacagtgaaagttctcaaggaaaagattgaagccgagaaagggagggatgcttttcctgtagcaggacagaagctgatctacgccggcaaaatcctgagcgatgatgtacccatccgtgactacaggatcgatgagaagaacttcgtggttgttatggtgacaaagaccaaggcaggacagggcacctccgctccccctgaagcgtctccgaccgctgccccagagagcagtacctcttttccccccgctccgacctcagggatgagccaccctcctccagctgctagggaagacaagagtccgtccgaggaatcagccccaaccacaagccctgaaagcgtgtccggaagtgtcccgagtagcggatcttctggcagagaggaagatgctgccagtacactggtgactggctccgagtatgaaaccatgctaacagaaatcatgtccatgggatacgagcgtgagagagttgtagccgccttaagagcaagctataacaatcctcatcgggcagtagaatacctattgacaggaattccaggcagccccgaaccagagcatgggtcggtacaggagtcccaggtgtcagaacagcctgcaactgaggccgcgggggagaatcccttggaatttcttcgcgatcagccgcaatttcagaacatgcgccaagtaattcagcagaatccagctctgcttcctgctctcctgcagcaactcggccaggagaaccctcagctgctgcaacaaataagcagacatcaggagcagttcattcagatgttgaacgagccgcctggtgagcttgctgatatcagcgacgtggagggagaggtaggggccattggggaggaagccccacaaatgaactatatacaggtaacaccgcaggagaaggaagccatcgagcgcctgaaagctctggggttccccgagagtttagtgatccaggcttactttgcttgtgagaagaatgagaatctggccgcaaattttctgctgtcccaaaattttgatgacgagtag

SEQ ID NO: 25958 - DNA, 597 bp, Artificial Sequence
  Description of Artificial Sequence: Synthetic coding sequence
atgctgaccgagatcatgagcatgggctacgagcgggagcgggtggttgccgctctcagagcctcctataacaacccacatcgcgcggtggagtatttactgactgggattccgggatcaccagagcctgagcacggatcagttcaggagagccaagtgagtgaacagcccgcaaccgaggcggctggcgaaaaccccttggaatttctgcgagaccagccacagttccagaacatgcggcaggtcattcaacagaacccagcgctgctgcctgcactcctgcagcaactgggccaagagaatccccagctcttgcagcaaattagtagacaccaggagcaattcattcagatgctgaatgaacctcctggtgagttagctgatatcagcgacgtggaaggtgaggttggagccattggcgaagaggcgcctcagatgaactatatacaggtaacaccacaagagaaggaagcaattgaaagactgaaggcgctgggattcccagaatcactagttattcaggcatactttgcttgcgaaaagaacgaaaatctcgcagctaacttcttgctgtctcagaatttcgatgatgaatag

SEQ ID NO: 25959 - DNA, 1092 bp, Artificial Sequence
  Description of Artificial Sequence: Synthetic coding sequence
atggccgtgaccatcaccctgaagaccctgcagcagcagaccttcaagatcagaatggaacctgacgaaaccgtcaaggtcctaaaggagaagattgaggcagagaaaggccgtgacgctttcccagttgcaggccagaagctgatatatgcaggcaaaatcctctcagatgacgtgcccatcagggactaccgcatcgatgaaaagaactttgttgtggtgatggttactaaaaccaaggccggacaagggacatcggctcctcccgaggcttcaccaactgctgccccagagtcgtccacttcattcccaccagcacctaccagtggcatgtctcacccaccaccggccgcccgagaagataagtctcccagcgaggaatccgctcctaccacatcccccgagtcggtgagcggatctgtgccctcctccggaagctcaggaagggaagaggacgccgcttccaccctcgttactggcagtgaatacgagacaatgcttaccgagatcatgagcatgggctatgaacgggaacgggtggtcgctgccctccgcgcctcctacaataaccctcatagggctgtggagtacctgctgactggaatccccggaagtcctgagcctgaacatggcagtgtgcaggagtctcaggtgtccgaacaacctgcaactgaggctgccggggaaaatccactggagtttttacgagaccagccccagtttcagaatatgcggcaggtcattcaacagaaccctgccctactaccagcgctgttacagcaactgggccaggaaaacccccagctgctgcagcagatttccagacaccaggagcaattcatccagatgttgaatgagccacctggcgagcttgcagacatatctgatgtcgagggggaagtgggagcgatcggagaagaggccccccagatgaactacattcaagtcaccccccaggaaaaagaagcgatcgagcggttaaaagctctgggcttccccgaaagcctcgttatacaggcttacttcgcctgtgagaaaaacgagaacctcgctgccaactttcttctaagtcaaaactttgacgacgagtag

SEQ ID NO: 25960 - DNA, 927 bp, Artificial Sequence
  Description of Artificial Sequence: Synthetic coding sequence
atggccgtgaccatcaccctgaagaccctgcagcagcagaccttcaagatcagaatggagcccgacgagactgtcaaggtgctgaaggagaagattgaggcagagaagggtagagacgcgttccctgtggccgggcaaaaacttatctacgcagggaaaatcctgtctgatgatgtgccaattcgggattaccggattgatgagaaaaactttgttgtggtgatggtgactaagaccaaggccggccaaggtacttccgcccctccagaggcttccccgaccgctgccccagagagttccactagcttccctccagccccaacatcaggcatgagccacccacctcctgctgcaagagaagacaaaagcccaagtgaggaatcagccccaaccactagcccagagtctgttagcggctccgtgccctcctctggcagttcgggaagagaagaggacgcggcttctacacttgtcactggaagtgaatacgaaactatgctcacagagatcatgagcatgggctatgaaagggagagggttgtcgccgccttgagggcaagttacaataaccctcaccgggcagtggagtacctcctgaccgggatacccgggagccccgagcctgagcacgggtccgtccaagagtcacaagtgtcggaacagcctgcaacagaagctgcaggtgaaaatccattggagttcttgcgcgaccagcctcagttccaaaatatgagacaggttatccagcagaatcctgccctattgccagctctgttgcaacagctggggcaagaaaatcctcaactgctccagctcaaggcgctcggcttcccagaatctctggtgatccaagcctactttgcttgcgaaaagaatgagaacctggccgcaaattttctgttgtcccagaacttcgatgatgaatag

SEQ ID NO: 25961 - DNA, 1230 bp, Artificial Sequence
  Description of Artificial Sequence: Synthetic coding sequence
atgcaggtgaccctgaagaccctgcagcagcagaccttcaagatcgatatcgatccagaggagaccgtgaaggcactgaaagagaagatcgagtctgagaaaggcaaggatgcatttcccgtagcaggtcagaagcttatctacgccggtaagatccttaacgacgacacggctctgaaagaatataagattgatgagaagaacttcgtggtggtcatggttactaaacccaaagctgtctcaacccctgcaccagccactactcagcagtctgctcccgcttctaccactgccgtcacttccagcacaacgacaacagtggcccaggctcctacaccagttcctgcactggcaccaacgtctactccagcttctattaccccagcatcagccaccgcgtcaagtgagcctgctcccgcttcagcggctaaacaggaaaagcccgctgagaaacccgccgagacacccgttgcaacgagcccgacagctacggacagcacctcgggagatagctcccggagcaatctctttgaagatgccacctccgccctcgtgacaggacagtcttatgaaaatatggtgacagagataatgtctatgggatacgagcgggagcaggtgatagcagcgcttagagctagcttcaacaatcccgaccgcgccgtggagtacctgctaatgggaatccctggggaccgggaatcccaggccgtggttgacccaccccaggcagcttccaccggcgcgccacagtcaagtgcggtcgccgcagcggctgccactaccacagctaccacaacgaccacctccagtggcggccaccctttagagtttctcaggaaccaaccccaatttcagcagatgagacagataatccaacagaatcccagtctcttacccgcactgctgcagcagatcgggagggagaatccacagctacttcagcagatctcccaacaccaggagcactttatccagatgctgaacgagcccgtgcaggaggcgggcggccaaggagggggtggaggtggcggcagcggcggaattgccgaggccggatctggacatatgaattatattcaagtgacccctcaagaaaaagaggcgatagagaggcttaaggcattagggtttccggagggtcttgtaatccaggcctacttcgcttgcgagaagaacgaaaacctggctgcgaattttttgttacagcagaacttcgacgaagactag

SEQ ID NO: 25962 - DNA, 519 bp, Artificial Sequence
  Description of Artificial Sequence: Synthetic coding sequence
atggtgaccaagcccaaggccgtgagcacccccgcccccgccaccacacagcagtcagccccagcaagtactacagccgtgaccagttccacaacaaccacagtcgcgcaggctccaacacctgtgcccgctctggcaccgactagcaccccagccagtattacacccgcatcagctacagcgtcctccgaacccgcaccagcttccgccgcaaagcaggagaagcccgccgaaaagccggcggagacccctgttgccacatcccccaccgccactgactctacatccggcgactcaagccgtagcaacctgtttgaagacgccacctcagcactggtaaccggccagtcatacgagaatatggtcactgaaatcatgtccatgggttacgaacgggagcaagtcatcgcagcactgcgggcatcatttaataatcccgaccgtgccgttgagtatctgctcatgatcatcgttaaaacagggaacaaaaagaaaaagcagccccttctcggaaagtag

SEQ ID NO: 25963 - DNA, 1014 bp, Artificial Sequence
  Description of Artificial Sequence: Synthetic coding sequence
atggtgaccaagcccaaggccgtgagcacccccgcccccgccaccacacaacagtcagcccctgcctccacaactgccgttaccagtagtacgactacaaccgtagctcaggctcccacacccgtccctgctctggcgccgaccagcacaccggcctccataacacccgcttcagctactgcctcctccgagcccgcaccagcttccgccgccaagcaggaaaaacccgccgagaagcctgctgagactcccgttgcgacgagccccaccgctacggactctacaagcggagattctagtaggtccaacttatttgaggatgctacaagtgcccttgttaccggtcaatcatatgagaatatggtgacagaaataatgagtatggggtacgagcgagagcaggtgatcgccgcgctgcgcgcatcgtttaacaatccagaccgggcggttgagtacttgctaatggggatacccggggacagagaaagccaggctgttgtcgaccctcctcaggccgccagcacaggagcacctcaaagttctgcagtggcagctgctgctgccaccacgaccgctaccacaactacaacctcctcaggtggtcaccctctggagttcctccgaaaccagccccagtttcagcagatgaggcagatcatccagcagaaccccagtctactgcccgcattgcttcaacaaatcggtcgtgagaatccccagctgcttcagcagatttctcagcatcaggagcactttatccagatgctcaatgagcccgtgcaagaagctggtggacagggaggcgggggtggaggtgggtctgggggcatcgcagaggctggttcagggcacatgaattatatccaagtgacacctcaggagaaggaggctattgagagactgaaggctctcgggttccctgaggggcttgtgatccaggcctatttcgcttgcgagaaaaacgaaaacctcgccgccaattttttgttacagcaaaatttcgatgaggattag

SEQ ID NO: 25964 - DNA, 441 bp, Artificial Sequence
  Description of Artificial Sequence: Synthetic coding sequence
atgcaggtgaccctgaagaccctgcagcagcagaccttcaagatcgacatagatccagaggagaccgtgaaagccctgaaggagaagatcgaatccgaaaaagggaaggatgccttcccggtggcaggccaaaaacttatctacgccgggaagatcctcaatgatgacactgccctgaaggagtataagattgacgaaaaaaatttcgtcgtggtgatggtgacaaagccgaaggctgtcagcacaccggctcccgctaccacacaacaatctgctcccgcttccacaacagctgtgacatcatccacgactacaacagttgctcaggcacccacccccgttcctgccctcgcacctacaagcaccccggcctccattacgccagcctctgccaccgctagttcggagcccgcacctgcttctgctgcgaaacaggagtag

SEQ ID NO: 25965 - DNA, 243 bp, Artificial Sequence
  Description of Artificial Sequence: Synthetic coding sequence
atggtgaaggccctgaaggagaagatcgagagcgagaagggcaaggacgcattcccggtcgcgggacagaagcttatctatgccgggaagatcctgaacgacgatactgccctgaaagaatacaagatcgatgagaaaaatttcgttgtggtgatggtgaccaaaccgaaggcggtctctactcccgctccagctaccacacagcagagtgctcccgcttcaacgaccgccgtaacttcttag

SEQ ID NO: 25966 - DNA, 345 bp, Artificial Sequence
  Description of Artificial Sequence: Synthetic coding sequence
tgaaccgccagcagcgagcccgcccccgccagcgccgccaagcaggagaagccagcggagaagccggccgagacccccgtcgctacctccccaaccgccacagatagcacctctggggattcatcccgctccaatctgttcgaggacgcaacaagtgctctcgtgacaggccagtcgtacgaaaacatggttaccgaaataatgtcaatgggttatgagcgggaacaagtgatcgcagcactcagggcaagcttcaataacccagacagggctgtggagtatttactcatgattattgtgaaaactggtaataagaaaaagaagcagccactgctgggtaaatag

SEQ ID NO: 25967 - DNA, 3939 bp, Artificial Sequence
  Description of Artificial Sequence: Synthetic coding sequence
atgagccggatcgagaagatgagcatcctgggcgtgcggagcttcggaatcgaggataaggacaagcaaatcataacattcttctctcctcttactatcctagtcggacccaacggggccgggaagactaccatcatagagtgcctgaaatatatatgcacaggcgactttccccccgggacaaaaggcaacacttttgtgcacgatcctaaagtcgcccaggaaacagacgtccgtgcacaaatccgactgcagttcagggacgtgaatggagagctcatcgcagtgcagcgttcaatggtatgcacccaaaagagcaagaagacagaatttaagaccttagaaggcgtgatcacgagaactaaacatggcgaaaaggtctctctgtcctccaaatgcgcggagattgatcgtgaaatgatttcctctctaggtgtatctaaggccgtgctgaataatgtgatattttgccaccaggaggactctaattggccgctgtccgagggaaaagcattaaagcagaaattcgacgagatcttttctgctacgcgttacattaaagccctcgaaaccctcaggcaggtgcgccaaacacaggggcagaaagtcaaggagtaccaaatggaacttaaatatctgaaacagtataaggaaaaggcttgtgaaattcgggaccagataacatccaaggaggcgcagttgactagcagcaaagagattgtgaaatcatacgaaaatgaactggatccgttgaagaaccggctgaaagagatcgaacataatctgtcaaaaattatgaaactcgacaatgaaatcaaggcgttagacagccgaaagaaacagatggagaaggacaactcagagcttgaggagaagatggagaaggtgttccaggggaccgatgagcagctgaatgacttgtaccataatcatcagagaaccgtacgcgagaaggagcgcaagctagtggattgccatcgtgagctggagaagctgaacaaggagtctcgcttgctgaatcaagagaagagtgagcttctggtggaacagggccggcttcaactacaggccgacagacaccaggagcatataagggcccgcgattcactgattcagagtctcgccacccagctggagctcgatgggtttgagaggggcccgttcagcgagcggcagattaaaaatttccacaaattggtccgtgaaagacaggagggagaagccaagaccgcaaaccagcttatgaatgatttcgctgaaaaagaaacactgaaacagaaacagatcgacgagatccgcgataaaaagacaggtttagggaggatcattgaactcaagtccgaaatactgagcaagaagcagaacgagctgaaaaatgtgaaatacgagttgcagcaactggagggcagcagcgaccggattctggagctggaccaggaactaatcaaagccgagagagaactcagtaaggccgagaagaacagcaatgtggagacactgaaaatggaggtcattagcctgcagaatgagaaggctgatctcgataggactttaagaaagttagaccaagaaatggaacagctaaaccatcacaccacaacaaggacccaaatggaaatgctgacgaaggataaagccgataaagatgaacaaattaggaaaatcaagtccaggcactctgatgagctcacctccctccttggctattttccgaacaaaaagcaactggaagactggctccattccaaaagcaaagaaattaaccagacacgcgacagactggccaaattgaacaaagaactagccagctccgagcagaacaagaatcacatcaataatgagctcaagcggaaagaggagcagctctcatcctacgaagacaaactgttcgacgtttgcggaagccaggattttgagtccgatctcgatcgtctgaaagaagagatcgagaagagttcaaaacagcgcgctatgttggctggagctaccgccgtgtactctcagttcattacacaactgacagatgagaatcagagctgttgccccgtttgccagcgcgtcttccagacggaagccgagctgcaggaggtgatttccgacttgcagagcaagctgcggttagcgccggataagctgaagtctaccgagtcagaactgaagaagaaggaaaagcgtcgagacgagatgttgggacttgtccctatgcgacagtccatcatcgacttgaaagaaaaagaaattccggaacttcggaataagctccagaatgtgaaccgggacatccagaggctaaagaacgacatcgaggaacaggaaactcttctgggtacaatcatgcccgaggaggaatctgccaaggtctgtctgacagacgtgaccatcatggaacgctttcaaatggaactcaaggacgtggagcgaaagatcgcgcagcaggccgcaaaattacagggcattgatttagaccgcacagtccagcaagtgaaccaggagaagcaagaaaagcagcataaactagataccgtatccagcaaaattgagctgaataggaagttgatccaagaccagcaagaacagatccagcacctgaaaagcacaacgaatgaactgaaaagtgagaagctgcaaatcagcacaaacctgcagcggaggcagcaattagaggagcagactgtcgagctgtcgacagaggtacagtcattataccgcgagatcaaagatgccaaggagcaggtgagtccactagagacaacactcgagaaatttcaacaggaaaaagaggaacttatcaacaagaagaacacctccaacaaaattgcccaagataagctgaacgatataaaggaaaaggtcaagaatatacacgggtatatgaaagacattgagaattatattcaggatggaaaggatgactacaaaaaacaaaaagagacagaactcaacaaagtaatagctcaactgtccgaatgtgagaagcacaaggaaaagataaatgaagacatgaggctaatgaggcaggatattgacacgcagaagattcaggagaggtggctgcaagataacctaactctgcggaagagaaacgaggaactcaaagaagtggaggaggagagaaaacagcacctgaaagagatgggtcagatgcaggtcctgcagatgaagagcgagcatcagaaattggaggaaaatatcgacaacattaaacgtaaccataatctggccctgggacggcagaagggctacgaagaggaaattattcactttaaaaaggaattgagggagccgcagttccgggacgcagaggaaaagtaccgcgaaatgatgatagtcatgaggacaacagagttggtgaacaaagacctcgatatatactataagaccctcgaccaggccataatgaagtttcattccatgaagatggaggagataaataaaatcattagagacttgtggcgttctacgtacagggggcaggacatcgagtatattgagattcgaagtgacgctgacgaaaacgtgagcgctagcgataagcgccgcaactataattatcgggtcgtcatgctgaaaggggacactgcccttgacatgcgcggacggtgcagtgcgggacagaaggtgcttgcctctttaatcatccggctggccttggccgagaccttctgcctaaattgtggcatcattgccttggacgagccaaccactaatctcgaccgagaaaatattgagtcattggcacacgcccttgttgagatcattaaatcacggtcacagcagcgcaactttcaactgctggtcatcacacacgacgaagacttcgttgagctattgggaaggtccgaatacgtggagaaattttaccggatcaaaaagaacatcgatcagtgtagcgagatcgtcaagtgttcagtatcttcccttggtttcaacgtgcactag

SEQ ID NO: 25968 - DNA, 3522 bp, Artificial Sequence
  Description of Artificial Sequence: Synthetic coding sequence
atgatcagcagcctgggcgtgagcaaggccgtgctgaacaacgtgatcttttgtcatcaggaggattcgaattggccgctgtccgaggggaaagcacttaagcagaagtttgacgagatattctcagccacacggtacattaaggctttagagactttgcgacaggttcgccagactcagggacaaaaagtcaaagaataccagatggagctgaagtacctgaagcagtataaagaaaaggcttgcgaaatccgggaccaaatcacgtcgaaggaggcccagcttacctcctctaaggagatcgttaagtcctacgagaacgaattggacccactaaagaaccgtttgaaggagattgaacacaacctgagtaaaatcatgaagctggataatgagattaaggctcttgattcaaggaaaaaacaaatggaaaaagacaactctgaactggaggaaaaaatggaaaaggtgtttcaggggacagacgaacagctgaacgacctataccataaccaccagcgcaccgtgcgtgaaaaggagcgcaaactcgtagactgccatagagagctcgaaaagttgaataaggaatcccgcctgctcaaccaggagaagtctgaactcttggtggaacagggtcggcttcaacttcaagcagaccgacatcaggagcacatccgagcccgcgacagcctaattcagagtctggcaactcaactggaactggatgggttcgagaggggccctttctctgagcgccagatcaaaaactttcacaagctggttcgtgagcgacaagagggcgaagcaaagaccgcaaaccagttgatgaacgacttcgccgagaaggaaacgctcaagcagaaacagatcgatgagatacgcgacaaaaaaacaggtctgggcagaattatagagctgaagagcgagattttgagtaagaagcagaacgaactcaaaaatgtgaagtacgagctgcaacagctagagggatccagtgatcggattctggaactggaccaggagctaatcaaggccgagcgtgagctgtccaaggccgaaaaaaattctaatgttgagaccctcaaaatggaggtgatcagcctgcagaacgaaaaagccgatttggaccgcactctgaggaaactcgatcaggaaatggagcaattgaaccatcacacaaccactcggactcagatggagatgctgactaaagacaaggccgacaaagatgaacagatccgcaagatcaagtcccgtcacagcgatgaattaacctccttactcggctacttccccaataaaaagcagttggaagactggcttcatagtaaatccaaagaaatcaaccagactagggatcgtctcgctaaactcaacaaagagttagcctcttctgaacaaaataagaaccacatcaataacgagctcaagcgtaaagaggagcagctgtcatcttacgaagataagctctttgacgtgtgcggatcgcaggacttcgagtcggacttggacaggctgaaagaagagatagagaagtcctccaagcagagggcgatgctggccggtgccactgcggtgtattcccaatttatcacacagcttactgacgagaatcaaagttgctgtcccgtgtgtcagagagtctttcagacagaagcagaattacaggaagttataagcgacttacagagcaaactgcgcctggcaccagataagctgaagtccacagagtccgaactgaaaaaaaaagaaaagagaagagatgagatgctgggtctagtgccaatgcgtcagtccatcatcgatctgaaggagaaggaaattcccgaactgaggaataaactgcagaatgtcaaccgcgatatccagcggctcaagaatgacatcgaggagcaggaaacactcttgggtacaataatgcccgaagaggagtccgccaaggtttgtctcactgacgtcaccataatggagcgctttcaaatggagctgaaggacgtggagcggaagatagctcagcaggcggccaaactgcagggaatcgaccttgacagaactgtgcagcaggtcaaccaggagaagcaggagaagcaacacaaattggacacagttagctctaagatcgagctgaaccgcaagcttattcaagatcagcaagagcaaattcagcacctgaagagcaccacaaatgaactgaaatctgagaagcttcagattagcactaacctgcagcggagacagcagctggaggagcaaactgttgagttgtctacagaggtgcaaagcctctatcgggagattaaggatgccaaggaacaagtatcgccacttgagaccaccctggaaaagttccagcaagaaaaggaggagctcattaataaaaaaaacacgagcaataagattgcccaagacaaactgaatgacattaaagagaaggttaagaatattcatggctatatgaaggacatcgagaactacatacaggatggaaaggatgattacaaaaagcaaaaggaaacagagctaaataaggtgatcgcgcagttatccgaatgtgaaaagcacaaagagaaaatcaatgaagacatgcgtctgatgagacaagacattgatacccaaaagatccaggagcggtggttacaggacaatctgacactacgaaaacggaacgaggaactgaaagaggtggaggaggagaggaagcagcacctgaaggagatggggcagatgcaggtattgcagatgaagtcagagcaccagaaattggaagaaaacattgataatatcaagcggaatcacaaccttgcgcttggcagacagaagggatatgaggaggagataatacactttaaaaaagagttgagagagccccagtttcgagatgcggaagaaaagtaccgagaaatgatgatcgtgatgagaaccaccgagctggtgaataaagacctcgacatttactataaaactctggatcaggccattatgaaatttcattctatgaaaatggaggaaatcaataagattatccgagatctttggcggagtacataccgtggacaggatatcgagtacatcgagattcgctctgatgctgatgaaaatgtgtccgcttccgataaacggcggaattataattacagggtggttatgctcaagggcgacactgcgctggacatgagagggaggtgcagcgctgggcaaaaagtgttagcctctttaatcatcagactcgcactggccgaaaccttctgccttaactgcggcattattgccctcgatgagcctacaactaatttggatagggagaacattgagagtctggcccacgcactcgtagaaataattaagtccaggagtcaacagagaaattttcagctgctggttatcacccacgatgaggattttgttgagttgctcggccggtcagagtacgtggaaaaattttatcgcatcaagaagaacatcgaccagtgtagtgagattgttaagtgttccgttagtagtctaggctttaacgtacactag

SEQ ID NO: 25969 - DNA, 1020 bp, Artificial Sequence
  Description of Artificial Sequence: Synthetic coding sequence
atggccatgcagatgcagctggaggccaacgccgacaccagcgtggaggaagaatcctttgggcctcagcccatctcccggcttgagcagtgcggcatcaacgcaaatgacgttaagaagttagaagaagccggattccacaccgttgaggccgttgcatacgctccaaagaaagaactgatcaacattaaaggtatttctgaagcgaaggcagataaaattctggcggaggcagccaagttggtccccatgggctttactaccgccacggagttccaccagcgccgcagcgaaatcatccagatcaccaccgggtcaaaggagctggacaaattactgcagggcggaattgagacaggcagtatcactgagatgttcggtgagtttaggaccgggaaaacccagatctgtcatacactcgctgttacttgccagctgcctatagaccggggagggggtgagggcaaagctatgtacatcgataccgagggcacttttagaccagaacggttactggctgtagcggagagatacgggcttagcggaagtgatgtgctcgacaacgtggcctatgccagggccttcaatactgatcaccaaactcagctgctgtaccaggcctccgctatgatggtagagagcagatatgcactgctcatcgttgactcagcaaccgccctgtataggacagactactctggccggggcgagttgagtgcaaggcagatgcacctagccaggttcctgcgcatgctcctaagactggcggatgagtttggagtggccgtggttatcaccaatcaggtagtggcacaagtggacggggctgctatgtttgcagcagaccccaaaaaaccaattggcggaaatattatcgctcacgcgtctaccaccagattgtacctgcggaaggggcggggagaaaccaggatatgtaagatttatgattcaccctgcttgccagaggcagaggcaatgtttgccataaacgcagacggagtgggggatgctaaagactag

SEQ ID NO: 25970 - DNA, 729 bp, Artificial Sequence
  Description of Artificial Sequence: Synthetic coding sequence
atggccatgcagatgcagctggaggccaacgccgacaccagcgtggaagaggagtcttttggtccccagccgatttctcgccttgagcagtgcggaattaacgcaaatgatgttaagaagttggaggaagcaggcttccacaccgtggaggctgtggcctacgcacccaagaaagagctgattaacatcaaaggcatctccgaggccaaagccgataaaatccttctactgagccacaggtacgggctgtcgggtagcgacgtgctggacaatgtcgcgtatgctcgtgcatttaacacagatcatcagacccagcttttatatcaggccagcgccatgatggttgagagtcgttacgccctgctgatcgttgacagcgctactgccctctaccgcactgattacagcgggcgcggagagttgtctgctagacaaatgcatctggccagattcttaaggatgttgttaaggcttgccgacgagttcggagtcgcagtggtcataactaatcaggtggtggctcaggttgatggggctgctatgttcgccgccgacccaaaaaaacctatcggcgggaatatcattgcgcacgcaagcacaactagactgtacctccgcaaagggcgtggagagacccgcatctgcaagatctacgattccccttgcctgcccgaggccgaggccatgttcgctatcaacgcagacggagtgggggacgccaaggactag

SEQ ID NO: 25971 - DNA, 1023 bp, Artificial Sequence
  Description of Artificial Sequence: Synthetic coding sequence
atggccatgcagatgcagctggaggccaacgccgacaccagcgtggaggaagagtcgtttgggcctcagccaatctccaggctcgaacagtgcggcattaatgctaatgacgtcaaaaagcttgaagaagcaggctttcataccgttgaggccgtcgcctatgcgccaaaaaaagaactgataaacatcaaaggaatttccgaggccaaggcagacaaaattctcacagagtccaggtcggttgcccggctcgagtgtaactctgtcatcctggtgtattgcacactgcgactgtccggaagctccgatagccccgcctccgcttctcgggtcgtgggcaccacaggtgggattgagacaggatcaatcaccgagatgttcggcgagtttagaaccggcaagacgcagatctgtcatacactcgctgtgacatgccaacttcccatagaccgcggggggggtgaggggaaggccatgtacattgacacagaaggaaccttccgtccagaacgcttgctggcagtcgcagagagatacggcctgtccgggagcgatgtgttggataacgtcgcttacgctagggccttcaatacagaccatcagactcagctcctgtaccaggcttccgccatgatggttgagtcaaggtacgccctccttatcgtcgactctgctactgccctttaccgcaccgattacagtggaagaggagagctctccgcccggcagatgcatttggctagattcctgagaatgctgctgagactcgcagacgagtttggagttgcagtcgtcattactaatcaggtcgtggctcaagtggatggggcggccatgttcgccgcggaccctaagaaacctataggcggcaacatcatcgctcatgcttctacgacacggctatatttacgaaagggccggggagagactagaatctgcaaaatttatgactctccatgtctccccgaggctgaagctatgtttgcaattaatgccgatggagttggggacgctaaggattag

SEQ ID NO: 25972 - DNA, 843 bp, Artificial Sequence
  Description of Artificial Sequence: Synthetic coding sequence
atggccatgcagatgcagctggaggccaacgccgacaccagcgtggaggaggaaagttttggcccacagccgatctctcggcttgagcagtgtggcatcaacgccaacgacgtaaagaagctggaagaagcaggctttcacacagtggaagccgtcgcttatgccccaaagaaagaactcattaacattaagggcatttccgaggccaaggcagacaagatcttggccgaagccgctaaacttgttccaatgggtttcactacagctacagaattccaccagcgccgttccgagatcatccaaattactacaggaagcaaagagttggataagctgttacagggtggtattgagacaggcagtatcactgagatgtttggagaattcagaactgggaagactcagatctgtcacaccctcgcagtgacctgccagttgccaattgatagaggcggaggtgaaggaaaagctatgtatatcgatacggagggcacttttcgccccgaaaggctgctggccgtggccgaaaggtatggcttatccggttccgacgtcctggacaacgtcgcctacgcacgggcttttaacaccgaccatcaaactcagctattgtaccaggcgtcagccatgatggttgagagtcgctatgctttactgatcgtggactctgctacagcactgtaccgcacggactactccggccgcggagaactgagcgccaggcaaatgcacctggcaaggtttctgagaatgttactccgactcgccgatgagattgtgagtgaagaaagaaagagggggaaccagaacctgcagaatctgaggttgtctttgagctcatag

SEQ ID NO: 25973 - DNA, 456 bp, Artificial Sequence
  Description of Artificial Sequence: Synthetic coding sequence
atggccatgcagatgcagctggaggccaacgccgacaccagcgtggaagaggagtcattcgggcctcagcctatctctcggcttgaacagtgtgggataaatgccaacgatgtaaaaaagttggaagaggctggatttcacacagtggaggcagttgcttatgcccccaaaaaggagctgatcaacatcaagggcatctctgaagcgaaggccgacaaaatcctcgccgaagccgcaaagctggtgcctatgggctttactaccgctactgagttccaccagaggcggagcgaaataatacagatcaccactggctctaaggagttggataagctgctgcagggcggcattgaaactggatccataacagagatgtttggcgaattcaggacaggcaagacgcaaatctgccacaccttggcggtgacctgtcaagtctggagtctctggcagtag

SEQ ID NO: 25974 - DNA, 228 bp, Artificial Sequence
  Description of Artificial Sequence: Synthetic coding sequence
atggccatgcagatgcagctggaggccaacgccgacaccagcgtggaggaagagagctttggcccacagcccatttctaggcttgaacagtgtgggattaacgccaatgatgttaaaaaactcgaggaggccgggttccacaccgttgaggctgtcgcttatgctcccaagaaggaacttattaatatcaagggaattagtgaggcaaaggccgataagattctgtag

SEQ ID NO: 25975 - DNA, 519 bp, Artificial Sequence
  Description of Artificial Sequence: Synthetic coding sequence
atggccatgcagatgcagctggaggccaacgccgacaccagcgtggaggaggaatcgtttggtcctcagcccatttcacgcttggagcagtgtgggataaatgcgaatgatgttaagaaactcgaagaggcgggtttccatacagtcgaggccgtggcatacgcaccgaagaaggagctgatcaacatcaaagggatctctgaggccaaggcagataaaattttggctgaggctgccaaactggttcccatgggttttactactgcgaccgagtttcaccaacgcaggtcagaaatcatccagattaccaccggatcaaaggaactagacaaactgctgcagggtggtatcgaaaccgggagcatcaccgaaatgttcggggagttcaggaccggaaagacacagatctgccacaccctggccgtaacctgccagttgcccatcgatcgcggtggaggagaggggaaggcaatgtatatagacacagaaggcaccttccgacctgagcgcttgttgtag

SEQ ID NO: 25976 - DNA, 303 bp, Artificial Sequence
  Description of Artificial Sequence: Synthetic coding sequence
atggccatgcagatgcagctggaggccaacgccgacaccagcgtggaggaggagtcattcggtccccagcccatctctcgcttggaacaatgtggcataaacgctaacgatgtgaagaaactggaggaggcgggattccacacagtggaagcagtggcctacgccccgaaaaaggagctgataaatattaagggtattagcgaggcgaaggccgacaaaatactggtcgaactccggctggacctttctcagaagtgcctcgaaaattccgaacttggaaggcctaggtctgtgatccgctag

SEQ ID NO: 25977 - DNA, 1023 bp, Artificial Sequence
  Description of Artificial Sequence: Synthetic coding sequence
atggccatgcagatgcagctggaggccaacgccgacaccagcgtggaagaggagtcttttgggccacagcccatttcccgactggagcagtgcggcatcaatgccaacgacgttaagaaactcgaggaagcgggattccacacggtggaggcggtagcttatgcccctaaaaaagagcttattaacatcaaagggatcagcgaggctaaagccgataaaatcctgaccgaatcccgctcagtcgctaggctggagtgtaacagcgttatattagtctactgcacgctaaggctgagcggctcctccgactcccccgcctccgcctcacgggtagtcggaaccacgggcggcatagaaactggatccatcacggaaatgtttggagagtttcgtacaggaaagacccagatctgtcacacactggcagttacctgtcagttaccaattgatcgcggtgggggagaggggaaggccatgtatatcgatacggaagggacatttagaccagaacgcttactggcggtcgcagagcggtacgggctgtcagggtccgacgtcctggacaatgtggcttacgcgcgcgcgttcaacacagaccaccagacccagctcctgtatcaggcttctgcaatgatggtggagtctagatacgccctcttaatcgtagattctgctacggctctgtatcggaccgattactcaggccggggagagcttagtgctcgacaaatgcacttggctaggtttctcaggatgctgctcaggctggccgacgagtttggagttgctgtggtgataacaaaccaggttgttgcgcaggtagacggcgccgctatgttcgcagcagatccaaagaagccgattggcggaaacataatcgcccatgcttccacaactagactgtatctgagaaagggcaggggcgaaactcggatttgtaaaatatatgatagcccttgcctgcccgaagctgaggcaatgttcgctatcaatgccgacggtgtcggcgacgccaaggactag

SEQ ID NO: 25978 - DNA, 729 bp, Artificial Sequence
  Description of Artificial Sequence: Synthetic coding sequence
atggccatgcagatgcagctggaggccaacgccgacaccagcgtggaggaggaatccttcggaccccagcctatctctcggctggaacagtgcggtataaacgcaaacgacgtgaagaagttagaggaggccggcttccacactgtcgaggccgtcgcatacgctccgaagaaggagcttataaacattaaggggatctcggaagcaaaagctgataagattcttgctgtggctgagcggtacggactttcaggctcagatgttctagataatgtggcatacgctcgcgcattcaataccgatcatcagacccagctactgtaccaagcctccgcaatgatggtggaatcgcgatacgctttactgatcgtcgactccgccaccgcgttgtatagaaccgactactccggccgcggcgaactgtctgccaggcagatgcacctggcgcgatttctgcgcatgttgctacggttggccgacgaattcggcgttgcggtcgtgataacgaatcaagttgtggctcaggtcgatggggcagcaatgttcgctgcggatccgaagaagcccataggcggaaacatcatcgcgcatgcgtctacaactagattgtatttgcgaaagggaaggggagagaccagaatatgtaagatttatgactccccttgcctccccgaagccgaggctatgttcgccataaacgccgatggagtcggggatgctaaagactag

SEQ ID NO: 25979 - DNA, 1053 bp, Artificial Sequence
  Description of Artificial Sequence: Synthetic coding sequence
atgggcagcaagaagctgaagcgggtgggcctgagccaggagctgtgcgatcgtttgtcccggcatcagattctgacttgtcaagacttcctttgcttaagccccctcgaattgatgaaggttaccggcttgtcataccgaggggtccacgagctgctctgcatggtgagcagggcctgtgcacccaagatgcagactgcctatggtattaaggcccagagatcagccgactttagcccagcattcctttctacaactctgagcgctcttgacgaagctcttcatggaggggtcgcctgtggatccttgacagagatcacggggcctcctggttgtggaaaaacccagttctgcatcatgatgagtatactcgccaccctgcccactaacatgggagggctggagggcgctgtggtgtatatagacacagagtccgcattcagcgccgagcgactggtggagattgctgaaagtcgatttcctaggtattttaatactgaagagaagctgctcctaacgtcttcaaaggtgcatttatatagagagcttacatgtgatgaggtgctccagcgcattgagtccttggaggaggaaattatctcgaagggtattaagctggttatcctggactcagtggccagtgtggtgaggaaggagtttgacgcacagctacaggggaatctaaaggaacggaataagtttctggcccgggaagccagcagcttgaagtacctcgctgaagaattctccattcctgtcatcctgaccaatcaaattaccacacacctgtcaggtgccttggccagtcaggcggacttggtctcccccgcagacgatctttcactttccgaggggactagcggatcctcttgcgtgattgctgctttaggaaatacctggtctcactcggtcaatacaagactgattctccagtaccttgatagcgaaaggcgccagatccttatcgccaaatccccactggcccccttcacttccttcgtgtatacgataaaggaggagggcctcgtgcttcaggcctatgctcagtgctag

SEQ ID NO: 25980 - DNA, 1101 bp, Artificial Sequence
  Description of Artificial Sequence: Synthetic coding sequence
atgggcagcaagaagctgaagcgggtgggcctgagccaggagctgtgcgataggctctctaggcaccaaattttgacttgtcaggacttcctatgtctgtctccgctggaattaatgaaagtgactggactaagttaccgaggggtccacgagctgctttgcatggtgtctagggcctgcgctcccaagatgcagaccgcctacggcatcaaggcccagcgatctgcggattttagtcctgccttcctttctactaccctttccgcgctggatgaggctttacatggcggcgtagcttgcggctctctcacagaaatcacagggccccctggctgtggtaagacgcagttttgtattatgatgagcatcctcgcgacactgccgaccaacatgggcggccttgagggagccgtggtgtatattgacactgaatccgccttctctgcagaacgactcgtggagattgccgaatcacggttccctagatactttaacaccgaggagaagctgctcttaacctctagtaaagtgcacctgtaccgggagctaacctgtgatgaggtactgcagaggatcgaatcactggaggaggagattatcagtaaagggattaagctcgtgatccttgactcagttgcatccgttgtacggaaagagttcgatgctcaactccaggggaatctgaaagagaggaacaagttcttggcacgagaagcttccagtctgaaatatttggccgaggaatttagcattcccgtaattctaacaaaccagattactactcacctgtctggcgcgttagcctctcaagctgacctcgtgtctccggcggacgacctctctctttctgaagggacaagtgggtcttcttgcgttatagccgccttaggtaacacatggtctcactctgtgaatacgaggctgattctccagtacctggactcggagcgacgccaaatactgatcgctaaaagccccctggcaccattcacttcattcgtatacacaataaaggaggaaggtcttgtcctgcaggagttttggcatatatgcatctccgggttttcaatacagaaccgccttaaggaaaatgagagttag

SEQ ID NO: 25981 - DNA, 1053 bp, Artificial Sequence
  Description of Artificial Sequence: Synthetic coding sequence
atgggcagcaagaagctgaagcgggtgggcctgagccaggagctgtgcgacagattatcgaggcatcagatcctgacttgccaggatttcttatgtttatcacctctggagttgatgaaagtgacagggctgagctataggggagtacacgaacttctgtgtatggtaagtcgcgcctgtgcacccaaaatgcaaactgcttatgggattaaggctcagcggagtgcagatttcagcccagcatttctttctacaacactcagtgccttagacgaggcccttcatggtggcgtggcctgcgggagccttaccgaaattacgggacctcctggttgtggaaaaactcagttttgtatcatgatgtccatcctggctaccctccctacaaatatggggggcctggaaggtgctgtcgtctatattgacaccgagtcagcattctcagccgagcgcttagtcgaaatcgccgagagccgattcccaaggtactttaacacagaggaaaaattactgctaacatctagcaaggtgcacctgtacagggagcttacctgtgacgaggtactccaaagaattgagagtttagaagaagagattatatctaaaggaatcaaattggtcatcctggattccgtggccagtgttgtgcgcaaggagtttgacgctcaactccagggaaatcttaaagagcggaataaattcttagccagggaagccagcagcctcaagtacctggctgaggagttctcaattccagttatcctaactaaccagatcacgacacatctcagcggagccctggccagccaagccgacctggtttccccggccgacgatttgtccctttcagagggcacaagcggttcctcgtgcgtgattgcggctctgggcaatacttggtctcactcagtcaacacacgcctcattctgcagtaccttgatagcgagcggcgtcagattctaatcgccaagtcacctctggcccccttcacatcattcgtgtacacaatcaaggaggaaggcttagtcttacaggggcaggaaaccccttag

SEQ ID NO: 25982 - DNA, 1053 bp, Artificial Sequence
  Description of Artificial Sequence: Synthetic coding sequence
atgggcagcaagaagctgaagcgggtgggcctgagccaggagctgtgtgaccggttatcccgacaccaaatcctgacgtgtcaggactttctttgtttaagcccacttgaactaatgaaggtaacaggtttatcttacaggggcgtgcacgagcttctgtgcatggtatccagagcctgcgctccgaagatgcagacagcctatggcattaaggcccaaagatctgctgacttctcaccagcattcctctccactactttaagcgcgcttgacgaagccctccacgggggtgtcgcttgcggcagcctgaccgaaattactgggccgccaggatgtgggaagacacaattctgtatcatgatgagtatactcgcaaccctgcccactaacatgggcggcctggaaggtgctgttgtgtatatcgacaccgaaagtgccttttctgccgagagattagtggaaattgcagaatcacggttcccaagatattttaacaccgaggagaagctacttctgacatcgtctaaggtgcacttgtatagggaattgacatgtgacgaagtcttgcagcgcatcgagagtcttgaggaagagattatttctaagggtatcaaactggtgatcctggattccgtagctagtgtggttcggaaggagtttgatgcccagctgcaaggaaatttgaaagaaaggaataagttcctggcaagagaagcttcgtcactgaagtatttggccgaagagttctctattcccgttatcctgactaaccaaataacaacccatctgagcggtgcactggcaagccaagcagatttggttagtccagcagatgatttgtccttgtctgaggggacctctggcagttcgtgcgtcatcgccgctctgggcaacacttggtcccacagcgtgaatacccgcttaatcttgcagtacttggactcagagaggagacagattctcattgcaaagagtccccttgccccttttacctcctttgtgtatactatcaaagaagaagggcttgtgttgcagggccaggaaaagccctag

SEQ ID NO: 25983 - DNA, 402 bp, Artificial Sequence
  Description of Artificial Sequence: Synthetic coding sequence
atgggcagcaagaagctgaagcgggtgggcctgagccaggagctgtgtgaccgactttcacgccatcagatcttaacatgtcaggacttcctgtgtctgtctcccctggaactgatgaaagtgacaggtctgtcctataggggcgtgcacgaacttctttgcatggtcagtagggcttgcgccccaaagatgcaaaccgcctacggcattaaggcacagcgaagtgcggatttctcccccgctttcctgagcaccacactcagcgcactcgacgaagccttgcacgggggggtggcttgcgggagcctgactgaaatcactggacctcccgggtgcggcaaaacacagttctgtatcatgatgtccattctcgccactctcccgacaaacatgggcggctag

SEQ ID NO: 25984 - DNA, 1155 bp, Artificial Sequence
  Description of Artificial Sequence: Synthetic coding sequence
atgggcagcaagaagctgaagcgggtgggcctgagccaggagctgtgcgaccgtctctcgagacaccagatcctcacgtgccaagatttcctgtgtctttcaccactggagctgatgaaagtgacagggttatcctacaggggtgtccatgaactcctttgcatggtgagtcgggcctgcgcacctaagatgcaaacggcttacggaataaaagctcagaggtctgccgacttttcgccagcttttctctcaacgacgctgagcgccctggacgaagcactgcacggaggtgtcgcctgcggctctctgactgagatcaccggaccccccggctgcggcaagacccagttctgtatcatgatgagcatcctcgctaccctcccaacaaacatgggcggcctcgagggcgctgttgtatatatagatacagaatcagctttcagtgcagagcgcctagtggagattgccgagagccggtttccacgctatttcaacaccgaagaaaagttactgcttacatcctccaaggtccatctgtacagggagctaacatgtgacgaggttttgcaaaggatcgaatccctggaagaggagatcatctccaaagggattaagttggtgatcctcgacagcgtggcttctgtggtcagaaaggagttcgatgcccaactgcaaggtaatttaaaagaaaggaacaagtttctcgcccgagaggcgagttccctgaagtatcttgctgaagagttctcaatcccagttatactaactaaccaaataaccactcacctgagcggagccctggcctctcaggccgatcttgtgtcacccgccgacgacctgagtctcagtgagggtacgtctggatctagctgcgttattgctgcattagggaatacctggtcccacagtgtgaacacacgcctcattttgcagtacctggattctgaacgccgacaaattttgattgccaagagtccattggccccatttacctctttcgtttatacgattaaggaggaggggctagtgctacaggagacaacattctgctccgtgacccaggcagagctcaactgggcccctgaaatcctcccaccacaacctcccgaacagctggggctgcagatgtgtcatcatacacagctaatcttttag

SEQ ID NO: 25985 - DNA, 1101 bp, Artificial Sequence
  Description of Artificial Sequence: Synthetic coding sequence
atgggcagcaagaagctgaagcgggtgggcctgagccaggagctgtgtgataggctgagccgtcaccagattttaacttgccaggactttctgtgcttgtctccgctggagctcatgaaggtgaccgggctgagttatcgaggcgttcacgagctgctgtgtatggtgtctagggcctgtgctcccaagatgcagactgcttacgggataaaagcgcagagatccgccgacttctcgccagccttcctgagtactaccctgagcgctttggacgaagcactgcatggaggggtggcatgcgggagcttgacagaaataacaggccctccgggatgtggaaaaacgcagttctgcataatgatgtcaatactggctaccctacctacaaacatgggaggtctcgaaggcgctgttgtttacatcgatacagagtcagctttctctgctgagcgcctcgtggaaattgcagagagccgcttcccaagatacttcaataccgaagagaagctcttactgacctcctctaaggtccacctgtatagggagctgacgtgtgatgaagttttgcagcgaatagaaagccttgaagaagagatcatctccaaaggaattaaactggtgatattagattccgtagcttccgttgtcagaaaagagttcgatgcccagctgcaagggaatctaaaagaacgaaacaaattccttgctcgggaggccagtagcctcaaatatctcgcggaagagtttagcatccccgtcatactgacgaaccaaatcacaacacacctaagtggggccctggcatctcaggctgaccttgtttcacctgcggacgatctcagcttgtctgagggaacctctgggtcgagctgcgtgattgccgccttagggaatacgtggtcacatagtgtgaatacccgcctgatcctgcagtacctggattccgagcgccgccaaattcttatcgcgaaatctcccttagccccttttacatcattcgtgtatacaatcaaagaggaggggctggtgctgcaggagttctggcatatctgtattagtgggttctctattcagaaccggctcaaagagaacgaatcgtag

SEQ ID NO: 25986 - DNA, 228 bp, Artificial Sequence
  Description of Artificial Sequence: Synthetic coding sequence
atgggcagcaagaagctgaagcgggtgggcctgagccaggagctgtgtgatcgactctcgcggcaccagatactcacctgccaagacttcctttgcctgtctccactggagttgatgaaagtgaccggtctaagttatcgaggcgtccacgaattgctatgtatggtgtcaagagcatgcgcccctaaaatgcagactgcctacggcataaaggcccagaggtcctag

SEQ ID NO: 25987 - DNA, 1131 bp, Artificial Sequence
  Description of Artificial Sequence: Synthetic coding sequence
atgcggggcaagaccttccggttcgagatgcagcgggacctggtgagtttccctctgtcaccggccgttcgcgttaaactggtaagcgccggattccagacggctgaagagttgctggaagttaaaccttccgagctttctaaagaagtgggaatcagtaaggccgaagcccttgaaacactgcagataattaggcgcgagtgcttaaccaacaaaccacgctatgcgggcacttctgagtctcacaaaaagtgtactgctctggagctgcttgagcaggaacatacccaggggtttatcatcaccttttgcagtgccttggacgacattctggggggcggggtgcccctgatgaagacaaccgaaatctgcggggctccaggcgtgggcaaaacgcagctgtgtatgcaactggccgtggatgtgcagatccctgagtgcttcggtggggtggccggtgaagctgtgtttattgatactgaggggagttttatggtggaccgggtagtagacctggcgacagcatgtatacagcacctccaattaattgccgaaaagcacaagggggaggaacacaggaaagcccttgaagatttcaccttggacaacattctctcccatatatactattttcgatgccgggattacacagaacttcttgctcaggtttacctccttccagactttctgtctgagcacagtaaggtgagacttgtgatcgtcgacggcattgcctttccatttaggcatgacctggatgacttgtcgttgcggactcgacttctaaatggcctcgcccagcagatgatcagtctggcaaacaaccatcggttagctgtgattctgacaaatcagatgaccaccaagatagataggaatcaggctttgctggtaccggccttgggtgaatcctggggtcatgccgcaactatcagactgattttccattgggaccggaaacagaggctggcaactctgtataagtcacccagccagaaagagtgtaccgtactgttccaaatcaagcctcaggggttccgcgatacagttgtgacctccgcttgctctttacagacggaggggagcttaagcacgcgcaagcgtagcagagatccagaagaagagctctag

SEQ ID NO: 25988 - DNA, 987 bp, Artificial Sequence
  Description of Artificial Sequence: Synthetic coding sequence
atgggcgtgctgcgggtgggcctgtgccccggcctgaccgaggagatgatccagctgctgcgttcgcacaggatcaagactgtggtggacctggtaagcgctgatctcgaggaagtggctcagaaatgcggcctgtcctataaggccttggtagctctccgacgcgtgctgcttgcccaattctccgcctttcctgttaatggtgctgacctttatgaggagttaaagacatccacggctatcctgtcgactggcatcgggagaatccgcctgtcagggaacgcccgttggctgatgccaaaggtgacggagatcgtaggagggccaggctcagggaagactcaggtgtgtctttgcatggctgcaaatgtggcccacggactgcagcaaaacgtactctacgtcgattccaacggaggcctcaccgcgagtcgcctcctgcagctgctgcaggctaaaactcaggatgaggaagagcaggctgaggccctgcgcaggatacaagttgtacacgcattcgacattttccagatgttagatgtcctccaagagctaagaggaactgtggcacagcaagtgaccggcagctccgggaccgtgaaggtggttgttgtagactctgtgacagcagttgtttcccctctgctcggcggtcagcaacgcgagggattagccttgatgatgcagctcgcccgagagctcaagacacttgctcgggatctgggcatggctgtcgtggtcaccaatcacatcacaagggatagagatagcgggcgactgaaaccggcactgggcaggtcgtggagcttcgtgccttcaactaggatcttactagacacaatcgagggcgcgggtgcctcgggcggccggagaatggcctgcctggcaaagtctagtcgccagcctaccggctttcaggaaatggtggacattgggacgtggggaactagcgagcagtcagctacgctgcagggagatcaaacatag

SEQ ID NO: 25989 - DNA, 987 bp, Artificial Sequence
  Description of Artificial Sequence: Synthetic coding sequence
atgggcgtgctgcgggtgggcctgtgccccggcctgaccgaggagatgatccagctgctgcggtcacaccgcatcaaaactgtggtggatttggtgagtgccgatcttgaagaagtggcgcaaaaatgcgggctgtcctataaagctctcgttgctctcagacgagttctgctcgcccagtttagcgctttccccgttaacggagccgacctgtacgaggagctgaaaacttccacggctattttatccaccggcatcgggagcttggacaaactcctagatgctggcctttataccggtgaggtaaccgaaatcgtgggcggccctggctctggaaagacacaggtgtgcttgtgcatggccgccaatgttgcacatgggctccaacagaatgtgttgtacgtggacagcaacggtggccttacagcctcacgtctcctccagctgctccaagcaaaaacacaggacgaggaagaacaggcagaggcactgaggaggattcaagttgttcatgcttttgatatcttccagatgctggatgtgttgcaggagcttcgcggaacagtggcccagcaggttaccggtagttctggcactgtgaaggtggttgtggtggacagtgtcactgcagtggtgagtccactgctgggaggccagcagagggagggccttgccttaatgatgcaactggctcgcgagctgaaaacactggctcgggacttgggaatggccgtcgtagtgactaaccacatcactcgagatcgggatagcggcaggctgaaacccgccctgggcagatcctggagcttcgtgcccagcacccggatattgctggacacaatagagggtgccggcgccagtggaggcagaaggatggcctgcctcgctaagtcctctcggcaaccgacagggttccaggagatggtggacatagggacatggggaacaagcgagcagagtgcaactcttcaaggcgaccaaacgtag

SEQ ID NO: 25990 - DNA, 651 bp, Artificial Sequence
  Description of Artificial Sequence: Synthetic coding sequence
atgggcgtgctgcgggtgggcctgtgccccggcctgaccgaggagatgatccagctgctgcgcagccatagaataaaaacggtagtggacctggtgtcggccgacctcgaggaggttgcccagaaatgtggcctgagttacaaggccgaggcactcagaagaattcaggtcgtgcacgcttttgacattttccagatgttggacgtgctgcaggagttgcggggtacggtcgctcagcaggtgaccgggtcaagtggaacggtgaaggttgtcgttgtggattctgtcacagcagtcgtgagtcccctgctgggaggccagcagcgggagggcctggctctgatgatgcaactggcccgagaactgaaaaccctggcccgggatctgggcatggcagtggttgtgaccaaccacatcaccagagatcgtgattccgggcggcttaaacctgcactgggtcggagctggagctttgtcccgtcaacaagaatcctgctggacaccattgagggggcaggcgcatccggcgggcgccgcatggcctgcctcgccaaatctagcagacagcccacgggattccaagaaatggtggatatcggcacatgggggacctctgagcagtcagccacacttcaaggtgaccagacatag

SEQ ID NO: 25991 - DNA, 357 bp, Artificial Sequence
  Description of Artificial Sequence: Synthetic coding sequence
atgggcgtgctgcgggtgggcctgtgccccggcctgaccgaggagatgattcagctgctgcgctctcaccgtattaaaacagtggttgatctggtgtcggcggatttggaggaggtcgcccagaagtgcggcttgagttataaggcactggtggcactgagaagggtcctcttagcacagtttagtgcgtttcccgtgaacggggccgacctgtacgaagaacttaaaaccagcactgctatcctgtctaccggaattggacgacatggtggtcgcacacaggtgggaacttgggaggattgcagttgtcttcgaagccctcagggcgacagaggtgtgggttccgggatgctgtag

SEQ ID NO: 25992 - DNA, 852 bp, Artificial Sequence
  Description of Artificial Sequence: Synthetic coding sequence
atgggcgtgctgcgggtgggcctgtgccccggcctgaccgaggagatgattcagctactgcgatctcatcgcatcaagactgttgtggaccttgtgagtgccgatttagaagaggtcgctcagaagtgcgggctgagttacaaggcactggtcgctcttcggagagtgcttctggcccagttcagtgccttccccgtcaatggtgccgacttatacgaagagttgaagacatccacggccattttgtctactggtatagggagtctggataagctcctggatgctggactatatacaggtgaggtgacagagatcgttgggggaccaggcagcgggaagacacaagccgaggctctgagaagaatacaggttgtccacgcattcgacatctttcagatgctcgacgttctgcaagagctgcggggaaccgtggcccagcaggtcactggctcttcgggcaccgtaaaagttgtagtggttgatagcgtaacagctgtggtgtccccgttgctggggggacagcagagggaaggacttgcccttatgatgcagcttgcccgagaattgaaaacactcgcacgggacttgggaatggctgtcgtggtaaccaatcacatcacgagggatcgggatagcggacgactcaagcctgctcttggccgaagttggtcattcgtgcccagtacaagaatattattggacaccatcgagggtgccggagcaagcggggggcgaagaatggcatgccttgctaagtcttcccggcagcctactggcttccaggaaatggtagacatcgggacatggggcacaagcgaacaatcagccacactccaaggggatcagacctag

SEQ ID NO: 25993 - DNA, 1047 bp, Artificial Sequence
  Description of Artificial Sequence: Synthetic coding sequence
atgggcgtgctgcgggtgggcctgtgccccggcctgaccgaggagatgattcagcttctgagaagtcacaggatcaagaccgtggttgacttggtgtctgctgacttggaggaggtggcacagaagtgtgggctgtcctacaaaacctggcgtgcccacagctcagggaatctcggtgggctgcagctcccacaggtccccgccggccgcagttggagcggcgttcgcaatgccctcaaaaaagcgggactcggccacgggggtacagatggcctgagcctgaacgcctttgatgagaggggaacagccgtgtccacatctagactagataagttacttgacgcgggactgtacacaggggaagtgactgagatagtcggcggacccggctccggcaaaacccaagtctgtctatgtatggccgcaaatgttgcgcacggtcttcagcagaacgttctgtacgtggactccaacggcggcctgaccgcctctagactgctgcagctgttgcaagcaaagacacaggacgaagaggagcaggccgaggcccttagaagaattcaagtggtgcacgcatttgacattttccagatgctcgacgtgctgcaggaacttcgcgggactgtggctcagcaggttaccggatcaagcggcactgttaaggtcgtggtggtggactccgttaccgcagtggtgtctccactgctagggggtcaacaaagggagggtctcgcgcttatgatgcagctggctcgagaactaaagacacttgccagagatctgggaatggccgttgtcgtcaccaaccatataacaagggatagggattctggacgactgaaaccagccctaggtagatcatggtccttcgtgccctcgacacggatcctgcttgacaccattgaaggcgctggcgccagcggcggtcgccggatggcctgtctggcaaaaagcagccggcagcccacaggattccaggagatggtggatatcgggacttggggcacatctgagcagagtgcaacactccagggagaccagacctag

SEQ ID NO: 25994 - DNA, 648 bp, Artificial Sequence
  Description of Artificial Sequence: Synthetic coding sequence
atggtgatggccgccctgcccttcagcgaggacctgaagatgcccgacacctgcgtgttaccccactgcccaggaaaggaaaataaggatgtggtggatctggtatccgcagacctagaggaggtcgcccagaagtgcggcttaagctacaaagctctcgttgcactgcgtcgcgtcctgctcgctcagttttcggctttcccagtaaacggcgcagatctgtacgaagagttgaaaacaagtaccgctatcttgtctacgggtattggctccctcgataaactgctcgacgccggtctgtacactggggaagtaaccgagatcgttggcgggccaggatccggcaagacgcaggtctgcctttgcatggcagcgaacgttgctcacggcctgcagcaaaacgtgctttatgtggactcaaacgggggactgactgcttcgcgactgctgcagttgctgcaagctaagacccaagacgaagaggagcaggcagaggctctacggcgcatacaggttgtgcacgcatttgacatatttcagatgctcgatgtgttgcaggagctgagaggcaccgtggcccaacaagacgggattcctgagcacctgaatcacattccccactgccttcacgtgcatctaccctgctag

SEQ ID NO: 25995 - DNA, 711 bp, Artificial Sequence
  Description of Artificial Sequence: Synthetic coding sequence
atgggcgtgctgcgggtgggcctgtgccccggcctgaccgaggagatgattcagctactgagaagccacaggatcaagacggtcgtcgatttagtaagcgccgacctggaagaagtggcccaaaagtgcggcctgtcatacaaagcactggtggccctccgaagggttctcctggcccaattctcagcgtttcctgtgaatggcgccgatctgtatgaggagcttaagactagcacagccatcctgtcaacaggcattggtagtttagataagctcctggatgccggcctctacacgggagaggtgacagaaatcgtagggggacctgggtcaggcaagacccaggtatgcttgtgtatggcggctaatgttgcacatggcctacagcaaaacgtgctttatgtagattccaacggaggtctcacagcttctcggctgctccagttgctgcaggcaaagactcaagatgaagaggagcaggccgaggccctgcgccgaatccaggtggtacatgcatttgacatcttccagatgctcgacgtcctgcaagagctgcgtgggaccgtcgctcagcaagttacaggcagttctggcactgtcaaggtggtggttgttgacagcgtgacagcggtagttagccccttattgggcgggcagcagagagagggtcttgccttaatgatgcaattggcccgcgagttaaagacttag

SEQ ID NO: 25996 - DNA, 1047 bp, Artificial Sequence
  Description of Artificial Sequence: Synthetic coding sequence
atgggcgtgctgcgggtgggcctgtgccccggcctgaccgaggagatgatacaattactccggtcccaccgcataaagacagtcgtggacttggtgtcagccgacctcgaagaggtggcccagaaatgcggcctgagctataaaacttggagagcccactcctcaggaaatctcggtgggctgcaactgccgcaggtaccagccggaaggtcgtggagcggagtgcggaacgcgttaaagaaagccggcctgggccacggcggaaccgacggcttgtccctcaatgccttcgacgagagggggacggccgtctccaccagccgattggacaaattgttggacgcaggcctgtacaccggagaagtgacagagatagttggaggacccggcagtggtaaaacccaagtgtgtctgtgcatggctgcgaatgtggcacacgggcttcagcagaatgtgctgtacgtggactcaaacggtggcctgacggctagccggcttctgcagctgctccaggctaagactcaggatgaagaagagcaagccgaagctttgcgccggatccaggtagttcatgcttttgatattttccaaatgctagacgtccttcaggagctccgcggaaccgtcgcccagcaggtgacaggaagttctgggactgtgaaagtagtggtggttgacagcgtcacagctgtcgtgtcacccctcctgggtgggcagcagcgcgagggactggctttaatgatgcaattggcccgtgaactcaagacgcttgcacgtgacctcggcatggctgtcgttgtgaccaatcatattaccagagatagagactccgggcggctgaagccagctctgggaaggagctggtcttttgtgccaagtacccgcatcctgcttgacactattgagggagccggagctagtgggggtcgaaggatggcctgcctcgctaaaagctctagacaacccactggattccaggagatggtcgacatcgggacctggggcaccagtgaacagagtgctactctccagggtgatcagacatag

SEQ ID NO: 25997 - DNA, 1257 bp, Artificial Sequence
  Description of Artificial Sequence: Synthetic coding sequence
atgagcggcaccgaggaggccatcctgggcggccgggacagccaccctgcggcggggggcgggtcagtactttgttttgggcagtgccagtacactgctgaagagtatcaggcaatacaaaaggccctccgacagcggctcgggcctgaatacatctcctcacgcatggctggaggagggcaaaaggtgtgctatattgagggccatagagtgatcaacctggccaatgagatgttcggctacaatggctgggcacattcgattacacagcagaatgtcgatttcgtcgacctgaacaacggaaagttttatgtcggagtgtgtgcattcgtgagggtgcagctgaaagatgggagctaccacgaagacgtaggctacggcgtgtctgaggggctgaaatcaaaggctctgagcctggagaaggcccggaaagaggctgtcacagacggccttaaacgcgcgctgagatccttcgggaatgccttaggcaactgcatcctcgataaagactatctgcgctctctgaataagctacctcgccagctgccccttgaagtcgatttgactaaggccaaaaggcaggacttggaaccatcggtggaagaagcccgctacaattcctgcagaccaaatatggcactgggccatcctcagttgcagcaggttacgtctccctccaggccgagtcacgccgtgataccagcagaccaggactgtagtagccgatctctgtcaagctccgctgtggagagcgaagcaactcaccagcgcaaattgcgtcagaaacagctgcaacagcaatttcgggagcgcatggagaaacagcaggttagagtgagtacgccctccgcggaaaaatccgaggctgctcctcctgcccctccggtgacccattctactcctgttacggtgtcggagcccctgttagagaaagacttcctggccggcgtgactcaggagctaattaaaaccttagaagataacagtgagaagtgggcggtgacccctgatgcaggggatggcgttgtgaagccaagttctcgagcagaccccgctcagactagcgacacattagccctgaacaaccagatggtgacgcagaaccgtacaccgcacagcgtctgccatcagaagccccaggcaaagtctggatcgtgggatctgcagacatattctgctgatcaacggacaaccgggaactgggagagtcacagaaaatctcaagatatgaagaaacggaagtacgatccatcttag

SEQ ID NO: 25998 - DNA, 1257 bp, Artificial Sequence
  Description of Artificial Sequence: Synthetic coding sequence
atgagcggcaccgaggaggccatcctgggcggccgggacagccaccccgccgctggcggtggatcagtattgtgtttcggccagtgccagtatacagctgaagaataccaggccattcagaaagcccttcgacaaaggctgggaccagagtacatctcgtccagaatggcaggaggaggtcagaaggtgtgttatattgaggggcatcgtgtgatcaatctggcaaacgaaatgtttggatacaatggctgggcccattccattacgcagcagaacgtcgactttgtcgatctgaacaacggcaaattctacgtcggcgtctgcgcttttgtcagggtgcagttaaaggatgggtcttaccatgaggacgttggttacggcgtctccgagggcctgaagtccaaagctttgtccctggagaaggcgaggaaagaggctgttaccgatgggcttaaacgggccctcagaagtttcggtaacgctttggggaactgcatcctcgataaggattatctgcgctctctgaataagttgccaaggcaactgccgctggaggttgacttgaccaaggccaagaggcaggacctcgagcctagcgtggaagaagccaggtataattcatgccgacctaacatggcactcgggcacccccagttgcagcaggtcacctccccctccagaccaagccatgcagtcataccggccgatcaggattgttcctctcgttctctgtcttcatctgcagtggagtcggaggctacacaccagcggaagctcagacaaaagcagttacagcagcagttccgcgagcgaatggaaaaacagcaggttcgggtatccacacctagtgcagaaaaaagcgaagcggcaccaccagcaccgccggtaacccactccacccctgtaaccgtcagcgagcctctgttggagaaggatttcctggccggggtgactcaggaattaatcaaaacactggaggataatagcgaaaaatgggccgtgactcccgacgcgggggacggcgtggtgaagccaagctcccgggctgaccctgcccagacaagcgacactctggctctgaacaaccagatggttactcaaaacagaacccctcactccgtgtgtcaccagaagcctcaggctaagagcggttcatgggatctccaaacatactcagccgatcagaggacaacaggaaactgggagtcccataggaaaagccaggatatgaaaaaacgcaaatatgacccatcctag

SEQ ID NO: 25999 - DNA, 1026 bp, Artificial Sequence
  Description of Artificial Sequence: Synthetic coding sequence
atgttcggctacaacggctgggcccacagcatcacccagcagaacgtagatttcgtggatttgaataatgggaaattctatgttggggtttgcgcttttgtgcgagttcagttgaaagacggctcctatcatgaagacgtaggatacggggtgtccgaaggtcttaagtccaaggccctttctctggagaaagcccgaaaagaagctgtaacggacggtttgaaacgggctctgaggtcctttggcaatgcactgggtaattgtatcctggataaggattatctgagatcactcaacaagctcccacggcagctgcccctcgaggtggatctcacaaaggcaaaacgtcaagacctagaacccagcgttgaagaggctcggtacaacagttgtagaccaaacatggccctcggccatcctcagttacagcaggtcacaagcccatcccgcccttctcacgcggtcataccggcggatcaggattgcagttctcggtcactgtctagctccgccgtggagtcggaggccacacaccagcgaaagctgaggcagaaacagttgcagcagcaattcagggaaaggatggagaagcaacaggttcgcgtaagtactcccagtgccgaaaagagcgaggccgcccccccggctccccccgtcactcactcgacccccgtgacagtgagcgaaccgctactcgagaaagacttcctggcaggcgttacgcaagaactgattaagacgcttgaggacaattccgaaaagtgggcagtcaccccagatgccggcgacggggtggttaaaccatcttcacgggccgatcctgcccagacatcagatacccttgcgctcaataaccagatggtgactcagaaccggactccccattcagtctgtcatcagaaaccccaggccaagagcgggagctgggacctccagacctatagcgcggaccagcgcacaacaggaaactgggaaagccaccggaagtctcaggacatgaagaagagaaaatacgatcctagctag

SEQ ID NO: 26000 - DNA, 681 bp, Artificial Sequence
  Description of Artificial Sequence: Synthetic coding sequence
atgagcggcaccgaggaggccatcctgggcggccgggacagccaccctgcagccggtggagggtctgtcctgtgcttcggccagtgccagtacactgcagaggagtatcaagccatccagaaagccctgagacagcggctggggccagaatacatctcctcacgaatggccggtggaggccagaaggtctgctacatcgaggggcacagagtgattaacctggccaatgagatgttcgggtataacggctgggctcacagcattacccagcagaacgtggactttgtggatctgaataacggtaagttctatgtgggagtctgcgcctttgtgagggttcagctcaaggatgggtcataccacgaggacgtggggtacggagtgagcgaggggttgaaatctaaggcactctctctcgagaaggctagaaaagaggccgtgacagacgggctgaagcgcgctctgcggctgcctctcctgggggtcagcgggcggattttgtacagcctgttctccgtgcattctgtcatgtgtgccggcgggctccccaccccaactgcctctgctcagactgcaccctcttctccttgctcatctgctgtacttagatatgctcaagagttctgggaatgcacatggaagctgtatagcggacagcgattgcccgagataaccaagtag

SEQ ID NO: 26001 - DNA, 2244 bp, Artificial Sequence
  Description of Artificial Sequence: Synthetic coding sequence
atgcggcggagcctggcccccagccagctggccaagcggaagcccgagggaagatcttgtgacgacgaggactggcagccgggactcgtgactcctcgtaagcggaagtcctcgagcgaaacccagatccaagagtgttttctatctcccttcaggaagcccctctctcagttgaccaaccagcctccatgcttggattccagccagcacgaggcattcatcaggagcattctctctaaacctttcaaggtgcctatccccaactatcagggacctctgggcagtagggctctgggcctgaaaagggccggggtgcgccgggcactgcacgatcctctcgagaaagacgccttagtattgtacgagccgcctcccctcagcgcacacgaccaattgaagctagacaaagaaaaattgcctgttcacgtcgtggtagatccaatactctcaaaagtgctgcggcctcaccaacgcgagggagtgaagttcctttgggagtgcgtaactagtcggcggattccaggctcacatggctgtatcatggcggatgaaatgggcctgggaaagactttgcagtgtatcactttgatgtggactctgttaagacagagtcccgaatgcaaacctgaaattgacaaagccgtagtagttagcccgtcgtcgcttgtcaaaaattggtacaatgaggtggggaagtggctaggcggcaggatccagcctctggcaatagacggcggttcaaaggacgagatcgaccagaaactggagggattcatgaaccaacggggcgctagagtgtccagcccaatacttatcatctcatacgaaacattcaggctgcacgtgggcgtattgcagaaggggagcgtgggtctggtcatttgtgatgaggggcaccggctaaagaattccgaaaaccagacttaccaagctttagacagcctcaatacgtctcggagggtccttattagtggaaccccgatccaaaacgatctactggagtacttttctctagtccacttcgtgaactcaggcatcctgggcacagctcacgaatttaaaaagcatttcgagctgccaattctgaaaggccgggatgcagctgcctctgaggcggacaggcagcttggcgaggaacgactgagggagctcacatctattgtcaaccgctgcttgattcgtaggacaagcgacatcctgtctaagtatctcccagtgaaaatcgaacaggtggtgtgctgtcgactgacccctctacagaccgagctgtacaaaagattcctcaggcaggcaaaacctgcagaggagctcctcgaaggaaaaatgtctgtctcttccttatccagtattacctccctgaaaaagctgtgcaaccacccagcgctgatatatgataagtgtgtggaagaggaggacggatttgtgggcgccctcgatttgttcccacccggatatagctctaaggctctggagccgcagctgtcaggcaaaatgctggtgctggactatatcctggcggtgactaggtcccgctcttctgataaggtcgtgttagtcagcaactacactcagaccctggatttgttcgagaaactttgcagggccaggcggtacttgtatgtgagattagatgggactatgagtattaaaaaacgcgccaaagttgtggagcggtttaactccccctcctctcctgattttgtgttcatgctgagctctaaggccggcgggtgtgggctgaatctcataggagcaaatcggcttgttatgtttgatcccgattggaatcccgccaacgacgagcaggccatggcccgtgtgtggagggacggccagaaaaagacctgttacatttatagattactgtccgcgggcacgattgaggaaaagatcttccagcggcaatcccataaaaaggccctatccagttgcgttgtggatgaggagcaggacgttgaaaggcacttctccctcggggagctcaaagagcttttcatcttagacgaggcctcactttccgatacacatgaccgactccactgccggaggtgcgttaattcccggcagatccggcctccaccagacggctccgattgcaccagtgacctcgccggttggaaccactgtacagataagtggggactgagagatgaggtcctccaagctgcatgggatgcggccagtaccgcaatcacctttgtcttccatcaacggagccacgaagagcagagagggttaaggtag

SEQ ID NO: 26002 - DNA, 2244 bp, Artificial Sequence
  Description of Artificial Sequence: Synthetic coding sequence
atgcggcggagcctggcccccagccagctggccaagcggaagcccgagggcaggagctgcgacgatgaagattggcagcctggactcgtaacaccaagaaaaagaaagtcgagtagtgagacccaaattcaagaatgttttctgagcccctttcgcaaaccactatctcagctgaccaaccagcccccttgccttgacagcagccagcatgaagcgttcataagatcaatcttaagcaaaccatttaaggtaccaattcctaactaccagggtcccttaggctctagagctctgggattgaaacgcgcaggggttaggcgagcactgcacgaccctttggagaaagacgcgctcgttttgtatgaacctcctccactttcggcacatgaccagctgaaactggacaaggagaagctgccggttcacgtggttgtagaccccattttgtctaaggtgttaagaccgcatcagagggaaggagtaaagtttctgtgggagtgcgtgacgtcacgaaggattccaggaagccacgggtgcatcatggctgacgaaatggggctcggtaagactcttcagtgtattactttaatgtggacactgctacgccagagcccggagtgcaaacccgagatagataaggcagtggttgtcagccccagttccttggtgaaaaattggtataacgaggtgggaaaatggctgggagggcgcatacagcccttagccatcgacggaggttctaaggatgagattgatcagaaactggagggcttcatgaatcagagaggcgctcgcgttagttcgccgatcctgatcatttcctatgagaccttcagactccacgtaggggtactccagaagggcagcgttggactggtgatttgcgatgaaggacaccgattaaaaaactccgagaaccaaacataccaagcactcgactcactcaataccagtcgccgcgtactcatcagtggaacccccatccagaacgatctattagagtatttcagtttagtgcattttgtaaattcaggcattctagggactgcacacgaatttaagaaacacttcgaactccctatactcaaagggcgtgacgccgccgcaagcgaagcagatcgccagctaggagaagagaggctgagagagctgaccagtatcgtgaatcgctgtctgataagaaggacatctgatattctctccaagtacctgcccgtgaagatcgagcaggtcgtgtgttgcagacttacgcctctgcaaaccgagttatacaagagattcctccgacaggctaaacctgctgaagaactgcttgaggggaagatgagcgtgagctcattgtctagtattacttccctcaaaaaactgtgtaatcaccctgcattgatctatgacaagtgcgtcgaagaggaagacggcttcgtgggcgctttggacctatttccccctggttactctagtaaagcacttgagccccaattgtcgggcaagatgcttgtgctcgactatattctggccgtgacccgatctcgatcatccgataaagtggtgctcgtttccaactatactcaaactctggacctcttcgagaaactctgtagagccaggcggtacttgtacgtgcggctcgacggcacaatgtctatcaagaagcgcgctaaagtagtagagcggtttaactcaccttccagcccagatttcgtcttcatgctgtcttctaaagcagggggatgtggattaaacctaatcggggcgaacaggctggtaatgttcgatccagactggaaccctgctaacgacgaacaggcaatggcgagggtgtggcgcgacggccaaaaaaagacttgttacatctacaggcttttgtctgcaggtacaatagaagaaaaaatttttcagcgccagtcccacaaaaaagccctgtctagttgcgtggtcgacgaagagcaggatgttgagcgccatttctctcttggtgaactgaaggaactgttcattttagacgaagcgtccctgtccgacacgcacgatagacttcactgtaggcgctgcgtcaatagccgacagattcgcccacctccagacggctcagattgcacatccgacctggctgggtggaaccactgtactgacaagtggggtctgcgggatgaagttctgcaggccgcatgggacgctgcgagtactgctattacttttgttttccaccaaaggagccatgaggaacagaggggactccgctag

SEQ ID NO: 26003 - DNA, 1704 bp, Artificial Sequence
  Description of Artificial Sequence: Synthetic coding sequence
atggccgacgagatgggcctgggcaagaccctgcagtgcatcaccctcatgtggaccctgctgaggcagtcgcctgagtgcaagcctgaaatagataaagcagtggtggtatcaccctccagtctagtaaaaaactggtacaacgaggttggtaaatggctgggaggtcgcatccagccactggcaatcgacggtggttcaaaggatgaaatcgatcagaagctcgagggcttcatgaaccagagaggagctagggtgtctagtcctatcctgattatctcatacgagacttttcgcctgcacgtaggtgtgttgcagaaaggctcggtagggctggtcatctgtgatgaaggacatcgactcaaaaacagcgagaaccagacatatcaggctcttgacagcctcaataccagtagacgtgtgttgatcagtgggacccctattcagaacgacctcctggagtacttttccttagtacacttcgtaaatagtgggatcctcgggaccgcccatgagtttaagaaacatttcgagttgcctattctcaaaggcagggacgccgcggcctctgaggccgatagacagcttggcgaggagcgtctccgcgaactaactagtatagtgaaccgctgtctgattcgacgtacctctgatatcctgtccaagtatttgccagtcaaaatcgaacaggtggtctgttgtaggctcacacccctgcaaactgaactctacaaacggtttctgcgccaggcaaagccggctgaggaactgctggaaggaaagatgtccgtcagcagcctgtcctcaataacatccctgaagaagctgtgcaaccaccctgcactgatttatgataaatgtgtggaggaggaagacggatttgtgggggccttagacctctttccgcccgggtacagctccaaagccctggaaccccagctctctggcaagatgctggtgttagattacattctggcggtcacacggtctcgttcatcggacaaggtcgtgctggtttcaaactacacacaaaccctggacctctttgaaaaactgtgtcgcgctaggaggtatctttatgtgaggctggatgggacgatgtctataaaaaaaagggctaaggtggttgagcgctttaatagtccttctagcccagacttcgtcttcatgctctcatcaaaggcgggaggatgcggactgaacctgataggtgccaataggctcgtgatgttcgacccggattggaacccagcaaatgatgagcaggccatggcgcgcgtgtggagagacggccagaaaaaaacctgttacatctatcggctgctgagcgctggcaccatcgaagagaagatctttcaaaggcagtctcacaagaaagccttaagctcttgtgtcgtggacgaagaacaggacgtagagcgccatttttctctgggcgagttaaaggagctctttatcctcgacgaagccagcctgagcgatacacacgaccgccttcattgcagacgatgtgtgaattctcggcagatcaggccaccccccgatggctcagattgcacctccgatttggcagggtggaatcattgcacggacaagtggggattgcgagatgaggtcctgcaggctgcctgggacgccgccagcaccgccatcacatttgtgttccatcagcgcagtcacgaggagcagagaggccttagatag

SEQ ID NO: 26004 - DNA, 1176 bp, Artificial Sequence
  Description of Artificial Sequence: Synthetic coding sequence
atgaagtgcctggtgaccggcggcaacgtgaaggtgctgggcaaggcagtgcattcactcagccgcattggagacgagctgtatctcgagcccctcgaagacggcctgtctcttcgaacagtcaactcaagccgaagcgcctacgcgtgctttttgttcgcccctctgttctttcagcagtaccaggccgccaccccaggacaggacctgctgcggtgtaaaattctaatgaagagctttctctctgtctttcggtccctggcgatgctggaaaagactgtcgaaaagtgttgcatctctctaaatggccgctcatctaggctcgttgtccagctgcactgtaaattcggtgtccggaagacacataacctgagcttccaagattgcgaatcactacaagctgtgttcgatccagctagctgccctcacatgctcagggccccagccagagtgctcggcgaagccgtcctccctttcagtccagccctggcagaggtcactctgggaatagggagaggacgtcgagttatcctgaggtcatatcatgaagaagaggccgattcaaccgctaaagccatggtcacagagatgtgtttgggagaggaagacttccaacaacttcaggcacaggagggtgtggcaatcactttttgcctgaaagagtttagaggtctcctgtctttcgcggagtcagctaatctgaacttatctattcacttcgacgcccctggcagaccagctatattcacaatcaaagacagtctcctagacggtcacttcgtgctagccactctgtctgacaccgattcccactctcaggatctgggctcccctgagcgtcatcagcccgtgccccagctccaggcccactccacaccccacccagatgactttgcaaacgacgatatcgactcatatatgattgctatggaaaccaccatcgggaatgaagggtcgcgagtgttaccttccatcagtctgtctccaggacctcagcctcctaaatctcccgggcctcatagcgaggaggaagatgaggccgagccttccaccgtgcccggaactccgccccctaagaaattcaggagcttattttttgggagtatcctggcccctgttcgttccccccagggcccatccccggtgctcgcagaagatagcgagggcgagggctag

SEQ ID NO: 26005 - DNA, 1752 bp, Artificial Sequence
  Description of Artificial Sequence: Synthetic coding sequence
atgcccaagcccatcaacgtgcgggtgaccaccatggacgccgagctcgaatttgccatacagcctaataccacggggaaacaactgttcgatcaggtcgtgaaaactgtgggcttaagagaagtgtggttctttggcttacagtacgtggatagtaaagggtactccacctggctgaagctaaacaaaaaggtgacgcagcaagacgtcaaaaaggaaaaccccttacaattcaaatttagagccaaattctttccagaagatgtgagcgaagaattaatccaggagataacacagcgcctgttcttcctgcaggtcaaggaggcgatactgaacgacgaaatctactgccccccagaaacagccgtgctgctggcttcttacgctgtgcaggccaagtacggcgattacaacaaagagattcataagcccggctacctcgccaacgacaggcttctgccccagcgggtgctggagcagcacaagctgaccaaggaacagtgggaggagagaatccagaactggcacgaggagcatcgtggtatgctcagagaggactctatgatggagtatctgaagatcgctcaggatctagaaatgtacggtgtgaattattttgaaatcaaaaataaaaaagggaccgagctgtggctgggcgtggatgctctgggcctgaacatatatgaacacgacgacaagttgactccgaaaatcggattcccgtggtcggaaattcggaatatctcctttaatgataaaaagtttgtcatcaagcccatcgataagaaggcccctgactttgtgttttatgcgccccgccttcgtatcaacaaacgcatcctcgccctttgcatgggtaaccacgagttatacatgcggcgtaggaaacccgataccatagaagtgcagcagatgaaggcccaggcccgtgaggaaaagcatcagaagcagctggagagagcacagctagaaaacgaaaagaaaaaaagagaaattgcagaaaaggaaaaagaaagaatcgaacgcgagaaagaagaactgatggagcgcctcaaacagatagaggagcaaacaataaaagcacagaaggaattagaagagcagacccgaaaagccctggagctcgaccaggagaggaagagagctaaagaggaggctgaacgactggaaaaggagagacgtgctgccgaggaggcaaagagcgcgatcgccaagcaagcggcggatcagatgaaaaaccaagagcagctcgccgcggagctcgccgagttcaccgctaagatagccttgctcgaagaagcaaaaaagaaaaaagaagaagaagccactgaatggcagcataaggcgttcgccgctcaggaagacctggaaaagaccaaagaggaactgaagaccgtaatgtctgcaccaccccctcccccaccgccccctgtcatcccgcctaccgagaatgagcatgacgaacacgacgagaacaacgccgaggcatcggcggaactgtccaatgagggtgtaatgaaccatagatctgaagaggaacgtgtgaccgagacccagaagaacgaaagggttaagaagcagctgcaggccctgtcttccgaactggcccaggcccgagacgagactaaaaagacgcagaatgatgtattgcacgccgaaaacgtgaaagcaggacgcgacaagtacaagaccttgcgacagatcaggcagggaaataccaaacagaggattgatgagtttgaggccatgtag

SEQ ID NO: 26006 - DNA, 1815 bp, Artificial Sequence
  Description of Artificial Sequence: Synthetic coding sequence
atgcccaagcccatcaacgtgcgggtgaccaccatggacgccgagctggaattcgccatccagcctaacaccactggaaagcagctgtttgaccaagttgttaaaacagtggggctcagggaggtgtggttcttcggcttacagtacgtggacagcaagggctattcaacttggcttaaacttaacaagaaagtgactcaacaggacgtgaagaaagagaaccctctgcaattcaagtttagggcaaagttcttccctgaggacgtcagtgaggaacttatacaggaaatcacccagcgtctcttttttctgcaggttaaggaagccattcttaacgacgaaatctactgcccccccgaaaccgcagtgctgttggcgtcctacgcggtgcaggccaagtatggagattacaacaaagagatccataaacctggctacctggccaatgatcgcctgctgccccagcgtgtcctggagcagcacaagctgactaaggagcagtgggaagagaggattcaaaactggcacgaagaacacaggggcatgctgagagaggattccatgatggaatatttaaaaatcgcgcaggatctggagatgtacggagtgaactatttcgagatcaaaaacaagaaaggcacagaactctggctcggcgtcgacgctctcgggctgaacatctatgaacatgacgacaagctgacgcctaaaatcggcttcccctggtcagagattagaaatatttcctttaatgataagaaattcgtgatcaagcccatcgacaagaaggcacccgatttcgtgttttacgccccacgactgcgcataaataagcgcatcttggccttgtgcatggggaaccacgagctttacatgcggcgccgcaagcctgacacaatcgaggtgcaacagatgaaagcacaggctcgggaggagaagcaccagaagcaactagagcgcgcgcagcttgagaacgagaaaaagaagagagagatcgccgagaaagagaaagagcgcattgaaagggagaaggaggagcttatggaaaggctcaagcagatcgaggaacagaccattaaagcccagaaagagctcgaagaacagacccgaaaggccctggagctggatcaagaacgaaagagggcaaaagaggaagctgaaaggttggaaaaggaacggcgagcggcggaagaagctaaatcagcgattgcaaaacaggccgcagatcagatgaaaaatcaggagcagctcgccgcagaactggctgaattcacggctaagatcgctctgctggaagaagctaagaagaaaaaagaggaggaagccactgaatggcagcataaggcatttgctgcccaggaggacctagaaaaaaccaaagaagagctcaaaacagtgatgtcagccccacctccaccgcctcccccccctgtgatcccacctacggaaaacgagcacgatgagcacgacgagaataatgccgaggcttcagccgagctgagcaatgagggcgtaatgaatcaccggagtgaagaggagcgcgtgacggaaacacagaagaacgaacgagtgaagaagcaactgcaggctctttctagtgaactggcccaggcacgggacgaaacgaagaaaacccagaacgatgtgctgcatgcagagaatgtcaaagccgggcgggacaagtataagacgttgcgtcaaattcggcaaggcaatactaagcagagaattgacgagttcgaagctatgtggggcccaaaactgtatgccttgtttcagatgagatcgtgccagagctcgattaagcagatgtag

SEQ ID NO: 26007 - DNA, 1020 bp, Artificial Sequence
  Description of Artificial Sequence: Synthetic coding sequence
ccccaccccaagatcaacgtgcgggtgaccaccatggacgccgagctggaattcgccatccagcctaacactactggtaagcaactgttcgaccaggtcgtgaagaccgtgggacttagggaagtctggttctttggcttacaatacgtcgatagtaaggggtatagcacatggctgaagttgaacaaaaaggtaacgcagcaggatgtgaagaaagagaacccgttgcaattcaaatttcgggccaaattctttccagaagacgtgtccgaggagctgatccaggagatcacccagaggctgttcttccttcaggtgaaagaggccattctgaacgatgagatatattgccctcctgaaactgccgttttgctcgcttcatatgccgtccaggctaagtatggggactataataaagaaattcataaacccgggtatctagcaaatgataggctactcccacagagggtactcgagcaacacaaactgaccaaagagcagtgggaggaacgcatccagaattggcacgaagaacaccggggcatgctcagagaggattcaatgatggaatatttgaaaatagctcaggacctggagatgtacggggtgaactactttgagattaagaacaaaaagggaactgagctgtggttgggagtggatgcacttggcctgaatatctatgagcacgatgacaaattaaccccaaaaatcgggtttccttggagcgagattcggaatattagctttaatgacaagaagtttgtgatcaaacctatcgataaaaaagctccagatttcgtgttctacgctccacgcctccgcattaacaaaaggattctggctctctgtatggggaatcacgaattgtatatgagacggcggaagccagacactatcgaagttcagcaaatgaaggctcaggcacgggaagagaaacatcagaagcagctggagagatcccgcctaagcaagattaagaagaagaagcgaaaaaaaaagaaaaagaaaaagaagtag

SEQ ID NO: 26008 - DNA, 1815 bp, Artificial Sequence
  Description of Artificial Sequence: Synthetic coding sequence
atgcccaagcccatcaacgtgcgggtgaccaccatggacgccgagctagaattcgctattcagccaaacacgacaggcaaacagctgttcgaccaggttgtgaaaacagtgggtctcagggaagtgtggtttttcgggctccaatacgtggactccaaaggatattctacttggctaaaattaaacaagaaggtaacacagcaggatgtgaaaaaggagaatcccctccaattcaagtttcgtgcgaaattcttcccagaggacgtgtccgaggagctgatccaggaaatcacccaacgtttgtttttccttcaagtcaaagaggctatcttaaatgacgagatctactgtcctccggaaactgcagttctgctggccagttacgcagtccaggccaagtacggagactacaataaagaaatccataagccaggctacctagccaacgataggctgctcccccagagggtgctggagcaacataaactgacaaaggaacaatgggaggaacgtattcaaaactggcatgaagagcacagaggcatgctgagggaggatagcatgatggaatatttgaagattgctcaagatcttgaaatgtacggcgtgaattattttgaaattaaaaacaagaaaggcactgaactttggcttggggtggatgccttggggcttaacatctacgagcatgatgataagcttactcctaaaattggcttcccatggagcgaaatccgcaacatttcatttaacgataaaaaattcgtcataaagccaatcgataagaaagctccagatttcgtgttttacgcaccacgccttaggattaataaaaggatattggcactgtgcatggggaaccacgagctgtatatgcgcagacggaagccagataccattgaggtgcagcaaatgaaggctcaagctagagaagagaagcaccagaaacagttggagcgggctcaactggagaacgagaagaagaagagggagatcgccgaaaaagaaaaggagaggattgaaagggaaaaagaagaactcatggaaagactgaagcaaatcgaggagcagactataaaagctcagaaggaactggaggaacaaacccggaaggcccttgagctggatcaagagcgtaagcgcgccaaggaagaggccgagcggctggaaaaggagagaagggccgcagaggaggcaaagagcgccattgctaagcaggccgctgaccaaatgaaaaatcaagaacagctagccgccgaactggcagagttcaccgcgaaaatcgccctattggaggaagctaagaaaaagaaggaagaagaagccacagagtggcagcataaagcatttgcagcccaagaagatttggagaagaccaaagaggaactgaagactgttatgagtgcgccccctcccccgcccccgccaccagtcattcctcctacagaaaacgagcacgatgagcacgatgagaacaatgccgaagcctcagctgagctaagtaatgaaggagtcatgaaccaccggtccgaggaagagagagtgaccgaaactcaaaagaacgagcgcgtaaagaagcagctgcaggccctgtcctccgagctcgcccaggcccgtgacgagactaaaaaaacccagaatgatgtgctgcacgctgagaacgtgaaggctgggcgggataagtacaaaactcttcggcagattagacagggcaacactaaacagaggatagacgagttcgaggccatgtgggggcctaaactatatgctctgtttcagatgcggagttgtcaaagcagtataaagcagatgtag

SEQ ID NO: 26009 - DNA, 774 bp, Artificial Sequence
  Description of Artificial Sequence: Synthetic coding sequence
atggagcggctgaagcagatcgaggagcagaccatcaaggcccagaaagaactggaagagcagacccgcaaagcgctggagttggatcaggagagaaagagagccaaggaagaagctgaaaggcttgagaaggagagacgggcagccgaggaggccaagtcagccatcgcgaaacaggcagccgaccagatgaaaaaccaggagcagctcgccgctgagctggccgaattcacggccaaaattgctctactggaagaagctaaaaagaaaaaggaggaagaagccactgagtggcagcacaaagcatttgccgcccaggaggatcttgagaaaacgaaggaagaactgaagactgtgatgtctgctccccccccaccaccaccccctcctgtaataccaccgacagagaacgagcatgacgagcacgacgaaaataacgccgaagcatcggccgaactgagcaatgagggggtgatgaaccacagatccgaggaagagagggtgacagagacgcagaaaaatgagagggtgaaaaagcagttgcaggccctttcttctgaactagcccaggctagagatgagaccaaaaaaacccagaacgacgtattacatgctgagaatgtgaaggcgggtcgtgacaagtataaaacacttcgtcagatccgacagggaaatacaaaacagagaattgacgagttcgaggcaatgtggggcccgaagctctacgcactgttccagatgcggtcgtgccaatcctcaatcaagcagatgtag

SEQ ID NO: 26010 - DNA, 762 bp, Artificial Sequence
  Description of Artificial Sequence: Synthetic coding sequence
ggcggccggatcgcccgggcccacgagttcgaggccgccgtgagcttctgtacgtccgcttgggctacagagagagatcctgtgtcgcgaaagcagagagagctagaggaacagacacgcaaagcgctcgagctggaccaagaacggaaacgtgccaaggaggaggccgagcgactggagaaagagaggcgggctgcggaggaggccaaatccgccatcgccaaacaggcagcagaccagatgaagaaccaggagcagctggcggccgagttggctgaatttaccgcaaagatcgccctccttgaggaggcaaagaaaaagaaggaagaggaagccacagagtggcaacacaaggctttcgccgcccaggaggacttggaaaagaccaaagaggagcttaagaccgtaatgagcgcgccacccccgccccctcctcccccagtcataccacccaccgaaaatgaacatgacgaacatgatgaaaacaacgcggaggctagtgccgagctgagtaatgaaggagtgatgaatcataggagcgaggaagagagggttacagagacacaaaaaaacgagagggtcaagaagcagctgcaggctttatcctcggagcttgcacaagctcgcgacgagaccaagaaaactcagaatgacgtactccacgctgagaacgtgaaggcaggcagagataagtacaagaccctgagacagatacggcagggaaatacaaagcagcgaatcgacgaatttgaggcaatgtag

SEQ ID NO: 26011 - DNA, 603 bp, Artificial Sequence
  Description of Artificial Sequence: Synthetic coding sequence
atgcccaagcccatcaacgtgcgggtgaccaccatggacgccgagctagagtttgccatccaacccaatacaaccggcaagcagctgttcgaccaggtcacacagcaggacgtgaagaaggaaaacccactgcagttcaagtttagagctaagtttttcccagaagacgtgtctgaagagctcatccaggagatcacccagaggcttttttttttgcaggtcaaagaggcgatcttgaacgacgagatctactgccctcctgagacggcagtgctgttggcctcttatgccgtgcaggccaaatacggtgattataataaggagatacataagcccggctatctagcgaacgaccgattgctcccccaacgagttcttgagcagcataagctgaccaaggaacaggatgaaacgaaaaaaacccaaaatgacgtgctgcatgctgaaaacgtgaaagcgggtcgcgacaaatacaagactttgcggcaaatccgccaggggaacaccaaacagaggatcgatgagttcgaggctatgtggggccctaagctgtacgctttgtttcagatgcgaagttgccagtcaagcatcaaacagatgtag

SEQ ID NO: 26012 - DNA, 1815 bp, Artificial Sequence
  Description of Artificial Sequence: Synthetic coding sequence
atgcccaagcccatcaacgtgcgggtgaccaccatggacgccgagctcgaattcgccatacaaccaaatacgaccggcaagcagctgttcgaccaggtagtgaagactgtgggcctgcgcgaagtttggtttttcggcctgcagtacgttgattcgaaaggatatagcacttggttgaagctcaacaaaaaggtcactcagcaagacgtcaagaaagagaatcccctgcagtttaagttccgcgccaaattttttcctgaggatgtatctgaagagttgattcaggaaataactcagcgtctgttctttttgcaggtgaaagaggcaatactgaacgatgagatctactgtcccccagagactgcagtgctgctcgctagttatgctgtgcaagccaagtatggagactacaacaaggagattcataaaccaggttaccttgcaaacgaccgcctgctccctcagagagtcctcgaacaacacaagctcactaaagaacagtgggaggagcgcatccagaattggcacgaagagcataggggcatgctgcgggaggattctatgatggaatatctgaaaatcgcgcaggacctcgagatgtatggggtgaattactttgagatcaaaaataaaaagggcacggaactctggttgggagtcgacgctctgggccttaatatttatgaacacgacgataagcttacaccgaaaattggcttcccatggagtgagatcagaaacatcagcttcaatgacaaaaaattcgtgattaaaccaattgacaagaaggcgcctgacttcgttttctatgcccccagacttaggatcaataaacgcatactcgccttgtgcatggggaaccacgagttgtacatgaggcgacgcaagccagataccattgaagttcagcagatgaaagctcaggctagggaggagaagcatcagaagcagctcgaaagagctcagcttgagaatgaaaagaagaaacgcgagattgcagagaaggagaaggagaggatcgaacgggaaaaggaggaactcatggaaaggttgaagcagattgaggagcaaacaatcaaagcccagaaggagctcgaggagcaaaccagaaaagctctcgaactggaccaggagagaaaacgagctaaggaggaagcggagcgcttggaaaaagaaaggagagctgctgaagaggctaaatctgcaatcgctaagcaggctgctgatcagatgaagaaccaggagcagttagctgctgagctcgccgagttcactgccaaaattgccctgcttgaggaggctaagaaaaagaaagaagaggaggctacagaatggcaacacaaggcgttcgcagcccaggaggacttagaaaaaactaaggaggagctgaaaacagtcatgagtgccccacctcccccgccaccaccacctgttatcccccctactgaaaacgaacatgacgagcacgacgaaaataacgctgaagcttccgccgaactttcaaatgaaggcgtgatgaaccatcgttcagaagaggagagagttaccgaaactcagaaaaatgagcgcgtgaagaaacagctgcaggcgttatccagtgagctcgcgcaggcacgtgatgagacaaagaagactcagaatgacgtcctgcacgccgagaatgtcaaggcggggcgggataaatacaaaacactgagacagatcaggcaaggcaataccaaacaaagaatcgatgaatttgaggctatgtggggtcctaagttgtatgctctgttccaaatgcgctcatgccaatctagcatcaagcagatgtag

SEQ ID NO: 26013 - DNA, 1344 bp, Artificial Sequence
  Description of Artificial Sequence: Synthetic coding sequence
atgctgagctggaacctgcccttcagccccatccagctggccaacaacttcctgacaagcgttctggagcagcacaaactaactaaggaacagtgggaagaacggattcagaattggcatgaagaacatcggggtatgctgcgtgaagatagtatgatggagtatctgaagattgctcaagatttagagatgtatggagtaaattacttcgaaatcaaaaataagaagggtaccgaactgtggttgggagtcgacgctctgggcctaaatatttacgagcatgatgacaaactcacccctaaaatagggttcccctggagcgaaattcgcaacatttcttttaacgacaagaaatttgtcatcaagcccatcgacaagaaagccccagatttcgtgttttacgccccgaggctgagaattaacaagcggattttggccttgtgtatggggaaccacgaactttacatgagaagaaggaagccagacacaatagaggtccaacagatgaaagcacaggcaagagaggagaaacaccaaaagcagctggagagagcccagctggagaatgagaagaagaaaagggaaatagccgaaaaagaaaaagagagaattgagagagagaaagaggaacttatggagaggctcaagcagatcgaggagcagactatcaaagcccaaaaagagttggaagagcagactcggaaggccttggagcttgatcaggaaagaaaacgagccaaggaggaggcagaacgcttggagaaggagagaagggccgctgaggaagcgaaatcggccattgccaagcaggccgccgaccagatgaaaaaccaagaacagttggctgcggagcttgctgaattcacggctaagatagctctgctcgaagaagcaaaaaagaagaaggaggaggaggctaccgagtggcagcacaaggccttcgccgcacaagaagatctggaaaagaccaaggaagaactaaagaccgtgatgtcagctcctcccccccccccacccccaccagtgatcccacctacagagaacgagcacgatgagcatgatgagaacaacgcagaagcatccgccgagctgagtaatgagggcgtgatgaatcatagatctgaggaggagagagtcacagagactcagaaaaacgaacgagtgaaaaaacaactgcaggctctctctagtgaattagctcaggcgcgagacgagacgaagaaaacacagaatgacgtgttgcacgccgaaaatgtgaaggctggacgggacaagtataagacactgagacagattcggcaaggcaacacgaagcagcgcatcgatgaattcgaggccatgtag

SEQ ID NO: 26014 - DNA, 3234 bp, Artificial Sequence
  Description of Artificial Sequence: Synthetic coding sequence
atggacaccgacagccagcggagccacctgagcagcttcaccatgaaattgatggataagttccacagtccaaagatcaaaagaacaccatccaaaaaaggaaaacccgcggaagtgagcgtcaagatccccgaaaaacctgtcaataaggaggctactgacagatttctccccgaagggtatcccctgcccctcgatttggagcagcaggctgtcgagttcatgagcacctctgcggttgcttcacggagtcagagacaaaagaacttgtcttggctcgaagagaaagaaaaggaggtcgtgtccgccctgcggtatttcaaaaccatcgtggacaagatggctatagacaaaaaggtgctggaaatgctgcccggctcggcgtctaaggtcctggaggctatcttgcccctggtgcagaacgatccgcgaattcagcacagctctgctctgtcctcttgctattcccgcgtctatcaatccttggcaaatctcatacgatggtctgaccaggtgatgttagaaggcgtgaactcagaggacaaggagatggtgacaacagtgaagggcgtaattaaggctgtgctcgatggagtcaaagagcttgtccgcctcactattgaaaaacaggggaggccctctccaaccagcccagtgaagccctcttcaccggcatctaaaccagacggaccagccgagctgcctctcacagaccgcgaggtggagatcttgaacaaaacaacaggcatgagccagtccacggagctacttccggatgccactgacgaggaagtggcccccccaaagccccctctcccaggaattcgcgtggtagacaactcccctccacccgcactgccgccgaagaaaagacaaagcgcgccctcccctacccgggtggccgttgtggccccaatgtcccgggctaccagcggctcttctctgcctgtcgggattaataggcaagactttgatgtcgactgttacgcccaacgcaggttaagcggaggttcgcattcatatggtggggaatccccacggctcagtccctgcagtagtatcgggaagctaagcaaaagcgatgaacagctttcctcattggacagagattctggacagtgctctcgcaataccagttgtgaaacactcgatcattacgacccagactacgagttcctccaacaggatttgagcaatgccgaccagattccgcagcagactgcatggaatctgtctccccttcctgagtccctcggagagagtggctccccatttcttgggcctccatttcagctgccccttgggggccaccctcagcccgacggtccactggcccctggacagcagactgatactcctccagcgttgcccgagaaaaaacgaaggtccgccgcctcgcagacggctgatggctccggttgccgggtgtcttatgagcggcatccgagccaatacgacaacatttcaggcgaggaccttcagagcactgctcccatcccaagcgtgccctacgccccattcgccgcaattctccctttccaacacggtggaagctccgctccagttgagtttgttggcgattttactgcacctgagtctaccggggaccccgaaaagccgcccccactgccagagaagaagaacaagcatatgctcgcatatatgcagttactggaggactactccgagccacagccttctatgttttaccagacccctcagaacgaacacatctaccaacagaagaacaaactccttatggaggtatacggcttctccgacagctttagtggtgtggactcagtgcaagagctggctccgcctcccgccttgccaccaaagcaacgacagctggagccacctgcggggaaggatggacatcctagagatccctccgcagtctctggagtgcccggcaaggacagcagggatggctcagaaagggcacccaaatccccggatgctttggaaagtgctcagtccgaggaagaagtggatgagctctcattgattgaccacaatgaaataatgtcacgcctcaccttaaagcaggaaggcgacgacgggcccgacgtgaggggcggctcaggcgatatcctgctggttcatgctaccgagaccgaccgcaaggacctagtgttgtactgcgaggcattcctcactacctataggacattcatttcacctgaagagctgatcaagaaacttcagtatcgttacgaaaaattctctcctttcgctgatacattcaagaagcgcgtttccaagaacactttctttgtcctggtgcgagtggttgatgagctgtgcctagtagaactcacagaggaaatccttaaactcctgatggaacttgtctttagacttgtttgcaacggagaactctctcttgcgagggtcttgcgtaaaaacattcttgacaaggtagatcagaagaagttattgcgttgcgccaccagctctcagccccttgccgctaggggagttgcagctcgacctggcactctgcacgactttcactcccacgagatcgcagaacaactgaccctcctggatgctgagttgttctacaagatcgagataccagaagtcctcctgtgggctaaggaacagaatgaggaaaaaagccctaatctcacccagttcacggagcattttaataatatgagctactgggttcgaagtataatcatgcttcaggagaaagctcaagacagggaacgccttttactgaagttcatcaagatcatgaagcacttacgcaagctcaacaacttcaattcttacctggccatacttagcgccctggattccgctcccatcagacgcctcgagtggcaaaagcagacaagtgaaggcctggcggaatattgcacactcatagacagtagttcaagcttccgcgcttatcgtgcagccttgagtgaagtggagccaccctgcattccatatctgggccttattctgcaagacctgacctttgttcatctgggaaaccccgactatatcgacggaaaagttaactttagtaagcgctggcaacaattcaatatcctggacagcatgcggtgctttcagcaagcccactatgacatgcggcgcaacgatgacatcatcaatttttttaatgatttcagcgaccacctagctgaagaagccctctgggagctgtcgcttaaaatcaagcccagaaatattacacgaagaaagaccgatcgcgaggagaaaacctag

SEQ ID NO: 26015 - DNA, 3168 bp, Artificial Sequence
  Description of Artificial Sequence: Synthetic coding sequence
atgagcaccagcgccgtggccagccggagccagcggcagaagaacctctcgtggcttgaagaaaaagagaaggaggttgtgagcgccctgcggtactttaaaacaatcgttgataaaatggccatagataagaaagtcctcgagatgcttcctggctcagcatctaaggtcctagaagccattctgccactggtccagaatgaccctcgaatccagcactcctcagcgctgagcagttgctactccagagtatatcagtctctggcaaatctgatccgttggtctgaccaagtcatgctggaaggggtcaactcagaggacaaagagatggtgaccacagtgaagggagtgatcaaggcggtgcttgacggggtgaaggagctggtgcgtcttacaatcgagaagcagggcagacctagtcctacctccccagttaaaccctcctcaccggctagtaagcctgacggcccagccgagttgcccctcaccgatcgtgaggtagaaattctgaataaaacgactgggatgtcccaatccacggaattgttgcctgacgccacagacgaggaggtcgccccaccaaaaccaccactccctggtataagggttgtggacaacagtccgccgccagctcttcctccgaaaaagcgccagagcgcaccttctcccacccgagtggcagtggtggccccaatgagtagagctacatcaggatcaagtctgccagtgggcattaacaggcaagactttgatgttgactgttatgcccagcgccggctcagtggagggtctcactcttatggaggggaaagccctcggctgtcaccatgttcaagtatcggcaaactaagtaagagcgatgagcagctcagctccctggatagggattctggccagtgctccaggaatacaagctgtgagactctggaccattatgacccagattatgaattcctgcagcaggacttgtctaacgccgatcagatcccccagcagaccgcctggaacctgtccccactgcctgagtcactaggggaaagtggatctccattcttgggaccacccttccaattgccacttggaggccatccccagccggacggcccactggcccctggccaacagaccgacacccctccagccctccctgagaaaaaacgccgtagcgctgccagccaaacagcggatggatccggctgccgcgtgagctatgagcggcacccttcccaatatgataatatttcaggagaagatctacaaagcacagctccaataccatctgtgccctacgctcccttcgccgccattctgcccttccaacacggtggatcttctgctccagttgaatttgtgggcgactttaccgcacctgagtcaactggagaccctgagaagccgccccccctgccagagaaaaaaaataagcacatgttagcctatatgcaactgcttgaagactattctgaaccccagccatcaatgttttaccagaccccacagaatgagcacatataccagcagaagaacaagctgctcatggaggtgtacgggtttagtgactcttttagcggcgttgactcagtacaggagcttgctccccctccagcactacctccaaagcagcggcagttagcctcatgtgcagcctcctccttctcaagcgtatctcactgcgtgcagcagacaaaagtggccttcactcctgaggatgggtctgcggcccagggcctgtccgtgagcgtgtctaacagttttctgtcccggcacgggagccttcctgtaccttctgaacctcccgcaggtaaagacgggcatccacgcgaccccagtgccgtgagcggcgttcctggtaaggactcgcgagacggcagcgagcgcgctcccaagtctcccgatgcacttgagagtgctcaatctgaggaggaggtcgacgagctgtccctgatcgatcataacgaaatcatgtcaaggcttacgctcaaacaggaaggagacgatggtccagatgtgcgcggggggtcgggagacatcctgttggtacatgcaaccgaaacagacagaaaggacctggttttgtactgcgaagccttccttaccacataccgcacttttattagccccgaggagctgattaaaaagttgcagtatagatatgagaagttcagtcccttcgcggacacattcaagaagcgcgtgagtaaaaacacgttcttcgtactggtccgcgtggttgacgaactttgcctggtcgagttgactgaagagatactcaagctgttgatggagctggttttcagactggtgtgtaacggcgagctttccttggcccgcgtgctcaggaagaatattctggacaaagttgatcagaaaaaactgctgcggtgtgctacctcaagccagccgttggctgcccggggagtggcagcaaggccaggtaccctccatgattttcattctcacgagattgcagagcaactgacccttttggatgcagagttgttttacaaaatcgaaatcccagaggtactgctgtgggctaaagaacagaatgaggaaaaatccccgaatctcacccagttcactgaacacttcaataatatgagctactgggtcagaagcataatcatgcttcaggaaaaagcgcaggatagagagcgactgctcctgaaattcattaagattatgaagcatctgagaaagcttaacaactttaatagctatcttgctatattgagtgcattagacagtgctcccattagacggttggagtggcaaaagcagactagtgaaggtttggctgagtattgtaccttgatcgactccagcagctcattccgtgcatatagggccgctctaagcgaagttgagccaccttgcatcccttatttgggacttatccttcaggacctgactttcgttcatcttgggaatcctgactacattgacggcaaagtgaactttagcaagaggtggcaacagttcaatattctggattctatgcggtgctttcagcaggcacattacgatatgagacgcaatgatgatatcatcaacttctttaatgatttctcggaccacctcgcagaggaggcactgtgggagttgagcttgaaaatcaagccgcgaaacattacacggagaaaaacagacagagaagagaagacgtag

SEQ ID NO: 26016 - DNA, 3285 bp, Artificial Sequence
  Description of Artificial Sequence: Synthetic coding sequence
atgagcggcggcctgggcctgcggcggagccccgagatgagcggcaagattgaaaaagcggacagccagaggtcccacttgtctagctttactatgaagctgatggacaaatttcactccccaaaaattaaacgtactcccagcaagaagggcaagcccgcagaggtctccgtcaagatcccagaaaaacctgtcaacaaggaggcgacagatcggttcctgcccgaaggataccccctacccctggacctggaacaacaggctgtcgagttcatgagcactagtgcagtggcgagccgctcgcaaaggcagaagaacctgtcatggctagaggagaaggagaaagaagttgtgagtgcactgcgctattttaaaactatcgtcgataaaatggccatcgacaagaaagtgctcgagatgctccctggatccgccagtaaagtgctggaggctatacttccactggtgcagaatgatccaaggattcaacatagttctgcactctcgtcgtgttacagtagagtttaccagagcctggctaacctgatcaggtggagcgaccaagtcatgctagaaggtgtgaattcagaagataaggaaatggtgacgactgtgaagggtgttattaaagccgtcctggatggggtgaaggaactggtgcgcctgaccatcgagaaacaggggcgcccctcacccacgtctccagtgaaaccatcctcgcccgcgtctaaacctgacggacccgcagaactaccactcacagatagagaggtggaaatcctgaacaagaccactggtatgagccaaagcactgagctactgcctgacgcgaccgatgaagaggttgccccccctaagcctcctttgccaggtatacgtgttgtagacaacagtccccctccagcactgccaccgaaaaagcgccagtctgcaccaagtcccacacgtgttgccgtggtcgcacccatgtctcgcgcgacatctggcagcagcctccctgtgggcattaaccgccaggactttgacgtggattgttatgcccagaggagattgtcagggggttcacactcatatggaggtgaatctcctagactgagtccctgcagttcaataggaaagttgtctaaaagcgacgaacagctgtcctccctagacagggacagcggtcagtgcagccgcaatacctcctgcgaaacactcgatcattacgatcccgattatgagtttctgcagcaagatctgtctaacgccgaccagatcccacagcagaccgcctggaatcttagcccattacctgagagcctgggcgaatccggcagccccttcctggggcctccttttcagctaccacttggcggccacccccagccagatggacccttagctcccggccagcaaactgacacacccccagcgctgcccgagaaaaaacggcggtcagcagcaagccaaaccgccgacggaagcggctgtcgggtgtcatatgagagacacccctcccaatacgacaatatctctggagaggatcttcagtcaactgcccccattccttccgtgccctatgccccttttgctgccatactacccttccaacacggagggagctcagccccggttgagttcgtcggcgactttaccgctcccgaatctacaggagatcccgaaaaacctccccccctgcccgaaaaaaaaaacaagcacatgctagcttacatgcagctgctcgaggattatagcgagccacagcctagcatgttttaccagacgccccagaatgagcatatataccagcaaaagaacaaactcttaatggaggtctacggcttttctgactccttttctggcgtcgatagcgtgcaggagctggcgccacccccagctctgccaccaaagcagaggcaactggaaccccctgctgggaaggacggacatccgcgcgatccaagtgccgtgagcggcgtccctggtaaagactcaagagacggctccgagcgggcccctaagagtccagacgctctggaatcagctcagtctgaggaagaggtggacgagctcagcctgatcgaccacaacgaaatcatgagccgactgaccctcaaacaggagggagatgacgggcctgacgtccggggaggaagcggagacattctactcgtccacgccactgaaacagataggaaagacttagtcctctactgtgaagcctttctcaccacgtacagaacgttcatttcccctgaagagctgatcaaaaaacttcaatacagatacgaaaagttttccccgtttgctgatacctttaaaaaacgagtgtccaagaatactttcttcgttctggtgcgcgtcgtggatgagctttgtctggttgaactgacggaagagatcctgaagcttctgatggagcttgtgttccggctggtgtgcaatggggagctgagtctagcccgggtactgagaaagaacatactggataaggtcgaccaaaagaagctgctgcgctgtgccacatcctcacagccgctagccgcaaggggagttgccgcccggccaggtactctgcacgacttccacagccacgagatcgccgagcagttgacactgctcgacgcagagctgttctataaaattgaaatccctgaagttttgctctgggcgaaagaacaaaacgaagaaaagagcccaaatctcacccagttcactgaacacttcaataacatgtcatactgggtgcggtctataatcatgctccaggaaaaagctcaagatcgagaaaggttactcttaaagttcatcaaaatcatgaagcatctgagaaagctaaataattttaacagctatctggcgatattgtccgctttggacagcgcccccattcgtcgcctggagtggcagaagcagacttctgagggactcgctgaatactgcactttaattgattcctctagtagttttcgggcctatagggccgctttaagcgaggtggagccaccatgcattccatatctggggcttatcctccaggacctcactttcgtacacctgggaaacccagactatattgatggaaaagttaacttctctaagcgatggcaacagttcaacattcttgactctatgaggtgctttcaacaggcccattacgatatgcggcggaatgacgatatcataaattttttcaacgacttctccgatcacctggccgaagaggccctttgggaactatcactgaagataaagccgagaaacattacgagacgcaagacagatagggaggagaaaacatag

SEQ ID NO: 26017 - DNA, 3234 bp, Artificial Sequence
  Description of Artificial Sequence: Synthetic coding sequence
atggacaccgacagccagcggagccacctgagcagcttcaccatgaagctaatggacaagtttcatagccctaagatcaagcgcactccctccaagaaaggcaaacctgcagaggtatctgtgaaaatccctgagaagccggtgaacaaagaggcaaccgatcgatttctccctgaaggttatccactgccactcgacctggagcagcaggctgtggagttcatgtccacctctgcggtggcttccagatcccagcgacaaaagaacctcagttggttggaagagaaagagaaggaggtggtgtctgcccttaggtatttcaagaccattgtagataaaatggccatcgacaagaaggtgctggaaatgctgcccggaagcgcttctaaggtgctagaggccatccttcccctggttcagaatgatccacggatccagcactcaagtgccttgagttcatgctacagccgggtctaccaatccctcgccaatttgattcggtggtcggaccaagtgatgttggagggcgtgaactccgaagacaaggagatggttactactgtgaaaggcgtgattaaagcggtgctggatggcgttaaggaactcgtccgtctaactattgaaaaacagggtagacccagccctacaagcccagtgaagccctcctctcccgccagcaagcctgatggtcccgccgaactgcctctcaccgatagggaagtagagatcctcaataagaccacaggtatgagccagtccacagagttgctgccagatgctacagatgaagaagtggccccgccaaagcctcccctccccggtattagagtagtggataattctcccccacctgctctgccccccaagaagcgccagagtgccccaagcccgacacgagtcgcagttgtggcaccgatgtctcgggccacaagcgggagctccctgcccgtcggcattaaccgccaggattttgatgttgattgttacgcccaacgtcggctaagtgggggtagccattcctatggaggagagtctccccggctttcaccttgtagctctatcgggaagctctccaaaagcgacgagcagttaagctcgctggatcgtgattccggtcaatgcagtcgcaacacgagttgtgagactctggaccattacgaccctgattacgagtttctccagcaggatcttagcaatgcagaccagatccctcaacagacagcttggaacctgtcccctctcccggagtccttgggagagagcgggagcccttttcttgggcctccatttcagctgcctctcggcgggcaccctcagccagacggccctttagcgcctgggcagcagaccgacaccccaccggctttgcccgaaaaaaagaggaggtctgcagctagccagactgccgacggcagtgggtgtcgagtgtcatacgaacggcatccttcacagtatgacaacatttcaggagaagatctgcagtctaccgcccccatccctagtgtcccctacgcccccttcgccgccatacttccatttcagcatggcggttcctctgctccagtggagtttgttggcgatttcacggcgccagaatcaactggggaccccgagaagccaccacccctgcccgagaagaaaaataagcatatgctagcatatatgcagctgctcgaggattattcagaaccccaaccaagtatgttctatcagactccccagaacgaacatatctaccagcagaaaaataagttgcttatggaggtgtatggctttagtgatagctttagtggcgtcgattccgtgcaggaactggcaccacctcctgctctacctccaaaacagcgtcaacttgaaccacccgccggaaaagacggccacccccgggaccctagcgccgtgtctggggttccaggtaaggattctagagacggctccgagcgtgccccgaaaagtccagatgccctcgagtctgctcagagcgaggaagaggttgacgaactctcactcatcgaccataacgagatcatgtcgcggcttacccttaaacaggaaggcgacgacggccctgacgtcagggggggatctggggatatattactggtgcacgccactgagactgatcggaaagatttggtcctttattgcgaagcatttctgactacctatcgcacatttatctcaccggaagagctcattaaaaaacttcagtaccggtacgagaagttcagtccattcgccgacactttcaagaagagagtatccaaaaacacattctttgtgctcgtgagagtcgtcgacgagttgtgcttagtggagcttaccgaggaaatcctcaagcttctcatggagttagtgtttcgactcgtgtgtaacggcgaattatctctggcgcgcgtgctcaggaagaatattctcgacaaagtggatcagaagaagctgctgagatgtgccacttcatctcagcctctagcagctcgaggggtggccgcccgcccagggacgctgcatgactttcatagtcacgagattgcagaacagcttacactcttggatgcggagcttttttataagatagaaatccccgaggtgcttttatgggcgaaggaacagaatgaagagaagagtcccaacctgacccagtttaccgaacatttcaacaacatgagctactgggtgcgtagcatcataatgctccaagagaaggcccaggacagggagcggctgctactcaaatttatcaaaataatgaagcacttacgcaagttgaacaacttcaatagctaccttgcgattctgtcagcccttgatagcgcccctatccggcggctggagtggcagaaacagacctccgagggacttgctgagtattgcaccctgatcgatagcagttcctcgttcagggcttaccgcgctgctctcagtgaggtcgagccaccatgtattccctaccttggattgatcttgcaggatctaactttcgtccacctcggcaacccagactacatcgatggaaaggttaatttctccaaacggtggcagcaatttaacatcctggattctatgagatgcttccagcaggcccactatgacatgcggagaaatgacgacatcataaatttttttaacgatttctctgaccaccttgctgaggaggccctgtgggagctgtctctcaaaatcaaaccacggaacatcacacgccgcaagactgatcgcgaagaaaagacctag

SEQ ID NO: 26018 - DNA, 3288 bp, Artificial Sequence
  Description of Artificial Sequence: Synthetic coding sequence
atgggcaacgccatcgagaagcagaagcccctgaagcggagccacctgtatccatggaagcaagattctcagcgcagccatctgtcatcatttacgatgaagctaatggataagttccactcccctaagatcaagagaactccaagcaagaagggcaaacccgcagaggtttcagttaagattcctgagaaaccggttaataaggaagccaccgatcggttcctgccagagggctatcccttgcccctagacttggaacagcaggcagtcgagtttatgagcacttccgccgtggcctcgaggtctcagcggcagaaaaacctcagctggctcgaggagaaagagaaggaggtagtctccgctctccgatacttcaagaccatcgttgataagatggccatcgacaagaaggtgctggagatgctacccggctccgccagtaaggtcttggaagccatcctccccctagtccagaatgaccctaggatacagcactcctcagctttaagttcttgctatagtcgggtctaccaatccctggccaacctgatcagatggtcagatcaggttatgctggagggggtgaattcagaagataaggagatggtcactacagtgaagggggttatcaaggcggttttggacggcgtgaaggagcttgtcaggcttaccattgagaagcagggaagacccagccccacatcccctgtgaagcccagcagtcctgctagtaagcccgatggtccagcagagctgcctctgacagatcgagaggtcgagattctcaataagaccacaggaatgagccagagcaccgagctgctgcctgacgccaccgacgaagaggtggcacccccgaagccccctctacctgggatccgggtggtggacaactctccaccccccgccttgcctccaaaaaaaagacaaagtgccccatctcctacccgggtggccgtggtggcaccgatgagccgtgcgacgagcggctctagtttgcccgtagggatcaatcgacaggatttcgacgtggactgttatgctcagcgcagactctcaggcggctctcactcctacggcggcgaaagtcccagactgagcccatgcagcagcattggcaagctgtctaaaagcgacgagcagttgagctccctggaccgtgacagtggacagtgcagcagaaatacctcatgcgaaacactcgaccattacgatcctgattatgaatttcttcagcaggacctgtcaaacgcggatcagattccacagcagacagcatggaacttatcacccctgcccgagtcgctgggggagtccggaagcccatttctgggcccgccttttcagctccccctgggcggtcatcctcagcccgacggcccactggctcctggacagcagacagacacccccccagcactgcccgaaaagaaaagacggtctgctgcaagtcagaccgctgatggaagcggctgcagagtgagctacgagagacacccctcccaatacgacaatattagcggtgaggatctgcagagcaccgcccctatccccagtgtgccctatgcgcccttcgcagcaatactccctttccagcatggtggaagctcagctccagtggaattcgttggcgacttcacagcaccggagtctaccggcgatccagaaaagccccctcctttgcccgagaaaaaaaataaacacatgctcgcatatatgcagcttttggaggattacagcgagcctcagccctctatgttctatcagactccacagaacgagcatatctaccagcaaaagaacaagctattaatggaggtttatgggttcagcgattccttttcgggcgtggacagcgttcaggagttggcccccccaccagcgttgccaccaaaacagagacagctggagccacccgcaggcaaagacgggcaccccagagatccttctgccgtatcaggggtgcctgggaaggatagcagagacggttctgagcgcgcccctaaatcaccagacgctctggaaagcgcacagtccgaagaagaggtcgatgagctttcccttatcgaccataatgagattatgtccaggctgactctgaaacaggagggtgacgatggcccagatgtccgcggagggagtggtgacattttgctggtgcacgcaacagagacggatcggaaagatttggtgctttactgcgaggcattcctaaccacatatcgcacattcatctctccggaggagctcattaaaaagctgcaatacagatacgaaaaattcagcccttttgccgacacattcaagaaaagagtgtccaagaacacctttttcgttctggtcagggtggtggatgagctgtgtctggtggagctcacagaggagatcctgaaacttctaatggaactggtatttagactagtgtgcaacggcgaactctcattagctcgagttttacgcaaaaatatcctagacaaggtggatcaaaagaagttgctgcgctgtgccactagctcccagccactggctgctagaggtgtcgcagccaggcccggcacactccatgacttccatagtcacgagatagctgagcagttgacactgctggatgctgagcttttttacaagattgaaatccccgaagtgctcctttgggcaaaggagcagaacgaagagaagagccccaaccttactcaattcacggagcactttaataatatgtcctattgggtgagatcaattatcatgctgcaggaaaaggcccaggacagagaaagactgctgctgaagttcatcaaaataatgaagcatttgaggaagttgaataactttaactcatacctggccatcctttccgctctggatagcgcgcccattcgcagactggagtggcaaaaacagacctccgagggcctcgctgagtattgcacgttaatcgatagctcatcctcgtttcgtgcttacagagcggccttatctgaggtggagcctccctgcataccttatttgggactcatactgcaggatctaacctttgttcacttggggaacccggattacatcgacggaaaagtgaacttctctaagcgctggcagcagtttaatatattagacagcatgcgatgtttccaacaggcccactacgacatgcgtaggaatgacgatattataaacttttttaacgatttcagcgaccacctggctgaggaggctttgtgggagctgagcctgaagatcaagcctcgcaatatcactagaaggaaaaccgatcgggaggaaaaaacgtag

SEQ ID NO: 26019 - DNA, 1395 bp, Artificial Sequence
  Description of Artificial Sequence: Synthetic coding sequence
atgagccgggccaccagcggcagcagcctgcccgtgggcatcaacaggcaggatttcgacgtggactgttacgcgcagcggcgcttatccggtggcagccactcttacggcggcgagtcccctcgtctctcaccttgcagctcaatcggtaagctcagcaagagcgatgagcaactatccagcctagatagagactcgggacagtgctctagaaatacgtcatgtgaaacattggatcactacgaccccgactacgaattcctacaacaggacttgagcaatgcggaccagatcccacagcagacagcctggaatctctctcccttgcccgaatccttaggcgagagcggaagcccctttcttgggcccccattccaacttcccctaggtggtcatccacagcccgacggcccactggcgcccggccagcaaaccgatactcccccggcgctccctgaaaagaaaaggaggagcgctgcgtcgcagacagcggacgggtccggttgccgcgtttcttatgagaggcaccccagtcaatatgacaatattagtggagaagatcttcagagcacagctcccatcccctctgtcccatacgctcccttcgctgcgatattacctttccaacatggcggttcctctgcgccagtggaatttgttggtgacttcacagcccccgagtcaacaggtgacccggaaaagccacccccactgcctgaaaaaaaaaacaagcatatgctagcatacatgcaactgctcgaggactacagtgaaccacagccttctatgttttatcagacgccgcagaatgagcacatttaccagcagaagaacaagctgctcatggaggtatatggattctccgacagcttttctggggtggactctgttcaggagttagcaccgcctccagcgctgcctccgaagcagaggcaactgcaagcgtcctgcgcagcctcctctttttccagcgtttcccattgcgtgcagcaaactaaggtcgctttcacacctgaggatggttcagcggcacagggcctctctgtcagcgtgagcaactcattcctgtccagacatggatctctgcccgtgccatcttataaaagtgtatttaggagctatagtcaagacttcgtcccccaccatcaagccagcgtgccacctttcttacctcctactagtagcagctcaccacactttccacctgcccaccagtctcagagtagcgatctggccgtgccaaccatggctgggcctcccccttctaccgtcgatggcccgctgtctgcatcccaagagtcttcttttcacggcaacaccgtctgtctgccatccgagaccagctttactgattcagagccacctgctggcaaggatggacaccctagagactag

SEQ ID NO: 26020 - DNA, 3285 bp, Artificial Sequence
  Description of Artificial Sequence: Synthetic coding sequence
atgagcggcggcctgggcctgcggcggagccccgagatgagcggcaagattgaaaaagccgatagccagcgatcacatttaagttcgttcacaatgaagctcatggacaaattccattctccaaaaatcaagcggaccccgtcgaaaaagggcaagcccgccgaagtgagcgtcaaaattcctgaaaaacccgttaataaggaagccaccgaccgtttcctcccagagggatatcctctaccacttgaccttgagcaacaagcggtagagtttatgagcacatctgcggtggcctcacgctcccagcggcagaagaacctctcctggttggaggagaaagaaaaagaagtggtgtcagcgttgcggtacttcaagaccatcgtcgacaagatggctatcgacaaaaaggtactggagatgctccctggttctgccagtaaggtgctggaggcgatattacccctggtacaaaatgacccaaggatccaacattccagtgccttaagttcatgctacagtagagtgtatcagtcactggccaacttgatccgctggtctgatcaagtaatgctggagggagtgaactccgaggataaagaaatggtgacaactgtgaaaggtgtaattaaggctgtgctggacggtgtgaaagaactcgtacgcctaacgattgaaaaacaagggaggccctcacctaccagcccagttaagcccagttccccggcctcaaagcccgatggcccagcagagttgccactgacagaccgagaggtggaaatcctcaacaagactacaggtatgtcccagtccactgaactgttgccagacgctactgacgaagaggttgcaccgcccaagccacccctgcccggcatccgggttgtggacaacagccctccacccgccctgcctcctaagaaaaggcagagtgcgccttctccaacaagagtcgcggtggttgctcctatgtccagggccacttccggaagcagtttacctgtcggcatcaacaggcaggactttgatgttgactgctatgcccagcgcagactgagcgggggctcccacagctacggcggagagagtccccgattatcgccctgttcttcgatcggtaaactgtccaagagtgacgagcaattgtcaagtctggatagggactcgggccagtgttcaaggaataccagttgcgagaccctcgatcactacgaccctgactacgagtttttgcaacaggatctgagcaacgccgaccagataccccagcaaacagcctggaatctgtcccctctgcctgagagtctgggcgagtctggcagcccgtttctgggcccccctttccagctacccttaggggggcacccacaaccagacgggccactggcccctggccagcaaactgacaccccacccgccttgcccgaaaagaagaggcgctccgcggcaagccagaccgccgatggcagcggatgtcgggtttcatatgaaagacacccctcacagtatgacaacatctccggtgaagacctgcagtctacagcccccattccgtccgtcccatacgcaccgtttgcagcaatcttaccgttccagcatggcgggtctagcgcgcctgtcgagtttgtgggcgacttcaccgccccagaaagcacaggcgacccagaaaagccccctccactgccggaaaaaaaaaataagcatatgttggcctatatgcaactgctcgaagactattcagagccccagccgtcaatgttctatcagactcctcaaaacgagcacatctaccagcagaagaacaaactgttaatggaagtctatggatttagcgacagttttagtggggtggactcagtgcaagagctggccccccctcctgcattgccacccaagcagaggcagctggagccccccgccggtaaggatggtcatccacgggaccctagcgctgtgtctggagttcctggcaaagacagccgcgatggctccgaaagggctcccaagagcccagatgctctcgaatccgcccagagcgaggaggaggtcgacgagctttccctgatagatcacaacgaaattatgagccgcctgaccctgaagcaggaaggcgacgatgggccagacgtgagaggggggagcggcgacattctactagtgcacgctacagagacagacagaaaagacctggtgttgtactgcgaggcgtttctgaccacataccgaactttcatctcacccgaagaactgataaagaagctgcaatatcggtacgagaaattctccccttttgctgacacgtttaagaaacgagtgtccaaaaacactttctttgttctggttcgcgtcgtggatgagctctgcctggtggagctgacagaggaaatacttaagttgttaatggagttagtgttcaggcttgtatgtaacggagaactgtctcttgcacgcgtgttgcgcaagaacatcctggacaaggtagatcaaaagaaactgttaagatgcgccacatcttcccagccccttgccgctaggggagtggcagcacgacctggcacattacatgacttccacagtcacgaaatcgccgaacagctcaccttgctggacgccgagctgttctataagattgaaatacccgaggttttactctgggcaaaggaacaaaacgaggaaaagtctcctaacttaacacagttcacggagcatttcaacaatatgtcttactgggtgcggagtatcatcatgctgcaggagaaagcccaggaccgggagcgattgttgctgaagtttatcaagattatgaaacatttacgcaagctgaataattttaatagctacctggcaatcctctctgctctggatagtgctccgatcaggaggctggaatggcagaagcagacttctgagggcctggcagaatactgcacccttattgactccagttcttcttttagagcgtatagggcggctctgtccgaggttgagcccccttgtatcccgtacttaggcttgatcttgcaagacctgactttcgtgcatctaggaaaccccgattacattgacgggaaagtcaatttctcaaagagatggcaacaattcaatattctggactctatgcgctgcttccagcaggcccactacgacatgcgccgtaacgatgacattatcaacttcttcaacgacttttctgaccacctggcagaagaggcactgtgggaactgagcttaaagatcaagccaaggaatatcacgcggcgcaagactgatagggaagaaaaaacgtag

SEQ ID NO: 26021 - DNA, 1011 bp, Artificial Sequence
  Description of Artificial Sequence: Synthetic coding sequence
atggaggtgtacggcttcagcgacagcttcagcggcgtggacagcgtgcaggagctggcccctcctcctgcactgccccctaagcagcgccagctgagcgagaatgcctccgaggaggctggagaaggtgaatatgtgaacctctacagcagtggacaatcatccgaggaactggccccctcgaggggcgagccgcccgcaggcaaagacggacacccacgggatcctagtgcagtctctggcgtgccagggaaagactctcgcgatgggagcgagcgggcccctaaaagccctgacgcacttgaaagtgcgcaaagcgaggaggaggtggacgaactgtccctgatagatcacaacgaaataatgagcagactgacacttaagcaagagggggacgatggacctgacgtaagaggggggtccggagatatccttctcgttcacgcaactgagaccgatagaaaagacctagtgctatactgtgaggccttccttacaacatataggacttttattagcccagaagagctcataaagaagttgcagtaccggtacgaaaagttctctccatttgcggatacatttaagaagcgggtgtcaaaaaacaccttcttcgtactggtgcgtgttgttgacgagctttgcttggtggaattaacagaggaaattttgaagctcctaatggagttagtattcagacttgtgtgtaacggcgaattaagcctagcaagagttttaaggaaaaatattcttgataaagtggatcagaagaagctgctcagatgcgccacgtcctcacagccattggcagcacgtggtgtagccgccagacctgggaccctgcatgattttcactctcacgaaatagcggagcagcttaccttgcttgacgccgagctcttttataaaatcgagattcctgaggtcctgctgtgggctaaggagcagaatgaggaaaagtcaccaaacttaacacagtttacagaacacttcaacaacatgagctattag

SEQ ID NO: 26022 - DNA, 3174 bp, Artificial Sequence
  Description of Artificial Sequence: Synthetic coding sequence
atgggcaacgccatcgagaagcagaagcccctgaagcggagccacctgtacccatggaaacaagactcccagaggagtcacctgtcttccttcactatgaagctgatggacaaattccacagccctaaaattaaaaggacgccaagtaagaaaggaaagccagcagaggtgagtgtgaaaattcccgagaaacccgtcaataaaaatctgtcatggctggaagagaaagaaaaagaggtggtgtccgcattacgatattttaagactattgtggacaaaatggctattgataagaaggtgcttgaaatgctcccagggagcgcatcaaaagtgctggaggccatcctgccattggtccagaacgacccaaggatacagcactcttctgctctatctagttgttactctcgcgtctatcagtccctcgctaacctgatacgttggtctgatcaggtcatgttggagggcgttaattccgaagacaaagagatggtgaccaccgtgaaaggggtcatcaaagctgtgctggatggcgtgaaggagctcgtgcgcctgactatcgagaaacagggtagaccctctccaacatcgcccgtgaaaccttcttcccctgcaagcaagcctgacggccccgccgaactgcctttaacggatagggaggtcgagatactcaataaaactacgggaatgagtcaatcaactgagctcctgccagatgccaccgatgaggaggtggctccacccaagccccctctccctgggattcgcgtcgttgacaactcaccccctcctgcactgcctccgaagaagaggcaatcggcgcctagcccgacacgtgtggctgttgtcgcgccaatgtcgagggctacaagcggtagcagtctcccagtggggataaatcggcaggattttgacgtggattgttacgcgcagcgccgactgagcgggggaagccattcctacggcggagagagtcccaggctgagtccctgttcaagcattggaaaactctcgaaatccgacgagcaacttagtagtctggaccgggacagcggacaatgtagtcgaaataccagttgtgaaacacttgaccactatgaccctgattatgagttccttcagcaggacttgtccaacgccgatcagatcccacagcaaactgcctggaacctgtccccccttcctgagtcccttggcgagagtggctcccctttcctcggaccacccttccaactgcctctggggggtcaccctcagcctgatggaccgctggcacctggacagcaaactgatacgcccccagccctccctgagaagaaacggcgcagtgccgcctcgcaaaccgcggatggatctggctgtagggtcagctatgagaggcacccttcccaatacgacaacattagcggggaggacctccagagcacagcccccataccttccgtaccctatgcccccttcgccgcgatcctacccttccagcacgggggaagcagtgcgcccgtggagttcgtgggggattttacagcgcccgaaagcactggcgatcccgagaagccaccacctcttcccgagaagaagaacaaacacatgctggcttacatgcaacttctggaggactattctgaacctcaacccagcatgttttaccagactccacagaatgagcacatttatcaacagaaaaacaaactactcatggaggtgtatggattctctgatagttttagcggagtggatagtgtccaggagcttgcaccgccccccgcactgcctcctaagcagcgtcaactggagccgcccgctggcaaggacggacatccacgcgaccctagcgccgtttcaggggtgcccggaaaagactcgcgggatggaagcgagagagcccccaaatccccagatgccctcgagagtgcccagtccgaggaggaagtcgatgagcttagtctgatcgatcataatgagatcatgagcaggcttacactgaaacaggaaggcgatgacggtcctgacgtcagaggcgggagtggcgatatcctcttagtccatgcaaccgaaacagacaggaaggatcttgtcctatactgcgaggcctttctcacaacatatcgtacattcatctctccggaggagctgatcaaaaagcttcagtaccgctacgaaaagttttccccatttgccgatacttttaagaagcgggtgtccaaaaatacgttctttgtcctcgtgcgggtcgtagacgaattatgtctcgtggagctgaccgaagagatactaaagctcctgatggagctcgtgtttcggctggtttgtaacggggagctaagcctggcaagagttcttcgcaagaacatcttggataaggttgaccagaagaagctgctcaggtgcgctaccagcagccaacccttggcggctagaggcgtagctgccaggcctggcaccctccacgacttccacagccacgaaatagcggagcaactaactctgttggatgcagaacttttctacaagatagagattccagaggtgctactatgggctaaggagcagaacgaggagaaaagccccaaccttacgcaattcaccgaacactttaataatatgtcctactgggtgcgcagtattatcatgctgcaggagaaggctcaggatcgcgagcgactgttgctgaaattcattaagattatgaaacacctgaggaagctgaataatttcaattcatatctcgccatcctgtcagcactggactccgctcccattcgacgactggagtggcagaagcagacctcggagggactggccgagtattgcactctcatcgacagcagttccagcttccgagcttacagggccgccttgagcgaagtcgagcctccctgtatcccttacttgggacttatcctccaggatctcacattcgtgcatctcggcaacccagattacattgacgggaaagtgaacttcagcaaaagatggcagcaattcaatattctagacagtatgcggtgtttccagcaggctcattacgacatgcgacgcaatgatgatattatcaacttctttaacgatttttctgaccacctggccgaagaagcactttgggagttgagcctgaagatcaagcctagaaacatcactcgaaggaagaccgaccgagaagagaaaacctag

SEQ ID NO: 26023 - DNA, 960 bp, Artificial Sequence
  Description of Artificial Sequence: Synthetic coding sequence
tgactggcccccccccccgccctgccccccaagcagcggcagctgtcagaaaatgccagcgaggaagctggggagggggaatacgtgaatttgtacagcagcggacagtcgagcgaggaacttgccccaagccgcggggaacctcctgcaggaaaggacggccacccccgggacccgagcgcagtgtcaggagtgccaggcaaagacagccgggacggatctgaacgggcacccaagagcccagatgctctggaaagcgctcagtccgaggaggaggtggatgagcttagcctcatagatcataacgagattatgtcgagattgaccctgaagcaggagggagacgacgggcctgatgtgcgaggtgggagcggggatattctgctcgtacacgccactgaaaccgatcggaaagacctcgtgctctactgcgaggctttcctcacaacttatcgcacctttattagtcccgaggagctgatcaagaagcttcaatatcggtacgagaaattctctcctttcgccgatacattcaaaaagcgcgttagcaaaaatacctttttcgtgctggtgagggttgtggacgaactgtgccttgtggaactaacggaggagattctgaaactgctcatggagttggtttttaggttggtatgcaatggcgaactgagcctagcccgcgtgcttagaaaaaacatcctcgataaagtcgaccaaaaaaagcttctgcgatgtgcgactagctcccagccacttgccgcccggggcgtggcagcacgcccggggacactgcacgactttcactctcacgaaatcgccgaacaactgacactattggatgctgagctcttctataaaatcgagattccggaggtgctcctgtgggccaaggaacagaacgaggagaaatctcctaatctgacccaatttaccgagcattttaataatatgtcttactag

SEQ ID NO: 26024 - DNA, 687 bp, Artificial Sequence
  Description of Artificial Sequence: Synthetic coding sequence
tgactgcccgagaagaagaacaagcacatgctggcctacatgcagctactggaagactatagcgaaccccagcccagtatgttttatcagacaccgcagaacgaacacatataccagcagaaaaacaaactcctgatggaggtttatgggttttccgattcgttttccggcgtggactcagtgcaagagctcgctccaccacccgccctgccaccaaagcagaggcaactccaggcatcgtgcgcagcttcctccttttcttccgtttctcattgcgtgcagcagactaaggtggcatttactccggaggacgggagcgccgcgcagggtctgtcagtttcagtatcaaacagtttcctgtccaggcatggtagcctgccagtcccatcttacaaatcagtctttcgatcctactcccaggattttgtcccacatcaccaggcatctgttccccctttcctcccccctacgtcttcctcttcccctcatttccccccagctcatcagtcccagagctccgatctcgcagttcctaccatggccggacctcccccatccactgttgatggtcccttgtcagccagccaggagtcatcattccacggtaacacagtgtgtctgcccagcgagacatcatttactgactccgaaccccccgctggaaaagatggacaccctagggattag

SEQ ID NO: 26025 - DNA, 582 bp, Artificial Sequence
  Description of Artificial Sequence: Synthetic coding sequence
atgggcaacgccatcgagaagcagaagcccctgaagcggagccacctctacccttggaaacaggattctcagagaagccatctgagcagctttacgatgaaactgatggataagtttcacagcccaaagatcaagcgtaccccatctaagaagggcaagcccgccgaagtgtcagtcaagatccccgaaaagccagtcaacaaggaggccactgaccgttttctgccagagggatatccgctgccactcgacctggagcagcaggcggtcgagtttatgtcaaccagtgccgtcgcgtcacgcagtcaacgccagaaaaatctgagctggctcgaggaaaaggagaaggaggtggtgtctgctcttaggtatttcaaaaccattgtggacaagatggccatcgacaaaaaagtcctcgagatgcttccagggtccgcatccaaggtgcttgaggctatactgcccctagtgcagaacgatcctcgcattcagcactcctctgcactgtcttcctgctactctcgggtgtaccaatctctggccaatctgatcagatggtcggatcaggtcatgttagagtag

SEQ ID NO: 26026 - DNA, 3072 bp, Artificial Sequence
  Description of Artificial Sequence: Synthetic coding sequence
ttcaagaccatcgtggacaagatggccatcgacaagaaggtgctggaaatgttacccggttccgcatccaaggtactcgaagccatcttacccctcgttcagaatgacccgaggatacagcattccagtgctctgagcagctgttattccagagtctaccagtcactcgctaatctcatccggtggtccgatcaggtcatgctggaaggggtcaacagcgaagataaagagatggtgacaacagttaagggagtgataaaggctgtgctcgatggggtcaaagagttggtcaggctgaccatagaaaaacagggcaggccctcccctacctccccggtgaaaccgtctagtccagctagcaagccggatggacccgctgagctgcctctgacagatcgcgaagtggaaattctgaataaaaccactgggatgtcccagtcaacagaactcctgcctgacgcaactgacgaagaggtggctccccctaagcctccccttcctggtatccgtgtggttgataattcaccaccccctgccctgccacctaaaaaaaggcaaagtgctccctccccaaccagggtggctgtggtggcccccatgtctcgggcaacgtccggtagttctctgcccgttgggattaaccgccaggacttcgatgtcgattgttacgcacaacgccggctgtcgggaggttcccacagctatggcggtgaaagccccaggctttccccatgtagtagtattggcaaattgtcaaagtcagacgagcagctgagcagtctcgaccgggactccggacagtgctccagaaatacctcttgcgagaccctggatcactatgaccctgattacgagttcctgcagcaagacttgagcaacgctgatcagattccccagcagacggcatggaacctaagccctttacccgagagcctaggagagtctggctctccattcctcggacctcccttccaacttcctctggggggacatccccaacctgatggtcccttggctcctggacagcagaccgataccccacctgcactcccagagaagaaacgaaggagcgctgcaagtcagacagccgatggaagcggctgcagagtgagctacgagcgccatccgtcccagtacgacaatatttccggtgaggatttacagagtaccgctcctatcccatctgtgccatacgcaccattcgccgctatccttccttttcaacatgggggctcttctgccccagtcgagtttgtcggcgattttactgcaccagaatctaccggcgaccccgaaaaacctccccccctgccagaaaagaagaacaaacacatgctggcctacatgcagcttctcgaggactacagcgagcctcagccttcaatgttctaccagacgccacagaatgagcacatctatcaacagaagaacaagctcctcatggaggtgtatggattttctgattccttcagcggcgtggacagcgtccaggagttggctccgcctcccgcactcccacctaaacagcgacagctggcttcgtgcgctgcaagctcgttctcctccgtcagccattgcgttcagcagacgaaagttgccttcaccccagaagatggcagtgcagcccaagggctgtccgtcagtgtctccaactcatttctgtctcggcatggctcattgcccgtccccagtgaacccccagctggaaaagacgggcacccgcgtgatccaagtgcagtgtccggggtacctggcaaagacagtagagatgggtccgagcgggcacccaagagccctgatgccttggaatccgcccagtctgaagaagaggtcgacgaactgtcactcatcgatcataatgagatcatgagtaggctaacactgaagcaagagggggacgacggcccagacgtgaggggtggatcaggcgatattctcttagtacatgccacagagactgatagaaaagacttggttttgtattgcgaggctttcttgaccacttatcgcacatttatctcccccgaagagctgatcaagaagctgcagtatcggtacgagaagtttagtccgttcgccgacacttttaagaaacgcgtgagcaagaatacattttttgtgctggttagagtggtggatgagctgtgcttggttgaattaactgaagagatcctgaaattgctgatggagctggtgtttcgccttgtctgtaatggagaacttagcctggcacgcgtcttgcggaaaaatatactggataaagttgaccagaagaaactgctgagatgtgctacgtccagtcagcccctggctgctaggggcgttgcagcccggccagggaccctgcatgacttccattcccacgaaatagcagagcagttgacactcctggacgccgagctcttttacaaaatcgaaatccctgaagttttgctatgggctaaggagcagaacgaggagaagtccccaaacctcacgcagttcaccgagcactttaataacatgagctattgggttaggtcaataatcatgctacaggagaaagctcaggaccgagagcgcctattgctcaagttcataaagatcatgaagcacctgagaaaactgaataacttcaactcctatctggccatcttatctgccctggattctgcccccataaggaggctggaatggcagaaacagacgtctgaaggcctcgccgagtactgcacacttatcgattcgtcctctagttttcgggcatatagggcagccttgagtgaggtcgagcctccctgcataccctacttgggcctaatcctccaggatctgactttcgtacatctggggaaccctgactacatcgacggcaaagtgaactttagcaagaggtggcagcagttcaatattctggactcgatgcgttgttttcagcaggctcattacgacatgcgccgcaacgatgatataatcaatttcttcaatgacttttctgaccatctcgccgaggaagctctgtgggagcttagcctgaagatcaaaccaagaaacatcactagacgcaagaccgatcgcgaagaaaaaacatag

SEQ ID NO: 26027 - DNA, 480 bp, Artificial Sequence
  Description of Artificial Sequence: Synthetic coding sequence
atggaggtgtacggcttcagcgacagcttcagcggcgtggacagcgtgcaggagctggcccctcccccggctttgccaccaaagcagcggcaattatataagtcagtgttccgatcttatagtcaagacttcgtgccccaccatcaagccagcgtgcccccttttctgcctccgacgtcctcatcgagccctcacttcccgcctgcacatcagagccaatcatctgatctggcggtcccaaccatggccggaccccccccgtctactgtcgatggccctctcagtgcttctcaggagtccagctttcacggcaacacagtatgtctcccctccgagacttcctttacggattctgagcctccagcagggaaagatggccatcccagagatccctctgcagtgagtggagtgcccggcaaagactcaagggacggctcagaacgggccccaaagtcacccgacgctctggagtcagcttag

SEQ ID NO: 26028 - DNA, 696 bp, Artificial Sequence
  Description of Artificial Sequence: Synthetic coding sequence
atggaggtgtacggcttcagcgacagcttcagcggcgtggacagcgtgcaagaactagccccacctccagccctgccacctaagcaaagacagttgcaggcgtcttgcgcggccagctctttttctagcgtctcccactgcgtgcaacagaccaaagttgcttttaccccagaagatgggtctgcagctcagggactcagtgtgtcagtcagcaactcctttttgtctcgacacggcagcctccccgttcctagctacaaatctgtgttccgatcgtattcacaggacttcgtgcctcatcaccaggcctctgtcccacccttccttccgcccactagcagctcaagtccacatttccctccagctcaccagagccagagctcagatctggcggtgcctaccatggccggccccccacccagcacagtggacggtccactgtctgctagccaggagtcttcgttccatggcaacaccgtgtgtctgccatctgagacaagctttactgattccagtgaaaacgcgagcgaggaagcaggggaaggagagtacgtgaatctgtactcaagcggtcaatccagcgaagagcttgcccctagtcgtggagagccaccggccggcaaggacggacacccacgggatccgtcagcggtgagtggtgtgccaggcaaggattcaagagatggctccgagtag

SEQ ID NO: 26029 - DNA, 477 bp, Artificial Sequence
  Description of Artificial Sequence: Synthetic coding sequence
atgagcggcggcctgggcctgcggcggagccccgagatgagcggcaagatcgagaaagccgatagtcagcggtcccatctttcttccttcactatgaaactgatggacaagtttcattcgcccaagatcaaacgaacacctagcaaaaaaggaaaacctgccgaggtgtcagtcaaaattcccgaaaaacctgtgaataagaaccttagttggctcgaggaaaaagagaaggaagttgtcagcgccctgagatatttcaagaccattgttgataaaatggccattgataagaaggtgctggaaatgctgccagggagcgcttccaaagtcctcgaagctattctcccccttgtgcagaatgatccccgcatccaacactcatcagccctgtcatcctgttatagccgggtctaccagtctttggccaacctgataaggtggagtgaccaggtcatgcttgagggcgtcaactcttag

SEQ ID NO: 26030 - DNA, 261 bp, Artificial Sequence
  Description of Artificial Sequence: Synthetic coding sequence
atggaggtgtacggcttcagcgacagcttcagcggcgtggacagcgtccaggagctggcccctccaccagccttgccacctaaacagagacagctggagcctcctgccgggaaggatggccaccccagagatccttctgcggtctcaggtgtacctggaaaggacagccgcgacgggtcggaaagtgggattaccagcgtgtaccggtggaatattcagaggcagcaacgactctcttacgggcacaccgcttcgcaatag

SEQ ID NO: 26031 - DNA, 7419 bp, Artificial Sequence
  Description of Artificial Sequence: Synthetic coding sequence
atgaccgcccggggccagagccccctggcccccctgctggagaccctcgaagatccaagtgccagccatgggggtcaaactgacgcttatttgaccctgacttctcggatgactggggaagagggtaaagaagtgatcaccgaaatcgagaagaaactccccaggctgtacaaagtcctgaaaacacatattagttcccagaattctgaactcagctctgccgctctccaggctctcggattctgtttgtataaccccaagatcacgagcgaactgagcgaggctaatgccctggagttactttctaaactgaatgacactatcaagaactcggacaagaacgttcggacccgtgctctctgggttatcagtaagcagacattcccttccgaggtagtgggcaagatggtgtcatccatcatcgattcactcgaaattcttttcaataaaggtgagacacattccgctgtggtggactttgaggccctgaatgtcattgtccgtctgattgagcaggcccccatacagatgggagaggaggccgtaagatgggcgaagctggtcattcccttagtggtgcattcggcccaaaaagtgcacctgagaggggccacagctctggagatggggatgcctcttttgctgcagaaacagcaggaaatagcaagcatcaccgaacagcttatgaccacgaaacttatcagtgagctgcagaaactgttcatgtcgaaaaatgagacatacgttctgaagctgtggccgttatttgtgaagctgttagggagaactctgcatcgttcgggctcattcataaattcactgctacagctggaggagctcgggtttcgaagcggggcacctatgatcaaaaaaatcgcatttatcgcttggaagtccctaatcgacaacttcgctctaaatcccgacattctttgctcagcaaagagattgaagctcttgatgcagccactgagttccatccacgttcggactgagacactggctctgacaaaactggaagtctggtggtacctgttaatgagactgggtccccacctgccagccaacttcgagcaggtgtgtgtgccactaattcaaagtaccatatccatcgattctaatgcgagcccacaggggaactcttgtcatgtcgcgacctcccctggcctgaaccccatgacgcctgtgcataagggtgcctccagtccctacggagccccaggtacgcctcgcatgaatctgagttccaatctcggcggcatggcaacaattcctagtatccagctcctgggactggagatgctcctgcactttctgcttggacccgaagccctaagttttgctaagcagaacaagcttgtactgagcctggaaccactcgaacacccacttatctcatcaccaagcttcttctcgaaacacgcaaatactttgattaccgccgttcatgatagtttcgtcgctgtggggaaggacgctcccgacgtggttgtgtcagccatttggaaggagttgatatctctggtgaagtcggttaccgagagcggcaacaagaaggagaagcctggctcagaggtcctgacgctgttattgaaaagtctggaaagtattgtgaaatccgaagtgttccctgttagtaagaccttggtattgatggaaattaccataaagggcctgccacagaaggtgcttggatcacctgcctatcaggtagcgaatatggatatactgaacggaacacccgcactgtttctcattcaactaatatttaataacttcctcgagtgcggcgtctctgacgaacgatttttcttgtcgctcgaatctctagtggggtgcgtgctctccggaccaacctcacccttggccttctccgactccgttctcaacgttataaatcagaatgccaagcagctggagaacaaagaacatctgtggaagatgtggtccgtgatcgtgacaccactcactgaactaataaatcagactaacgaagtgaatcagggcgacgctctcgaacacaacttcagtgccatttacggcgctctgactctgcctgtaaaccacatcttcagcgagcagagatttcctgtcgctaccatgaagaccctcctgcgcacttggagcgagctctacagggcgtttgcccggtgcgcggccctggtggcgaccgctgaggaaaatttgtgttgcgaggagcttagttcaaagattatgagctccctggaggacgaaggattcagcaatctgctgtttgtggatcgcatcatttatattattacggtcatggtagactgcattgacttctcgccttacaatataaagtatcagcctaaagttaagtcccctcagagaccaagtgactggagcaagaaaaaaaacgaacctcttggcaaactaacttctctgtttaaacttattgtgaaggtaatctatagttttcacacactttccttcaaggaggcccactcggacacgctttttaccattggcaacagcattactggcattatatcctcggtgttgggccatatctccctcccgtccatgatcagaaaaatttttgccacactgactcggcctttggctcttttctacgaaaactctaaactggacgaggtgcctaaggtgtatagctgtctgaacaacaaactggagaagctgttgggagagatcatcgcttgtctgcagttttcttacaccggcacctacgattcggagctgctagagcagttgagccccctgttatgtataatctttttgcacaagaataaacagataagaaaacagagcgcacagttttggaatgctacctttgctaaagttatgatgctcgtgtatcccgaagaactgaagcccgtgttaacccaggctaagcagaaattcttactgcttctgccaggactggagactgtggagatgatggaggagagcagcggaccttacagtgatggtaccgagaattcccagttgaacgtgaaaattagtgggatggagcgaaagtctaatggaaagagagactcttttctagcacaaacaaagaacaagaaagagaacatgaaacctgccgccaaactgaagctggaatctagctcgctgaaggttaaaggagagatcttacttgaggaggaaaaatcaaccgattttgtgttcattccgcctgaagggaaggatgctaaagaacgaattttgaccgatcatcaaaaggaggtgctgaaaacaaagcgttgcgatatcccagctatgtacaataacctggatgtctcccaggacactctgttcactcaatattcacaggaagagccgatggagatacccacgttgacacggaagccgaaagaagacagtaagatgatgatcacagaagagcagatggactccgatattgtcattcctcaagacgttaccgaggattgcggtatggcagagcacctggaaaaatctagcttgagcaataacgagtgcggatcactggacaagacgtcacccgagatgtcaaattccaacaatgacgagcgcaaaaaggctctgatcagcagccggaaaacatccacagagtgtgcctcaagtacagaaaattcatttgtggttagctcttcatccgtgtctaatacgacagtggcaggcacccctccatatcctacctcgaggcgccagacatttattacattagaaaagttcgacgggagcgagaatagacccttctcccccagcccactgaacaacatcagcagcacagtaacggtaaagaacaaccaggaaacaatgatcaagaccgactttttgcctaaggccaagcaaagagagggaacattttccaaatctgacagtgagaagatagtaaatggcacaaagcggtcctctcgccgcgctggcaaggccgagcagactggtaacaaacgcagcaaaccattgatgagatcagagccggagaagaacacggaggagtcagtagagggaattgtggttctcgaaaataaccccccagggctgctgaaccaaactgaatgtgtgagcgacaatcaggtgcatctctctgagagtaccatggaacatgataacaccaagctcaaggccgccacagtcgagaacgcagtgctcctggaaaccaacactgtggaagaaaagaacgttgagattaacttagagagcaaagagaacacgccacccgtggtgatttcagctgatcagatggtcaatgaggattcccaggtgcagataactccaaaccagaaaacgctaaggcgttcctccaggcgtcgcagcgaggtggtggaatctaccactgagagtcaggataaagaaaatagtcaccagaaaaaggaacggcggaaggaggaggaaaagcctttgcaaaagtccccactgcacattaaagacgatgtcctgccgaagcagaaattaattgccgaacagacactgcaggagaatctcattgagaagggcagcaatctgcatgagaagaccctgggagaaacctcggcgaacgctgagaccgagcagaacaagaaaaaggccgacccagagaacataaagtcggagggggatggaacacaggatatcgtcgataagtcttctgagaaactggtgaggggacgcactaggtaccagacacgtcgcgctagtcagggcctgctcagctcaatagaaaattctgaaagcgatagttcagaagctaaggaagaagggagtaggaaaaaacgaagtggcaaatggaaaaataagtccaacgagagtgtcgatatacaagatcaggaagaaaaggttgttaagcaggagtgcattaaggccgaaaaccagtctcacgactataaggcaaccagtgaggaagacgtatccatcaagtctcctatctgtgagaagcaggatgagtccaacacagttatctgccaggactctacagtgacatcagacctccttcaggtgccagacgacctgccaaatgtgtgtgaagagaagaacgaaacgtccaaatacgcagagtactcctttacctccctgcccgtccccgaatctaacctacgcacgcggaatgcgatcaagaggcttcacaagcgggacagctttgataattgctctctgggcgagtccagcaagattggcatttccgacatttcttctctcagcgaaaaaacgttccagacgctcgagtgccagcacaaacgctcaaggcgagtgcgccgttccaagggatgcgactgttgtggggagaagtcgcagcctcaggagaagagcctgatcggcctgaaaaacaccgaaaataacgacgtcgaaatcagcgaaaccaagaaagctgacgttcaggctcctgtgagtccatccgaaacatctcaggccaatccgtactctgaaggacagtttcttgatgagcatcatagtgttaactttcacctgggtttgaaggaggataacgacaccatcaacgactccctgattgtaagtgaaactaaatccaaggaaaacacaatgcaggaatcccttccatccggaatcgtgaacttccgtgaggagatctgcgacatggatagcagcgaggccatgtccctggagtcacaggaaagtcccaacgagaacttcaaaactgtgggcccttgtctcggcgacagtaaaaacgtctctcaggagtctctggagacaaaggaggaaaagccggaagaaacccccaagatggaactttctctcgagaacgttaccgtggaggggaacgcctgcaaggtcaccgagagtaacctggagaaggctaaaacaatggagctgaacgtaggaaacgaagcctcctttcatggacaagaaagaactaaaactgggatcagcgaggaggcggccatagaggagaataagagaaacgatgactcagaagccgacacagctaaactgaacgcaaaggaggtcgccactgaggaattcaacagcgacatttccctgtcggataataccacacctgtgaaactgaatgcccagacagagattagcgaacagacggcggccggggagctggatggtgggaacgatgtgtccgacctacacagctcagaggaaacaaatacgaagatgaagaataacgaggagatgatgatcggggaagctatggctgagactggccacgacggcgaaacagagaatgaaggcatcaccaccaagacctccaaacccgacgaggctgagaccaatatgcttactgccgagatggataacttcgtctgcgacaccgtggagatgtcgactgaagaggggatcatagatgcaaacaaaacagagactaacaccgagtattcgaagagcgaagaaaaactggataacaaccaaatggttatggagtcagacatcttacaggaagatcatcatacgagtcagaaggtggaagagccttcccaatgcctggcttcgggaaccgccattagcgagcttattattgaggacaacaacgcctccccacagaaactgcgggagctagacccttctctcgtatccgctaacgactctccttcaggcatgcagacccgctgcgtgtggtcccccctggcctccccctccacttctatcttgaagagaggcctaaaaagatcacaagaggacgaaattagctctcccgtaaataaggtcagaagagtcagtttcgctgatcctatttaccaggccggactcgccgacgacatcgaccggcggtgttccatcgtgcggtcccatagcagcaattccagccctatcgggaagtcagtgaagacctctcccaccacccaatctaaacacaatacaacctcggccaaaggttttctgtcgcctggatctcgaagtccaaagttcaagtcctctaagaaatgtctcatctcagaaatggctaaagagtcaatcccatgtccaacggagtctgtgtaccctcccctggtcaactgtgttgcgcccgtggacattatcttgccacagatcacatctaatatgtgggctcgaggcctcgggcaactcattagagcaaagaacatcaagaccataggagatctgagcaccctgaccgcaagtgaaataaaaactctgccaattcgctcacctaaggtgagcaacgtaaagaaggccctaagaatctaccacgagcagcaggtgaaaacacggggactcgaagaaatcccggtgttcgacatctcagaaaaaactgtgaatggcattgaaaataagagcctatctccggacgaggaacgtctggtctcagatattatcgatcccgtagcattggaaatacctctgagtaaaaatctcttagcacagatttcagccctggcactccaattagattctgaggaccttcataattattcaggcagccagctcttcgagatgcatgaaaaattatcttgtatggccaattcggtcattaagaacctgcaaagtcggtggcgcagcccgagccatgagaactccatctag

SEQ ID NO: 26032 - DNA, 264 bp, Artificial Sequence
  Description of Artificial Sequence: Synthetic coding sequence
atgaccgcccggggccagagccccctggcccccctgctggagaccttggaggacccatctgcttctcatggtggccagactgacgcttatctcaccttgacgagtaggatgacaggagaagaaggcaaagaggtcatcacggagattgagaaaaaacttcctcgcctctacaaggtgcttaagacccacatcagtagccaaaattcagagttgtcttcagccgcgctgcaagccttaggattttgcttgtataaccccaaatag

SEQ ID NO: 26033 - DNA, 7341 bp, Artificial Sequence
  Description of Artificial Sequence: Synthetic coding sequence
atgaccgcccggggccagagccccctggcccccctgctggagaccttagaggatcctagtgctagccatggcgggcagacagatgcctatttgacactcacatcacgcatgacaggagaagaaggcaaggaagtgattacagagattgaaaagaaactccctcggctgtacaaggtgctgaagacccatattagtagccagaattcagagctctcctccgctgccctgcaggcactcggattttgtctctataacccgaaaatcaccagcgagctgtcagaggcaaatgccttggaactgctctccaagctgaacgacacgattaagaactcggataaaaatgtaagaacccgggccctgtgggtcataagcaagcagacatttcctagcgaggtcgtgggcaaaatggtcagtagcatcatagactctctggagatcctgttcaataagggcgagacacactccgcggtggttgattttgaggccctgaatgtgattgtgcgattgatcgaacaggcccctatccaaatgggcgaagaggcagtgcgctgggcgaaacttgttattccacttgtcgtgcacagcgcacagaaggtgcatcttcggggtgctacagctctagagatgggcatgcccttactcctccagaaacagcaagagatagcgtccattactgagcagcttatgaccaccaagttgatcagtgagttacagaaactgttcatgagcaagaatgagacctacgtgctgaagctttggcccctttttgtcaagttgcttgggagaacgcttcatcgctccggctcatttatcaacagcctccttcagttggaagaactcggattccgctctggcgctcccatgataaaaaaaatcgcctttattgcgtggaagtctctgatcgacaacttcgccctcaacccagacatcctgtgttccgccaagagacttaagttactgatgcaaccactctcatccatccatgtaaggacggagactcttgccctgaccaaacttgaggtgtggtggtatctcctcatgcgccttggcccccacctgcctgctaacttcgagcaggtatgtgtaccactcatacaatcaactatctctatcgactctaacgcatctccacagggaaactcatgccacgtggccacctctccgggacttaaccctatgactcccgttcataaaggtgcttctagtccatacggggcccccgggactcctcgaatgaatctctctagtaaccttggcggcatggccacgatcccctccatacagctgctggggctggaaatgcttttgcacttcctgctcggccccgaggcactgtcttttgccaagcagaacaaacttgtacttagcttggaaccactggaacacccactgattagcagtccaagctttttctcgaagcacgcaaatacactgatcacggccgtgcacgacagtttcgttgcggttggaaaggatgccccggacgtggtagtatccgcaatatggaaggaacttatttcactggtgaagtcagtcacagagtccgggaataagaaggagaagcccggcagtgaggtgctcacgttgctgttgaaatccttggagtcaatcgtgaagagtgaagtctttcctgtcagcaagaccctggtactgatggaaattaccattaaaggactcccgcagaaggtacttggctcacccgcttaccaggtggcaaatatggacatcttgaatggaacccccgcgctattcttaatccagctgatcttcaataattttttagaatgtggcgtttccgatgaacgctttttcctgtctctggaaagcctggtcggatgtgtcctgtcagggcctacatcgcccctagctttttccgattctgttcttaatgtcattaatcagaacgctaagcaattggaaaacaaagagcacctctggaagatgtggagcgtaatcgtcaccccgctcactgaactgatcaatcagaccaatgaagtgaatcagggggacgcgctggaacataactttagtgcaatctacggagccctaaccctgccagtaaatcatattttcagcgaacagaggtttcccgtggcaactatgaaaacgttgctgagaacatggtcagaactctatagggcctttgcgcggtgcgccgccctggttgccacagcagaagagaatctgtgctgtgaggagttatccagcaaaatcatgtcgtctttggaggacgaagggttcagcaatctattattcgtggaccggatcatatacattatcactgtgatggtagattgtattgacttcagcccttacaacatcaaataccaacccaaagtgaaaagcccccaacgaccttctgactggtccaaaaagaaaaacgaacctctgggaaagctgacctccctgttcaagcttatagttaaggtgatatactccttccatactttgtccttcaaggaagcacattccgatactttattcacaatcggaaactctatcacggggattatctctagtgtcctggggcatattagcctgccttccatgattagaaagatctttgcaacactgacaagaccattggcactattttacgaaaactcaaaactagacgaggtgccgaaagtttattcatgcctgaacaataaactcgaaaagctacttggggagatcattgcttgcctccaattcagctacaccggcacgtatgacagcgaacttttagagcaattgtcacctctcttgtgtatcatcttcttacataaaaacaagcagataagaaaacagtccgcacagttctggaacgcgacattcgcaaaagtaatgatgctggtctatcctgaggagcttaaacctgtcctgacacaagcaaaacagaaatttctgctgcttctccctggattggaaaccgtggagatgatggaagagtccagcgggccatactcggacggaacggaaaactcccagttgaacgtgaagatctcagggatggaacgcaagtccaacggtaaaagagatagcttcctggcccagaccaagaataagaaagaaaacatgaaacccgccgcgaagcttaaactggagtcaagtagtctcaaagtcaaaggcgagatcctactcgaggaggagaaatccactgactttgttttcatcccgccggagggtaaagacgcgaaggaacgcatcttgaccgatcatcaaaaggaagtgctgaaaacaaaacgctgcgacattcctgcgatgtataataacctcgacgtgtctcaggataccctctttacccagtactcccaagaggagccaatggagattcccaccctcacaaggaagcccaaggaggattccaaaatgatgatcaccgaagagcagatggattccgacatcgtgattcctcaggatgtcaccgaggactgtggcatggctgagcatttggaaaaaagctctttgagtaataacgagtgcggaagccttgacaaaacctctccagagatgtcgaattccaacaacgacgagcgtaaaaaagccctgatttctagcaggaaaacctcaacagagtgtgcaagcagtacagagaatagcttcgtggtgtcttctagctccgtgtcaaacactacagtcgctggaactccgccgtaccctactagccggaggcagacctttatcaccctggaaaaatttgatggatccgaaaatcgaccattttccccatcaccattgaacaatatctcttcaacagtgactgtcaagaacaaccaagagactatgatcaagacggacttcctgccgaaagccaagcagcgggagggcactttctccaagagcgactcagagaagatcgtcaacggaacgaagaggtcaagtcggagagccggaaaagctgagcaaacgggcaataagcggtcaaagccactgatgcggagcgaaccggaaaagaatacagaggagagcgtggagggaattgtggtcctggagaacaatcccccaggtctgctaaatcaaaccgaatgcgtcagcgacaaccaggtgcatttatccgaatcgacaatggagcatgacaatacaaaacttaaggctgccactgtagagaacgcagttctgctggaaactaacacagtcgaagaaaaaaacgtggaaatcaacctagaatccaaagagaatactcctcctgtggttatctcggccgatcagatggttaatgaagattctcaggtccaaattacccccaaccagaagaccctgcgccgtagtagccggcggagaagcgaggtggtggagagcaccactgaatcgcaagataaagagaactctcaccagaagaaggagagaaggaaagaagaggagaaacctctgcagaaatctccactccacattaaagatgacgtgctaccaaaacagaagctaattgccgaacaaaccctccaggagaatttaatcgagaaaggatctaacttacatgaaaagactctcggcgaaacctcggccaacgctgaaaccgagcaaaataaaaaaaaagctgatcccgaaaacatcaagtcagagggagatggcactcaagacatagtggacaagagtagtgagaagctcgtgcgcggcagaacaaggtatcaaactcggcgtgccagtcagggcctgctgagttctattgagaactctgagtcagattcctccgaagcgaaggaagaggggagccgaaaaaagcggtctggcaagtggaagaacaagtcaaacgaatctgtggacattcaggaccaagaggaaaaggtggtaaagcaggaatgtatcaaggctgagaatcaaagccacgattacaaggccacaagcgaagaggacgtcagcattaaatctccaatctgtgaaaaacaggacgagtccaataccgttatttgccaggacagcactgtgacaagtgatcttctgcaggtgcccgacgacttgcctaatgtgtgtgaggaaaagaacgagacctccaaatacgcggaatattcgttcacaagcctgcccgtgcctgagtccaatctcaggaccaggaatgccatcaagagactgcataagagagactcttttgacaactgttcactgggcgagagtagcaagattggcatctctgacatttcgtcactgtcggaaaagacatttcagactctggagtgccagcacaaaagatcaaggcgggttaggagaagtaaagggtgtgactgctgtggagaaaaatcccaacctcaagagaaatctctcattggcttaaagaataccgagaacaacgacgtcgaaattagtgaaacaaagaaagcagatgtccaggcacctgtgtccccaagcgagacctcccaggccaatccctattcggaagggcagttccttgatgaacaccactccgtcaacttccacttgggtctcaaggaagacaacgacacaataaacgactccctgattgtgtccgaaacaaagtccaaggaaaacaccatgcaagagtctctgcctagcggcatcgtgaactttcgggaagagatctgtgacatggattcaagcgaggcgatgtcacttgaatcacaggaatcaccaaacgagaattttaaaacagtcgggccatgcctgggagacagtaaaaacgtgagccaggagtccctggaaaccaaagaggagaagcctgaggagacaccaaaaatggagctgtctctagagaatgtcaccgtcgagggaaatgcctgcaaagtgaccgagagtaacctggaaaaagccaagactatggaacttaacgtcggtaatgaagctagttttcatggccaagaacggacgaagaccggaataagcgaggaagcagcaattgaagagaacaaacgcaatgacgattccgaagctgacacagctaaactcaacgccaaggaagttgcaactgaggaattcaatagcgatataagcctcagcgacaatacgaccccggtcaaattgaacgcccagactgagatcagcgaacagactgctgctggcgagcttgatgggggaaacgatgtctcagacctgcatagcagtgaggagacaaacacgaaaatgaagaacaacgaagagatgatgataggagaagccatggcggagacggggcatgatggcgagacagagaatgaagggatcactacaaaaactagcaaaccagatgaggccgagacgaacatgctgacagcagaaatggataatttcgtttgcgacacggtggagatgtcaacggaagagggaattatcgacgcaaataagacagagaccaatactgaatattctaaaagtgaggagaaactggataacaaccagatggttatggagtccgacatcctccaggaggatcatcacacatctcagaaagtggaagagccgtcccagtgtttagccagcgggactgcaataagcgagctgatcattgaggacaacaacgccagtccacagaaattacgggagctggatccttccctggtctcagcaaacgacagtccttccggcatgcagacaaggtgcgtatggagcccactggcttctcccagcacctcaatacttaagagaggactgaagcggagccaggaggatgagatcagcagtccggttaataaagtgaggagagtctccttcgccgatcccatttaccaggccggcctggctgatgacattgacaggcgttgtagcattgtccgcagtcactcttctaactcctcgccgatagggaagtctgttaagactagtcccaccactcagtccaagatttccgaaatggccaaagagtccatcccctgtccgactgagtctgtctatcctcctcttgtaaattgtgtggcccccgtcgacattatcctcccacaaatcaccagcaatatgtgggccagaggcttggggcaacttattagagctaaaaacatcaagacgattggggacctcagcaccctgaccgcatcagaaatcaagacactgcctatccgctcccctaaagtcagtaatgtaaagaaggccttgcggatctaccatgagcagcaggtgaaaacacgtggtctggaggagatcccggtgtttgatatcagtgaaaagacagttaatgggatagaaaacaaatctctgtctccagacgaagaaagactggtcagcgatattatagatccagtggccctggagattcccctgtctaagaacctgttggcccagatctcggctctggctcttcagctggattctgaagatctgcataactatagtggcagccagctgttcgaaatgcacgagaagctctcgtgcatggccaattctgtgatcaagaatctgcaatcccgctggaggtccccttcacacgaaaactcaatttag

SEQ ID NO: 26034 - DNA, 7341 bp, Artificial Sequence
  Description of Artificial Sequence: Synthetic coding sequence
atgaccgcccggggccagagccccctggcccccctgctggagaccctcgaagacccctctgcatcacatggcggccagactgatgcctatctgacactgacttctaggatgacgggcgaggaaggaaaggaggtgatcacagagatagaaaagaaactcccccgactatataaagtgctgaaaacgcatatcagctcccagaactctgagctgagttcagccgctctgcaggctttggggttttgtctatataatcccaagatcacatctgaactctctgaagcaaatgccctagaattgctgagtaaactgaatgatacaatcaaaaactcagacaaaaatgtgcggacacgcgccctgtgggtgatctccaaacaaacttttcccagtgaggtcgtcggcaagatggtaagtagcattattgactcactagaaattcttttcaataagggggaaacacacagtgctgtagtggatttcgaggccctgaacgtaatcgtgagactgattgagcaagccccaatccagatgggcgaagaagcagtgaggtgggcaaaactagtgatccctctcgtggtccacagcgctcagaaggtacacctccgaggcgccaccgcactcgaaatgggcatgccactcctgcttcagaaacagcaggagattgctagcataacagagcagctgatgacaactaagttaatcagtgagctacagaagctgtttatgagcaaaaatgaaacctacgtgctgaaactgtggccactcttcgtgaagcttttaggccgtacactgcaccgctcaggtagttttattaactcacttctacaactcgaagaactgggatttcgctctggagctccgatgattaagaaaatcgcctttatcgcatggaaatccctgattgacaactttgcgttgaatcctgacatcctgtgctctgctaaacgcttgaagttgttaatgcaacctttaagctccatccatgtacgaacagagaccctggctctcaccaagctggaagtttggtggtacctactgatgcgtctgggaccccaccttcccgcgaacttcgagcaggtctgtgtgccactgatacagtccactatttcgatagactcaaatgcctccccgcaggggaattcctgccatgtggccacaagccctggactgaacccaatgactccggtacacaaaggcgcttcctcgccttacggagcacccggaacaccccggatgaacctgtctagcaaccttggaggcatggccaccattccatcgatacaattacttggcctggaaatgctccttcactttctgctcgggcctgaagccctgtcattcgcaaagcaaaataagttagttctgagcctggagccccttgaacaccctctgattagttcaccgagcttcttctctaagcacgccaacactctcatcaccgccgtgcatgacagtttcgtggctgtggggaaagacgcacccgatgtcgttgttagcgctatttggaaagagctgatatctttagtcaaatccgtcacagagtctggcaacaagaaagagaaaccaggctcagaagtgctgacgctcctacttaaatctctggaaagcatagtaaagagtgaagtttttccggtctctaagactttggtgctgatggaaattaccataaaaggcctcccccagaaagtgctaggtagccccgcttaccaggtggcaaacatggatattctgaacgggacacccgctctctttctcatccagctgatatttaacaatttcctcgagtgcggggtgtccgatgagcgattcttcttgtctctagagagtctggtgggctgtgtcctgagcggaccaacttctcctctggcgttcagtgattccgtgctcaacgtcattaaccaaaacgccaagcaattagaaaacaaagagcatctgtggaagatgtggtcggtaatcgtcacacccctgaccgaactgattaatcagacaaatgaagtgaaccagggagacgctttagagcacaatttttccgcaatctatggggctctgacactacccgtaaaccacatattctcagaacagcggttccctgtcgctactatgaaaaccctgctgaggacctggagtgagctatatcgagctttcgctcggtgcgctgcccttgtggcaactgcggaggagaatctctgttgcgaggagcttagcagcaagattatgagtagtcttgaggatgaaggcttctccaacctcctgtttgtggaccgtattatatatattataactgtaatggtggattgcattgatttctctccatataatatcaagtatcagccaaaagtcaaatccccccagaggcccagcgattggtcaaaaaaaaagaatgagccgctgggtaaattgacaagcctgtttaaactgattgtgaaagtgatctacagttttcacaccctgtccttcaaggaagctcactctgataccttgtttaccatcggtaacagcatcacaggtattatttccagcgttctgggacatatttctctcccatctatgatccgcaagatattcgccactctgactcgcccactcgccctgttttacgagaatagcaaactggacgaagtgccaaaagtctacagctgtctgaacaataagcttgagaaactgctaggagaaatcatcgcctgtctccaattttcttacacgggaacctacgatagcgaactgctggagcaactgtccccccttctgtgcattatcttcctgcacaaaaataagcagatacgaaaacagtctgctcagttctggaacgccacctttgctaaggtcatgatgctggtctacccagaggagttgaagccagttctgacacaggctaaacagaagttccttctgctgcttcctgggctggagacggtggagatgatggaggagagttccgggccgtatagtgatggcaccgagaactcccagctaaatgtgaagatctctggaatggaaaggaagagtaacgggaagagggacagttttctcgctcagaccaaaaataaaaaagagaatatgaaacctgcggctaagctcaagctcgaatcttcatcactcaaggtcaagggagaaattctgttggaggaagagaaaagcaccgatttcgtgttcattccccctgaagggaaagatgctaaggagaggatcctaacggaccatcagaaggaagtcttaaagaccaagagatgcgatattcccgccatgtacaacaacctggatgtgagccaggataccctctttacacagtattcgcaggaagaaccgatggagattcctactctgacaaggaagcctaaggaagacagcaagatgatgatcaccgaagagcagatggacagtgatatcgttatccctcaggacgtcaccgaggactgtggaatggccgaacacctggagaagagttccctcagcaacaacgagtgcgggtcactcgacaagacgtcccctgaaatgtcgaattctaacaacgatgagcgcaagaaggccttgatcagtagcagaaaaactagtaccgaatgcgcgtcaagtacagagaattcgttcgtggtcagttcttctagtgtcagcaacaccaccgttgcaggcacaccaccttatcccacatctcggagacagacattcatcaccttggagaagtttgacgggtcagagaataggcccttcagtccttcccctctcaacaacatcagctcaacagtgactgtgaaaaataaccaggaaacgatgatcaaaaccgatttcttgcccaaggccaagcagcgagagggcacattctcaaagagtgatagtgagaaaatcgtaaacggcacgaagaggtcctccaggcgggctgggaaggctgagcaaaccggcaataagaggtctaagcccctgatgcgatccgagccagagaagaacactgaagagtccgtcgagggaatcgtggttctcgagaacaacccaccaggcttgctgaaccagaccgaatgtgtttccgacaatcaggtacaccttagcgagagtacgatggagcacgacaacactaagctgaaagctgctaccgtggagaatgccgtgctacttgagaccaatacagtcgaagagaaaaacgtagaaataaacttagaatctaaagagaacactccacctgtagtgatttcagccgaccaaatggtaaatgaggacagccaggtgcagataacaccaaatcagaagacactacgacgcagttcccgaagacgcagtgaggtcgtagagtcaacaacggagagccaggataaggaaaattcacaccagaagaaggaacggcgcaaggaggaagagaagcctctgcagaaaagtcccttacatattaaggatgatgtactgcctaagcagaaactgatagctgagcagactctgcaagaaaacctgatcgagaaaggaagcaacctgcacgaaaagaccctgggtgagacatccgctaacgccgaaactgaacagaacaaaaagaaggccgaccctgagaatatcaaaagtgagggcgatggaactcaggacattgtggacaaatcctccgagaaattggtgcggggacggacacggtatcaaaccagaagggcctcacagggcctcctgtcttcgatagagaacagtgagtctgactctagtgaagcaaaggaggaaggctccaggaaaaagcggagtggaaagtggaaaaataaatctaacgagtctgtggacatacaggatcaagaagaaaaggtggtgaaacaagaatgcattaaggcagaaaatcaaagccacgactacaaagcgacatcggaggaggatgtttccatcaaatcaccgatttgcgagaagcaggatgagagtaacaccgtgatctgccaggactctacagtcaccagcgacctgctgcaagtgcccgatgacctacccaatgtttgcgaagagaagaatgaaaccagcaagtacgctgagtactccttcacttcgctgccagtcccagagagcaacctaagaacgagaaacgctatcaagcgcctgcataagagggacagctttgataactgcagtcttggggagagtagcaaaatcggtatttctgacatttcaagtctttctgagaagacctttcagacactggagtgccagcataagcgctcgcggcgtgtgcgacgttcaaaggggtgtgactgctgtggcgagaagtcccagccacaggagaagtctcttatcggacttaaaaacacggagaacaacgacgtagagatcagtgaaaccaaaaaagctgacgtacaggcaccagtatcccctagcgagacctcccaggctaacccttactcagaggggcagttcctggacgaacatcactctgtgaatttccaccttggccttaaggaggataatgataccataaacgattctctgattgtgagtgagactaagagtaaggagaacactatgcaagaaagcctgccttctggcatcgtgaatttccgagaggagatctgcgacatggactcctctgaggccatgagtctggaaagccaggagtccccgaacgagaattttaagacagtcggaccatgtctgggggacagcaagaatgtcagccaagagtccttagagaccaaggaggagaaacccgaggaaaccccaaaaatggagcttagcttggagaatgtgaccgtcgaaggtaacgcgtgcaaggtcactgagtctaacctggaaaaggccaaaaccatggaactcaatgtgggcaatgaggcctcatttcacgggcaagagaggactaaaaccggcatttctgaagaggcggccatcgaggaaaacaagcggaacgacgactcagaggcagacacggccaagctcaacgccaaggaagtggccaccgaagagttcaacagcgacatctccctttccgataacacaacccctgtcaaactgaacgctcagactgagatctccgagcagacagccgccggcgagcttgacggaggaaatgatgtgtcagacctgcattcatcagaggaaacaaatacaaaaatgaaaaataatgaggagatgatgataggggaggcgatggccgaaactggacacgatggtgagaccgaaaatgaaggcattaccactaaaacgagcaaacctgacgaggccgagacaaatatgttgactgccgaaatggataactttgtctgcgataccgtggagatgtctactgaggaggggattatcgacgctaacaagaccgaaaccaataccgaatattccaagtcggaagagaaactagataacaatcaaatggtcatggagtctgatattctgcaagaggatcatcatacttcacaaaaggtcgaagagccttcacagtgcttagccagcgggacagctatctccgaactgatcatagaagataacaacgcctctccccagaaattgagagaactggacccgtccctggtcagcgcaaacgacagcccaagtggcatgcaaaccaggtgcgtctggtcacctctggcctccccttccacaagtatccttaaacggggcctcaaacgctcacaggaagatgagatttcgtcccctgtcaacaaggtacgaagagtgtcttttgctgacccaatctatcaagcagggttagctgatgacatcgaccgccgatgctcaatcgtcaggagccacagttcaaactcctcgcccattggtaagtccgtcaagaccagtccgacgacacaatcaaaaatctcagagatggcaaaagaatccatcccctgcccaactgagtccgtatatccccctctcgttaattgtgttgctcctgtcgacatcatactacctcagatcactagcaacatgtgggctcgaggtctcgggcaactgatcagagcgaagaacatcaagacgattggtgacctgtctacgctcactgcaagtgaaatcaaaaccttgcctattaggagcccaaaggtgtctaacgtgaagaaagcactccgcatttaccacgagcaacaggtgaagactcgaggtctggaagagattcccgtgtttgacattagtgaaaaaactgtcaacgggatcgaaaacaaatctctctcacccgacgaagaaagattggtgagcgacatcatagacccagtagctttggagatccctctctccaagaaccttttagctcaaatttccgcgctggcattgcaactggactccgaggatctgcacaactacagtggatcccaattattcgagatgcacgaaaagctgtcatgtatggccaatagcgtgataaagaatctgcagtctaggtggcgctccccctcccacgaaaattccatttag

SEQ ID NO: 26035 - DNA, 1026 bp, Artificial Sequence
  Description of Artificial Sequence: Synthetic coding sequence
atgaccgcccggggccagagccccctggcccccctgctggagaccctggaagacccttcagcctctcatggcgggcagaccgacgcctatctgaccctgactagccgaatgacgggagaagaaggaaaggaggtgatcacagagatagagaagaaactcccgcgtctatacaaagtgctgaaaacccacatctcatcgcagaactccgagcttagcagcgccgcactgcaagccctcgggttttgtttgtacaaccccaaaattactagtgagctctccgaggcgaatgctctcgagttgctgtcaaaactcaacgatacaattaagaactcggacaagaatgtcagaacgagggcactgtgggtcatatccaagcagaccttccccagcgaggttgtaggtaagatggtctcatccattatcgatagtctagaaattctgtttaacaagggtgagacacattccgccgtggtggattttgaggccctaaatgtaatcgtgagactcatcgagcaggctccgattcaaatgggagaggaagcagtaaggtgggccaagcttgtgatccccctggttgtgcactcagcccagaaggtgcatctgaggggtgccacagctctagagatgggaatgcccctgctactgcagaaacagcaggaaatcgcaagtattactgagcagcttatgaccacaacacttcaccgctccgggagttttataaattcactgctccagttagaggaattgggcttccgtagcggcgcccccatgatcaagaaaattgcttttatcgcttggaaaagtctgattgataacttcgcacttaatcccgacatcttgtgctccgccaaaagactgaaactgttgatgcagcccctgagcagcattcatgtgcggactgaaaccctggcgctgactaaactggaggtgtggtggtaccttctgatgagactgggcccccatctgccagcaaatttcgaacaggtgctgccaccccggacagagccgcgcgaactcccagaatag

SEQ ID NO: 26036 - DNA, 7419 bp, Artificial Sequence
  Description of Artificial Sequence: Synthetic coding sequence
atgaccgcccggggccagagccccctggcccccctgctggagaccctggaagatccttctgccagtcacggaggccagactgatgcctatttgacccttacctctagaatgaccggggaagaaggaaaagaagtcattacagaaatcgagaagaagttgccaaggctttacaaagtgctgaagacacatattagctcccagaatagcgaactgtcctctgccgcgttgcaggcccttgggttctgcctgtacaatcccaaaataacctccgagctcagcgaggccaatgcccttgagctgctaagtaaacttaatgacaccataaagaactcggacaagaacgtgcgcacccgggccctgtgggtcatctctaaacagacgttcccctccgaggttgtgggaaagatggtgagtagcatcatcgattcgttggaaattctgtttaataagggcgaaacacatagtgccgtggttgattttgaagcgctgaacgtgatcgtcagactgattgagcaggcacccattcaaatgggcgaggaggccgtgcgatgggccaagctggtaatcccattggtggttcactccgcacagaaggtgcatctaagaggggccaccgccctggagatgggaatgcctctgctcctacagaaacagcaggagatcgcctccatcaccgagcagctgatgaccaccaagcttatctccgagctgcagaagctgttcatgtccaagaacgaaacttatgtgctgaagctttggccactctttgtcaagctattgggaagaactcttcatcggtctgggtctttcataaacagcctgctccagctagaggagctcggctttcgatccggggcgccaatgatcaaaaaaatagccttcattgcctggaagtccctaatcgacaatttcgccctgaaccctgatattttgtgtagtgccaagcgcctgaagctcttgatgcagccgttaagttctattcacgtcaggaccgagactctggcgttgacaaaactagaggtttggtggtacctcctcatgaggttaggacctcacctgcctgctaatttcgagcaggtttgtgtgcctctcatccagtctaccatttcgatcgacagtaatgcatcaccacagggcaatagctgtcacgtggccacctctcccggcttaaacccaatgacaccagttcataaaggggcgtcaagcccatatggtgcgcccgggaccccacgcatgaacctgagtagtaatctggggggaatggctacgatcccctccatacagttgctcggtctcgaaatgttgctgcacttcttgctcggacccgaggcattgtcatttgctaagcaaaacaaactcgtgctgtctctggaacccttagagcaccccttgatttcaagtccttctttcttctcaaaacacgcgaatacactgatcactgctgttcacgacagctttgtcgcggtgggtaaagacgcacccgacgtcgtggttagcgctatttggaaggagctgataagcctagtcaaatccgtaacagaatccgggaacaagaaggaaaagccgggaagcgaagttctaacgcttctcctgaagagcctagagtcgatcgtaaagtctgaagtttttccagttagcaagacccttgtcctgatggagatcacgataaaagggctccctcagaaagtactgggcagtccagcttaccaggtcgctaacatggatatcctcaacggcactcccgccctgttcctaatccagttaatattcaacaatttccttgaatgcggcgtgagtgacgaaagatttttcctgagcttggaatcgcttgtcgggtgtgtgctgtcaggacccacctctccactggctttctcggacagcgttttgaatgtgataaatcagaatgctaagcaattggaaaataaggagcacctgtggaaaatgtggtctgtcattgttactcccttgacagagctgattaaccagaccaatgaggtaaatcagggggatgcactagagcacaacttcagcgctatatatggcgctctcacattacccgttaaccacatcttctcggagcagaggtttcctgtagccaccatgaagacactcctccggacttggtccgaactttatagagcgtttgcgcgttgtgcagctctcgtcgccacggccgaagaaaatttgtgttgcgaggaattgagcagcaagatcatgtcaagtttggaggatgaaggctttagtaatctcctgtttgttgacagaataatctacattattaccgtgatggttgactgcatcgacttctccccgtacaacattaaatatcagcctaaagtcaaatccccgcagcgcccttccgattggtcaaagaaaaagaacgagccattaggtaaactgaccagtctgttcaaacttatcgtgaaagtcatctattcttttcacaccttatcttttaaggaggcccactccgatacactctttactatcggtaattcaatcactggaatcatcagctccgttctgggtcatattagtctcccaagtatgatccgcaagattttcgctactctaacccgtcccctggccctgttctatgaaaatagcaagctagacgaggtcccaaaggtgtactcctgcctgaacaataagctggagaagctgctcggagagatcattgcctgtctccagttctcctatactggcacttatgacagtgagctgcttgagcagctaagtcctttgctctgcatcatcttcctgcacaagaacaagcagatccgtaagcagtccgctcaattctggaacgctacctttgcaaaggtgatgatgcttgtttatccggaagagcttaaaccagtgctgacccaagccaaacaaaagtttctgctcttgttacctgggctggaaactgtggaaatgatggaggagtcatccggcccctacagcgacggaactgagaactctcagttgaatgtcaagatcagtggaatggagagaaagtccaacgggaagcgcgactccttccttgcccagacaaaaaataagaaggagaacatgaagcccgcagccaaattgaagttagagtcctcgtcgctgaaggtcaaaggtgagattctgttggaggaggagaaaagcacggactttgtctttattcctcctgaggggaaggatgcgaaggaaaggatcctcacagatcaccagaaggaagtgctgaaaacaaagcggtgcgatatacccgcaatgtacaataatctggatgtgagccaagataccctcttcacgcaatatagccaagaagagcctatggagatcccaacacttacaaggaagcccaaagaagactccaaaatgatgatcacagaagagcagatggacagcgacattgttatccctcaagacgtcaccgaagactgtgggatggctgaacatctggagaagtcctcgctgtccaacaatgagtgcggctctctcgataagacaagtcctgaaatgagcaatagcaataatgatgagcgtaagaaagcactcatatcatcgcgaaagacctcaaccgagtgcgcttcttcaaccgagaacagttttgtggtgtcaagcagctccgttagcaacacaacagtggcaggaaccccaccttatccgacctcccggcgtcagacatttataaccctggaaaaatttgacgggtccgagaataggccgttttcccccagcccgctaaacaatatttcatccacggtgacagttaaaaataatcaggaaaccatgataaagaccgactttctgcccaaagccaagcaacgggagggaacgttctctaaatctgactcagagaaaatagttaatggcaccaaacgctcctcaagaagggctggaaaagccgagcagactggcaataagagatcaaaaccactgatgcgatccgaacctgagaaaaatactgaggaatccgtggagggcatcgtggtcctggagaacaatccacctggcctcctcaaccagaccgaatgtgtgtcagataaccaagtacacctctcagagagcacaatggagcatgataacactaaactaaaagctgcaactgtagagaatgccgtgttgctcgaaactaatacggtggaggaaaaaaatgtcgagattaatctggaatctaaagagaataccccacctgtagtaatcagtgccgatcagatggtgaacgaggatagccaagtccaaattaccccaaaccagaaaactctccggcgtagtagtcggagaagatccgaagtagttgagtctacaaccgaatcccaggacaaggagaactcccatcagaagaaagagagacggaaagaggaggaaaaaccacttcagaaatccccgctgcacataaaggacgacgtgctacccaagcagaagctgatagcagagcaaacgcttcaggagaatcttatcgaaaaaggttctaatctgcatgaaaaaaccctcggagagaccagcgctaatgccgagacagagcagaacaagaagaaagcggaccctgagaacataaagtcggaaggcgatgggacgcaagacattgtagataagtctagcgaaaagttagtcagaggacgtactcggtaccagacaaggcgagcatcccagggtctgctctcatctatagaaaattccgaaagtgattcgagtgaggctaaggaagaggggagcagaaagaagaggagtggcaaatggaagaataagagcaatgagtctgtcgacatccaggatcaggaagagaaggtcgtgaagcaggaatgtataaaagccgaaaatcagtcccatgattacaaggccacttcagaggaggacgtgtcaattaagtctccaatttgcgaaaagcaggacgaaagcaatacggtgatctgtcaggattctactgttacatctgatctcctccaggtgcccgacgatctgccgaatgtctgcgaggagaagaacgaaacctctaaatacgccgaatacagctttacttcgttacccgttcccgaatcaaatctccggactcgaaatgcgatcaagcggcttcataaacgagatagctttgataactgcagcctcggtgagagttccaagatcggtatttcagacatctcttctctcagcgagaaaacttttcagaccctcgagtgccaacacaagagatcccgccgcgtgcgtcgatctaaaggttgcgactgctgtggtgagaaaagccagcctcaggagaagagtcttatcggacttaaaaacactgaaaacaacgatgtcgagatctcagagactaagaaagcggacgtgcaggcaccagtttccccttcagaaaccagccaggccaatccatatagcgagggacagttcctggacgaacatcacagcgtgaacttccatctggggctcaaagaagataacgatactatcaatgatagcctgatcgtcagcgaaaccaagagtaaagaaaacaccatgcaggagtccctgccctccggcattgtcaatttcagggaggagatatgcgacatggactcatcagaggccatgagtctggaatctcaggagagccccaacgagaacttcaaaacggtgggcccatgtctgggagattcaaagaacgtgtcgcaggagtctttggagaccaaggaggaaaagcctgaagagacacctaaaatggaattaagcttagagaatgtaaccgtggaaggaaacgcttgtaaggtgaccgaaagcaatcttgagaaggccaagaccatggagctaaacgtggggaatgaagcctcgttccatggccaagaacgcactaagaccggcatttccgaggaagctgccatcgaggagaataagcggaatgacgactctgaagcagacacagccaaactgaacgccaaggaagtagccaccgaagaattcaattccgatatctccttaagtgataacacgaccccagtgaagctcaatgcccagactgagatttcggaacagactgccgccggagagctggatggtggcaacgatgtctctgatctgcacagctccgaagagacaaacactaaaatgaaaaacaacgaagaaatgatgataggagaggctatggccgagaccggacacgatggggagaccgagaatgagggcatcactaccaaaacctcaaaacccgacgaagcagaaacaaatatgctgaccgccgaaatggacaattttgtctgtgacaccgtagagatgagtacggaagagggcatcatcgatgctaataaaacagagacgaataccgagtattctaaatctgaagagaaactggataacaatcagatggttatggagtccgacatcctgcaggaagaccatcatacgagccaaaaggtggaggaacctagtcagtgcttagccagcgggacggcaatttcagagttaatcatagaggataataatgcatccccgcagaagctccgcgagctagatccctccttggtgtccgccaacgacagcccttccggtatgcagacccgctgtgtctggtcccccttggcaagtccctcgaccagcatcctgaaacgcggcctgaaaagatcacaggaagatgagatctcctcacctgttaacaaagtgcggagagtgagtttcgccgaccctatctaccaagcgggcctggccgacgacatagaccgtcgatgttcgatcgtacggagccatagctcaaattctagccccatcggaaagtccgtgaagacctctccaactacacaatccaagcataatacgaccagcgccaaaggattcctcagcccagggtctaggagcccaaagtttaagagctccaagaagtgtctcatctcggagatggctaaagagtcaatcccgtgcccgactgaatctgtgtacccccccctggtgaactgtgtggctcctgttgacattatcctgccacagatcacctctaatatgtgggcccggggcctgggacaacttatccgcgctaagaatatcaaaacaataggagatctaagcacattaacagcttctgagatcaagacacttcctatcagatcaccgaaggtgtctaacgtgaagaaagccttacggatttaccatgagcaacaagtgaagacaagaggcttagaggaaatccccgttttcgacatttcggagaaaaccgttaatgggattgagaacaagtccctgagtccagacgaggagcgcctcgtgtcagatattatcgacccagtcgcccttgaaattccgctgtctaagaacctcctggcgcagatttccgcactcgctctgcagcttgattccgaagacttgcacaactactccgggtcccagctgtttgagatgcatgagaagctgagctgcatggctaattccgtgatcaaaaatctgcagtcacggtggcgcagtccttcgcacgaaaattcgatatag

SEQ ID NO: 26037 - DNA, 7341 bp, Artificial Sequence
  Description of Artificial Sequence: Synthetic coding sequence
atgaccgcccggggccagagccccctggcccccctgctggagaccctcgaggacccatcagcatcccatggcggccaaacagatgcctacttgaccctgactagcagaatgacaggcgaagagggaaaggaggtcatcaccgagattgagaagaaacttccaagattgtacaaggtcctaaagacccatattagttcccaaaattccgagctgtcttcggcagcactgcaagccctggggttttgtctgtataatcccaagattacctccgaactgtcagaggccaacgcgctcgaactactctctaaactgaatgacactatcaagaatagtgataagaacgtgcgcactcgcgccctgtgggtaatcagcaagcagaccttcccatcagaagtcgtaggcaaaatggttagctcaatcattgattcactggagatcctctttaataagggcgagactcacagcgccgtggtggactttgaggctctaaacgtgatcgtcagactgatagagcaggcccccatccagatgggtgaggaagccgtccgatgggctaagttagtgatccccttggtggtgcactccgcccagaaggttcatctgcgaggggccaccgctctggaaatgggcatgcctctgttgctccaaaaacaacaggagatcgccagcattacggagcaactgatgacgacaaagctgatttccgaactgcagaagctgttcatgtcgaagaacgagacttatgtcctaaagttatggcccctatttgtcaagttgctgggacgaacgctgcaccgaagcggctcatttatcaacagcctcttgcagctggaagaattgggctttcgttccggagcaccaatgatcaagaagattgcctttatcgcctggaagagcttaatcgacaatttcgcactgaatcccgacatactctgttcagctaagcgattaaaactgctgatgcagcccctgagctcaatccacgtgcggactgaaaccctggcattgaccaagctagaagtgtggtggtacctgctgatgcgccttgggccccacctgcccgccaactttgagcaggtgtgcgtaccattaattcaaagcacaatttcaatcgattccaatgcctctcctcagggaaacagttgccacgtggccacctcacctgggctgaaccctatgaccccagtgcacaagggagcttcatctccctatggtgcacctggcaccccacgtatgaacctgtcttccaatctgggggggatggctactattcccagtatccagctgctcggcttagagatgttactacacttcctgctggggccagaagcattgtctttcgcaaagcagaacaaattggtgctgtcccttgagcctctggagcaccctttaatcagctccccctcattctttagcaagcacgccaatactctgataaccgcagttcacgatagcttcgtggccgtcggtaaagacgcacctgacgtggtggtttcagctatatggaaagagttaatttctctcgtcaaatcagtgacagagtccggcaataaaaaggagaagccgggatcagaggtcctgacgctgcttctgaagagcctggaatctatcgtcaaaagtgaagtgtttcctgtgagtaaaacactggtgcttatggagattaccattaagggactgccacagaaagtgctgggaagtccagcctaccaggtggctaacatggacattctgaacggaactcccgctctgttcctcatacagcttatctttaataatttcctggaatgcggagttagcgacgagagattcttcctctcactggagtcactcgtggggtgcgtgctgtccggcccaacaagtcctctggccttttcggactctgtgctcaatgtcatcaaccagaatgccaaacagctagagaacaaagagcatctatggaagatgtggtctgtgatcgttacgcccttgacagagcttatcaaccaaactaatgaggtaaatcagggggacgccctggagcacaatttcagtgctatttacggagccctcacgctaccagtcaaccatatattcagcgagcagagattcccggtggcaacaatgaaaactctgctgcgtacctggtctgagttgtacagagccttcgctagatgcgccgctctcgttgctactgctgaagaaaacctgtgttgtgaagaactgagtagcaagattatgagcagtcttgaagacgaagggttttccaatcttctgttcgttgatcggattatttacattataaccgtcatggtggattgtatcgatttctctccttacaacatcaagtatcagccaaaagtcaagagtccccagaggccaagcgattggtcaaagaagaagaatgagcccctgggtaaacttacctcgttgttcaagttgatagtcaaagtgatttattcttttcacacattgagctttaaggaagcgcatagcgatacactgttcactatcggcaactcaattacgggcattataagctctgtactgggccatatctctctgccatccatgatccgtaaaattttcgctacattgactcgaccactggctctattttatgagaactctaagctggatgaagttccaaaagtatacagctgcttgaataacaagctcgagaaactgctcggagaaatcatcgcctgtctacaattttcttacacaggaacgtatgattcagagttactggagcagctgtctccgctgctgtgtattattttcctgcataagaacaaacagataaggaaacagtccgcgcagttttggaatgcgacatttgctaaggtaatgatgctagtttaccccgaagagctgaaacctgtactcacccaagctaaacagaaatttctgctcttgctccccggactcgagacagtggagatgatggaggagtcaagtggcccctactccgatggaaccgagaattcgcagctgaacgtaaaaatctccggaatggagcggaagtccaatgggaagagagactctttcctggcgcagactaaaaataagaaagagaacatgaagcccgctgctaagcttaaactggagtcctcttctctgaaagtgaagggcgagatcctcctcgaggaggagaagtcgacagattttgtgtttataccacccgaaggtaaagacgccaaagaacgaatactcaccgaccaccagaaagaagtgcttaagactaagcgatgcgatatacccgctatgtacaataatttagatgtcagccaggacacacttttcacccagtatagtcaggaagaaccaatggagatcccgaccctaacaagaaaacccaaagaagactctaagatgatgatcacagaagaacagatggacagtgatatcgtgatcccccaagacgttacggaggactgcggtatggccgagcacctggagaaatctagtttgtcaaacaacgagtgtggctctctcgataagacctcacccgaaatgagcaattctaacaatgatgagaggaagaaagctctgatttccagtcggaagacatcgactgaatgtgcatcttccactgaaaattcctttgtcgtgagcagttcttctgtcagtaacaccaccgtagccgggacacccccatatcctacaagtaggagacaaactttcataacgcttgaaaagttcgatggctccgagaatcggcctttttctccaagccctctgaacaacatcagctccaccgtcacggtgaagaacaaccaggaaaccatgattaaaaccgacttcttgcctaaagccaagcagagggagggcacatttagcaaaagtgatagtgagaagattgtgaatggaaccaagaggagctctcggcgggcaggaaaagccgaacaaactggcaacaaaaggtcgaagccactcatgcgttcagagcccgaaaaaaacaccgaggaaagtgttgaggggatagtggtactggagaacaatccccctgggttgctgaatcagaccgagtgtgtgtctgacaatcaggtacacctcagtgagtccacaatggaacatgacaacacaaaactaaaagccgccactgtagagaatgctgtactcctggaaaccaatactgtggaggagaagaacgtggagattaacctggaatcaaaggaaaatactcctccggtggtcatcagcgccgatcagatggtgaacgaagactcccaagtgcagattaccccgaaccaaaaaacgctccgcaggtcttctcgccgacggtcagaagttgtggagagtacaaccgagtcgcaggataaggaaaattcccaccaaaagaaggagcggcgaaaggaggaagagaaacccctgcagaagtcccctctgcatattaaagatgatgtgctgcctaaacagaagctgattgccgagcaaaccttgcaagagaacctgatagaaaagggatccaacctccatgaaaaaaccctgggtgagacatcagctaacgctgagaccgagcagaacaagaagaaggccgacccagaaaacattaagagtgagggggacgggacccaggatatcgttgacaagtcctccgaaaagctggtgaggggccgcacccgatatcagaccaggcgcgcctcgcagggcctgctgagctcgattgagaattctgaatcagatagcagcgaggccaaggaagaaggaagccggaagaaacgctcgggtaaatggaaaaacaaaagcaatgagagcgtcgacattcaggatcaggaggaaaaggtggtgaaacaggaatgcatcaaggcagagaatcagagccacgactacaaagccacctcagaagaggacgtcagcattaagagccctatttgtgagaagcaggatgaatcaaacactgtcatctgccaggactcgactgtgacttccgatcttctgcaggtgccagacgatctgcctaacgtgtgtgaggagaaaaatgagacctccaagtatgcggagtattcctttacgtctctgcccgtgcctgagtctaacctccggacgagaaacgccattaaaagacttcacaaaagagactccttcgacaattgttcactcggagagtcttcaaagattgggatttcggacatatcgagtctcagtgagaaaactttccagaccctggagtgtcagcacaaacggtctcgtcgggtgagaagaagcaagggttgtgactgttgtggcgagaaaagccagccacaggaaaagagtctgatcggcctgaagaatacagagaataacgatgttgagatttccgaaacaaaaaaagctgatgtccaagccccggtcagccccagtgagacaagtcaggcaaacccttacagcgagggtcaattcctggacgaacatcacagcgtgaactttcaccttggcctaaaagaggacaatgacaccattaatgattcgctgattgtctctgaaacaaaaagcaaggagaacaccatgcaggagagtttacctagtggaatcgtaaacttcagagaagaaatctgcgatatggattcttcggaggctatgtccctggaatcacaggagtcaccgaatgagaattttaagaccgtcggtccatgcctcggggactctaaaaacgtttcacaggagagtctggagacaaaggaagaaaaacctgaagagacaccgaaaatggaacttagtctcgaaaacgtgacagttgaggggaatgcgtgcaaagtgacagagtccaacctggaaaaggcaaaaactatggaactaaatgtcggtaacgaagccagttttcatggccaggaacggactaagactggcatctccgaggaagctgctatagaagagaataagaggaatgatgattctgaggcggatactgccaagctgaacgcaaaggaagttgctactgaagagttcaacagcgacattagcctatccgacaatacgacaccagtcaaactcaacgcccagactgagatttcagagcaaactgcagccggcgagctggatgggggcaacgacgtgagcgacctacattcctccgaagagaccaacacaaagatgaagaacaatgaagagatgatgattggcgaagctatggccgagacagggcacgatggagagacagaaaacgagggaattacaacaaagacctcgaagcccgatgaggctgagaccaatatgcttacagccgagatggacaatttcgtgtgtgatacggtcgagatgtcaacggaggagggtatcattgatgcaaataaaacagagactaatacggagtattcgaaatctgaggagaagttagataacaaccaaatggtgatggaaagcgacatcttacaggaggaccaccatactagccaaaaggttgaggagccatctcagtgtttagctagcggtactgcaatcagtgaattgattattgaggataataatgctagtcctcaaaaattgagagagttagatccttccctggtgagcgccaacgactccccctcgggtatgcaaactagatgcgtctggagccctctggcttccccatccaccagcattttgaagagaggcctgaagcggtctcaggaggacgaaataagcagcccggtgaataaggtgcggagagtttccttcgctgaccctatctaccaagcaggcctggccgacgatatcgatcgccggtgcagcattgtgaggtcacatagctccaactccagtccaatcggcaaatccgtgaagacgagccctactactcagagcaagatttccgagatggcgaaggaaagcattccatgccccaccgaaagtgtgtatccccctctcgttaactgcgtcgcaccagtcgacattattctgccccagattaccagtaatatgtgggcccgggggcttgggcagctaatacgggccaagaacatcaaaaccattggggatctgtctactctgaccgcttctgagattaaaacactccctatccggagccctaaagtgtcgaatgttaaaaaggcacttagaatttaccatgagcagcaggtgaaaaccagaggactcgaagaaattcccgtttttgatatttctgaaaagaccgttaacgggatcgagaacaaaagcttgagtccggatgaggagcggctcgttagcgacattatcgaccctgtggctctggagatacctctctccaagaatcttctggcgcaaatctctgccttggccctgcagcttgactctgaagacctgcacaattactcgggcagtcagttgtttgaaatgcatgagaagctcagctgcatggccaattccgtcatcaaaaatctgcagtcaaggtggaggtctccctctcacgagaattccatttag

SEQ ID NO: 26038 - DNA, 555 bp, Artificial Sequence
  Description of Artificial Sequence: Synthetic coding sequence
atgcgggagtacaagctggtggtgctgggcagcggcggcgtgggcaagagcgcgcttactgtgcagttcgttcaaggcatcttcgtagagaaatatgatcccacaattgaggactcctacaggaaacaagttgaggtggattgtcagcagtgcatgctggagattctggatacagcggggactgagcagttcacggctatgagagatctatatatgaaaaatgggcaaggatttgcccttgtgtactctattaccgctcagtcaactttcaatgatcttcaggatctcagggagcaaatcctgagggtaaaggacacagaagacgttccaatgatattggtgggcaacaagtgtgatctggaagacgaaagagtggtggggaaggagcagggtcagaatctggcccgacagtggtgtaattgtgcctttttagagtcttccgccaagagtaagatcaacgtcaatgagattttttacgaccttgtccggcagatcaacaggaaaactcctgtggagaaaaaaaaacctaagaaaaaaagctgccttcttttgtag

SEQ ID NO: 26039 - DNA, 555 bp, Artificial Sequence
  Description of Artificial Sequence: Synthetic coding sequence
atgcgggagtacaagctggtggtgctgggcagcggcggcgtgggcaaatcagctctgacggtccaattcgtgcagggaatctttgtcgaaaagtacgatcctaccattgaagactcttaccggaagcaggtagaagtcgactgtcaacagtgtatgctcgaaatccttgacacggccggaacggagcagtttactgcgatgagggatctctatatgaagaacgggcagggattcgccctggtgtactcgattaccgcacagtcgacatttaatgacctgcaggatctccgggaacagattcttagggtcaaggacactgaagatgttcccatgatactggtgggtaacaagtgtgatctggaggacgaacgcgtggtcgggaaggaacagggccagaatctggcacgccaatggtgcaactgtgcgttcttggagagcagtgctaagtctaagattaatgtgaatgaaattttctacgatctggtgcgccaaattaatcgtaaaactcctgtggaaaagaaaaaaccaaagaagaaatcctgtttgctcctgtag

SEQ ID NO: 26040 - DNA, 390 bp, Artificial Sequence
  Description of Artificial Sequence: Synthetic coding sequence
atgcgggagtacaagctggtggtgctgggcagcggcggcgtgggcaaatctgccctgacggtccaatttgtgcagggcatctttgtagaaaagtatgaccccaccatcgaagactcgtataggaaacaagtcgaagtcgactgccaacagtgtatgttggagattctggacaccgctggcacagaacagttcactgcaatgcgtgacctatacatgaagaatggccagggctttgccttggtgtacagcatcacagcacagagtacttttaacgaccttcaggatctgagggagcagattcttcgggttaaagatacagaggacgttccaatgatcctggtgggaaacaaatgcgatcttgaagatgaacgggtggtaggcaaggagtag

SEQ ID NO: 26041 - DNA, 555 bp, Artificial Sequence
  Description of Artificial Sequence: Synthetic coding sequence
atgcgggagtacaagctggtggtgctgggcagcggcggcgtgggcaagagcgccctgaccgtgcaattcgtccagggtatttttgtcgagaaatacgatcccaccatcgaggacagctacagaaagcaggtggaggtggactgtcaacagtgtatgctggagatactggacactgccggaacagaacagttcacagccatgagggacctgtatatgaagaatggccagggattcgccttagtctatagtatcacagctcagtccacattcaatgacttgcaggacctgcgcgagcagatcctgagagtgaaagacacagaggatgtccccatgattttggtgggtaataagtgtgatttagaagatgagagagtcgtggggaaggagcagggccagaacctggccagacaatggtgtaactgtgccttcctggaatccagtgccaaaagcaaaattaatgtcaacgaaatattctatgacctggttcgccagataaataggaagacacctgtcgagaaaaaaaaaccaaaaaaaaaatcctgcctgctgctgtag

SEQ ID NO: 26042 - DNA, 555 bp, Artificial Sequence
  Description of Artificial Sequence: Synthetic coding sequence
atgcgggagtacaagctggtggtgctgggcagcggcggcgtgggcaagagtgcactgacagtgcagttcgtgcagggtatcttcgtcgagaagtacgaccccaccatcgaagacagctatagaaagcaggtggaagtggattgccagcagtgcatgcttgagattcttgatacggctggcacagagcagtttaccgccatgcgggacctttacatgaagaacggtcaagggtttgccttggtatatagtataacggcccagtctacatttaatgatctgcaggacctccgggaacagatcctgcgggtgaaagacaccgaggacgtcccaatgattcttgtcggtaataaatgcgacctggaagacgagagagtggtgggcaaggagcagggacaaaatctggcccggcagtggtgtaactgtgcctttcttgagtcgtctgctaagtccaaaatcaatgtgaacgagattttctatgatctcgtccgccagatcaatcggaagacgcccgtggagaaaaagaagccaaagaaaaaatcatgcctgttgctctag

SEQ ID NO: 26043 - DNA, 1380 bp, Artificial Sequence
  Description of Artificial Sequence: Synthetic coding sequence
atgcgggcccagatcgaggtgatcccctgcaagatctgcggcgacaagtctagcgggattcattatggggtgataacctgtgaaggctgcaagggcttctttaggcgctctcagcagaacaatgctagttactcttgtcccaggcagcgcaattgcctcattgataggacgaatagaaatagatgtcagcactgcagactccagaagtgcctcgcacttggaatgtccagagacgcggtgaagttcgggcgcatgtcaaaaaagcagagagatagtctgtacgctgaagttcagaagcaccagcagaggcttcaggagcagcgacagcaacagtcaggggaagcagaggccctggcgcgggtatacagctcatccatctcaaacggtctgtcaaacctcaataacgagaccagtggaacctacgccaacggccacgtcattgacttacctaagtcggaaggatactacaatgttgacagcggccagccttcccctgaccagagcggactagacatgacagggatcaagcagatcaagcaggaacccatatacgatctgaccagcgtccccaacctgttcacatattccagctttaataatggccagcttgcaccagggatcactatgactgagatagacaggatcgcacagaatataattaagagtcacctggagacgtgtcagtataccatggaagaattgcatcagctggcttggcagacacacacttacgaagagatcaaagcgtatcaaagtaaatcacgcgaggccctgtggcagcagtgtgccatccagatcacacatgctatccaatacgttgtggagttcgctaagcgaatcactggcttcatggagctgtgtcaaaatgatcagatccttctgttgaagtccggatgtcttgaggtggtcctggtgaggatgtgccgcgcctttaatcccctgaacaacaccgttctgtttgaaggaaaatacgggggcatgcagatgtttaaggccttgggttccgatgatttggtgaatgaggcctttgattttgccaagaacctctgtagtttgcagttaaccgaggaggagattgctttgttctcttctgctgtactgatttctccggaccgggcttggcttatcgagcctagaaaagttcaaaagctgcaagagaagatttactttgcattgcagcacgtgatccagaaaaatcacctcgatgatgagaccctggctaagctgatagcgaaaataccaactattacagccgtctgcaatctgcacggggaaaagttgcaggtctttaaacaaagccacccagagatcgtcaataccctcttccctccactgtacaaagaactgttcaaccccgactgcgccactggatgcaaatag

SEQ ID NO: 26044 - DNA, 1413 bp, Artificial Sequence
  Description of Artificial Sequence: Synthetic coding sequence
atgtgcgagaaccagctgaagaccaaggccgacgccaccgcccagattgaggttatcccttgcaaaatctgtggcgacaagtcctcagggattcattatggcgtgatcacctgcgagggctgcaagggtttctttagacggtcccagcagaacaacgcatcttactcatgcccacgccagcggaattgcctcatagataggacaaaccgcaaccggtgtcagcattgtcggctgcaaaaatgcctggcactgggtatgtctagagatgctgtgaagtttggaagaatgtcaaaaaaacagcgggattctctttatgcggaggtacagaaacaccagcagcggttacaggagcagcgccagcagcaatccggcgaggccgaggcactagcccgtgtatattccagcagtatttccaatggtctgagcaatctcaataacgaaaccagcggcacatatgccaacggtcacgtgatcgaccttcccaagtctgaaggatactacaacgtggactccgggcagccctctcctgaccagagtggcctcgacatgactgggatcaaacagattaaacaggagccgatttatgacctgacttcagttccgaatctgtttacctacagctctttcaacaatggccagttggctccaggtattaccatgactgagatcgaccgaatcgcccagaacatcattaagtcccacctcgagacgtgccagtacaccatggaggaactgcaccagctcgcttggcagacacacacttacgaggaaattaaggcataccagagcaagagcagagaggcactctggcagcagtgtgcgatccagataacacacgcaatacagtacgtcgtggaattcgccaagaggattaccggcttcatggaattatgtcagaacgatcagatactgctgctaaagtcggggtgcctcgaagtcgtcctggtgaggatgtgcagagcctttaaccccctgaacaacaccgtccttttcgagggcaaatatggcggtatgcagatgttcaaagcattaggctctgacgatctagttaatgaggcctttgatttcgctaaaaacctgtgctccctgcagttgactgaggaggaaatcgccctcttcagcagcgctgtcctaattagtcccgaccgcgcctggctaatcgaaccccgcaaggtccagaaactgcaagaaaaaatttattttgctcttcaacatgtgattcagaagaaccacctggacgacgaaacccttgccaagttgattgcgaagatccctactatcactgccgtgtgtaacctgcacggtgaaaagctgcaagtgtttaaacagtcccatccagagatagtgaataccttattcccaccactctataaggagctgtttaatccagactgtgcaactggctgcaagtag

SEQ ID NO: 26045 - DNA, 813 bp, Artificial Sequence
  Description of Artificial Sequence: Synthetic coding sequence
atgggcgaggccgaggcccccagcttcgagatgacctggagcagcaccacctctagtggatactgcagtcaggaggatagtgattcagagctggagcagtattttactgcccggacatcactcgccaggaggccaaggcgcgaccaggatgaacccgtggaatgggagacccccgacctctctcaagctgaaatcgaacaaaaaatcaaagagtataacgctcagattaattctaatctgttcatgagcttgaacaaggacggcagctacaccggatttataaaggtgcaactcaaattggtgcgccctgtgagcgtaccgtctagcaagaaacctccgtcacttcaggacgctaggagagggcccggtagagggacaagtgtacggaggcgaacctcgttttatttgcccaaagacgccgtcaagcacctccacgtgctgtcccggacgagggctcgagaggtgattgaagctcttctgcggaaatttctggtggttgacgatccgcggaaatttgctctgtttgagcgagcggagcggcacggacaggtttatcttcggaagttgttagacgacgagcaaccgctgagactgcggctgctcgcaggacctagcgacaaggcactgagtttcgtcctgaaggaaaacgattcaggtgaagtgaattgggatgctttttcgatgcctgagttgcacaactttctgaggatcctgcaacgcgaggaagaagagcatctgcgccagatacttcagaaatattcatattgcagacagaagattcaagaagctctgcatgcgtgtcccctgggatag

SEQ ID NO: 26046 - DNA, 1035 bp, Artificial Sequence
  Description of Artificial Sequence: Synthetic coding sequence
atgagcggcgagcccgagctgatcgagctgcgggagctggcccccgcgggcagggcaggaaaaggaaggacgcgactggaaagggccaacgccttgcgaattgcccgcggaactgcttgcaaccccacaaggcagttggtcccaggaaggggacatcgttttcagccagctggacccgcaactcacacgtggtgcgatttgtgcggagacttcatctggggcgtggtacgcaaaggcttacagtgtgctcgcctgtcagccgattgcaagtttacctgtcattataggtgtagggccctcgtatgtctggattgctgcggaccacgtgacttgggttgggaacccgccgtggaacgggataccaatgtggacgagccagtggaatgggagacaccggacctaagccaggctgagattgagcagaagatcaaggagtataacgcacagattaactccaacctgttcatgtccctcaataaggatgggtcctatacggggttcataaaagtacagcttaagttggtccgcccagtgagcgtaccctctagtaagaaaccgccatctttgcaggacgctcgccgcggaccagggcgaggaaccagtgtcagaaggagaacgagtttttacctgccaaaagatgctgtcaagcatcttcacgtgttgagtcgaacccgggcacgggaggtgatcgaggccttgcttcggaagttcttggtggtggatgaccctaggaaatttgccttattcgagcgggcagagcggcacgggcaagtttacctccgaaaactcctggatgacgagcagcccctgcgcctgcgcctgcttgccgggcctagtgacaaagccttgtcctttgtcctgaaagaaaatgacagtggtgaggtgaattgggatgctttctcgatgcccgagctgcacaattttttgcgtatcttacagcgagaggaggaggaacatttgaggcagattctgcagaaatacagctactgcagacagaagatccaggaggccctccatgcgtgccccctcgggtag

SEQ ID NO: 26047 - DNA, 1023 bp, Artificial Sequence
  Description of Artificial Sequence: Synthetic coding sequence
atgagcggcgagcccgagctgatcgagctgcgggagctggcccccgcaggcagagcgggaaagggtcggactaggctggagagggctaatgccttacgtatcgcaagggggaccgcttgcaatccaacgagacagctggttccagggaggggacataggttccagcctgccgggcccgcaacccatacgtggtgtgacctctgcggcgacttcatatggggagtggttagaaaagggctccagtgtgcccactgtaaattcacgtgccactaccggtgcagagccctcgtttgcctggactgctgtgggccgcgagacctgggatgggagccagctgtcgagcgagatactaacgtggacgagccagtagagtgggagacacccgatctcagccaggctgagattgaacaaaaaatcaaagagtacaatgcccagatcaactctaacctattcatgagcctgaacaaagatgggtcctataccggtttcattaaggtgcaactcaagctggtgcggcccgtgagcgtgcctagcagtaaaaaacctcccagcctgcaggacgccagacgcggtcctggacgcggcactagcgtccggcgcagaacctccttttacctgcccaaagatgcggtaaaacatttacatgttctgtccaggacgagggctcgagaggtgatagaggcgttgcttagaaagtttcttgtggttgacgatccccgcaagttcgctctgtttgaacgggcagagcgccacggccaggtataccttcgaaaactgctggacgatgaacaaccacttaggttacgactgttggctggtccgagtgacaaggcgctgtcgttcgtgttgaaagaaaacgacagcggggaggtgaattgggacgctttctctatgccagagctccataactttctccgtatactgcagcgtgaagaggaagaacatttacggcagatactccagaagtattcttactgccgccagaaaattcaggaagccctgcacgcctgtccgctcggctag

SEQ ID NO: 26048 - DNA, 570 bp, Artificial Sequence
  Description of Artificial Sequence: Synthetic coding sequence
atgagcctgaacaaggacggcagctacaccggcttcatcaaggtgcagctcaaattagtccggccagtcagtgtgccatcatcgaagaaacctcctagtttacaggatgctaggcggggccccgggcgcggaacaagcgttcggcggcgtacctccttctatcttcccaaggatgctgtgaagcatctccacgtactgagtaggacaagagccagggaagtcattgaggccctcctgagaaagttcctagtggtggatgatccaagaaagtttgctcttttcgaaagagccgagcggcatggccaggtatacttgaggaaattactggatgacgaacaacctctccggctgagactgctcgcgggtccttctgacaaggctctctccttcgtgctgaaggaaaacgactctggggaagtcaactgggacgcatttagtatgcccgagctgcacaatttcttgcgaattctccagcgcgaggaagaggagcacctgcgtcagattctccagaaatacagctattgcaggcagaagatccaagaggcccttcacgcatgcccgctgggatag

SEQ ID NO: 26049 - DNA, 981 bp, Artificial Sequence
  Description of Artificial Sequence: Synthetic coding sequence
atggactacagccaccagaccagcctggtgccctgcggccaggacaagtacattagcaaaaacgaactgctgttacatcttaaaacctacaacctctattacgaaggccagaaccttcagctcaggcaccgagaagaagaggacgagtttatcgtggaaggccttctgaacataagctggggcctgcgtagaccaatccgtcttcagatgcaagatgataacgaacgaattcgcccccccccaagcagtagtagctggcactcaggctgtaacctgggtgcccaaggaactacactgaagccgctgaccgtgcctaaagtgcagatctccgaggtggacgctcccccagagggcgaccagatgccttcctctacggattctaggggtcttaagcctctgcaggaagacacgcctcagctgatgagaactagatcagacgttggggtgcgacgcagaggtaacgttcgtacccctagtgaccagcggcggatacgccggcatcggttttcaatcaatgggcacttttataaccataagacctccgtgtttactccagcttatgggagtgtcaccaacgttcgaatcaacagcactatgaccacacctcaagtgttaaagttactgctgaacaagttcaaaatcgagaacagtgctgaggaattcgctctttatgtcgtgcacacttcaggtgaaaaacagaaactgaaggcaaccgactatccacttatagctcgcatcctgcagggtccctgtgaacagatcagcaaagtctttctcatggagaaggaccaggttgaggaggtgacctacgacgtcgcccagtacattaagtttgaaatgcctgtgcttaaatcttttatccagaaactacaagaggaggaggatagagaagtgaaaaaattgatgagaaaatacacggtactgaggctgatgatccggcagaggctggaggagatagcagagacgcccgccacaatctag

SEQ ID NO: 26050 - DNA, 981 bp, Artificial Sequence
  Description of Artificial Sequence: Synthetic coding sequence
atggactacagccaccagaccagcctggtgccctgcggccaggacaaatatatctctaaaaatgagttactcctacacctgaaaacgtataatctatattatgaggggcagaatctgcagctgcggcacagggaggaagaggatgaatttatcgtggaggggctgttgaatatttcttgggggctccgccggccgatcaggttgcagatgcaggacgacaatgagcgtattagacctccgccctcctcctccagctggcacagcgggtgcaatttgggggcccagggtacaaccttgaaaccactaacggtgccaaaggttcagatatcagaggtagacgccccacctgaaggcgatcagatgcccagcagtaccgactctcgaggactgaagcccctgcaggaggacacccctcaactgatgaggactaggtcagacgtcggagttaggcggcgggggaatgttaggacgccaagcgatcagaggcggatccggcgccaccggttcagtatcaacggccacttttataaccacaaaaccagcgtgttcacaccggcctatggctcagtgacaaacgtgagaatcaactccactatgaccacccctcaagtgctgaagctgttactgaataaatttaaaatcgagaactcagccgaagagtttgctctgtatgtggtgcacacatcaggcgagaagcagaagctgaaggcgacagactaccctctcatcgcacggattttgcagggaccgtgcgaacagatttccaaggttttccttatggagaaagatcaggttgaggaagtgacttacgatgttgcccaatacattaaattcgagatgcctgtgttgaagtcattcattcaaaagctgcaggaggaggaggaccgagaagttaagaagctcatgcgcaaatataccgtgcttcggctgatgattcgacaaagactggaagaaatagcagagactcctgccactatctag

SEQ ID NO: 26051 - DNA, 993 bp, Artificial Sequence
  Description of Artificial Sequence: Synthetic coding sequence
atgaaggaggactgcctgcccagcagccacgtgcccatcagcgactctaagagcatccaaaaaagggatgtccaggggctcagcgaggaaggaaccttaatcatagagggtttgctcaatattgcctggggccttcgacgccctattcgattgcaaatgcaggacgatcgagagcaggttcatttaccttcaacctcttggatgcctcgcagaccgagctgtcccctgggatgttggtccctgcttctgggactcagctccctcagcctcccagcggccattagcgcgctgcagctttcagtgtttaggaaggaaccttcgcctcaaaatggaaatattactgcacagggaccctctatccagccggtccataaagcagagtccagcacggatagtagtgggccactcgaggaagccgaagaggcccctcagctgatgcggacaaagtcagacgctagttgcatgagccagcgccgacccaagtgtcgggcaccgggggaggcccagcgaatccggagacatcgcttctctatcaacgggcatttctacaatcataagacgagtgtgttcactcccgcctacggcagtgtgactaacgtgcgggtgaactctactatgactacactccaggtgttgactctgctattaaacaagtttcgggtcgaagatgggccctccgagttcgccctttacattgttcacgaatctggcgaacgcactaagcttaaggactgcgagtatccactaatctcacggattttgcacgggccatgcgaaaagatcgcgcggatcttcctgatggaagctgatttaggagtcgaagttccccacgaggttgcccagtacattaaatttgaaatgcccgtactcgactctttcgtcgaaaagctgaaggaggaggaggagcgcgaaattattaaattgaccatgaagttccaggcgctgcgactaactatgctgcagagactggagcagttggtggaggccaaatag

SEQ ID NO: 26052 - DNA, 966 bp, Artificial Sequence
  Description of Artificial Sequence: Synthetic coding sequence
atgaaggaggactgcctgcccagcagccacgtgcccatcagcgacagtaagtctatccagaaatccgaacttttaggtttgttaaaaacatataactgctatcatgagggaaaaagtttccagttgcggcatagagaggaggaggggactctcatcattgagggcctgcttaacatcgcctggggtttgcggcgccccattcgtttgcaaatgcaagatgaccgagagcaggtgcatcttcctagcaccagctggatgcctcgtcggccctcgtgtcctcttaaagagccttcaccccaaaatggaaatatcaccgcccaggggcctagtatccagccagtgcataaagcagagagttccaccgatagctccggcccattagaggaggctgaggaggcaccccagctcatgaggaccaagagtgacgcgagttgcatgtcacagcggcgaccaaagtgcagggctccaggcgaggcgcagcggatccgtcgccatagatttagcattaacggacatttctataatcataaaacctccgtattcacacctgcatatggatccgtcaccaacgtgagagtaaacagtaccatgactactctccaagtacttactctcctgttgaacaagttccgggtggaggatggccccagcgagttcgccctgtatattgtgcatgaaagcggggagcgtacgaagctaaaagactgcgaatatccactgatctcccggatcctccatggcccttgcgaaaagattgcaagaattttcctgatggaagcagatctgggtgtggaggtgccccacgaagtagcacagtatattaagttcgaaatgccggtgctcgatagttttgtggagaaactcaaggaagaagaagagcgcgagataatcaaactgaccatgaaattccaggcactgcggttaaccatgctccagcgcctcgagcagctcgtggaagcaaagtag

SEQ ID NO: 26053 - DNA, 1239 bp, Artificial Sequence
  Description of Artificial Sequence: Synthetic coding sequence
ggcagcaacgccggcggcggccagggcggctgccagggcctgacctgcgatagtgagtcagtcggcactctggatatactcgaccagactcaagcgtgtccagtctccttagcatcatcctctgcccgccctccgtgtcctccacctggcccctgcgcagagccatccggttgcatagcaatggccgtgtggtcccctctggtgatgccaggtaggcgcgagggatgttgccatactccagtgacaaacgaggaaactgaggctcgggaggccaaaggacagaagttgcgtccctgtcatacactcggcgtgcatgtttgtttgtctctgttccggtcagagctcttagggttattgaagacatacaactgctatcacgaggggaagagtttccaactgcggcaccgtgaagaggaggggactctgataatagaaggcttacttaatattgcttggggcctgcgacgacccattagacttcaaatgcaggatgaccgagagcaggtgcacctcccatccacttcctggatgccacggagaccatcatgtccgcttaaggaaccaagcccacagaacggcaacatcacagcacaaggaccttcaatccagccagtgcataaggctgagtcctcaactgattctagtggcccactagaagaagccgaagaggcgccgcagcttatgagaacaaagtctgatgcgagctgcatgtcccaacgccgccccaagtgtcgcgcaccaggcgaggcccaaaggattcgcagacatagattttcaatcaacgggcacttctataaccacaagacctccgttttcactccagcctatggatctgttacaaacgttcgtgtgaactctacaatgacaactctccaagtgctcacacttttgttaaataagttcagggtggaagacggacctagcgaatttgcactgtacattgtacacgagtctggcgagaggactaaactaaaggactgcgaatacccccttatttctagaatcctccacgggccatgcgagaaaatcgctcgcattttcctcatggaagctgacttaggggtggaggtgccacacgaagtggcacagtacattaaattcgaaatgccagtgctggatagctttgtggaaaagttgaaggaggaagaggaaagggagataatcaaacttaccatgaaatttcaagctctccgactgacaatgctgcagcggttagaacagctggtggaagctaaatag

SEQ ID NO: 26054 - DNA, 393 bp, Artificial Sequence
  Description of Artificial Sequence: Synthetic coding sequence
atgaaggaggactgcctgcccagcagccacgtgcccatcagcgacagcaaaagtattcaaaaatctgaattgttgggcctactcaaaacctacaactgctatcatgagggcaaatccttccagttgcggcacagggaagaagaaggtactctgataatagaaggattacttaatatcgcttggggactgcgcagaccaatcaggctgcagatgcaggacgacagagagcaagtccacctcccttcaacaagctggatgcctagacgccccagttgtccactacatctggcagggaagaagggccgtcttcaacccggaggcctcccaactcctatgcaagctgagcacgtgtcccccagtctcgtgttatccctcaaattcacgcgtatttag

SEQ ID NO: 26055 - DNA, 381 bp, Artificial Sequence
  Description of Artificial Sequence: Synthetic coding sequence
atgaaggaggactgcctgcccagcagccacgtgcccatcagcgactctaagtcgatccagaagtccgagctgctggggctgctaaaaacctacaattgttaccatgagggcaagtcattccagctgcgccacagagaagaggagggtactttaattatagaaggcctcctgaacatcgcctggggtcttcggcggccgatcagattgcagatgcaggacgatcgagagcaagtgcatctcccaagtacgtcttggatgccgcggcgaccaagttgccctctggcccctggtggcggaagaggaggcccaccagctgacgccgaccaggagcgccgccaattgcacgagccagaagaagcccaggtgcctaggccacggtag

SEQ ID NO: 26056 - DNA, 456 bp, Artificial Sequence
  Description of Artificial Sequence: Synthetic coding sequence
atgaaggaggactgcctgcccagcagccacgtgcccatcagcgactccaagtcaatccagaaatccgaacttctgggcttgctgaaaacttataattgttaccacgaaggcaagtctttccaacttagacatagagaggaggagggcaccctgattattgaaggactccttaatatagcctggggacttcgaaggcccattaggcttcagatgcaggacgacagggagcaagtgcatttgccaagtacaagctggatgccccgccggccttcctgtccactgggctgctggagcttgctgctgggcctctcttcactgtcattgccagcagctattagtgcactgcagttatcagtgtttcggaaagaaccttctccccaaaacgggaatatcacagcccagggcccctctattcaaccggtgcataaagctgaatcctctaccgattccagctag

SEQ ID NO: 26057 - DNA, 372 bp, Artificial Sequence
  Description of Artificial Sequence: Synthetic coding sequence
agcagccacgtgcccatcagcgacagcaagagcatccagaagagcgaactgctcgggcttctcaagacatacaactgctaccacgaaggtaagagcttccagcttcgccatcgggaggaggaaggaacacttattattgaaggcctgctcaatatagcctggggactgagacgacccatcagactgcagatgcaggacgatcgagagcaagtccacttgccgtcaacatcatggatgcctcgccgacctagttgcccccttcatctcgcgggcaaaaaaggaaggctgcagccaggtgggctccccactccaatgcaagccgaacatgtctctccctccctggtgctgtccttaaaatttacacgcatctag

SEQ ID NO: 26058 - DNA, 798 bp, Artificial Sequence
  Description of Artificial Sequence: Synthetic coding sequence
atgaccgtggacagcagcatgagcagcggctactgcagcctggacgaagagctggaggattgtttctttacggcgaaaacaacttttttccgcaacgcgcaaagtaagcatttgtcaaagaacgtctgcaaacccgtggaggagacccagcgcccgcctactttgcaagagattaagcagaagattgattcttataatacaagagaaaagaattgcctcgggatgaagctcagcgaggatgggacctatacaggattcattaaggtccacctgaaactaagaagacctgttacggtgccggcaggcattagaccccagtctatttacgatgccattaaagaagtgaacctcgccgctaccactgataaaagaacttccttctatctccctctcgatgcaatcaaacaactccacatctcttcaacaactaccgtcagcgaagttatacaaggcttgttaaagaagtttatggttgtcgataaccctcagaagttcgctctgttcaaacggatccacaaagatggccaggtgctgttccaaaagctgagcattgccgacagacccctgtacctgagactgcttgcaggcccagacaccgaagtactgagtttcgttctaaaggagaacgaaacgggtgaagttgaatgggatgccttctctataccagaactgcaaaactttttaaccatattagaaaaagaggaacaggacaagatccagcaagttcagaagaagtacgacaaattccgtcagaaactcgaggaagctctgagggaaagtcaggggaagcccgggtag

SEQ ID NO: 26059 - DNA, 1179 bp, Artificial Sequence
  Description of Artificial Sequence: Synthetic coding sequence
atggccatggccagccccgccatcggccagcggccctaccccctgttgctagacccagaacccccacgttatctgcagtcactgtctggtccagaactacccccacccccccctgatcggagctcaagactgtgcgtacccgctcctttgtctacagcccctggcgcccgtgagggtcgctcagctagacgagcagccaggggaaatttggaaccccctccaagagcctcccgacctgccagacctctccgccctggattgcagcagcgtctccggcgccgcccaggcgcccccaggccgcgggatgtacgctctatctttgagcagcctcaggatccgcgggtccccgctgaaaggggtgaggggcattgcttcgccgaactcgttctgcccgggggtccggggtggtgtgatctgtgtggacgggaggtgcttcggcaagccctcagatgtactaattgcaaatttacttgtcaccccgagtgccgctcccttatacagcttgactgtagccagcaggagggtttgagccgtgatcggccgtcacctgaatccactcttacagtgacatttagccagaacgtgtgtaagcccgtcgaagagactcagcgccctccaactttgcaggagattaagcaaaagatagactcttacaatactagagagaagaactgtcttgggatgaaactgtcagaggatgggacgtatacaggtttcattaaagttcacctaaaactgaggcgccctgtgacggtccctgctggcataagacctcagagtatatacgatgctatcaaggaggtaaatttggcggccactacagataaaagaaccagcttttacctgccccttgacgcgattaagcagctacacatatcgtccacaaccaccgtgagcgaggtaattcaggggttacttaagaagtttatggtcgtagataacccacagaaattcgccctctttaagcgcatccacaaggacggccaggtcctattccaaaagttatctatcgccgatcggcccctttatttacgactcttggccgggcctgacaccgaagtgctgtcatttgtccttaaagagaatgaaaccggcgaagtggagtgggatgcattttcaatccctgagctacagaacttcttgtcttcttggtgcatacaaatttacttgtattattag

SEQ ID NO: 26060 - DNA, 1257 bp, Artificial Sequence
  Description of Artificial Sequence: Synthetic coding sequence
atggccatggccagccccgccatcggccagcggccctaccccctgctgctagatccagagcctcctcgctacctgcagagcttaagtgggccggagctcccccccccaccgccagatcgcagttctcggctgtgtgtccccgctcctcttagtaccgcaccaggcgccagagagggacgtagcgctcgcagagcagcacgcggtaacctggagccacctcccagggcctccaggccagcacggccgctcaggccgggtttgcagcaaaggctacgcaggagaccaggagctcctagaccccgagatgtgagatctatcttcgagcaaccccaggatcctagggtgcctgccgagagaggagaaggccactgcttcgctgagctggtgctacctgggggaccagggtggtgcgatctatgcggacgcgaggtgttgagacaggccctgcgctgtaccaattgtaaatttacttgccacccagaatgtcgcagcctgatccagttggattgtagccagcaggaaggtctgtcacgcgatcgaccgagccctgaatctacattgacagtgactttttcccagaacgtttgtaagccagttgaggagacccaacgaccacccacgcttcaggagattaagcagaaaattgactcctataacacacgcgaaaagaactgcctcggtatgaaactgtcagaagacggcacatacaccggcttcattaaggtgcatcttaagctccgtcgccccgtcacagtgcctgccggcattcgaccacaatccatttatgacgccatcaaggaggtgaacctcgccgcaactactgataagcggaccagtttttatttacctctcgatgccattaagcaactccatataagtagtactacaaccgtcagtgaagtcattcagggactgttgaagaagttcatggttgtggataaccctcagaagtttgctctgtttaagcgaattcacaaggatggccaggtgttgttccagaaactcagtattgcagaccggcctctctatctcagactcctcgccggacctgataccgaagtgctgtcgtttgtgttaaaagaaaatgagaccggcgaggtggagtgggacgccttttcaatccctgaactgcagaacttcctgaccatcctcgagaaggaggagcaggataagatacagcaggtccagaagaaatatgacaaattccggcagaaacttgaggaagccctgcgagaatctcagggcaaacccgggtag

SEQ ID NO: 26061 - DNA, 1011 bp, Artificial Sequence
  Description of Artificial Sequence: Synthetic coding sequence
atggccatggccagccccgccatcggccagcggccctaccccctgctgctggatcccgagcccccgcggtacctccagtccctttccgggccagaactccctccacctcctcccgacagatctagtagactgtgtgtgccggcaccgctgagcaccgctcccggcgcacgcgaaggacgatcagccagacgggcggctcggggaaacctcgagcctccccccagagcttcccgacccgcacggcccttgcgtcccggactccagcagagactgcgtagacgccccggagcccctcggccgcgggacgtgaggtccatattcgagcagccacaggatccccgagttcccgcagaacggggcgagggacactgtttcgctgagctggtgctaccaggcgggcccgggtggtgcgatctttgtggacgagaggtattgcgtcaggctttgcggtgtacaaattgcaagtttacctgtcaccccgaatgccgctccttaatccagctggactgcagccagcaagagggcctgagccgggaccggccaagtccagagagcacactgacagtcactttttcccagaacgtgtgcaagccagtagaggaaacccagcggcctccaaccctccaggaaatcaagcaaaagatagattcttacaatacccgcgagaagaactgccttggaatgaaattatccgaagacgggacgtatactgggttcatcaaggtgcacctcaaactgaggaggccagttacagtccctgccggtattagaccccagagcatctatgacgcgatcaaagaagttaacttggcggccaccactgacaaacgcactagtttttacctacctctggacgccataaaacagcttcacatttcatccaccactacagtcagcgaggtaatccagggtctgctgaaaaaattcatggttgttgataaccctcagaaattcgccctgtttaaacgtatccataaagacgggcaggtgggctgcctgctgcacccatag

SEQ ID NO: 26062 - DNA, 1182 bp, Artificial Sequence
  Description of Artificial Sequence: Synthetic coding sequence
atggccatggccagccccgccatcggccagcggccctaccccctgttgctggatcctgagccacctcggtacttacagtcactcagtggtccagagctgcctccaccaccacccgatcgctcatcaaggttgtgtgtacccgcaccactcagcacggcaccaggcgcacgcgagggacgcagcgcccgtagagctgcgcggggcaatctggagcctcccccccgggctagtagaccagcacgccctctccgccctggactccagcagaggttgcgcaggagacctggcgctcccaggcccagagacgttcgctccatttttgaacagccccaagacccacgcgtgccagctgaaaggggggagggacattgcttcgcagaactcgtgctgccgggtgggcctggctggtgtgacttgtgtggtagagaggtgctacgccaggcccttcggtgtaccaactgcaagtttacgtgccaccccgaatgtcgcagcctcattcagctggactgttcccaacaagaaggactctctcgcgatcggccttcccccgaaagtaccctgacagtcacttttagccaaaatgtctgcaagccagtggaagagacccagaggccgccaactctgcaggaaattaagcaaaaaattgattcgtataatacccgcgagaaaaactgcttgggcatgaagctgtctgaggacggcacctatacaggattcattaaagtgcacttgaagttgagaaggcctgttaccgtgcccgcgggtattagacctcagtcaatctatgacgccataaaggaggtcaacctggctgccaccacagataaacgcaccagcttttacctgccattagacgccatcaagcagcttcacatctcctctacaaccacagtatccgaggtgattcaagggctgctgaaaaagtttatggttgttgataaccctcagaagttcgccctattcaaacgaatccacaaggacggccaggttctttttcagaagctaagcattgcggatagacctctctacctcagactgttagccgggccagacactgaggttctctccttcgtgctcaaagagaatgagactggggaagtggagtgggatgccttctctatcccagaactgcaaaattttttcctctcttcttggtgtatacagatatatctgtattactag

SEQ ID NO: 26063 - DNA, 555 bp, Artificial Sequence
  Description of Artificial Sequence: Synthetic coding sequence
atgccccagagcaagagccggaagatcgccatcctgggctaccggagtgtgggcaagtccagcctgacaatccagttcgtcgagggccagtttgtggattcctatgatccaaccatagaaaatacattcaccaaattaattacagtgaacgggcaggagtatcacctgcagctcgtggatactgctgggcaggatgagtacagtatctttccccaaacatacagtatcgatattaacggttacatcctcgtatattccgtgacctcaatcaaaagctttgaggtgatcaaagttatccacggaaagctcttggatatggtcgggaaggttcagatacctataatgctcgtgggcaataaaaaggacctgcacatggaacgggtcatatcctatgaggaaggcaaggccttggctgaatcctggaatgcagcctttctggagtctagtgccaaggaaaatcagacggccgtggacgtgtttaggcgtataattctggaagcagaaaagatggacggtgctgcctctcagggcaagagtagttgtagtgtaatgtag

SEQ ID NO: 26064 - DNA, 582 bp, Artificial Sequence
  Description of Artificial Sequence: Synthetic coding sequence
atggccgccatccggaagaagctggtgatcgtgggcgacggcgcctgcggtaaaacctgcttattgatcgtgttctccaaagatcaatttcccgaggtgtatgtgcctactgtgtttgaaaactacgtggcggacatagaggttgacgggaaacaagtcgagctggcgctgtgggacaccgcaggacaagaagactatgacagactaaggccgcttagctaccctgacactgatgtgatactgatgtgcttttctattgactcacccgactcactcgaaaacattcctgaaaagtggacccccgaggtaaagcacttttgtccgaatgtgccgattatactagtcggtaataagaaggatttgcgaaatgatgaacacactaggagagagctcgctaagatgaagcaagaacctgttaaacccgaagaggggcgggacatggctaatcgcattggcgcctttggttatatggaatgctccgcaaagacgaaggatggagtgcgcgaggtgttcgaaatggcgacacgagcagcactccaggctcgacggggcaaaaaaaagtcgggatgcctggtcctgtag

SEQ ID NO: 26065 - DNA, 591 bp, Artificial Sequence
  Description of Artificial Sequence: Synthetic coding sequence
atggccgccatccggaagaagctggtggtggtgggcgacggcgcctgcggcaagacgtgcctcctcatcgtgttttcaaaggatgaatttccagaagtgtacgtacccacagtgttcgagaactacgtggcagacatcgaggtggatgggaagcaggtggagctcgcactctgggacactgcaggacaggaagactacgataggctccgtcctctgtcataccccgataccgacgtgatcctgatgtgcttcagtgtggattcaccagactcccttgagaacatccccgagaaatgggttcctgaagttaaacacttctgcccaaacgtgcctatcatcctcgtggctaacaaaaaagatctgaggagcgatgagcacgtccggaccgagctggcccggatgaaacaggagcccgtgaggactgacgatggccgcgcaatggccgtccgcatacaggcatatgattacctggagtgtagcgcaaagaccaaagagggcgtgcgcgaagtgtttgagaccgcaactagggcggccctccagaaacggtacggttctcagaatggttgtattaactgctgcaaggtgctgtag

SEQ ID NO: 26066 - DNA, 582 bp, Artificial Sequence
  Description of Artificial Sequence: Synthetic coding sequence
atggccgccatccggaagaagctggtgatcgtgggcgacggcgcctgcggtaagacctgcctactcattgttttcagtaaagatcagttccctgaggtctatgtgccgactgtgtttgagaattacatcgctgacatcgaggtggacggcaagcaggtggagctcgccctgtgggacacggccggtcaagaggactacgatcggctcaggcccttgagctacccagacacggatgttatcctgatgtgctttagcatcgacagcccagatagcctggaaaatatccccgaaaagtggacacctgaggtcaagcatttctgtcctaatgtaccgatcatccttgtgggcaataagaaggacctgagacaggatgagcacacacgccgagaattggctaaaatgaagcaggagccagttcgttcagaagagggaagggacatggccaacagaatctcagccttcggctatttagagtgctctgcaaagacaaaggaaggagtgcgagaggtgttcgagatggccactcgcgccggccttcaggtcagaaagaacaaacggcgccggggttgcccaattttgtag

SEQ ID NO: 26067 - DNA, 582 bp, Artificial Sequence
  Description of Artificial Sequence: Synthetic coding sequence
atggccgccatccggaagaagctggtgatcgtgggcgacggcgcctgcggaaagacttgtctgctcattgtgttcagcaaagaccagttccccgaagtttacgtcccaacagtgttcgagaattatattgccgatattgaagtggacgggaaacaagtggagctagcgttgtgggacaccgccggccaggaagactatgatcgtctgaggcctttatcttatcctgatactgacgtcatcctaatgtgcttttcaatcgacagccctgacagcttggagaatattcctgaaaagtggacacccgaggtgaagcatttctgtcctaatgtgccaatcatacttgtggggaacaagaaggacttacggcaggatgagcataccaggcgagagctggctaagatgaagcaggagccggttcgaagcgaggaaggaagggatatggcgaatcggatctctgcctttggctatcttgaatgtagtgctaagacaaaagaaggggtccgtgaggtgttcgaaatggcgacacgggcaggattacaggtaaggaagaacaagcggagaagagggtgccccatcctttag

SEQ ID NO: 26068 - DNA, 582 bp, Artificial Sequence
  Description of Artificial Sequence: Synthetic coding sequence
atggccgccatccggaagaagctggtgatcgtgggcgacggcgcctgcggcaagacctgtctattgatagtcttttctaaagatcagttccctgaggtgtatgtgccaaccgtgttcgagaactatattgctgatattgaagtcgatggaaagcaggtggagcttgctctctgggatacggctggccaggaggactatgacaggttgcggcctctctcttacccagatacagatgtgattctgatgtgcttctctatcgattcaccagacagtctggagaatatccccgagaaatggactccagaggtgaaacacttctgccccaacgtgcccatcattctcgtaggtaataaaaaagacctacggcaggatgagcatactagaagggaacttgccaaaatgaagcaggagcccgttcgctccgaggagggaagggatatggccaatcggatttcagcctttgggtatttggagtgttcagccaaaactaaggagggtgtgagagaggtgtttgagatggctacaagggccggactgcaggtacgaaagaataagcggagaagaggctgtccgatcctatag

SEQ ID NO: 26069 - DNA, 582 bp, Artificial Sequence
  Description of Artificial Sequence: Synthetic coding sequence
atggccgccatccggaagaagctggtgatcgtgggcgacggcgcctgtggaaaaacctgcctgttgatcgtgttctctaaggaccaattcccagaagtatatgtcccgaccgtcttcgagaattatattgcagatattgaagtggatggaaaacaggtggagctggccttgtgggataccgctggacaggaggactacgaccggttacgccccctcagctatcccgacacggacgtgatcctgatgtgtttttcaatcgatagtcccgacagcttggagaatatcccagaaaaatggacacccgaggttaagcacttttgtcctaatgtgccgattatcttggtaggcaacaaaaaggacttgagacaggatgagcacaccaggagggagctggctaaaatgaaacaggagcctgtccgctccgaggaaggacgggatatggccaatagaatctccgccttcggatatttggagtgcagcgcgaagactaaagagggagtcagggaggttttcgaaatggcaacgcgtgcaggattacaagttcggaaaaacaagaggcggcggggatgtccaatcctttag

SEQ ID NO: 26070 - DNA, 600 bp, Artificial Sequence
  Description of Artificial Sequence: Synthetic coding sequence
atggccgccatccggaagaagctggtgatcgtgggcgacggcgcctgtggcaaaacttgtctcttgattgtgttcagtaaggaccagtttccagaagtttatgtgccgacagtgtttgagaactacatagcagatatcgaggtcgacggaaagcaggtggagctggctctgtgggacaccgccggccaagaggactacgacaggcttcgacccttatcttaccctgacaccgacgtgatcctgatgtgtttctcgatagatagccccgactcccttgagaacatccctgagaaatggactcctgaggtgaagcacttttgtccaaatgtaccaatcatcttggtagggaataaaaaagatctgcgcaaggctggtacttggcgaaccggttctgtgcccctggctacattatccgctcagccacgcccaaggcgcgagtgtggcagatgcctgcggtggccactaggactggcctctaggagcgcaaggacctcggtgggcggagcggtgcctttcagcgagatacctaaggcgtttccaacatgtccgttaccttctcagggttatcgcaattacccccccaccacccctgcttcttag

SEQ ID NO: 26071 - DNA, 582 bp, Artificial Sequence
  Description of Artificial Sequence: Synthetic coding sequence
atggccgccatccggaagaagctggtgatcgtgggcgacggcgcctgtgggaagacatgcctgctgattgttttcagcaaggaccaatttcctgaagtgtatgtgcccacggtgtttgagaattacatcgcagacattgaagtggacggaaaacaggtggagcttgccctctgggacactgctggacaggaagattacgataggctccgcccactgtcttatcccgataccgacgttatcctgatgtgcttttcaattgactctcctgattcactggagaatatcccggagaaatggacccccgaggtgaaacatttctgcccaaatgttcccataattctagtcgggaataaaaaggaccttcggcaggacgaacacacgagaagagagctggctaaaatgaaacaggagcctgtgagatcagaggagggccgggacatggcaaatcgtatttccgcattcggttatcttgagtgctccgctaagacaaaggagggagttagggaggtgtttgagatggccactcgcgccggtctgcaggttcgcaaaaataagcgccgtaggggctgtcctattttgtag

SEQ ID NO: 26072 - DNA, 582 bp, Artificial Sequence
  Description of Artificial Sequence: Synthetic coding sequence
atggccgccatccggaagaagctggtgatcgtgggcgacggcgcctgcggcaaaacctgtctgctgatagtgttctccaaggatcagttccccgaggtctacgtaccgactgtcttcgaaaattatatcgcggacattgaagtggatggaaagcaggtggagctcgccctatgggacacagcaggccaggaggattacgatcggcttagacccctttcttacccagacacagatgtgatcctgatgtgctttagtattgattcaccggacagcctggagaatatccccgagaagtggacccctgaggtgaaacacttctgtcccaacgtgcccatcatcttggttggtaataaaaaagacttgaggcaggacgagcatactagaagggagttggcaaagatgaaacaggagcctgtccggagtgaggaggggagagacatggccaacaggataagcgcgtttggctacctggaatgttccgcgaagacaaaggagggagtgagagaggtgtttgagatggccacccgggctggtctccaggtgaggaagaacaaaaggcggaggggctgcccaattctgtag

SEQ ID NO: 26073 - DNA, 582 bp, Artificial Sequence
  Description of Artificial Sequence: Synthetic coding sequence
atggccgccatccggaagaagctggtgatcgtgggcgacggcgcctgtggcaagacatgcctcctgattgtgttctcaaaggatcagttccctgaggtgtacgtgccaaccgtgttcgagaattacatagctgatattgaagtggacggaaagcaggtagagctggccttgtgggacactgcggggcaggaggactatgaccgcctgagaccacttagttatcccgatactgacgtgattctgatgtgcttcagtattgactcccccgacagtctagaaaacatcccagaaaaatggacaccagaagtgaagcacttctgtcctaatgtccctattatcttggtgggaaacaagaaggacctgcggcaggacgagcacacaagaagagaactcgccaaaatgaaacaggagccagttcggtccgaagaaggaagagatatggcaaatagaatcagcgcgtttggataccttgaatgctctgctaaaacaaaggagggcgtgcgagaggtgtttgaaatggctacacgagccgggttgcaagtacgtaaaaacaaaaggagacgtgggtgtccgattttatag

SEQ ID NO: 26074 - DNA, 279 bp, Artificial Sequence
  Description of Artificial Sequence: Synthetic coding sequence
atggccgccatccggaagaagctggtgatcgtgggcgacggcgcctgtggtaagacatgccttctgattgtattctctaaagatcagtttccagaggtctacgtgcctaccgttttcgaaaactacatcgccgatatcgaggtggatgggaagcaggtagagctcgcgctgtgggataccgcaggacaagaggactatgaccgcctacgtccactgagttatcctgatacagacgttattctgatgtgtttttcaatagactccccagatagcctctag

SEQ ID NO: 26075 - DNA, 570 bp, Artificial Sequence
  Description of Artificial Sequence: Synthetic coding sequence
atggccgccatccggaagaagctggtgatcgtgggcgacggcgcctgcggcaaaacctgcctgctgatcgtgttcagtaaggatcagttccccgaggtctatgtgcccaccgttttcgagaactacatcgccgacattgaagtagacgggaagcaggtggaattagcgctgtgggacaccgccgggcaggaagactatgacaggcttaggccactcagctaccctgacaccgacgtgatccttatgtgcttcagcatagacagtccggattccctagaaaatatcccagagaaatggacgcctgaagtgaagcatttttgtcccaatgtcccaataatcctggttggaaataaaaaagacctgcgccaggacgaacacaccagaagggagttagctaagatgaaacaggaacctgtgcggtcagaggagggaagggacatggcaaatcgtattagtgcctttggatatctagaatgttccgctaaaaccaaggaaggagtgcgtgaagtcttcgaaatggccacgagggccggactgcaggtgaggaaaaacaaaaggcggcgtgggtag

SEQ ID NO: 26076 - DNA, 384 bp, Artificial Sequence
  Description of Artificial Sequence: Synthetic coding sequence
atggccgccatccggaagaagctggtgatcgtgggcgacggcgcctgtggaaaaacttgcctgctgattgtgttctccaaagaccagtttccagaggtttacgtgccgaccgtattcgagaattatatcgccgatatagaagtggacggcaagcaagtcgaacttgccctgtgggatactgccggccaggaagattacgatagattgcgcccattatcttaccccgacaccgacgtgatactgatgtgcttttcaatcgactcccccgactcactcgagaatatcccagagaaatggactcctgaggtcaaacacttctgccctaacgtgcccatcattcttgttgggaataaaaaggacctaagacaggatgaacacacctag

SEQ ID NO: 26077 - DNA, 690 bp, Artificial Sequence
  Description of Artificial Sequence: Synthetic coding sequence
atggtgagcatcagcggcggcgacctgcccaccggcctggacttcatcagcgcacccgaaccagcattatccagttgctctcttggaacatctgcgggctggagcccaacaatggctgccattcgcaagaagctggtgatcgtcggtgacggcgcttgcggtaaaacttgcctgctgattgtgtttagtaaggatcaattccccgaggtatatgtgcctaccgtctttgagaattatatcgctgatatagaagtggacggaaagcaggttgagctcgctttgtgggacactgcgggtcaggaggattacgaccgactgagacccctgtcctaccctgatactgacgtgattttgatgtgtttctctatcgattctcccgattctctagagaacatccctgaaaagtggaccccggaagttaagcacttctgtcccaatgtgccaattatattggttggcaacaaaaaggatttacggcaagatgaacatactcggcgcgagctcgccaagatgaaacaagagcctgttcgaagtgaagagggcagagacatggcaaatcggatatccgcctttggctacctggagtgtagcgccaaaaccaaagagggagttagggaggtatttgaaatggccacccgcgctggactgcaggtcaggaagaataagcggcgacggggatgtcccatttag

SEQ ID NO: 26078 - DNA, 510 bp, Artificial Sequence
  Description of Artificial Sequence: Synthetic coding sequence
atggccgccatccggaagaagctggtgatcgtgggcgacggcgcctgtggcaagacttgcctcctgatagtgttttcaaaggatcagtttccggaggtgtatgtaccgactgtcttcgagaattacatcgctgatatcgaagtggacgggaaacaggtcgaactggccttgtgggataccgcaggccaggaggattacgacaggctgaggccgttaagctatcccgatacagatgttatcctgatgtgtttcagtatcgacagtccggattctctcgaaaatatccctgaaaaatggaccccagaggtgaaacacttttgtccgaatgtccctataattcttgtggggaataaaaaggacctgagacaggatgaacacacgagacgggagctcgctaaaatgaagcaggagccggtcagatcagaagaaggtagagatatggctaaccgcatttcggcttttgggtacctcgaatgttccgctaagaccaaagaaggggtgagggagtag

SEQ ID NO: 26079 - DNA, 3144 bp, Artificial Sequence
  Description of Artificial Sequence: Synthetic coding sequence
atgatggccgccgaggccggcagcgaggagggcggccccgtgaccgccggggccggcggcggcggagctgcagccgggtcttcagcgtaccctgccgtttgcagagtcaaaatcccagctgccctgccagtggctgctgcgccctaccctggcctggtggagactggcgtggcgggtaccttgggcgggggagcggccttaggatccgagttcttgggggctgggagcgtcgccggcgcccttggaggagccggtttaaccggaggggggaccgccgccggggtcgccggcgctgcggcaggagtcgctggcgccgccgtagccggccccagcggcgacatggctctgacaaagctgcccaccagtctgctggcagaaacgctgggacctggcgggggatttcctccattgccacctccgccttacttaccgccccttggtgcggggttaggaaccgtcgatgagggcgactctttagatggtccagagtatgaagaggaagaagtggcaatccctctaacagctcccccgaccaaccagtggtaccatggcaagttagaccgaaccatagccgaggagagactaagacaagcagggaaatcaggctcgtacctcatccgagagtcagacaggcgaccggggtccttcgtgctttccttcctctcccagatgaatgtcgtgaaccattttcggatcatcgctatgtgtggggattactatataggcggtcgccggttctccagcttgtctgacctgatagggtactatagtcacgtatcttgtctgctgaagggtgagaagcttctgtatccagtggcacctccagaacccgtggaggacagaagacgggtcagggccattctaccatacaccaaggtcccggataccgacgagatcagcttcctaaagggagatatgtttatcgtgcataacgagttggaggacggctggatgtgggtcacgaatctgcggacagacgagcaggggttaattgtcgaagatttagtggaggaggttggaagagaggaggatccacacgagggaaaaatctggttccatggcaagattagtaagcaagaggcttataatctgttgatgactgttggacaagtgtgcagctttttggtgcgacccagtgataatacccccggtgactattcactctattttcgaactaacgagaatattcagagattcaaaatttgccccactcctaataaccagtttatgatgggcggccggtattacaattcaataggggacattattgatcattatagaaaagagcagattgtggagggttattacctgaaagaacctgtccccatgcaggatcaggagcaggtgctaaatgatacagtcgacggcaaggagatttacaacactatacggcgcaagaccaaagacgccttctacaaaaatatcgtcaaaaaaggctatttgcttaaaaaaggcaagggcaaacggtggaaaaacctgtacttcattctcgagggatccgatgcacagttgatctacttcgagagtgaaaagcgagccacaaagccaaaaggactgatcgacctgtctgtgtgcagtgtgtacgtcgtccacgattccctgttcggtaggcctaactgcttccaaatcgtggtacaacattttagcgaagaacactacatcttttacttcgccggagagacacccgagcaggccgaagactggatgaaggggctgcaggctttttgtaatttacgaaagtcctccccgggcacctcaaacaaacgactacggcaggtgtcgagtctggttctgcacatcgaagaagcccataagctgcctgtaaagcactttactaacccctactgcaacatctacctaaactccgtgcaggtggcgaaaacccacgccagggaggggcaaaatcctgtgtggagcgaggaattcgtcttcgatgacctgcctccggacattaaccgatttgaaatcacactgtccaacaaaacaaaaaaaagtaaggatcctgacatcctcttcatgcgctgtcagttaagtcgcttgcagaaggggcatgccacggatgagtggtttttattgtcatcccacatccctttgaagggaatcgagcccggttcgttacgcgtgcgagccaggtatagcatggagaagattatgcctgaagaggaatactcagaattcaaggaactaatccttcagaaagaactccacgtggtttacgccttaagccatgtgtgtggccaggataggacacttcttgcaagtattctgctgaggatatttctgcatgaaaagcttgagtcactactcctatgtaccctgaacgaccgggagatttctatggaggacgaggctaccacgctcttccgggccactaccttggcgtcaactttgatggaacaatacatgaaggcaaccgctactcaatttgtgcatcacgcccttaaggattccatcttgaagatcatggagagcaagcagtcctgcgaactgtcacccagtaaattggagaaaaatgaggatgttaacactaatcttacccacctcctgaatattctctcggaactggtggagaaaatttttatggcctctgaaatacttccacctaccttgcgatacatctacggctgtttacagaaatccgtgcaacacaaatggcctaccaacacgacaatgcgcactcgggttgtgtctggctttgtgttcttgaggcttatctgcccagctattctaaacccccggatgtttaatatcatctcagactcgccaagccctatcgctgcacgaaccctgatcttagttgcaaagagcgttcagaacctcgccaacctcgttgagttcggagccaaggagccatacatggagggtgtgaaccccttcattaagagcaataagcatagaatgatcatgtttcttgatgaactgggcaatgtgcctgagcttccggacaccaccgaacacagccggaccgatttgagtagagacttagccgcactacatgaaatatgtgttgctcatagcgacgagcttaggacgttgtctaatgaaaggggggctcagcagcatgtgttaaagaaactgctggccattactgagctcctccagcagaagcagaaccagtataccaaaacaaacgacgtgcgatag

SEQ ID NO: 26080 - DNA, 2613 bp, Artificial Sequence
  Description of Artificial Sequence: Synthetic coding sequence
atgaagggctggtaccacggcaagctggaccggaccatcgccgaggagcgcctccgacaagccggcaaaagcggaagctacctgatacgcgagtccgatcgacgcccaggtagttttgttttgtccttcctcagccagatgaacgttgtgaaccattttcgcataattgcaatgtgcggcgattactacatagggggacggcggttctcctccttgtctgacctcataggctattatagccacgtctcctgtttgctaaagggcgaaaaattattgtaccctgtagcaccgcctgaacccgttgaagacaggaggagggtgagggcaatcctgccttacaccaaagtccccgatactgatgaaatttctttcctgaaaggggacatgtttatagtgcataatgagctggaagacggttggatgtgggtgaccaacttgcgcaccgacgagcaaggactgatcgtagaggatctggtcgaggaagtcgggagggaggaggacccgcatgaggggaaaatctggtttcacgggaagatctcgaagcaggaagcgtacaatctgctgatgaccgtcggacaggtttgtagcttcttagtgaggccttcagacaacacccccggggactatagtctgtacttccggacaaatgaaaatatacagcgatttaaaatatgccccacacccaataaccagttcatgatgggcggccgctactataacagcattggtgacatcattgaccactaccgaaaggagcagatcgttgagggctattacctcaaggagcccgtccctatgcaggaccaagaacaggtgttaaatgacaccgtggatggaaaggagatatataataccatccgacggaaaactaaggatgcattctataagaatatcgttaagaaagggtatcttctgaaaaagggcaaaggcaaaagatggaagaacttgtacttcattctcgaaggtagcgacgcccagctgatatattttgaatctgaaaaaagggctaccaagccaaaggggctgatcgatctgagcgtttgctctgtctacgtggttcatgactccttgtttggaagacccaactgttttcaaattgtcgtgcagcattttagtgaggagcactatatcttctatttcgccggggagacccctgagcaggctgaagactggatgaaaggcctccaggctttctgcaacctacggaagtcatcccccgggacctctaataagagactgcgacaagtgtcctctctggttctgcatatagaggaggctcacaaattacccgtgaagcacttcaccaatccttattgtaacatttatcttaatagtgtgcaggtcgccaaaacccacgcccgggaggggcagaacccagtgtggtctgaggagtttgtgttcgacgatctacctccagatattaacagattcgagatcaccctttctaacaagaccaagaagtcaaaagatcccgatattcttttcatgagatgtcagctcagtagactccagaagggccatgcaaccgatgaatggtttctactaagcagtcacatcccgctgaaaggcattgaacctgggtcactgcgtgtgagggccaggtattccatggaaaagataatgccagaagaagagtactcagaatttaaagagctgatcttacagaaggagctgcacgtcgtgtatgcactgtctcacgtgtgcggccaggataggacactgctggcaagtattcttcttcggatttttttacacgagaaactggaatccctcctgctctgtaccctgaacgaccgggagatttcaatggaagatgaggctacaaccctgttcagggccacaaccctcgctagcacactgatggagcagtacatgaaggcaactgcaacacagtttgtgcatcacgctctcaaagacagcatactaaagattatggaatccaaacaaagttgcgagctgtcgccaagtaaattggagaagaacgaggacgtgaacaccaatctaacacacctgctcaatatcctctccgagctcgtggaaaaaattttcatggccagcgagatcctgcctcccacccttcggtacatctatggctgtctgcagaagtccgtccagcacaaatggccaaccaacacaactatgagaacgcgcgtggtctctggatttgtgttcttacgacttatatgtcccgctattcttaaccccagaatgtttaatatcatatctgattcacccagtccaattgccgcccgcactctaattttggttgcaaaaagtgttcagaatttagccaatctcgtggagttcggcgctaaggagccgtatatggaaggagtgaatccctttattaagagcaataaacatcgcatgataatgtttctcgatgagttgggcaatgtgccagagcttccggatactactgagcactctaggaccgacttgagcagggacttagccgccctgcatgagatttgtgtggcgcactctgatgaactaagaaccctgtccaacgagcggggggcacagcagcatgttctcaaaaaacttctcgccatcaccgagctgctgcaacaaaagcagaaccagtacactaaaaccaacgatgtgaggtag

SEQ ID NO: 26081 - DNA, 2646 bp, Artificial Sequence
  Description of Artificial Sequence: Synthetic coding sequence
atgtgcctggtgaagagctggttcctgagcatccggagccggtggtaccacggtaagctggataggaccatcgccgaggagcgccttcgacaggccggtaaatcaggctcttatttgattagggaaagcgatagaagaccgggctcgttcgtcctctccttcttatcgcagatgaatgttgttaaccatttccgaattattgcgatgtgtggtgactattacattggtgggcgaaggttctcttccttgtcagacctaatcggctactactctcatgtctcctgtctactgaagggagaaaagttactttatccggtagcccctcctgagcctgtggaggaccgccgacgggtcagagctatcctaccatacacaaaggtccctgacacggacgagattagttttttgaaaggagatatgttcatagtgcataacgagctggaggatggttggatgtgggtgactaacttacgtaccgacgagcaagggctgattgtggaagacctggtcgaagaagtggggagagaggaagaccctcatgagggaaagatttggttccatggcaagatcagcaagcaggaggcctataaccttcttatgaccgtcgggcaagtttgtagctttctggtgaggccatcagacaacactcccggagactattcactttatttccgcacgaacgagaatattcagcgctttaagatctgtcccacccctaacaaccagtttatgatgggaggtcgatactataacagcatcggggacatcattgatcactatcgtaaggaacagatagtagagggctactaccttaaggagcctgtgcctatgcaggatcaggaacaggtgctcaacgacaccgtggacggaaaagagatttataataccatcaggaggaaaactaaagatgccttttacaaaaacattgtgaagaagggctatctacttaagaaaggtaaggggaaacgatggaaaaacttgtacttcatccttgaggggagcgatgcccagttgatttactttgagtcagaaaagagggccactaagccgaaaggtttaatcgatctgtccgtctgtagcgtttacgttgtacacgactcgctctttggacgaccaaactgttttcaaattgtcgttcaacacttctcggaagagcactacatattctactttgccggggagaccccagaacaggccgaggactggatgaaaggacttcaggcgttttgtaatctgaggaagtctagtccggggacgtccaacaaacggctgcggcaggtttcctccctcgtgcttcacattgaggaagctcacaagctcccagttaagcatttcaccaacccttactgtaacatctatctgaatagtgttcaggtcgcgaaaacccatgctcgggagggccagaacccagtatggtcagaggagtttgtcttcgacgacctgccgccagacatcaaccggttcgagattactctatcaaacaagacaaagaagagtaaagaccccgatatcctctttatgagatgccagctgagccgattgcagaagggacacgcaacagatgaatggttcctgttgtccagccatataccacttaaggggatcgagccaggctcactcagagtccgggcccggtacagcatggagaagataatgccagaggaagaatactctgagtttaaggagttaatcctccagaaggaactgcatgttgtatacgctctgtctcatgtttgtggccaagataggaccctgctcgcttcaattctcctgcggatatttcttcatgagaaattggaaagcctgctgctgtgcaccctcaacgatagggagatcagcatggaagacgaggccacaaccctatttagagctaccacgctcgcctccactctaatggagcagtacatgaaagccactgccactcagttcgtgcaccacgcactaaaggacagcatactaaagatcatggaatctaagcaatcctgcgaattgtctccatcaaagctggagaagaatgaggacgtaaataccaacctgacgcatttactaaatattctcagtgagctggtggagaagatcttcatggcatccgaaatattgccacccaccttgaggtatatctatggatgcttacagaaaagcgtacagcacaaatggccaactaatacgacaatgaggacacgtgttgtatcaggatttgttttcctgcggctaatctgccccgccattctgaatcccagaatgttcaacattatcagtgactctccttcccccatcgcagcccgtacattgattctggtagcgaagtcagttcagaacctagcaaacttggtggagttcggggctaaggaaccctacatggagggcgttaacccatttattaaaagcaataagcacagaatgataatgtttctcgatgagcttggaaatgttccagaattgcctgacaccacagaacacagccgaacagacctttctcgcgatctggctgctctgcacgagatttgcgtggctcactccgatgaactgcggaccctgtcaaacgaaaggggggcacagcaacatgtcttaaagaagttactcgccatcactgaactcttgcagcagaaacagaatcagtacaccaagaccaatgacgtccgttag

SEQ ID NO: 26082 - DNA, 2643 bp, Artificial Sequence
  Description of Artificial Sequence: Synthetic coding sequence
atgcggaccggctacagcagcgtgcccagcaagctgcggtggtaccatggtaaacttgaccgaacaatcgccgaagaacgattaaggcaagccgggaagtcaggtagttacctcattcgcgagtccgatagacgcccagggagttttgttttgtctttcttaagtcagatgaacgtggtgaatcactttcgcatcattgcgatgtgtggagattactacataggcggccgacggttttcttcattgtccgacctgatcgggtattactcccatgtgtcctgcctgttaaaaggagagaaacttctgtatcctgttgcgcctccagagcccgtcgaggatcggcgtcgagtgagagcaatcctgccatatacaaaggttccggacaccgacgaaataagctttctgaagggagatatgtttattgtccacaacgagctcgaggacggatggatgtgggtgaccaatctgcgaaccgacgagcagggattgatagtggaagatctggttgaggaagtcggaagagaggaggaccctcacgagggcaaaatttggttccatggcaaaatctctaagcaagaggcatacaatctgctgatgaccgtgggccaggtttgtagctttcttgtgcgtcccagcgacaatacccccggagactatagtctttactttcgcactaatgaaaacatccaaaggttcaagatctgtccaacaccgaacaatcagtttatgatgggtggtcgatactacaactcaataggggacattatagaccactataggaaggaacagattgtggaaggctactatctgaaggagcctgttcccatgcaggatcaggaacaggtgctgaacgataccgttgatggaaaggagatctacaatacaattcggcggaagacaaaggatgccttttataagaacatcgtaaagaaaggctatctgctgaagaaaggcaaaggcaagaggtggaagaatctgtattttatcctagaaggatcagacgcccagctgatctactttgagagcgaaaagagagcaaccaagccaaagggcctcatcgacctgtccgtgtgttcagtatatgtggtgcacgacagcttgttcggccgccccaactgtttccagattgtcgtacagcactttagcgaggagcactacatattctattttgcgggggaaacaccagaacaggccgaggattggatgaagggtctgcaggccttctgcaatctgaggaagtcctcccctggaacctccaataagcgtcttaggcaggtaagctctcttgtcctgcacatagaggaagcccacaagctacctgtgaaacacttcactaatccctactgtaatatttaccttaactctgtccaagtggcaaaaacacacgcccgcgaggggcagaatcccgtctggtctgaggagttcgtgttcgacgaccttccaccagacataaatagatttgagataactctcagtaacaagacgaaaaaatccaaggaccctgacatcttatttatgcggtgtcagctctctcgcctgcagaagggtcacgctacagacgagtggttcctactgtccagccatattcccttgaaggggatcgaaccgggctcactaagggttagggcacgttactccatggaaaagattatgcccgaggaggaatatagtgagttcaaggaacttatcttacaaaaggaactgcacgtggtttatgcactgtcccatgtgtgcggacaggatcgaactttgttggcaagcatccttctgcgcatatttctgcacgaaaagctggagagcctcctgctttgtacattgaatgacagagagatttccatggaggacgaggctaccaccctcttcagggccacaaccctggcttcaacccttatggagcaatacatgaaggccacagccacacaatttgtgcaccacgctcttaaggatagcatcctgaaaatcatggaatcgaagcagtcgtgcgagctcagcccatccaagttagagaagaacgaggacgtcaacactaatcttactcatttgctgaacatcctcagcgagttggtggagaagatttttatggcctcagagattttgcctccaacccttcggtacatttacgggtgcttacagaagtctgtgcagcataagtggccaacaaacaccaccatgagaactcgcgtcgtttccggtttcgtttttcttcggctgatttgccctgccattctgaacccacgaatgttcaacattattagtgacagtccatctcccatcgctgccagaactctcatcctggtagcgaaaagcgtgcagaatctcgcaaacctggtggaatttggcgccaaggagccgtatatggaaggggtcaacccattcataaaatccaacaagcaccgcatgattatgttcctcgatgagctgggcaatgtgcccgaactaccagacaccaccgaacattctagaacagatctttctcgcgaccttgccgccttgcatgagatctgtgtggcccactcggatgaactgaggacgttaagtaacgaaagaggcgcccagcagcatgtgctgaaaaaattactcgccatcacagaactgctgcagcaaaagcagaaccagtacacaaagactaatgacgtgagatag

SEQ ID NO: 26083 - DNA, 2616 bp, Artificial Sequence
  Description of Artificial Sequence: Synthetic coding sequence
cggggcgacgccagcggctggggctgcagcgagcccggccccggcggaccctgggggagccgggcaggtcgcgtaggccagagcagagccggcttcaacatgatggccgcagaggctggcagtgaggaggggggaccagtgactgctggagccggcggaggaggcgccgccgcagggagctctgcttatcctgctgtgtgccgcgtcaagattcctgccgcattgccagtggctgctgctccataccccggcctggtggaaaccggggtggcaggcacattgggaggcggggccgccctcggatccgagtttctgggtgcgggatctgtagccggcgcgcttggaggcgccggattgacaggtggaggaacggctgccggagtagccggtgccgccgcaggggtggcaggcgcagctgtggccggaccaagtggggacatggctctgaccaagctgcctacctctctcctggctgaaacactgggacccggtggcgggttcccaccactgccgccacctccatatctgccgcccctaggcgccgggctggggactgttgacgaaggagattcgctggatggccccgaatacgaggaagaggaggtcgccatccctttgactgcgccccccactaatcaatggtaccacggtaaactggacaggaccatagcggaggaaaggcttagacaggccggtaagagcggaagttacctgatcagggagtcagatagacggcctggatcttttgttttgagcttcctgtctcaaatgaacgtggtgaatcacttccgaattatcgccatgtgcggcgactactacatcggcgggagacgattcagttccctgtccgacttaattggctactactctcacgtgtcctgcctgctgaaaggggaaaagctcctttatcccgtcgcgcccccggaaccggtcgaagaccggagaagggtgagagccattctgccatatacgaaagtgcccgacactgatgagatatcttttttgaagggcgacatgttcattgtgcataatgagttggaagacggatggatgtgggtgaccaatctgaggactgatgagcagggcctgatcgtagaggatctcgtggaggaagtcggtcgggaagaagatcctcacgaaggcaagatatggtttcatggtaagatttcgaaacaggaggcatacaatctcctgatgacggttggacaagtttgtagtttccttgtacgaccctccgacaataccccgggtgactatagcttatacttccgcaccaacgagaacatacagagatttaaaatctgccccacccctaacaatcagttcatgatgggcgggaggtattataatagtatcggtgacatcatcgaccattaccgcaaggaacaaatcgtggaaggctattacctaaaagagcccgtcccaatgcaggaccaggagcaggttctaaacgacacagtagatggaaaggagatctataacactataaggagaaagactaaagatgccttctacaagaatatcgtaaagaaaggatatttgctgaagaagggaaagggaaaacgttggaaaaatctgtactttatcctcgagggatctgatgcccagctgatctatttcgagagtgaaaagagagcgaccaagcccaagggcctgattgacctgagcgtgtgctccgtgtacgtagtacacgattctttatttggcagacctaattgcttccagatcgtcgtgcagcacttcagcgaggaacactatatcttttattttgcgggggagacccccgagcaagccgaagactggatgaaggggttgcaggcattctgtaatcttcggaaatcaagcccgggcaccagtaacaaacgcctcagacaagtgtcctccctggtgttgcacatcgaagaagcacataaactgcctgtgaagcacttcactaatccctactgcaacatttacctgaattccgttcaggtcgccaagacccacgcccgagaaggccaaaatcccgtgtggagcgaagagttcgttttcgacgatcttccaccagatatcaacagattcgaaattaccctttcaaataagactaagaaatctaaagatccagacattctcttcatgagatgccaactgtcccgcctccagaagggtcacgccactgacgagtggttcctgctaagtagtcacattcccctgaagggtatagagccaggatcgctacgcgtccgcgccagatactcaatggagaagattatgcccgaggaggaatactccgagtttaaggagcttatcttacagaaagagctgcatgttgtatacgctctctcccatgtgtgcggtcaggatcgtacattgttggcaagtatcctcctgcgaatcttcttacacgaaaaactggagtccttgctgctgtgtacgctcaatgacagagagatttccatggaggacgaggcaacgactctttttcgagccaccaccctggcttccactttaatggagcaatacatgaaggcgactgctacccagtttgtacaccacgctctgaaggatagcatccttaaaatcatggagagcaagcaatcttgtgagctcagctctagtaaactccagaaggcatag

SEQ ID NO: 26084 - DNA, 1161 bp, Artificial Sequence
  Description of Artificial Sequence: Synthetic coding sequence
atgaacccccagatccggaaccccatggagcggatgtaccgggacactttttacgacaactttgagaatgaacccatcctctacggacgcagctacacctggctgtgctatgaagtgaagatcaagcgaggccggtccaacctcctgtgggacaccggcgtgtttcgcggtccggtactgcctaaacgccaatcaaatcatagacaggaggtgtactttcgtttcgagaaccatgccgagatgtgctttctgagttggttctgcggaaaccgcttgcctgccaaccgtcggtttcagatcacctggttcgtatcctggaatccttgtctcccatgcgtggtgaaggtcacgaagtttctggccgagcacccaaacgtgacccttaccattagcgcggcaagactctactattacagggatcgggactggcgctgggtgctgctcagattgcacaaagccggcgcccgagtgaagattatggattatgaggatttcgcttattgttgggaaaattttgtttgcaatgagggacagcccttcatgccatggtataaattcgacgataactacgcatccctgcaccgcacgctgaaagaaatcctgcgcaatcccatggaggctatgtatcctcatatcttttatttccacttcaagaacctgctgaaggcttgcgggaggaatgagtcatggctgtgttttactatggaagtgaccaaacatcatagtgctgtttttaggaaacggggcgttttccgcaaccaggtggacccagagacccattgccatgccgaacgatgtttcttatcatggttctgtgatgacatcttaagcccaaacacgaattacgaggttacctggtacacctcctggtctccttgtcccgaatgtgccggagaggttgccgagttcttggccaggcacagcaacgtgaatttaaccatatttactgcgcgcctgtgctatttttgggacaccgattatcaggaggggctgtgcagcctcagtcaggagggcgcatcggttaagattatgggatacaaggactttgtgtcttgctggaaaaatttcgtgtactcagatgacgagccatttaaaccatggaaaggtcttcagacaaatttccgactcctgaagcgaagacttagggaaattctgcagtag

SEQ ID NO: 26085 - DNA, 348 bp, Artificial Sequence
  Description of Artificial Sequence: Synthetic coding sequence
atgggcggcagcctgcgggtggccgtgctgggcgcccccggcgtggggaagaccgccatcatccgtcagttccttttcggagactaccctgagcggcacagaccgacggacggacctaggctgtaccgaccggccgtgctgcttgatggcgcagtttacgacctgtccatccgggatggagatgtcgcgggtccaggatcttcacctgggggccccgaggaatggccggatgccaaggattggagcctgcaagataccgacgccttcgtcctggtgtatgacatctgctctcctgacagcttcgactatgtcaaggcattaagacagcgcatcgctgagacccggtag

SEQ ID NO: 26086 - DNA, 579 bp, Artificial Sequence
  Description of Artificial Sequence: Synthetic coding sequence
atgcaggccatcaagtgcgtggtggtgggcgacggcgccgtgggcaaaacctgcctcctcataagctacacaaccaatgccttccccggggaatatatcccaacagtgtttgacaactacagcgccaatgtgatggtggatggcaagccagtcaatctggggttatgggacaccgccgggcaggaagactacgaccggctccggccactctcctatccccagaccgacgtatttctaatttgcttttctctagtcagcccagcatctttcgagaatgtccgcgcaaaatggtatccagaggtcagacaccattgccctaacaccccaatcatactggtggggaccaagctcgacctcagagacgacaaagacaccattgaaaaacttaaagagaagaaacttactcctatcacatatccacaggggctcgctatggccaaagaaatcggagcagtcaaatacttggagtgcagtgcactgacacagcggggactgaaaacagtcttcgacgaagccattagagccgtgctgtgcccaccaccggtaaagaagcggaaacggaagtgcctgcttctgtag

SEQ ID NO: 26087 - DNA, 636 bp, Artificial Sequence
  Description of Artificial Sequence: Synthetic coding sequence
atgcaggccatcaagtgcgtggtggtgggcgacggcgccgtgggcaagacgtgtctcctgatctcctacacaacaaatgcattccccggtgagtacataccgactgttttcgataattatagcgcaaacgtaatggtcgatgggaagccagtaaatctgggactctgggataccgcaggccaggaggactacgataggctccgcccactgtcctaccctcagacggtgggggagacttatggcaaggatattacctccaggggaaaagataaaccaattgcggatgtgtttctgatttgtttcagcctggtgtcgcccgcctctttcgagaacgtgagggcaaaatggtacccagaggttaggcatcattgccctaacacacccataatactggtggggaccaagctggacctgagagacgataaagacacgatcgagaaactgaaagagaagaaacttacccccatcacctatcctcagggcctcgctatggccaaagaaataggagctgtaaagtacttggaatgcagcgctcttacccaacgcggcttaaagacagtttttgatgaagcaatccgtgccgtcttgtgtcctccgccggtcaagaagcggaagaggaagtgtctcctcctttag

SEQ ID NO: 26088 - DNA, 579 bp, Artificial Sequence
  Description of Artificial Sequence: Synthetic coding sequence
atgcaggccatcaagtgcgtggtggtgggcgacggcgccgtgggcaaaacctgtcttctgatctcttacactacgaacgctttccccggagaatatatccccactgtcttcgataactacagtgccaacgtgatggtggacagcaaacccgtcaatttggggctgtgggacactgcgggacaggaagactatgatcggctgaggccgctctcctacccccagaccgatgttttcctgatctgttttagtctggtgagtcctgctagctatgaaaacgtgcgggccaagtggtttccagaggtccggcaccattgtcccagtactcccattatactcgttggcacaaaattggatctacgggatgacaaagacacgatcgaaaaattaaaagagaaaaaattggctcctataacctatccacagggtctggcattggccaaggagattgactcggtgaaataccttgaatgctccgctctgacccagagggggctgaagaccgtgttcgatgaggcaatcagggcagtcttgtgccctcagccgactcggcagcagaaaagggcctgttctttgctatag

SEQ ID NO: 26089 - DNA, 261 bp, Artificial Sequence
  Description of Artificial Sequence: Synthetic coding sequence
atgcaggccatcaagtgcgtggtggtgggcgacggcgccgtgggcaaaacctgccttctcatctcttacactactaacgccttcccaggcgagtacattccaacagtgcccggacgcccatgtgctctgttgcaggacgctgaggcggggcttagctctgacgtcgaaggcgcctgctggtgccagacccaggagggacgcatgacaggggaggccccagcccccccttggccggctttgaggggcccacatcactcttag

SEQ ID NO: 26090 - DNA, 558 bp, Artificial Sequence
  Description of Artificial Sequence: Synthetic coding sequence
atgcaggccatcaaggccgtgggcaagacctgcctgctgatcagctacaccaccaacgcgttccccggggaatacatacctaccgtgttcgataattactctgccaacgtaatggttgattcgaaacctgttaacctcggcctgtgggataccgctgggcaggaggattatgaccggctgcgcccactgagttaccctcagactgacgtgtttctcatctgtttctccctggtgagccctgcgtcatacgaaaatgtgagagccaagtggttccctgaggttaggcatcactgcccctctacccctattattctggtcggcacgaagctggatttgcgcgatgacaaggacaccatagaaaagctcaaagagaagaaattggcgcctattacctacccacagggcctggctctcgctaaagagatcgattctgtgaagtacctggagtgttctgctctgacacaacgaggactaaagactgtcttcgacgaggccatacgcgctgtgctttgccctcaacctacacggcaacagaagagagcttgtagcttactgtag

SEQ ID NO: 26091 - DNA, 447 bp, Artificial Sequence
  Description of Artificial Sequence: Synthetic coding sequence
atggtggacagcaagcccgtgaacctgggcctgtgggacaccgccggtcaagaagactatgataggctgaggcctttgagttacccccaaaccgatgtattcctcatctgttttagcctcgtgagcccagcgtcgtacgagaacgttagggccaaatggttccctgaggtgcggcaccattgccccagtactccaatcatacttgtcggcacaaagctagatttgagggatgataaggacactatcgagaagctaaaagaaaagaaattagcccccattacatacccacagggactggctctggcgaaagaaatagacagtgttaagtacctggagtgctctgctcttactcaacgagggctcaagaccgtgttcgatgaagccattagagctgtgctttgtccccaacctactcggcagcagaagagagcatgttcactgctttag

SEQ ID NO: 26092 - DNA, 501 bp, Artificial Sequence
  Description of Artificial Sequence: Synthetic coding sequence
atgcaggccatcaagtgcgtggtggtgggcgacggcgccgtgggcaaaacatgcctgctgatatcttacactactaacgcatttccaggtgaatatatcccaacggtgttcgataattactctgccaacgtaatggttgactctaaacctgttaatctagggctgtgggacacagccggacaagaggattatgatagactcagacctctcagctatccacagacagacgtgttcctgatctgcttttccctagtgagtcctgcttcatatgagaatgtcagggccaaatggtttccagaggtgagacaccactgtccctccactcccatcatcctggtgggtaccaaactagatctgcgggacgacaaggacaccatcgaaaagctgaaggagaagaagctggctcctattacctacccgcagggcctggcgctggccaaagaaatcgactcagtgaagtacttggagtgcagcgcactcactcagcgtggtctgaagtag

SEQ ID NO: 26093 - DNA, 4785 bp, Artificial Sequence
  Description of Artificial Sequence: Synthetic coding sequence
atgaagctgtacgtgttcctggtgaacaccggcaccaccctgacctttgacaccgaactcacagtccaaactgtcgccgatctcaagcatgctatacaaagcaaatacaaaatcgcgatccagcaccaagtgctggtcgtaaacggaggcgagtgcatggccgcagaccgcagagtctgcacctacagtgctgggaccgatactaaccccatattcctcttcaataaagagatgatcctgtgtgatcgcccacctgctatcccaaagacaacattctctacagagaatgatatggaaattaaggttgaggagtcgcttatgatgccagctgtttttcacaccgtagcgtcgaggacccaactcgccctagagatgtacgaggtggccaagaagctctgttcattttgcgaaggcctcgttcatgatgaacacctccagcaccaagggtgggccgccattatggctaacctagaagactgcagcaattcttatcagaagctcttattcaaatttgagtccatctacagcaattatttacaatccatcgaggatatcaaattgaagctgacacatctggggacggcggtctccgtcatggctaagatacctttgctggaatgtctgacacggcattcataccgcgagtgtctcggtcggctggacagtcttcccgaacatgaggattctgagaaagccgaaatgaaacggtctaccgaactagtcttatctccggacatgcctagaactaccaacgagtcgttgctcacaagtttccctaaatcggttgaacacgtttccccagacacagccgacgccgagtcaggaaaagaaatcagagagtcttgccagtcaacagtccatcagcaggatgagacaacaatcgatactaaggacggtgacctgcccttcttcaatgtgtccctgctagattggatcaatgtgcaggatcgtcctaatgatgtcgagagcctcgtgagaaagtgttttgacagcatgagtcgcttggacccccgcatcattcgtccattcatcgctgagtgtcggcagactatcgcaaagctagacaaccagaatatgaaggccatcaagggtttagaggataggctgtacgccttggaccagatgatcgcttcttgcggccggctcgtaaacgagcagaaggaactggcccaaggctttctagcaaaccagaagcgcgcggagaacctgaaggacgcaagtgtgttgccagacctttgcctgtcacacgcaaatcaattgatgattatgcttcagaaccaccgcaagctcttggatatcaagcagaaatgcacgaccgccaagcaggagctcgccaataacttgcacgtgcgactgaagtggtgctgtttcgtcatgttgcacgcggaccaagacggtgaaaaactccaggccctgctgagactcgtgatcgaacttttagagcgggtgaagatagtggaggcattatctaccgttccacagatgtattgtctggcagttgttgaagttgttcggaggaagatgttcatcaaacactacagagagtgggctggcgcccttgtgaaggatgggaagaggttgtatgaggcggaaaagagtaagagagagtccttcggcaaacttttcagaaaatcttttcttagaaatcgtttgtttagagggttagattcatggccacccagcttctgcacccagaaaccccgaaagtttgactgtgagctgccagacattagcctaaaagatctccagttcctgcaatccttttgtccttcagaagtgcaaccttttctcagggtgcctttgctttgcgattttgagcccctgcaccagcatgtgctcgccctccataatctcgttaaggctgcccagtccctggatgagatgtcgcaaacaattaccgatctgcttagcgagcagaaggccagtgtctcacagactagtcctcagtctgcaagctccccccgtatggaaagcacggccggcattactaccaccacctctccccggacacctccacccctaacagttcaggatcctctgtgccccgctgtgtgccctctcgaggagttgtcaccagactcgattgatgcgcatactttcgacttcgagacaattcctcatccaaatattgagcagaccattcatcaagtgtctctcgacctcgactctctcgctgagtcccctgaatctgatttcatgagtgccgttaacgagtttgtcattgaggagaacctgtcctcccctaatcccatatcagacccccagtctccggaaatgatggtggaatcactctacagctctgtcattaacgctatagacagtcggcgcatgcaggatactaatgtctgtggaaaagaggatttcggagatcacacaagcctgaatgttcaactcgaacgctgtcgcgttgttgctcaagattctcattttagcatacagacaattaaagaggatctatgtcattttcggacctttgtccagaaggagcaatgtgactttagtaacagtttgaagtgcaccgccgtcgaaataaggaacataatcgagaaagtgaaatgcagcctcgagattacccttaaggagaaacaccaaaaggaacttctctctctgaagaacgagtatgaagggaaacttgatgggttaatcaaggagacagaggagaatgagaataagattaaaaagctgaagggagaactggtatgtctggaggaagtgctccagaacaaggataatgaattcgctctggttaaacatgagaaggaggctgtgatctgcctgcagaacgagaaggatcagaagttgttagagatggaaaatattatgcattcgcagaattgcgagatcaaggagctgaaacaaagccgtgagattgtactggaagacctcaaaaagctgcacgtcgagaacgatgaaaagttgcagttgctgagagctgaactccaatcgctggaacaaagccacttaaaagaactcgaggacaccttgcaggttcgacacatacaagagtttgagaaagtgatgacagaccacagggtttcactggaggagctgaagaaggaaaaccagcaaataataaaccaaattcaggagtcacacgctgagattatccaagagaaggagaaacagctacaggagctcaagctgaaggtttcagacctgagtgacaccaggtgtaagttagaggttgaactggcgttgaaagaggctgaaaccgatgaaataaagatactactggaagagtctcgcgcccagcaaaaagagaccctaaagtctctcctcgagcaggagacggagaatctgcgcacagaaatcagcaaactgaaccagaaaatccaggataacaatgagaattaccaggtggggctggccgagctgcggactctgatgacaatcgagaaggatcagtgtatctcagaactcatttcccgacacgaggaggagagcaacatcctcaaagccgaactgaacaaagtgacctctttgcataaccaagcatttgagatcgagaagaacctgaaagagcagattattgagctccagtcgaaacttgattccgaactttcagctctggaaaggcagaaagacgaaaaaatcacccagcaggaggaaaaatatgaagctattatccaaaatctcgagaaggatcggcaaaagctcgtttcctcacaggaacaagatagggaacaattgatccagaaactaaattgcgaaaaggatgaggcgatccagacggctctgaaagagttcaagctcgagagggaagtcgtggaaaaagagctcctggaaaaggttaagcatttagagaatcagatcgcgaagagccccgccattgatagcacccggggagattcgtcttctctcgtcgccgagcttcaggaaaaactccaagaagagaaagctaaattcctggaacaattagaggagcaggagaaaagaaaaaacgaagagatgcagaatgttcgcacctcacttattgctgagcagcagacaaacttcaataccgttctgacccgcgaaaaaatgcggaaggaaaatatcattaatgatttatcagataagctgaagtctaccatgcagcagcaggagcgagacaaagatctcatcgaatcattgagtgaggacagggctaggctcctggaggagaaaaagaaactggaggaggaggtgtctaagctgcggtcttcatcatttgtgccatcaccatatgtagcgaccgctccggaattgtatggcgcttgtgctcctgaactgcctggtgaatccgataggtctgcagtggagacggctgatgaaggccgtgtggactcggctatggagacttccatgatgtccgtgcaagaaaatatccatatgctgtctgaggaaaagcagcggatcatgttgctggagcgtactcttcagctgaaggaggaggaaaataaaagattgaatcaacgcttaatgtcccagtcaatgagctccgtctcttcaaggcattcagagaaaattgccatccgcgattttcaggttggtgacctagtccttataattttagacgaaagacacgacaactacgtcctctttacagttagtcctactttgtacttcctgcacagtgagtccttaccagcactggacctgaagcccggcgaaggggcctccggtgcctctcggcgtccttgggtcttgggcaaagttatggagaaagagtactgtcaggccaaaaaagctcagaacagattcaaggtgcccctgggcaccaaattctatcgcgtcaaggcagtgtcttggaataaaaaagtgtag

SEQ ID NO: 26094 - DNA, 4776 bp, Artificial Sequence
  Description of Artificial Sequence: Synthetic coding sequence
atgaagctgtacgtgttcctggtgaacaccggcaccaccctgaccttcgataccgagctgaccgtacaaacagtggcagacctgaaacatgctattcagtccaaatataaaatagctatccaacaccaagtactcgtcgttaacgggggtgagtgcatggctgcggatcgccgagtctgtacatatagtgcagggacagatactaatcctatcttcctgtttaacaaagagatgatcctctgtgaccgcccccctgcaatcccgaagaccaccttcagcacagaaaacgatatggaaatcaaggttgaagaatcacttatgatgcccgccgtatttcacacggtggcctcccgaactcagttggcactggagatgtatgaagtcgcaaagaagctgtgctctttttgcgaaggccttgttcatgacgagcacctccagcaccaggggtgggctgctatcatggctaacttggaggattgtagcaattcctaccaaaaacttctgttcaagtttgaaagtatctattcaaattatctgcagagtatcgaggacattaagctgaagttgacccatctgggtaccgccgtgagcgtaatggcgaagatcccgctcctggagtgcttgacccgccattcttacagagagtgtttgggccggttagacagtctccctgagcacgaggacagcgaaaaggcagagatgaagcgctcaactgagctcgtactatcccctgacatgccccggactacaaacgaaagtttgttgacttcgttccccaaaagcgtggagcatgtttccccagacacagctgacgccgagagtggaaaagagatccgggagtcctgccagagcaccgttcaccagcaagatgagaccacaatcgatacaaaagatggagacctgccttttttcaatgtgagccttctggactggatcaatgtgcaggaccggccgaatgacgtcgagtctctggtaaggaaatgttttgattccatgagtcgacttgacccccgaatcattcggccttttatagcagagtgccgccagacaatcgccaagctcgataatcagaatatgaaagcgatcaagggactcgaggaccgactgtacgctctggatcaaatgatcgccagttgcgggagattagtgaacgagcagaaagagctagctcaaggtttcctcgctaatcagaaaagggcagagaaccttaaagatgccagcgtcctgccggatctatgcctatcccatgctaatcagctgatgatcatgctgcagaaccacaggaagctgctggatattaaacagaagtgtaccacagcaaagcaggagctcgcgaataacttacacgttcggctcaaatggtgttgcttcgtaatgttacacgctgatcaggacggcgagaagttgcaggcactgctgcgcctagtgatcgagttgctcgagcgggtgaagattgttgaggcgttaagcaccgttccacagatgtactgcctcgctgtggtggaggtggtgcgacgcaaaatgttcattaaacactacagggaatgggcgggtgccctcgtcaaggacggcaagcggctttacgaggctgagaaatccaagagggaatcattcggcaagttgttcagaaagagttttctgcgtaatcgactctttcgcgggctggattcatggcccccaagtttttgcactcagaagccgcgcaagttcgattgtgagctgcccgatatttctctgaaggacctgcagttcttgcagtcattttgtccatccgaggtccaaccttttctacgcgttcccttgctttgtgactttgagcctctgcatcagcacgtgctggccctgcacaacttggtgaaagccgcacagagtctcgatgagatgtctcagaccattaccgatctgctgagcgaacagaaggccagcgtaagccagacttcaccacagtccgcatccagtccaaggatggagtcaactgctggaatcaccacaaccacctccccgcggactcccccgcccctgaccgtacaggaccccttatgccccgccgtgtgccctctggaagaactatcacccgactctattgatgcacacacatttgattttgaaaccattccccaccccaatattgagcagaccattcaccaggtctccttggatttggacagtctggcggagtcgcccgagtccgatttcatgtccgctgtgaatgaatttgtcattgaggaaaatctctcctcccctaaccccattagtgacccacagagcccagagatgatggtggaaagcttgtacagcagcgtcatcaacgccatcgacagcagacgcatgcaggacactaatgtgtgtgggaaggaggatttcggggatcacacaagcctcaatgttcaactggagagatgcagagtggtggcccaagactcacatttctctatacagacgataaaggaggacctctgtcatttccggactttcgtgcagaaggagcagtgcgatttcagtaacagtctgaagtgcaccgctgtagagatacgtaatattattgagaaggtcaaatgttctctggaaataacactgaaagagaagcatcagaaggaacttttatccctgaagaacgaatacgaaggtaagttggatggactgatcaaggagaccgaagaaaatgaaaataagatcaagaaactgaagggcgaacttgtatgcctggaagaagtgctacaaaataaagacaacgaattcgccctcgtgaagcatgaaaaagaggccgtaatctgtcttcagaacgaaaaggaccagaaactcttagagatggaaaacataatgcactcacagaactgcgagatcaaagagcttaaacagagccgcgagatcgtgctcgaggatctgaaaaagcttcacgttgaaaacgacgaaaagcttcagctactcagagctgaactacagagtctggaacagtcccatcttaaagaactcgaagatacacttcaggtgcggcacatccaagaattcgaaaaggtgatgactgatcatagggtttcactcgaggagttaaaaaaggagaatcagcagatcataaaccaaattcaagagagtcacgccgagatcatccaagagaaggagaagcaactccaggaacttaagctcaaggtttccgacctgagcgatacgaggtgcaaattggaagtggagctggccttgaaggaggcagagacagatgagattaaaatcctgttagaggagtctagagctcagcagaaggagacactgaagagcctcctggagcaggagaccgaaaatctgcgcaccgagatctctaaattgaaccagaaaatccaggataataacgaaaactatcaggtggggttagccgagcttcgtaccctgatgacaatagaaaaggatcaatgtatttccgaactcatatcaagacacgaagaagaaagcaacatactgaaagccgagctcaataaagtgacatctctgcataaccaggcttttgagatcgagaaaaacctaaaggagcagataattgagctgcagtccaagctcgatagcgagttgtcagcacttgaaaggcagaaagatgaaaagatcactcaacaggaagagaaatacgaggctataattcaaaatctcgaaaaggacaggcaaaagctggttagctctcaagagcaagaccgcgaacagttgatccagaaactgaattgcgagaaagatgaggctatccagactgcactcaaggagttcaagcttgaacgagaagtagtcgagaaggagcttctggagaaagtaaagcacctggagaaccagattgctaagtccccagccatcgatagcacaaggggggacagtagcagcctggtggccgagcttcaagagaagctgcaggaggagaaagcaaaatttcttgaacagctggaagaacaggagaagaggaagaacgaagaaatgcagaacgtccgaacttccctcattgccgagcaacagaccaattttaataccgtgctgacaagggagaagatgcgcaaggaaaatatcatcaacgatctctctgataagcttaaatctaccatgcaacagcaagagcgggacaaagacctgattgagagcctgtccgaggacagagcaagattactggaggaaaagaaaaaactcgaggaagaggtcagcaagctgcggtcgtcatcttttgtgccctcaccatatgtcgcgaccgcccccgagctctacggagcttgcgcccccgaactgcctggcgagagcgatagaagtgccgtagagacggccgacgaggggcgtgtggatagtgctatggagacctccatgatgtccgtccaagaaaacattcacatgctgagtgaggaaaagcaacgaattatgcttctggagaggaccttgcagcttaaggaggaggagaataaaagactgaaccagcgtctaatgtcccagtccatgtcaagcgtgtccagccgacacagtgaaaagatagctatcagggattttcaggtcggcgatctagtccttattatactggacgagaggcacgacaattacgtcctttttactgtgtctccaaccctctacttcctgcactccgaatccctgcctgcactcgacctgaagcctgcatccggggcatctcgccgcccctgggtgcttgggaaggtaatggagaaagaatactgtcaagctaaaaaggctcaaaacaggtttaaggtgcccctgggaacaaagttctaccgggtaaaggcagtgtcctggaacaaaaaggtttag

SEQ ID NO: 26095 - DNA, 48 bp, Artificial Sequence; identical to SEQ ID NO: 12631
  Description of Artificial Sequence: Synthetic coding sequence

SEQ ID NO: 26096 - DNA, 4776 bp, Artificial Sequence
  Description of Artificial Sequence: Synthetic coding sequence
atgaagctgtacgtgttcctggtgaacaccggcaccaccctgaccttcgatacagagctgacagtccagactgtcgcagatctgaaacacgccatccagtcaaagtacaaaatagctatccagcatcaggtactcgtggtaaatggcggcgagtgtatggcggcagatcgccgagtctgtacttactctgcgggcacggatactaatcccatcttcctttttaacaaggagatgatcctgtgtgacaggccgcctgcgattccaaagaccactttctccacagaaaatgacatggaaatcaaggtcgaggaaagtctgatgatgcccgccgtgtttcatacagtcgcgtcaaggacccaactcgccttggaaatgtatgaggtggcaaaaaaactttgttccttctgtgagggtctcgtccacgacgaacacctgcagcatcaggggtgggctgccatcatggcaaacctggaagattgctccaattcataccagaagctcttgttcaagtttgagtccatatactccaactacttacagtcgatagaggacattaaactgaagctgacccatcttggaaccgcagtttctgtcatggccaagatccctttgctggagtgtttaaccaggcactcatatcgggaatgcctcggacggttagattctctgcccgaacatgaagactcagagaaggctgagatgaaacgctccaccgagctggtgttatcccctgatatgcctaggaccactaacgagtctctgctcacttcctttcccaagagtgttgaacatgtgagcccagataccgcagacgccgagtcggggaaggaaatccgcgaaagctgccagtcaactgtgcatcagcaagatgaaactaccatcgacactaaagatggggatttgccttttttcaatgtcagcttgcttgattggataaatgtgcaggatcgtccgaacgacgtggagtctctggtgcggaaatgttttgacagcatgagtcgccttgatccgaggattatcaggccctttatcgcggagtgtcggcagacaatcgctaaactcgacaaccagaacatgaaggccataaaaggcctggaagatcgtttatatgccttggaccaaatgattgccagttgcggacgcttggttaacgagcagaaagaattagcccaaggatttctggcaaatcagaaaagggcagagaatctcaaggacgctagtgttttacccgacctttgcctgtctcatgctaatcagttgatgattatgctgcagaaccatagaaagctgttggacatcaaacagaagtgcacgacggccaaacaggagcttgccaataacttacatgttaggctgaagtggtgctgctttgtgatgttgcacgccgatcaggatggcgaaaagcttcaagctctgcttagattagtaattgaactgcttgagagggtgaagatagtagaggccctctctacagtgcctcagatgtactgcttagccgttgtggaagtcgtgagaagaaagatgttcatcaaacactacagagaatgggccggcgcactcgtcaaagacggcaaacgactgtacgaagctgaaaaaagcaaacgtgagtcttttggcaaactgtttcgaaaaagtttcctccgaaataggctctttaggggcctggacagttggccaccttccttctgtacacagaagcccagaaaatttgactgcgagttgccagacatctccctcaaggatctccagtttttacaatccttctgtccctctgaagtccagccgtttcttcgcgtccctttgttatgcgactttgagcccctgcaccagcatgttctggccttacataacctggtgaaggccgcgcagtcactggacgaaatgtcacaaaccattacagatcttctgtcggagcagaaggcgtctgtcagtcagacatcgcctcaatcagcgtcaagtcccagaatggagtccacagccgggatcacaacgacaacatctccaagaacccctccccccctcactgttcaggacccactgtgtccagctgtctgccctttagaggaacttagccccgatagcattgacgcccacacgttcgacttcgaaaccattcctcatcctaatatcgagcagactatacaccaagtcagtctcgacttggatagtctcgcggagtcccctgagagcgattttatgtcagccgtgaatgagtttgttatcgaagagaatctctcttctcccaacccaatatcagacccccaaagcccagagatgatggtggaatcactgtattcatccgtcatcaacgccatcgattctaggaggatgcaagacactaacgtgtgcggtaaagaggatttcggtgaccacacctctctcaacgtacagttggagcggtgcagagttgtcgcccaggactcacacttttctatccaaacaatcaaagaggatctctgtcattttcgtacctttgtgcaaaaagaacagtgtgactttagcaacagcctgaaatgtacagcagtcgagatacgcaatataatcgaaaaggtgaagtgctcgctagagataactctgaaggagaaacatcaaaaggagctcctctcgctgaaaaatgagtacgaaggtaaattggatgggctgattaaggagaccgaggaaaatgagaataagatcaaaaaattaaaaggtgagctggtgtgcttggaagaggtgctgcagaacaaggataacgaattcgcccttgtcaagcacgagaaggaggcagtgatctgtttgcagaatgaaaaggaccagaagctgctggaaatggaaaacattatgcactcacagaactgcgagatcaaagagctgaagcagtcgagggaaatagtgctggaggatctgaaaaagctccacgtagaaaacgatgagaagttgcagctgttgagggctgaactgcaatctctagagcaatcccacttgaaggagctggaggacactctccaagtaaggcacattcaggagttcgaaaaagtaatgaccgaccacagagtttccttagaagagctgaagaaggagaaccagcagatcattaatcagatccaggaatctcatgcagaaattatccaggagaaagaaaaacagttgcaggagctgaagctgaaagtgagcgatctgtctgatactcgatgcaagttagaagttgaattagcactcaaagaggcggagaccgatgagataaagattctgttagaggaaagccgggctcagcagaaagagacactcaaatcgctgctggagcaggaaacagagaacctgcgcacagagatcagtaagctcaatcagaagattcaagacaacaacgagaactaccaggtgggattggcagagctcaggacgttgatgaccattgagaaggatcagtgtatttcagagctgatctcgaggcacgaggaagagtctaacatcctgaaagctgagctcaacaaagttacaagtcttcacaaccaggctttcgagatcgaaaaaaatttaaaggagcagatcatcgagcttcagagcaaattggattctgaactgtccgcactcgagagacagaaggacgaaaagatcacgcagcaagaggagaagtatgaagccatcattcagaacttggagaaggataggcagaagctcgtgtcaagccaggagcaggatcgcgagcagctgatccagaagcttaattgtgaaaaggacgaggccatccagaccgccctgaaagagttcaagctggagagggaggtggtcgagaaggagttattggagaaagtcaagcacttggaaaaccagatcgcgaagtctccggctatagattctacccgaggtgactcttcgtctctggtcgcagagctacaggagaagctccaagaggaaaaagccaaattccttgaacagctggaggagcaggagaaaaggaagaacgaggaaatgcagaatgtaagaacaagcttaattgcagaacagcaaactaacttcaacactgtgctcactagggaaaagatgaggaaggaaaacattatcaatgacctgtccgacaagttgaagtctacaatgcagcagcaggaacgggacaaagatctaatcgagtccttatccgaagacagagcaaggttgctcgaagagaaaaaaaaactagaggaggaagtcagcaaattgcggagctcatcctttgtgccatctccttatgtagctacagccccggagctttatggagcatgtgcaccagagctccccggtgaatccgataggtctgccgtagaaactgccgatgaaggaagggtggactccgcgatggaaacctcaatgatgtcagtgcaggagaatattcacatgctcagcgaagagaaacaacggattatgctgcttgagcgtacactccaactgaaggaggaagaaaacaagagattaaaccagcggttgatgtcgcagtccatgtcaagtgtgagctctagacatagtgagaagatcgccatacgtgactttcaggtaggcgacctcgtgctgatcatactcgacgagcggcacgacaattacgtcctttttaccgtatcccccacgctctacttcctacacagcgaaagtctgcccgctctggacctgaaacccgccagtggagcctctcggcgaccttgggtgttgggcaaggtgatggagaaggagtactgtcaggccaaaaaggcccagaaccgcttcaaggtgcccctggggactaaattttaccgcgtaaaggccgtgagctggaataagaaggtctag

SEQ ID NO: 26097 - DNA, 6471 bp, Artificial Sequence
  Description of Artificial Sequence: Synthetic coding sequence
atgagcgacacccccagcaccggcttcagcatcatccaccccacctcatcagaggggcaggtacctccaccgcgccatttgtcactgactcacccagtagttgcaaaacgcatttccttctacaagagcggggatccccagttcgggggggtccgcgtcgtggtgaaccccagatccttcaagtcatttgatgcccttctagataacctgtcccgaaaggttcccctgcccttcggcgtgcgaaatataagcacccctcgaggtaggcactccattactcgcctggaggaactggaagacggggaatcctacctctgttcccacggacgtaaggtccagcccgtcgatctggacaaagctcgacggcgtccaaggccatggctctctagtagggcaatcagcgcacattcaccaccacaccccgtggctgtggccgcacctggcatgcccaggccacccaggtctctggtcgtctttaggaatggggacccaaaaacccgtcgtgcagttctgctgtcccggcgggtgacccagagcttcgaagcatttctccaacacctgaccgaagttatgcagaggcctgtcgttaagctctacgcaactgacggcagaagggtaccctctctgcaggccgtgattctcagcagcggcgccgttgtggccgccggacgggaaccattcaaacccggaaactatgacatccagaagtacttgctccctgctcgcttgccagggataagtcaacgcgtgtatccgaaagggaatgctaaatcagagtctagaaaaatctcaactcatatgtctagtagcagccggtctcagatttactccgttagttcagagaagacccacaacaacgactgctacctggattactcatttgttccggaaaagtatctggccctggagaagaacgattcgcagaacttacccatttacccttcggaagacgacattgaaaagagtatcatattcaatcaggacggaacgatgacggtcgagatgaaagtcagatttaggatcaaggaagaggagaccattaagtggaccaccaccgtgtctaaaaccggacccagtaataacgacgaaaaaagcgagatgtccttcccaggtcggacggaaagtagatcctccggcttgaagctggcagcttgcagtttttctgccgacgtatcccccatggagcggtcatctaatcaggagggcagtctggcagaagaaatcaacattcaaatgactgaccaggttgcagaaacctgcagctccgcctcatgggagaacgctactgtcgatactgacatcattcagggaacccaggaccaggcaaaacatagattctatagaccgcctacaccaggccttagacgagtgaggcagaaaaaatcagtgatcggctcagtgacactcgtgtcagaaaccgaagtacaggagaagatgattgggcagttttcttacagtgaagagagagagtctggggaaaataaatccgagtatcacatgtttacacactcgtgctccaaaatgtccagcgtgtcgaacaagcccgttcttgtccaaatcaacaataatgatcagatggaagaatcctcgctggagagaaaaaaagaaaattccttactgaagtccagcgccatcagtgctggggtgatcgagataacgtcccaaaaaatgctggaaatgtcccacaacaacggattgccaagcactatcagcaacaattctatcgttgaggaagacgtggttgactgtgttgtgctggataataaaactggaataaagaatttcaagacttacggcaatacaaatgaccggttttctcctatatcagcagatgctacccatttctcttcaaacaattccggcactgataagaacatcagtgaagcacctgcctctgaggcttcatcgaccgtgacggcgcggatagaccggctgatcaacgagtttgcacagtgcggcctaacaaaactgccaaaaaatgagaagaagattttgtcaagcgtggcctcaaagaaaaagaagaagtctcgacagcaagctattaatagccgataccaggatggccagctggcaacaaaggggatcctgaataagaatgaaaggataaatacaaagggtaggatcaccaaggagatgatcgtccaagactcagattcccccttaaaaggggggattctctgtgaggaggacctgcagaaaagtgacacagtgatcgaatctaacaccttctgctcgaagtcaaacctgaactctaccatttccaagaattttcatcgaaacaaactgaacacaacccagaattctaaagtccaaggcctgctgacaaagaggaaaagtcgaagcctgaacaagatttccctgggagccccaaagaagagggagattggtcaacgggacaaagtcttcccccacaatgagtcaaagtattgtaaaagtaccttcgagaataaatctctttttcacgtgtttaacattctcgaacagaagccgaaggatttctacgctcctcaatcacaggccgaggttgcaagcggctatctgcgcggtatggcgaagaaaagtctcgtgagcaaggtgaccgattctcacattacattgaaatcccaaaagaaacggaaaggcgataaggtgaaggcatccgcgatcctgagcaaacagcacgccacgacacgggccaattcgcttgcaagtctcaagaaaccagatttcccagaggccattgctcaccactctattcaaaattacatacagtcctggctgcaaaatattaacccatacccgacactgaagccgattaagagtgctcctgtgtgtagaaatgagacttcagtggtcaattgttcaaataacagcttcagtggcaacgatccgcacacaaactccgggaaaatttcaaatttcgtgatggaaagcaacaagcacatcactaaaatagccggtctcactggagacaatctgtgcaaggaaggcgataaatctttcattgcaaacgatacaggtgaagaagatttgcacgaaactcaggtggggtccctgaatgatgcttatcttgtgccacttcacgaacattgtacactttcacagtccgcaataaatgaccacaataccaaatctcacattgccgctgagaagtcaggcccagaaaagaaactcgtttaccaggaaatcaatttggcgcgaaaacgccagtccgtagaggcagccattcaggttgaccccatcgaggaggaaacccctaaagatctgctccctgtgcttatgctgcaccagctccaggcatccgttcccggaatccataagacccagaatggggtagtacaaatgcctggctccctggccggagtacccttccactccgcgatctgcaacagttccaccaatctactgctcgcctggctcctagtgctcaaccttaaaggatctatgaattctttctgtcaggtcgatgcccataaggctaccaacaaaagcagtgaaaccttagccctcctggaaattctcaaacacatcgccattacagaggaggctgacgacctcaaagccgcagtggccaacctggtggagagcacaacatctcattttggcctaagcgaaaaagagcaagatatggtgcctatcgacctgtcagccaactgttccaccgttaatatccaatcagttcccaagtgtagtgaaaatgaaaggacgcaggggatctcttcattggatggtggatgcagcgcaagtgaggcttgcgccccagaagtgtgcgtattggaggtgacatgttctccctgtgagatgtgcaccgtgaacaaagcctactcccccaaagaaacctgtaacccttcggacactttttttccatccgatgggtatggcgtggatcagacctccatgaacaaggcctgctttctgggggaagtttgttctctgactgatacggtcttctccgacaaggcctgcgctcaaaaggaaaatcatacatacgagggcgcgtgtccaatcgatgaaacctacgtcccagtcaatgtctgcaacactatcgactttctgaatagcaaagaaaatacatataccgacaacctcgacagcactgaagagctggaaaggggggacgacatccagaaagatctgaacatcctgaccgaccccgagtacaaaaatgggttcaacactctcgtctcccaccagaacgtgtctaacctcagcagctgcggactgtgcctgtctgagaaggaagcggagctggacaagaaacacagcagcctagatgactttgaaaactgttccctgcgcaaatttcaagacgagaatgcgtacacttcttttgatatggaggagccccgtacctccgaggaaccaggcagcatcacaaactcaatgacaagtagtgagaggaacatttccgaattagaatccttcgaggagctcgagaatcatgacacagatattttcaacactgtcgttaatgggggtgagcaggctacagaggagctgatacaggaagaagtggaagcttccaaaactctggaactcattgacattagttctaaaaacatcatggaagagaagcgtatgaacggaatcatatacgaaatcatcagtaaacggctggctaccccccccagtttggatttttgctatgacagcaaacagaacagcgaaaaggagactaatgaaggcgagaccaagatggtgaagatgatggtgaagactatggagactggatcgtacagtgaatcctcccccgacctgaagaaatgtataaaaagccccgtaacctcggattggtccgattacagaccggatagcgattcagagcagccttacaaaacttcttcagatgatccaaacgacagcggcgagctcacccaggaaaaagagtacaatattgggttcgtgaaacgcgcaatagagaagctttacggaaaagctgacataatcaagccctcattctttcctggcagcacaagaaagtcccaagtgtgcccttacaatagcgttgaattccagtgcagtcggaaagcctccctctacgactctgaaggccagtccttcggctcttccgagcaggtttcctcctctagctctatgctgcaggagtttcaggaggagaggcaggacaaatgtgacgtgtcggcagtgagagacaattattgtcggggagacatagtagaaccaggtactaagcaaaacgatgacagccgcatactgaccgatatcgaggaaggggttctgatagataaggggaaatggttgctgaaggagaaccacctccttcgaatgagtagcgagaacccagggatgtgcggcaatgccgacacaacaagcgtggacacactcctggataataactcctctgaagtgccctattctcattttggtaatttggctcctggcccaacgatggacgagctgtcctccagcgaattggaagagctgacccagccactcgaattaaaatgtaactactttaatatgccccatgggtcggattccgagccttttcacgaagatctgctggatgtgaggaatgaaacatgcgcaaaggagagaatcgccaaccaccacaccgaagagaaggggagtcatcagtccgaaagagtctgtacaagcgtaactcattcattcatctcagccgggaataaggtctaccctgtgtcagacgacgctataaagaatcagccgctccccgggagtaatatgattcacggaaccctgcaagaggccgattctctcgacaagctttacgccttgtgcgggcaacactgccccattctgaccgtgataatccagccaatgaatgaggaggataggggattcgcctatcgcaaagagagcgacattgaaaattttttaggcttctatctctggatgaaaatccacccttaccttctccagacagataagaacgtttttagagaagagaacaacaaggcctccatgcggcaaaacctcatagataatgctataggcgacatcttcgaccagttctatttttccaatacatttgatctcatggggaagcgtcgaaaacagaaaagaataaatttcttgggtctggaagaagaggggaatttaaaaaaatttcagcctgatctcaaggaaaggttttgtatgaactttctgcatacctcgctactggtagtgggaaatgtggactctaatacacaagacctgagcggccagacaaacgaaatctttaaagctgtagatgagaacaataacctcttaaataatcggttccaaggcagtaggaccaatctgaaccaggtcgtacgagagaatattaattgtcactatttttttgagatgctgggacaagcatgccttctggacatttgtcaagttgaaacttcgctgaatatttcaaaccgcaacattctagagctttgcatgtttgaaggtgaaaatctctttatttgggaggaagaggacatcctgaatctgactgatcttgaaagcagtcgcgaacaggaagatctttag

SEQ ID NO: 26098 - DNA, 1212 bp, Artificial Sequence
  Description of Artificial Sequence: Synthetic coding sequence
atgaccccccccctgctgcaccacgacctgaagacccagaacatcctgttagataatgaattccacgtgaagatagccgacttcgggctgtccaagtggcgcatgatgtccctctcacagtctcgcagctccaaatccgctcctgaggggggcaccattatctatatgccgccagagaattatgagcccgggcagaaatcccgggcgtccatcaagcacgacatttactcttacgcagtgataacatgggaggtgctctctaggaagcagcccttcgaggacgttaccaatcccttgcagataatgtatagcgtcagtcagggccataggccagtgatcaatgaagagagcctcccctacgatatccctcatagagctaggatgatttcactgatcgaatccggctgggctcagaaccctgacgagcgtccttcgtttctgaaatgccttattgagttggagccagtactcagaacattcgaggagattacctttctcgaagctgtaatccagttgaagaagaccaaactgcagagtgttagctccgctatccacctgtgtgacaagaagaaaatggagctctccctgaatattcccgttaatcacggaccccaggaagagtcttgcggatccagtcagctgcatgaaaacagcggcagccctgaaacttctagaagtctcccagccccccaagataatgacttcctaagccgaaaggctcaagattgctattttatgaagctccaccattgcccgggcaaccactcttgggactcaacgatttccgggtcgcagcgggctgctttctgcgatcataagaccaccccttgcagctccgccatcatcaaccccctgtccaccgcaggaaacagtgaacgtctgcagcccggtatagcgcaacagtggatacagtccaagagggaagatatcgtgaaccagatgaccgaagcctgtttgaatcagtctctggatgccctgctttcaagagacctgataatgaaggaagactacgagttagtctctactaagcccaccagaacatctaaggtgcgccaactcctggataccacggatattcagggcgaggaattcgcaaaggtgatagtccagaaactcaaagacaacaagcagatgggtcttcagccttatccggaaatcctggtggtgtcccgcagtcccagtctgaacctgttgcaaaataagtctatgtag

SEQ ID NO: 26099 - DNA, 10377 bp, Artificial Sequence
  Description of Artificial Sequence: Synthetic coding sequence
atggagcggagcggctgggcccggcagaccttcctgctggccctgttgcttggggcaaccttgcgagcccgcgcagccgctgggtactaccccaggttttcaccattttttttcctgtgcacacaccatggcgagcttgagggtgatggggaacagggagaggtgcttatcagcctccacattgccggcaatcccacatattatgtaccaggccaggaatatcatgtgactattagtaccagcacttttttcgatggcttacttgtcacaggcctttatacgtccacttcggtgcaggccagtcagagcatcggcggctcatcagcgttcgggtttgggatcatgtctgaccatcaattcggcaaccagtttatgtgctccgtagtggcgagccatgtgagtcatctgccaaccacaaatctttcctttatctggattgctcccccagccggaaccggctgtgtaaatttcatggccactgctacccacaggggacaagtcattttcaaggatgctctcgcccagcagctttgtgagcaaggcgctccaactgacgtgacagtgcatccacatctcgctgaaattcattctgatagtataattctccgcgatgactttgacagctaccaccagctccagctgaatccgaatatttgggtggagtgcaacaattgtgaaaccggggaacaatgcggcgcgatcatgcatggaaacgcagtgacgttttgcgagccatatggacctcgcgagctcataacaacaggcctcaacacaaccacagcgtcagtgctgcagttcagtatcggctccgggagttgccggttcagctactctgatcccagtattatcgtgctgtatgcgaaaaataattctgcggattggatccagctggagaagatacgggctccaagcaatgtttccactattatacatattttatacctgccagaggatgccaaaggggaaaacgttcaattccagtggaagcaggagaatcttcgcgttggagaagtgtacgaggcgtgttgggcactagacaatattctgatcattaacagcgcccataggcaggtcgtcctggaagatagtctcgacccagtggacacaggtaactggctgtttttcccaggggctacggttaagcacagctgtcagagcgacggcaacagtatctattttcatggcaacgaggggtctgaatttaattttgctactactagggatgtggacttgtccacagaggacatccaggaacagtggtccgaagaattcgaaagccagccgacaggctgggatgttcttggagcagtgatcggcaccgagtgcggtactattgaatcaggtctcagtatggtgttcctgaaggacggcgagagaaaactctgtacaccctccatggatacgactggatatggaaatcttaggttctacttcgtcatgggcgggatctgtgaccccgggaatagtcacgagaatgacattattctgtatgcgaagattgaggggagaaaggagcacatcacgctcgataccctctcctacagcagttataaggtgccatctctggtctctgttgtcatcaacccagaactgcagacaccagcaacaaagttctgcctgcggcaaaagaaccatcagggccacaacagaaacgtctgggccgtggatttcttccatgttctccccgtgttgccttccaccatgtctcatatgatccagttctccatcaatctgggctgcggcacacatcagccaggcaactcggtgtccctggagttctctaccaaccacgggcggagctggtcgctgttgcatacggagtgtctgcctgaaatctgcgctggaccacacctgccgcatagtactgtctatagcagtgagaattactcaggatggaacagaattactatccccctgcccaatgccgccttaactaggaacaccaggatccggtggcgccagacaggtcctatcttgggtaatatgtgggctatcgataatgtgtatatcggcccatcatgtctcaaattttgctcagggagaggccaatgtacgagacacggctgtaagtgcgaccccggcttctccggtcccgcgtgtgagatggcttcccagactttccccatgtttatctccgaatcttttggctcttcacgactgtccagttaccataacttctacagcattagaggggccgaggtctccttcggttgtggcgtccttgctagcgggaaagccctggttttcaataaagatggcaggcggcagcttataacgtcttttttggactcatcccagtcaagattcctacaattcactctgcgcttgggatccaagtctgtgctgagcacctgccgcgcgcccgaccagccaggggaaggggtgctgttgcactactcctacgacaatggcataacgtggaagttgttggaacattacagctaccttagctatcacgagccgcgtatcattagtgtggaactgccaggggacgccaaacagtttggaatacaattcaggtggtggcagccttaccactcctcgcagcgggaggacgtgtgggcaattgatgaaataatcatgacatcagtattatttaacagcatcagcttggattttactaatctggtggaggtgacacaaagcctcggtttctacttaggtaatgtgcaaccttattgtggtcacgattggactctgtgctttacaggcgattctaagcttgcctctagtatgcgctatgtcgagactcaaagtatgcagatcggcgcaagctatatgatccagttctcattggtgatgggatgcgggcaaaaatacacaccacatatggacaaccaggtcaagttggaatactccacaaaccacgggttaacctggcacctggtgcaagaggaatgcctcccaagcatgccatcgtgtcaggagtttacgagcgctagcatttaccacgcctctgaatttacgcagtggaggagagtcattgtactactgccccaaaaaacatggtcatctgccacacgtttccgatggtcccagtcctactacactgcgcaagatgagtgggccctcgattctatctatatcggccaacagtgtcccaacatgtgctccggacatggcagttgcgatcacgggatttgccgctgtgatcagggctatcagggcacggagtgtcacccagaggctgcgctccctagcacaattatgagtgactttgaaaatcagaacggatgggaaagcgactggcaggaggtaatcggtggagaaattgtaaaacctgagcagggttgtggggtaattagcagtggctcctctttatattttagcaaggctggaaaacggcagctggtgtcatgggacttggacaccagctgggttgattttgttcagttctacattcagatcggtggggaatcggccagctgcaacaaacccgatagccgggaggaaggagtcctactgcaatattctaataacggcgggatacagtggcatctgcttgcagagatgtacttctcggacttcagcaagccacggttcgtgtatctcgagctccctgcagcagccaagaccccatgtacacggtttcggtggtggcagcctgtattcagcggagaggattacgatcagtgggcagtggacgacattattattctgagcgagaagcaaaagcagatcatcccagtgatcaatcccacacttccacagaacttttatgagaaaccagcattcgattatccaatgaatcagatgtctgtatggttgatgctcgccaacgagggtatggtaaaaaatgagacattctgcgccgcaaccccatccgccatgatcttcggcaagtcggacggtgaccggttcgcggtgacccgcgacctgacacttaaaccagggtacgtgttacagtttaaactgaacatcggatgtgccaatcagttctcctctacagctccggtcttgttgcaatatagtcatgacgctggtatgtcttggttcctagtcaaggaaggttgttaccccgcgtccgccggcaaagggtgtgagggcaactctagagaactgtccgagccaaccatgtaccacaccggggattttgaggagtggactcgcatcacaattgtaatcccgagaagcctggcctccagcaaaacgcgtttcagatggatacaagaatcctcctcgcagaaaaatgtgcctccatttggactggatggcgtatacatctcggaaccttgcccttcatattgttctggacatggcgattgcataagcggggtttgtttttgtgacctggggtacactgctgcgcagggcacttgcgtgagtaacgttcccaatcataacgagatgttcgatcggtttgaaggaaaactgtcgcctttgtggtataagatcacgggggcccaagtggggaccggctgtggcacactcaatgatggtaagagcctgtactttaacggaccaggcaagagggaggcacggactgtcccccttgatacgagaaacatcaggttagtccaattctacattcagatcggctcgaaaacctccggcattacctgtataaagccacggacacgaaacgaaggcctgatcgtccaatacagtaatgataatggtatactttggcacctcctgcgcgagcttgacttcatgagctttctggagcctcagataatttcaattgatctgcctcaggatgctaaaacccccgccacggctttccggtggtggcagccccagcacggaaagcactcagcccagtgggccctggatgacgtgctgattgggatgaacgattcgtcccagactggattccaggacaagttcgacgggtccatcgacttacaggccaattggtacagaatacagggcggccaggttgatatagactgcctgtccatggacacggcactgatttttactgagaacattggaaaaccccgctacgccgagacatgggactttcatgtctctgctagcactttcctccagttcgagatgtctatgggctgttccaaaccattcagcaattcacactcagtgcagcttcagtactcacttaataatgggaaggactggcacctagtgacggaggagtgcgtccctccaacaatcggctgtctgcattatactgagagctccatttataccagtgagaggtttcaaaactggaagcggatcacagtgtatctgcctttgagcacaatttcccctagaactagatttagatggatccaggcaaactacaccgtgggggccgattcctgggccattgacaacgtggtgcttgccagtgggtgcccttggatgtgctctggccgcgggatttgtgacgcagggaggtgcgtatgcgacaggggcttcggcggaccttattgtgtgcctgtggtgcctttacctagtatactgaaagacgacttcaacgggaacttgcatcctgacttatggccagaagtctatggtgccgaacggggaaacctgaacggagagactatcaagagcggtacatccctgatctttaagggggaaggactgcgaatgttaataagtagggacctagattgcaccaacacaatgtacgttcagttttccttacggttcattgctaaaagtacgcccgaacgatcccacagtatcctactccaattcagtatctccggtgggatcacttggcaccttatggacgagttttatttcccgcagaccacgaatatactgttcataaacgttccgttaccttatacagcccagactaatgctacaaggttccgtctctggcaaccatacaacaatggaaaaaaagaggagatctggatcgtggatgattttataatcgacgggaataacgtcaacaaccccgtgatgttactggacacttttgacttcgggcctcgggaagataactggtttttctacccaggggggaacattggactctactgcccatacagctcaaagggcgcccccgaggaagactcagccatggtctttgtgtcaaacgaagtcggcgagcacagcatcactacaagagatctgaatgtgaacgaaaatactataatccaatttgaaatcaatgtcgggtgcagcaccgactcatctagtgcagaccctgtgaggctggagttctccagagacttcggagcaacttggcatctgctgcttccgctctgctatcattccagctctcacgtctcctctttgtgtagtaccgaacaccaccctagttcaacatactatgccggtacaatgcaaggatggaggagagaggtggtgcactttgggaagctccatctgtgtgggagtgtgcgcttccgctggtaccagggtttctacccagcaggatctcagcccgtgacatgggctatcgataacgtctacatcgggccacagtgcgaggagatgtgtaacggacagggcagttgcatcaacggcactaaatgtatttgtgatccagggtatagcgggcccacctgcaagatcagtaccaagaacccagactttttgaaagacgatttcgaggggcagctagagtcagacagattcctgctgatgtccgggggcaaacccagccggaaatgcggtatactgtcttccggcaacaacttattcttcaacgaagatggtctgcggatgctgatgacgcgtgatcttgatctgagccacgcaaggtttgttcagttttttatgcggttgggatgtggtaagggagtacctgatcccagatcacagcccgtgctactgcaatacagtctcaacggtggcttaagctggtctcttctacaagagtttctcttcagcaatagcagtaacgtcggcagatatatagcacttgagatccctctcaaggccaggagtggttctacacggttaagatggtggcagccttcagaaaatgggcacttctacagcccatgggtgattgatcaaatactgattggaggtaatatctccggcaataccgtcttggaggacgatttcacaactttagatagtcgtaagtggcttttgcatcccggcggaaccaagatgccagtgtgtggatccactggggatgccttagtcttcatagagaaggcatcgacgcgctacgttgtgtcaactgatgtggcggtcaatgaggactcatttctgcagatagacttcgccgctagctgctcagtgaccgactcctgttatgcaatcgagctggaatactctgtggaccttggactgagttggcaccctctggtccgcgattgcctgccgactaatgtggagtgttcaaggtaccacctccaacgaatcctagtttctgacaccttcaacaagtggacaaggatcactctgcccctccctccttatacccgaagccaggcaacccgatttcggtggcaccagccagcgcctttcgacaagcaacagacgtgggcaatcgacaacgtatacatcggagacggttgtatcgacatgtgttctggacacgggcggtgtattcaggggaattgcgtatgtgatgagcaatggggaggcctctactgcgacgatcccgagacttctctgccaacccaattaaaggacaattttaatcgcgccccatcctcacagaactggctgacggtaaacggtggcaagctgagcacagtgtgcggagccgtcgcttcaggaatggccctgcatttcagcggaggctgctcacggctgctcgttaccgtggacctgaatttaaccaatgcagagtttatccagttctacttcatgtatggttgcctaataacacctaataacagaaatcaaggtgtgcttctggagtattccgtcaacggaggaatcacatggaatctgttaatggagattttctatgaccagtattccaaacctggattcgttaacattctgttaccacccgatgccaaggaaatagcaactcgattcagatggtggcagccccggcatgatgggttagaccagaacgattgggcgattgacaatgtgcttatttctggctccgccgatcagcgaactgttatgctggacaccttcagtagcgccccggtgcctcagcacgagcgaagccccgctgatgccggtccggtaggtaggatcgcattcgatatgttcatggaggacaaaactagcgtgaacgagcattggctgtttcacgacgactgcactgtggagcggttctgtgatagtcccgacggggtcatgctttgcggtagtcacgatggacgagaagtgtacgcagttacacacgacctcacccctactgaaggatggatcatgcaatttaagatttcagttgggtgtaaggtcagcgagaagatcgcacagaaccagatccacgtgcagtatagtaccgacttcggagtgagctggaactatctggtgccacagtgccttccagccgaccccaagtgctctggctcagtgagtcagccttcagtttttttccctaccaaaggctggaaacggattacatacccattgccagaaagcctcgtagggaaccctgttcgtttcagattttaccagaaatattcagatatgcaatgggccattgacaatttctacttgggacccggatgtctggataactgtcgcgggcacggggactgcctgagggagcaatgtatctgcgaccccggctactctgggcccaattgctatctgacgcacaccttgaaaacattcttgaaagagaggttcgacagcgaagagataaagcccgatctttggatgtccctggagggcggctcaacctgtactgaatgcggcatccttgcagaagatacggctctctactttggcggtagtactgtgcggcaggctgtgactcaggatctggatctgagaggtgccaagtttctccagtactgggggagaatcggatctgagaacaatatgactagctgccaccgccctatctgtagaaaggagggagtgcttctcgattatagcactgacggaggtataacttggacactcctacatgagatggattaccagaagtacatcagcgtgcgtcacgattacattttgcttcctgaggacgcccttaccaatacaacacgccttcggtggtggcaaccttttgtgatttcaaacggtatcgtcgtctccggcgtggagagggcccagtgggccctcgataatatcctcatcggaggcgcagagataaatccctcgcagctagtggacacatttgacgatgagggtacgagccatgaggaaaactggtcattctaccctaatgccgtccgaactgctggcttctgtggcaatccctcttttcacctttattggcccaataagaaaaaggacaagactcacaatgctctgtcgtcgcgagagctcattattcagcctggctatatgatgcagttcaagatcgtagtgggctgcgaggccacctcttgcggagatttgcactccgtcatgctggaatatactaaggacgccaggtccgacagctggcaacttgttcagacccagtgtctaccaagcagttctaatagcattggttgctctcccttccagtttcacgaggcaaccatctacaattcggtgaactcgtcttcgtggaagcgtatcacaattcagctgccagaccacgtgagcagttccgccacccagttccggtggatccaaaaaggtgaggagactgagaagcagtcttgggcaatagaccatgtgtacatcggcgaggcctgtcctaagctgtgttccgggcacggctactgcactacaggcgcaatctgcatttgcgacgagtctttccagggtgacgattgtagcgtgttcagtcacgatcttcccagttacatcaaggacaattttgaaagcgccagggtcactgaggcaaattgggaaacaatccagggaggggtgatcgggtcaggatgtggccaattggctccctacgcccacggcgattcactttacttcaatgggtgccagatacggcaggccgccaccaaaccgctggatttaaccagggcctcgaaaatcatgttcgtcctgcagattggatctatgagccagactgactcttgcaactcagatctgtctggacctcacgcagtggacaaggccgtcctgcttcaatacagtgtgaataatggcatcacctggcatgttatagcccaacatcagcccaaagacttcacacaggcacagagagtgtcatataatgttcccctggaggctcgtatgaaaggcgtcttactacggtggtggcaacctagacacaatggcactggacacgaccagtgggccctggatcatgtggaagttgtactaaccagaaagcagaattatatgatgaacttctcccgccaacatgggctgcgccatttttacaatcggcgacggagatctcttaggcgatacccttag

SEQ ID NO: 26100 - DNA, 10383 bp, Artificial Sequence
  Description of Artificial Sequence: Synthetic coding sequence
atggagcggagcggctgggcccggcagaccttcctgctggccctgctcctcggcgctacactcagggccagggctgcggctggctattatccgcgcttcagcccctttttcttcttatgtacgcatcacggagagcttgagggcgacggggagcagggagaggtactgatcagtctacacattgcaggtaatccaacctactatgtccccgggcaggagtaccatgttaccatctcaacgtcaactttctttgatggtctgctcgtcaccgggctgtacacatccacctcagtccaggctagtcaaagtatcggaggaagtagtgcattcgggttcgggatcatgtctgaccatcagttcggtaaccagtttatgtgtagtgtggtggcttctcatgtctctcacctcccgacaacaaacctttccttcatttggatcgcccctccagccgggaccggttgcgtcaattttatggccactgccactcaccgcgggcaggtgatcttcaaagatgccctggcacaacagttgtgcgaacagggcgcccccaccgatgtgacagtacacccccacctcgcagagatccactcagactctatcattctaagggatgatttcgactcatatcaccagcttcagcttaaccctaacatctgggtggaatgtaacaactgtgagacaggcgagcagtgcggggcaataatgcacgggaacgccgtgacattctgcgaaccctacgggccacgggaactgatcaccacgggactgaacaccaccacggccagtgttttgcagttttccattggcagcgggagttgtaggttctcctattccgacccaagtataattgttctgtacgcaaagaacaacagcgcagattggattcaacttgagaaaatcagagctccaagcaatgtgagtaccattattcacattctgtacctccctgaagatgccaaaggcgaaaacgtgcagttccagtggaaacaggaaaacttgagggtgggcgaggtatacgaggcttgctgggccctggacaatattctcattataaactctgcacaccgccaagtcgtcttagaagatagcctggaccctgtggacactgggaactggctcttttttcctggcgccacggtgaaacattcatgtcaatctgatggcaattccatttattttcatggcaatgagggttccgagttcaacttcgccaccacgcgggacgtagatttatcaacagaagatattcaggaacaatggagtgaggaattcgaaagccagcctactggatgggacgtgcttggcgccgtgatcggcacggagtgtggaaccattgagtccggcctctctatggtgttcctgaaggacggtgagaggaagttgtgtacaccatccatggacaccacggggtacgggaatctgagattttacttcgtaatgggcggaatctgtgatcccggaaactcccacgagaacgacatcattctgtacgccaagatagaggggcggaaagagcacatcacactagacaccctcagttactctagttataaggtgcccagcctcgtatctgtggttatcaatcccgagctgcagacaccagccaccaaattctgcctgcgccagaagaatcatcaaggacacaatagaaacgtctgggcagtagactttttccatgtccttccagtgctcccttccacgatgagccacatgatccagttcagcatcaacctcggatgcggcacccatcaacccggtaacagtgtctcacttgaattctctaccaatcacggtcgatcctggtctctgctgcacacagaatgtctgcctgagatatgtgctggaccacacctgccgcactcaacagtctattcatctgagaactattctggttggaaccgaatcaccatccctttgccaaacgccgccctgacccgcaatacaaggataagatggcggcagaccggacccatactgggtaacatgtgggccatcgataatgtttacattggccccagctgccttaaattttgttctggtcgaggacagtgtacccgccacgggtgtaagtgtgatcctggcttctctgggccagcctgcgagatggccagtcaaacattccccatgttcatctccgagtccttcggaagctcaagactgagctcttatcacaacttctattccatccgcggcgccgaagtctcctttgggtgtggcgtcctcgcctctggtaaggcattggtctttaataaagacggccgccgccagctgatcacctccttcctagacagctcccagtccagattccttcagtttaccctccggctgggaagcaaatcggttctcagtacttgccgggcaccagaccagcccggtgaaggagtactgctccactacagttacgacaatgggatcacctggaaactcctagaacactactcgtacctcagttaccatgagcccagaatcatttcagtcgagttaccaggtgacgcaaaacaattcggaatccagttcagatggtggcagccataccactcttcacagagagaagacgtgtgggccattgacgaaatcattatgacatctgtactgttcaatagcatttccctggattttaccaatttggttgaagtcacccagtctctgggattttatctcggaaacgtccagccttactgtgggcatgattggacactgtgttttacaggtgactccaaactggcaagtagtatgcggtatgtggagacgcaatccatgcagataggagcatcatatatgatacagttctctctagtcatgggatgcggccagaagtatactccacacatggacaaccaggtaaaattagaatactctacgaaccacgggcttacttggcacctggtccaggaggagtgccttccctcaatgcctagctgtcaggagtttacctccgctagtatctatcatgctagtgagttcacacagtggcgaagggtgatcgtgctactgccccagaaaacctggagctctgcaacgcggtttaggtggagccagtcctactacaccgcacaggatgaatgggccctggactctatttatattgggcaacaatgcccgaatatgtgttcagggcacgggtcatgcgatcatggaatctgtcgctgcgaccagggctaccaaggcactgaatgtcacccagaggctgcacttcctagcaccatcatgtccgattttgagaaccaaaatggctgggaatccgattggcaagaagtaatcggcggggagatcgtcaaacccgagcagggatgcggcgtgatcagctccggtagctccctatattttagcaaagctggaaaaagacagctggtcagttgggacctggacaccagttgggttgatttcgtccagttttacatacagatcgggggcgagtcagccagctgtaacaaacctgattctcgcgaagagggcgttttactccagtatagtaacaacgggggaatccagtggcatttgcttgccgagatgtatttttctgacttctccaagcccaggtttgtgtaccttgagcttccagcagcagcgaagactccttgcacaagatttcgatggtggcagccagtgttttcgggcgaggactacgatcagtgggcggtggatgacattattatcctttctgagaagcaaaagcaaatcattcctgtgatcaaccctaccctgccacaaaatttttatgagaagcccgcatttgactatcccatgaaccagatgagcgtgtggctgatgttagctaacgaggggatggtcaaaaacgaaaccttttgcgctgctaccccatccgcaatgatttttggaaagagcgatggggacaggttcgctgtgaccagggatctgactctaaaaccaggatacgtattgcagttcaaactgaacatcggctgtgcgaaccagtttagttctactgcgccagttctcttacagtatagccacgatgccggaatgtcatggtttcttgtcaaggagggatgttaccccgccagcgccggaaagggatgcgagggcaactcaagggagttatcagaaccaacaatgtaccatacgggcgatttcgaagaatggactcgtataaccatcgttatcccccgcagcctggcctcctctaagacacggtttcgttggatccaggaaagctcttctcagaaaaacgtgccgccttttgggttggatggtgtgtacataagcgaaccctgcccatcgtattgctcaggtcatggcgattgcatcagcggcgtgtgtttttgtgacttagggtacaccgccgcccaggggacgtgcgtgtcaaacgtgcccaatcacaacgaaatgttcgaccgcttcgagggaaagctcagtcctttatggtataaaattaccggcgcccaggtcggaaccggttgtggtaccttaaacgacgggaagagtctgtattttaacgggcccggaaagagagaagcccgaacggtgcctctggatacgcgcaacattaggctcgttcagttttacatccagatcgggtctaagacctccgggattacctgcattaaaccaagaacccggaatgaaggcctgatcgtacagtatagcaatgacaacgggatcctttggcaccttctccgcgagctggactttatgtccttcctggagccccagatcattagtattgatctgcctcaggacgcaaagacccccgccaccgcctttcggtggtggcagccccaacatgggaagcattcagcccagtgggctctggacgatgtgctcataggcatgaacgactcttctcaaactggattccaggacaagtttgatggttcaattgacctgcaggccaattggtataggatccagggcggacaagttgatatcgattgcctcagcatggatactgccctcatattcaccgagaatatcggaaaaccgagatacgcagaaacatgggatttccacgtttctgctagcacatttctccagttcgagatgtctatgggctgctctaaacctttttcaaactcccacagtgtccagctgcagtatagcctaaacaatgggaaagattggcatcttgtgactgaggaatgcgtgcccccaaccatcgggtgcctgcactatacagaatcttctatctatacctccgaacgttttcagaactggaagagaatcaccgtctacctcccgttgagcacaatatcacccagaacgcgatttaggtggatccaggccaattataccgtcggtgccgacagctgggccatcgacaacgtggtcctcgccagcggctgcccatggatgtgttctggtcgcggcatctgtgatgctggacgttgcgtatgcgatagggggtttggggggccttactgcgtaccagtggttccattgccttcaatactcaaggacgatttcaacggcaacttgcacccagatctgtggcccgaggtatacggcgctgagagaggaaacctgaatggggagactatcaaaagtggcacaagtctgatcttcaagggggaaggcctgagaatgctgatatctcgcgacctggactgtaccaatacgatgtatgtccagttttcccttcggttcatcgctaaatctacccccgagcgaagtcacagcattctgctccaattctccatttctggaggtattacctggcatctcatggacgagttctactttcctcagacaacaaatatactgttcattaacgtcccattgccctacacggcacagactaacgcaactagatttcgcctgtggcaaccgtataataatggaaagaaggaggagatttggatcgtggatgatttcataattgatggaaataacgttaacaaccctgtaatgttactggacacatttgactttggaccgcgcgaggataattggtttttctatccaggcgggaatatcggtctttactgcccatattctagtaagggggcaccagaggaagactccgccatggtattcgtgtctaacgaggttggcgaacactccattactaccagagatctgaatgttaatgagaatactatcattcaattcgaaatcaatgtcggatgtagtacggactcctcaagcgcagatccagtgcgcttggaattcagccgggactttggcgccacctggcacctgttgctacccctgtgttatcatagcagctctcacgtctcttctctgtgttccaccgagcatcacccatccagcacgtactacgcagggactatgcaggggtggagaagagaggtcgttcatttcggaaagttacatctctgcggatctgttagatttcgctggtaccaggggttctatcctgcggggagccaaccagtaacctgggctatcgataacgtctacatcggcccacagtgtgaggagatgtgcaatggccaggggtcgtgcattaatggaacaaaatgcatctgtgatcccggctatagtggccctacatgtaaaattagtacaaagaatcccgattttctaaaagatgacttcgagggccagctggagtccgaccgcttcctgctcatgagcggtggcaaaccctctcggaaatgtggcatcctcagctccggcaataacttgtttttcaatgaggacgggctgcgcatgctcatgactcgggacctcgacttaagccatgctaggttcgttcaattcttcatgagactggggtgcggcaaaggagttcctgacccacgctcccagccagtgctcctccaatacagtctgaacggcgggctgagttggtcactcctgcaggaattcctcttttccaattccagtaatgtaggacggtatatcgcactggaaatccccctgaaggcgcggtctggaagtactcgcttgcgctggtggcagccatccgagaatggacacttctacagtccgtgggtcatcgaccagattctgattggagggaacatctcagggaataccgtcctcgaagatgattttactactctggattccaggaaatggttactgcatcccggcgggactaagatgcccgtgtgcggcagcactggtgacgcgctggtttttatagaaaaagcctcgacgcgctacgtcgtttccaccgacgtcgccgtgaacgaagattcctttctccagattgacttcgccgcgtcatgttctgtgaccgatagttgttatgccatcgagctggagtacagtgtggacctgggcctctcttggcaccccttggtgcgtgactgccttccaacaaacgtggaatgttctcgctatcacctccaaagaattctcgtatcagacactttcaataagtggacgagaatcacactgcccctcccaccgtacacaaggagccaagccacacggtttcggtggcaccagccggctccattcgacaaacagcagacctgggctatcgacaacgtgtacattggtgacggttgtatcgatatgtgtagtggacatgggcgttgtattcaaggtaactgtgtgtgtgatgagcagtggggtgggttgtactgcgatgatccggagacctctctgcctacccagttgaaggataatttcaatcgtgcaccatcgtctcagaattggttgactgtgaacggtggtaagctgtcaacagtctgcggcgcggtggcctccggaatggcgctgcatttttctggcggctgctctagattgctcgtcactgttgacctcaacctcacgaatgccgagtttattcagttctacttcatgtacgggtgcctgattacccccaacaatcgtaaccagggagttctcctggagtattctgtgaatggggggattacctggaatttgttaatggagatcttctacgaccaatactccaaaccaggctttgtaaatatcctcctcccccccgatgctaaagagattgctacaaggtttaggtggtggcagcccagacacgacggactggaccagaacgactgggctattgataatgtgctgattagtggaagcgccgatcaacggactgttatgcttgataccttctcttcggcacccgtcccccagcacgagcggagccctgccgatgccggtccagttggtcgaattgcgttcgacatgtttatggaggataagacctctgtgaacgagcactggttattccacgatgattgtacggtggagagattttgcgatagtcccgacggagtcatgctctgtggttcacatgacgggcgggaggtctatgcggtgacgcacgatctgactcctaccgaggggtggattatgcaattcaagatttcagtaggctgtaaggtctccgagaaaatcgcccagaaccagattcacgttcaatacagcacagattttggcgtgtcttggaactatctggtccctcagtgccttcctgcggatcctaagtgcagcggctccgtgagtcagccctctgtattcttccctaccaaaggctggaaacgcattacctaccccctacccgaatcactggtcggaaacccagtaaggttccgcttctaccagaagtacagtgacatgcaatgggccatcgataatttctatctgggtccaggctgtttagataactgtcgcggtcacggtgactgtctgagagagcagtgcatctgcgaccctggctacagcgggccgaattgttacctgacccacaccctgaaaacattcctaaaagagaggtttgactcagaagagatcaagccagatctgtggatgtccctggagggaggctccacctgcactgaatgcggcatacttgctgaagataccgcactgtattttggtggaagcaccgttaggcaggccgtcacgcaggatctcgatttacggggagccaagttcttacagtactgggggcgcatcggttccgagaataatatgacaagctgccacaggcccatctgcagaaaggaaggggtcttactcgactacagtactgatggcgggatcacctggacactgctacacgaaatggattatcagaagtatatctcagtcagacacgactacatcttacttcctgaagatgccctgaccaatacaacgcggctacgttggtggcaaccttttgtcatctcaaatgggatcgtggtttcgggcgtggagagggcccagtgggctctcgacaatatcctgatagggggagccgagataaatcccagccagcttgtggacaccttcgacgatgaaggcacctcacatgaagaaaattggtcattctacccaaacgccgtccgaaccgccggattctgcggcaacccgagtttccatctctactggcccaacaagaagaaggacaagacccacaatgccctgtcatctcgagaacttattatccagcccggttatatgatgcagtttaaaattgtcgtgggctgtgaagccacatcatgtggcgatctgcattcagtcatgttggagtacaccaaagatgctagatccgactcatggcagctcgtccaaacacaatgcctcccatcttcgagtaattctattggctgcagcccctttcagttccatgaagcaaccatctacaatagcgtaaacagctcaagctggaagcgcattactatccagctccctgatcatgtgtcaagctccgctacccagttccggtggatacagaaaggggaagaaactgaaaaacagagctgggctatcgatcatgtgtatatcggggaagcttgcccgaagctgtgcagcggccatggatactgtactacgggggcgatttgcatctgcgacgagagcttccagggggatgactgctcagttttctctcacgacttgccctcgtatatcaaagacaactttgagtcggctcgagtgacagaggccaattgggaaacaatacagggcggtgtcatcggaagcggatgcggacagctcgctccgtacgctcatggcgattcactgtattttaatggctgtcaaattcgccaggccgccaccaagcctctagacttgacccgagcgtcaaaaattatgttcgtactgcagatcggatcaatgagccagaccgattcatgtaactcagatttatcaggccctcacgcagtggacaaggcagttttgttgcagtatagcgtaaacaatggaattacatggcatgttatcgcccagcaccaacctaaggattttacacaagcgcagagggtatcttataatgtgccgctggaggctaggatgaaaggggtgctgctgcggtggtggcagcctaggcacaatggtacagggcacgaccagtgggctctagaccacgtggaggtggtgctgttttccactcggaagcaaaactacatgatgaattttagtagacagcatggcttaagacacttctataatcgcagaaggcggtccctgcgcagatacccttag

SEQ ID NO: 26101 - DNA, 2934 bp, Artificial Sequence
  Description of Artificial Sequence: Synthetic coding sequence
atgtgcagcggccacggccggtgcatccagggcaactgcgtgtgcgacgagcaatggggcgggctttactgtgatgacccagagacctctctccccacgcaacttaaggacaacttcaatagagcaccaagctcgcagaactggctcacagtcaacggaggaaaactgtcgacagtatgtggcgcagttgcatccggaatggctctccatttctccggcggctgttcgcgcctgctggtgacagtcgaccttaatttgacaaacgcagaattcatccagttctatttcatgtacggctgtctgatcacgccaaataatcgaaatcagggcgttcttctggaatactctgtaaacggcgggatcacctggaatcttctgatggaaattttttacgaccaatactctaagccagggttcgtaaacattctgttgccgccagacgcaaaggaaatcgccactcggttccgctggtggcagccccgccatgacgggctggaccagaacgattgggctatcgacaatgtgctcattagtgggagtgccgaccagaggaccgtcatgctcgacacgttttcttccgccccggtgccacaacacgagcggtcaccagccgatgcaggccctgtgggtcgcattgctttcgatatgttcatggaggacaaaaccagcgtgaatgagcattggcttttccatgacgactgcacagtggagcggttctgtgactccccagatggcgtgatgctgtgcgggagccacgatggtcgagaggtttacgctgtcacccacgacctgacaccgacagaagggtggataatgcagtttaagatctctgtggggtgtaaggtgtcagagaagatcgcacagaatcaaattcacgttcaatattccacagatttcggggtgtcatggaactatctggttcctcagtgtctgcctgcggaccccaagtgttcaggatctgtatcccagccttcagttttcttccctaccaaggggtggaaacgaatcacataccccctacctgagtccctagtcggaaacccagtgcgttttcgcttctaccaaaagtattctgatatgcagtgggccatagataacttctatcttggacccgggtgtttggacaattgtagaggccatggcgattgcctccgcgaacagtgcatctgtgaccccggatactcgggcccgaactgttaccttacgcacactttgaagacttttctgaaagaaaggttcgacagcgaagaaataaagcccgacctgtggatgtcccttgaagggggctcaacatgtacagagtgcggcatcctggctgaggatacggctctgtatttcggaggcagtacagttaggcaggccgtgacccaggacctcgatctgagaggggctaaattccttcagtattggggaaggatcgggtctgagaataacatgacatcctgtcatagaccaatctgcagaaaggagggggtgctgctggactatagcactgacggaggaataacatggacgttactgcatgagatggactaccagaaatacatctcagtgaggcacgactatatccttctccccgaagacgctctgacaaacacaacccgcctcaggtggtggcagcctttcgtgatctccaatggcatcgtagtctctggagtcgaacgggcacaatgggcactggacaacatccttattggtggcgccgagattaatccatcgcaactggtggatactttcgacgatgagggtacctcacacgaagagaactggtccttttacccaaacgctgtgcggaccgcaggattttgcggaaacccatcattccatttgtactggccaaataaaaaaaaggataagacacataatgccttaagtagcagggaacttattattcagccaggctacatgatgcagttcaagattgtcgtcggatgcgaagcaacctcctgtggcgacctgcacagcgtaatgctggagtacacaaaagacgcccggagcgattcttggcagcttgttcagacccagtgcctcccgagctccagtaactcgattggatgttccccatttcagttccacgaggcgacaatctataactcggtgaatagcagttcttggaagcgtataacaattcagttaccagaccacgtttccagttcagcaacgcagttccgatggatccagaagggggaggagaccgagaaacagtcttgggcgattgatcacgtctacataggagaagcatgtccaaaactttgctctgggcatggatattgtacaactggtgcaatttgcatttgtgacgaatctttccagggagacgactgctccgtcttctctcatgacctcccctcttacataaaagacaactttgaaagtgccagggtcactgaggccaactgggagacaattcagggaggtgtgattgggtctgggtgtgggcagctcgctccttacgctcacggtgactctttatacttcaacggctgccaaatccggcaggccgcaacaaagccactagatctgacgagggcctctaagataatgtttgtgctgcagatcggttcaatgtcccagaccgatagttgcaatagcgatctctcgggccctcacgcagtggataaggctgttctccttcagtatagtgtcaacaatggaatcacttggcacgttatcgcccagcatcagcctaaggacttcacacaagcacaaagagtgagctacaatgtgccgctggaagctcggatgaagggggtgctgctcaggtggtggcagccccgccacaacgggactggccatgatcagtgggctttggaccacgtggaagtcgtcctcgtgacgacccggaaacagaactacatgatgaatttttcccgccagcacgggctgaggcacttctataataggcgccgccgcagcctgaggcggtatccttag

SEQ ID NO: 26102 - DNA, 10383 bp, Artificial Sequence
  Description of Artificial Sequence: Synthetic coding sequence
atggagcggagcggctgggcccggcagaccttcctgctggccctgctactgggagccactctgcgagcgcgagccgcggctgggtattatccgagattcagcccctttttttttctctgtacacaccacggcgagttggagggcgacggggaacagggcgaggtcctgattagcttacacatcgccggcaatccaacatactacgttcccggccaggagtaccatgtaactatatccacaagtactttctttgacggtttgctggtgaccggcctgtatacctccaccagtgtacaggctagtcagtctatcggcggttctagcgcatttggatttggaatcatgtcagaccaccaattcggaaatcaatttatgtgtagtgtggttgcgtctcacgtgtcccaccttcctactacgaacctgagtttcatatggattgcacctcctgccggtactggatgtgtgaattttatggcaaccgctacccaccggggacaggttatctttaaggacgccttggcacagcaattatgcgagcagggagctcctactgatgtgaccgtccacccacacctggcagagatacatagtgatagcatcattctgcgcgatgacttcgatagctaccatcagctccaattgaatcccaacatctgggtggaatgcaacaactgcgagaccggtgagcaatgcggagcgattatgcacggcaacgccgtcacattctgtgagccctatggcccaagggaactgatcacgacgggcttaaatactaccaccgcttctgttctgcagttttccatcggtagtggctcgtgtcggttcagttactcagatcccagcatcatagtgctctacgcgaaaaataatagtgccgactggatacagttggaaaagatacgcgcaccatccaatgtctctactattattcacattttataccttcctgaagacgcgaagggagagaatgtccagtttcaatggaaacaagagaacttacgagttggtgaggtctacgaagcctgctgggcactggacaatattttaataattaatagcgcacaccgtcaggttgttttagaggactccctcgaccccgttgatactggtaactggctgttcttcccaggcgctaccgtcaaacacagctgccagagtgatggaaattctatttattttcatggcaacgaggggagtgagtttaatttcgccactacacgcgacgtcgacctgtcgactgaggatatccaggagcaatggtctgaagagttcgagtcccaacccaccggatgggatgtcttaggggccgtgatcggcaccgagtgcggaactatcgagtcaggactgtcgatggtattcctgaaggatggtgagaggaaattgtgtacaccttccatggacaccaccggttatgggaacctcaggttttatttcgtaatggggggaatctgcgacccaggcaactctcacgagaatgacattattctctatgccaaaatcgaagggagaaaggagcacattacccttgataccctcagctacagtagctacaaggtgcccagtcttgtttccgtggtaattaacccagagttgcaaacaccagcaacgaagttttgcttacgtcaaaagaaccatcaggggcataacagaaatgtgtgggcagtggatttcttccatgttctcccagtgctcccctccacaatgtcccatatgatccaattttctatcaatctagggtgcggaacccaccagccgggcaactctgtgtctctggagttttctaccaaccacgggaggtcttggtcactccttcacacagagtgtttgcccgagatctgcgctggcccccacctgccgcactccactgtgtattcttccgagaactactctggctggaaccgtattaccattcctctgcctaacgctgccctgactcggaatacccggatccggtggcggcagacgggacccatcttggggaacatgtgggctatcgataacgtatacattggtcccagttgtctgaaattttgctctggccgcggccaatgcacaagacacggctgtaaatgcgatccagggttttctgggcctgcatgtgagatggcctctcagaccttccccatgtttatttccgagtcttttggttcttctcggttgagctcctatcacaacttttactctatccggggagctgaagtcagctttggttgtggtgttcttgcatcagggaaagctctggttttcaacaaggacgggaggcggcagctgattacttcattccttgattcttcgcagtctaggtttctccaattcacccttagactcgggagcaaaagcgtactgagtacctgccgggcaccggaccaacccggggaaggagtgcttttacactactcgtatgacaatggcataacatggaagctgttggagcattactcatacctgagctaccacgagccacgaatcatcagcgttgagctgccgggagatgccaaacagttcggtattcagtttagatggtggcagccttatcacagctctcagagagaggacgtgtgggcaattgatgagattataatgaccagtgtgctctttaattctatttctcttgactttactaacctagtggaagtgacgcaaagcctcggattttacttggggaatgtgcagccttactgtgggcatgactggactctgtgcttcactggggactcaaagctcgcatcatcaatgcggtacgtggaaactcaatccatgcaaataggcgctagttacatgatacagttcagtctggtgatgggctgcggccaaaaatacacgccacatatggacaatcaggttaagctggaatacagtaccaatcatggactaacatggcacttggtgcaagaggagtgccttccaagcatgccgagctgtcaggagtttacgagcgcctccatctaccacgctagtgaatttacccagtggcggcgagtcatagtgctgcttccccagaaaacctggtctagtgcaacaagattccggtggagccagtcttactataccgctcaggacgagtgggccctggacagcatctacatcggacaacaatgtccgaacatgtgctccggccacgggagctgtgatcacggtatttgccgatgtgatcagggatatcaagggactgaatgtcatcccgaagctgccttgccctccaccatcatgagtgactttgaaaaccaaaacggatgggagagtgactggcaggaagtgatcgggggcgagatagtcaagcccgaacagggatgtggcgtcatttcctcagggtccagtctgtactttagcaaagccggcaaacgccagttagttagttgggatcttgacacttcgtgggtggacttcgtgcaattctatatccaaattgggggagagtcagcatcttgtaacaagcccgacagcagagaggagggcgtactgttgcagtattcgaataatggtggtatacaatggcatctcctggctgagatgtacttctcagattttagcaaaccacggtttgtgtacctggagctgccagcagcagctaagactccctgcacaagattccgctggtggcagcccgtcttctccggcgaggactatgaccaatgggcagttgatgatattataatcctgtccgaaaaacagaagcagatcattccagttatcaatccaaccctcccccaaaacttctatgaaaagcccgccttcgattacccaatgaaccaaatgagcgtctggttgatgcttgccaacgaagggatggtgaaaaatgaaacattctgtgccgccaccccatcagctatgatttttgggaaatctgatggagaccgcttcgcagttacaagggatctgactctgaagccgggatacgtactgcagttcaagctcaatataggatgtgcgaaccagttcagctctactgcacccgtgctgctgcaatacagtcacgatgccggcatgagctggttcttagtgaaggagggatgctaccccgcatcagctggaaagggatgcgaaggcaactctcgagagctttccgagcccacaatgtaccacactggggattttgaggaatggacccgaatcacaatcgtcataccaagaagcttggcaagttccaagactagattccgctggattcaagagagcagctctcagaaaaatgtgcctccattcggtcttgatggagtttatatctcagagccgtgtcctagttattgcagcgggcacggggattgtatatccggcgtgtgtttctgtgacctgggttataccgcggcccaggggacttgtgtgagtaacgttccaaatcataatgagatgtttgacagatttgaggggaagctcagtccactctggtataagataactggggcccaggtgggcactggctgtgggacactgaatgatggaaagtccctgtacttcaacggcccaggaaaacgggaggcacgcacggttcctctggatacccgtaacatcaggcttgttcagttctatattcagattggatccaaaacgtctggtataacgtgcataaaaccaaggacacgcaatgagggcctcattgtccagtactcaaatgataatgggatcctgtggcacctgctgcgagagttggacttcatgagctttttagaacctcagatcatttcaatagatcttccccaagacgccaaaactcctgctactgcatttcggtggtggcagccgcagcatggtaagcactcggcccaatgggcactagacgatgtcctgattggaatgaatgactccagtcaaacagggtttcaggacaagttcgatggctcaatcgatcttcaggcaaactggtatagaattcaggggggacaggtcgacatcgactgtcttagcatggacaccgcactcatctttactgagaacatcggaaagccgcggtacgccgaaacttgggacttccacgtgagcgccagcaccttcctgcagtttgaaatgtccatgggatgttccaagcctttcagcaacagtcattccgttcagctccaatattccttgaataacggtaaggactggcacctagtgactgaggagtgtgttccacccacaatcggctgtctccactatacagaatcttccatctatactagcgaaaggttccagaactggaaacggataactgtgtatttacccctatccaccatctccccacgtacccggttccgctggattcaagctaactatactgttggagcagacagctgggcgatcgataacgttgtactcgcctccggttgcccttggatgtgtagcgggcgcgggatctgcgacgcgggccgatgcgtctgcgatcgcggctttggtggaccatattgcgtcccggttgtccctctgccttccatactgaaggacgatttcaacggcaatttgcacccagacctgtggccagaagtttatggcgccgaacggggaaatctgaacggcgaaaccatcaagtctgggacatcattgatctttaagggggaaggtctgaggatgttaattagccgggaccttgattgcacgaatacaatgtacgtgcagtttagtttgaggtttattgccaagagtactcctgagaggagtcactccattctgctgcaattcagtataagcgggggtataacatggcacctcatggatgagttttactttccccaaaccaccaacatcttatttatcaatgtgcccttaccctataccgctcagacaaatgccacaaggttccgattgtggcagccttacaacaatggaaagaaagaagaaatttggatcgtcgacgacttcatcatcgacggcaataacgtgaataacccggtcatgctgctggacacatttgactttgggccgagagaggataactggttcttctacccaggcggcaacatcggcctgtattgcccctattcttccaagggagctccagaggaggactccgcaatggtgtttgtgtccaatgaggttggcgaacactctatcaccacccgggatctgaacgtcaacgagaacacaatcatccagttcgagattaatgtcgggtgctccaccgatagttcaagcgccgaccccgtgcggcttgaattcagtcgcgatttcggtgctacctggcatctattgctgccactctgttaccacagttcctcacacgtttcctcgctgtgctcgactgagcaccacccttcgagcacttattacgccgggacaatgcagggttggcgtagggaggtggtccatttcgggaagttacacttgtgcggtagcgtccgttttcggtggtaccagggattctatccagcaggctcccagccagtgacatgggccattgataacgtgtacattgggccccagtgcgaagaaatgtgcaacggccagggtagctgcattaatgggacaaagtgcatttgcgatcctgggtattcaggcccaacctgcaagattagcaccaagaacccggatttcttaaaagacgactttgaaggccagctggaatctgataggttccttcttatgagcggggggaaaccctccagaaagtgcggaattctcagttcgggtaataatctgttctttaacgaggatgggcttaggatgctcatgacacgcgatctggacctgtctcatgcacgcttcgtgcagttcttcatgcgcctggggtgcgggaagggggtccctgaccctagaagccagcctgtcctcctgcagtactctcttaacggcggactgtcttggtccctcttgcaggaattcctcttctctaactcatcaaatgttgggagatacattgcccttgagatacctctgaaagccagatccggatctacaaggctgaggtggtggcagccctccgagaacgggcacttttactcgccttgggtcattgaccaaatcctgatcggcggcaacatctccgggaatacagtccttgaagatgatttcaccaccctggattcccgcaagtggcttctgcatccggggggcactaagatgcctgtgtgcgggtcaaccggcgatgccctggtgtttatcgagaaagcatctactagatacgtggtgtcgacagacgtcgccgtgaatgaggactctttcctgcagattgactttgccgcatcttgcagtgtcaccgactcctgctacgccatcgagttagaatatagtgtggacctgggcctttcatggcacccccttgtaagggattgtctgcccacgaatgtggaatgcagtcggtaccacttacagcgaatcctggtgtctgacaccttcaataagtggaccaggattaccctcccattgccaccatacaccagatcccaggcaaccagatttcgttggcatcagccagcaccatttgacaaacagcaaacgtgggccattgacaatgtatacataggcgacggatgcatcgatatgtgttcaggtcacggaaggtgcatccaaggtaactgtgtatgtgatgagcaatggggcggcctctactgcgacgacccggaaacgtctcttcccacgcagctcaaggataacttcaaccgcgcccccagctcacaaaattggttaacagtcaacggcggaaagctgtcgactgtttgcggggccgttgcttccggcatggcactccactttagtggcggttgcagccgactgctcgtgactgtagaccttaacctcactaacgccgagttcatccaattctactttatgtacggatgcctcatcacccccaataatcgcaatcagggagtcctcctggaatattccgtgaatggcggaatcacatggaacttacttatggaaattttctatgaccagtattccaaaccggggttcgtgaacattttgctgcctcctgacgccaaggagatcgcaacacgttttcggtggtggcagccgagacacgacgggctggatcaaaatgactgggccattgataacgtgctgatctctggatcggccgatcaaaggactgtgatgctcgacacattcagctcagccccagtgccccagcacgaaagaagtccagctgatgccggcccagtcgggcggatcgcttttgacatgtttatggaggacaagaccagcgtaaatgagcactggctattccacgacgactgtacagtagagcggttctgcgactcaccggacggggttatgctctgcgggagccatgacgggcgggaggtgtatgctgtgacacacgacctcacacccacggaaggttggatcatgcagttcaaaatttccgttggatgtaaagtctctgagaagatcgcccaaaatcagatccatgtgcagtactccacagactttggagtgagttggaattatctggtgccccagtgtcttcccgccgatcccaagtgttccgggtcggtgagtcagccgagcgtgtttttccccacaaagggatggaaaagaattacgtatcccctgcccgagagcttggtgggaaaccctgtgcggttccgattttaccagaaatactcagacatgcaatgggctattgacaacttctaccttggacctggctgcctggacaattgtcgcggccacggcgactgccttagggagcagtgtatttgcgaccctgggtactcggggcctaattgttatctgactcacaccctgaaaaccttcctgaaggaacgttttgattcagaagaaattaagccagacctgtggatgtccctcgagggggggagtacctgcaccgagtgcggaattttggccgaagacacggccctttattttggtgggtcaacagtgagacaggccgtgacccaggacctggatctgcgcggtgcaaagttcttgcagtattggggcagaattggatctgagaacaatatgactagttgccacagaccaatctgccgcaaggagggggtgctgcttgactacagcaccgacgggggtataacttggaccctactccacgagatggactaccagaagtatatttctgtgcggcatgactacatcctcctacccgaagatgccctgaccaacacaacccgcttgagatggtggcagccatttgtaatctcgaatggcatagtggtcagcggggtagaaagagcacaatgggccctggacaatatccttattggcggcgcagagattaatccgagccagcttgtggacacctttgatgatgagggcacttcacatgaagaaaattggtcattctatcctaacgctgtgcgcaccgccggcttctgtggaaacccatcatttcatctttactggcctaataaaaagaaggacaaaactcataatgccctgagttcccgggagctgatcatccaacctggatatatgatgcagtttaagattgtggtgggatgcgaagcaacatcgtgtggtgacttacattctgtgatgcttgaatacacaaaggacgccaggtcggattcgtggcagttggtacagactcagtgcctgcctagttcctccaattctattgggtgctcgccctttcaatttcatgaggcaacaatttataactccgtgaactcctcgtcttggaaaagaattacaatccagctgcccgaccacgtcagcagttccgcaacgcagtttcgatggattcagaagggagaagaaacagagaagcagtcctgggcaattgatcatgtctatattggagaggcatgtcccaagctctgcagtggccacggctactgcacgaccggcgccatctgtatttgcgacgaaagctttcaaggcgacgattgttccgtttttagtcatgacctgccatcgtacataaaggataattttgagagtgcccgtgttacagaagccaactgggaaacaattcaagggggagtgatcggcagcgggtgtggacagctggccccttatgcccatggagatagtctatactttaatggatgccaaatccggcaagcagcaacgaaacccctggatctcactcgcgcatccaaaatcatgtttgtattacaaatcgggtctatgtcgcagacagattcatgcaattctgacctgagcggcccccatgccgtggataaggcagtcttgcttcagtactccgtcaacaatggcataacttggcacgtgatcgcgcaacatcagccgaaagactttacacaagcacaacgggtgagctacaatgtgccactggaggcgcgcatgaaaggtgtcttactccgctggtggcagccacgccataacggcacaggccatgaccagtgggctctggatcacgtggaagtggtcctggtatccacacggaagcagaattacatgatgaattttagccggcagcatggcctacggcacttctataatcgccggagacgctctttgagaagatatccatag

SEQ ID NO: 26103 - DNA, 10284 bp, Artificial Sequence
  Description of Artificial Sequence: Synthetic coding sequence
atggagcggagcggctgggcccggcagaccttcctgctggccctgcttttgggtgctactctccgagcacgggctgctgcaggatattatccaaggttttctccttttttctttctctgcacccatcatggggagctggagggagatggagagcagggggaggttttaattagtctgcatatcgccgggaatcctacctactacgtgcctggccaagaataccatgtgactataagtacctccacattcttcgatgggctcctcgtaacagggctgtacaccagtacgtccgtgcaggccagtcaatctattggcggttcttcagccttcggatttggcatcatgtcagatcatcagttcgggaaccagtttatgtgtagcgtggtcgcgagccacgtgtctcatctgcccactaccaatctgtctttcatttggattgccccaccggccggcaccgggtgtgtgaactttatggccacagctactcatcgtgggcaggtgatttttaaagacgccttggctcagcaactgtgtgaacagggggcacccactgacgtgacagtccatcctcatctggccgagattcactcggactcgatcatactcagagacgattttgactcctaccaccagctgcagctgaatccaaacatctgggtagagtgcaacaattgcgagacaggagaacagtgtggtgcaatcatgcatggaaacgccgtgacattctgcgagccctatgggccgagagagctcattaccacaggactgaatacaaccacagcgagtgtgctccagttctcgatcgggtctggttcttgcaggttttcatattctgatccgtctataatcgtactgtatgccaagaacaattcagccgactggatccagctggaaaagatcagagcaccatctaacgtgtctactattatacacatcctgtacttgccagaggatgctaagggagaaaacgtgcaatttcagtggaaacaggaaaacctgagggtgggtgaagtgtacgaggcttgctgggctctagacaatattctgatcatcaattccgcacatcgtcaagtagtcttagaggactccctggaccccgtcgacacgggtaattggctctttttccctggagcaacagtaaagcactcatgccagtctgatggaaactccatctatttccacggaaacgaaggttctgagttcaactttgctacgacacgcgacgttgatctcagtactgaagatatacaagaacagtggagcgaagaatttgagtcccagccgactggatgggatgtacttggtgctgtaatcggaacagagtgcggtaccatagagagtgggttaagcatggtgtttctcaaagacggggagagaaagctgtgcactcccagcatggataccaccggctacgggaacctccgattctacttcgtaatgggcggcatatgcgatccaggcaactcccatgagaacgatataatcctgtatgccaagatcgaaggaaggaaggaacacatcacactcgatacccttagttatagttcctacaaggtaccgtccttggtgtccgtggtgatcaatccagagctgcagactcccgccacaaaattctgtctgaggcagaagaatcaccagggacataaccgcaatgtatgggcggtggacttcttccacgtcctccctgtcctgccctcaactatgtcacacatgattcagttctcaatcaatctcgggtgtggtacacaccaaccagggaactccgtgtcactcgagttctctaccaaccacggccgcagttggtcactgcttcacaccgaatgtctcccagagatctgtgccggcccacacctgccacattctaccgtgtactcttcagagaactactccggctggaaccgcattactatcccactcccaaatgccgccctgacccggaacacccggattaggtggaggcaaacaggtcccatcctgggcaatatgtgggctattgacaatgtctatataggaccatcttgtctgaagttctgctcggggagggggcagtgtacgcgtcacggatgcaagtgtgatccagggtttagtggcccggcttgtgaaatggccagccagacgtttccgatgttcataagcgaatcctttggaagtagtagattatccagctatcacaatttttatagtattagaggagctgaggtatctttcggatgcggcgtgctggctagtggcaaggcgctcgtgtttaataaggacggaagacgccagctgattacctccttcttagacagcagtcagtcaaggttcttacagtttaccctgcgcctcgggtccaagtccgtgctatccacctgcagagcccccgaccaaccaggggagggcgttctgctgcactatagttatgataacggaattacgtggaaattgctggaacactattcatatctgagttatcacgagcctcgtatcatttctgtggagctgcctggggacgccaaacaattcggaatccaatttcgctggtggcagccctaccacagtagccagagggaagacgtctgggccatagacgaaattattatgacaagcgtgctatttaactcaatctcactcgatttcacaaatctggtcgaggtgacccagtccctgggattctacctggggaatgtgcagccgtactgcgggcatgattggaccctttgttttacgggggactctaaactggctagtagcatgcgatacgtggagacccagtctatgcagatcggcgcttcatacatgattcagtttagcctggtaatgggctgcggacagaagtacacccctcacatggacaatcaagtcaaactggagtattccaccaatcatggtctaacttggcacctggttcaggaagagtgtctgccaagcatgcctagttgtcaggaattcacctccgcatcaatctatcatgcgagcgagtttacccagtggcgccgggtgatcgtgctgcttcctcagaagacctggtcttctgccacccggtttaggtggtctcagagttattatacagctcaagacgaatgggcacttgactccatttacattggacaacagtgtcccaacatgtgctctggccacggaagctgcgaccacggcatatgtcggtgtgatcaggggtaccagggtaccgaatgccatcctgaagcagctctgcccagtacgatcatgtcagactttgagaaccagaacggttgggagagcgattggcaagaagtcattggaggagagatcgtgaagccagaacagggctgtggggtcatctcttccgggtcaagcctgtatttttcaaaagccggcaagcggcagcttgtatcgtgggatctggacacttcatgggtcgactttgtgcaattctacatccaaatcggaggcgagagcgcgtcttgcaacaaacctgacagtagagaggaaggtgtgttgttgcaatacagcaacaatgggggcatacagtggcatctgctagctgaaatgtatttttcagatttcagcaaacctcgctttgtttacctcgagctccctgccgctgccaagaccccttgcacacgcttccggtggtggcagcccgtgttctcaggggaggattatgaccagtgggcagtcgacgacattattattctgtccgaaaagcaaaagcaaataattccagttataaacccaactcttcctcagaatttttatgaaaagcctgctttcgattatcctatgaatcagatgtccgtctggttgatgctcgcaaatgagggcatggtgaagaacgaaacgttctgtgccgcgacccccagcgccatgatctttgggaagtcagatggcgatcgctttgccgttactcgggacctcaccttgaaaccaggctacgttctccagtttaagctgaacatcggttgcgcgaatcaattctcctccactgcccccgtccttttgcagtactcgcacgacgctggcatgtcatggtttctcgttaaggagggctgctatcctgcatcagctggcaaaggatgtgagggtaatagccgtgaactgtccgaacccaccatgtatcatactggagactttgaggaatggacaagaataaccattgtgattcctcgatccctagccagctcaaagaccagatttaggtggattcaggaaagctccagtcagaagaacgtccccccattcgggctggatggtgtatacatctccgagccctgcccatcatactgtagtgggcacggcgactgcattagcggcgtgtgcttctgcgacctggggtataccgccgcccaagggacctgcgtgtctaacgtgccaaaccataatgagatgtttgatcgctttgaaggtaagctgtctccactatggtataagatcactggcgcccaagtgggaacaggctgcgggactctgaacgacggcaagtccctgtatttcaatgggcccggcaaacgcgaggcccgaacagttcccctggatactcgaaacatcaggctggtgcagttttatattcagattggaagcaagacaagtggaatcacttgcatcaagcctagaaccaggaatgagggccttatcgttcagtactctaatgacaatggcatcctttggcacctgctccgggaactggactttatgtcatttctcgagccacagatcataagcatcgatctcccacaggatgccaagactcccgcaacagctttcagatggtggcagcctcagcacggaaaacactccgcccagtgggcactagacgatgtgctcatcggcatgaatgattcttcgcaaacgggctttcaggacaagttcgacgggtcgatagatttacaggcaaattggtaccgcattcagggcggacaggtagacatcgactgcctgagcatggataccgcattgatattcactgaaaacatcggtaaaccgcgctatgcagaaacatgggatttccacgtttccgcttcaacttttctgcagtttgagatgagcatgggctgttccaaaccgttttcaaactcccattccgttcagctgcagtactccctgaataatggcaaagactggcacctggtgacagaagagtgtgtacccccaactattggttgccttcattatactgaatcctccatctacacatccgagcggtttcagaattggaagcgaatcacggtgtatctgcccctcagtacaattagtcctagaacccgttttcgctggatccaggccaactacactgtcggtgccgattcttgggcgatcgataatgtggtgctcgctagcgggtgcccctggatgtgttctgggaggggcatctgcgacgcaggccgctgtgtatgtgaccggggctttggggggccctattgcgtccccgtggtgccattgccaagtatcttgaaggacgacttcaacggtaacctgcatccagacctctggccagaagtgtatggcgctgagcgtgggaacctgaacggcgagaccatcaagagcggtacatcgttgatattcaagggggaaggtttgcggatgctgataagccgggatctggactgcacaaacacaatgtatgtacagttctctctgcgattcattgcgaaatctaccccggaaaggagccatagcatattgctccagttctccatctctggcggaatcacatggcatcttatggacgagttctacttccctcagactaccaacattctgttcatcaatgtgccactgccctatacggctcaaaccaacgccacacgttttcggctttggcaaccttataacaatggaaagaaggaagagatatggatagttgacgattttatcatcgatgggaataacgtgaacaatccggtgatgctgctggacacctttgattttggcccgagagaggacaattggtttttttaccctgggggaaacatcggcctatactgtccgtactcctcaaagggtgccccagaggaggactccgcaatggtgtttgtttctaatgaagtgggcgaacactccatcacaactagagatctgaacgtcaacgagaataccatcatccagttcgagatcaacgtcggctgttcaacagattcctcatcagctgatccagtgagactggagtttagcagggatttcggcgcaacatggcacctgctcctcccattgtgctatcatagttccagtcatgtgagtagtctgtgtagtaccgagcaccatccttcttcaacgtactacgcaggcaccatgcaggggtggaggcgcgaagtcgtacactttggcaaactgcatctgtgtgggagtgtgcgcttcaggtggtaccaaggcttctatcccgcagggtcgcagccagtcacctgggccattgacaacgtttacataggaccccagtgcgaagagatgtgtaatgggcaaggtagctgtattaacggcaccaagtgcatctgtgaccccggctattcaggcccaacgtgtaagatcagcaccaagaatcccgactttctgaaggatgactttgagggacaactcgagagtgaccgctttttgctcatgtcaggtggtaagccttcccgtaagtgtggtattctcagttccggaaataatctgttttttaacgaggatggcttacgcatgctcatgacccgagacctcgacctgtctcacgctagatttgttcagttctttatgaggctaggctgcggcaaaggcgtgccagatccaagaagtcagccagtcctgcttcagtactcactaaatggcggtctgtcctggtctctcctgcaggagttcctgttcagcaactcatcgaacgtgggaaggtatattgcactcgaaataccattgaaagcccgatccggaagcacgcgcctccgctggtggcaaccttctgagaacggccatttctattcaccatgggtcatcgatcagatcctcattggggggaacataagcggaaacaccgtattggaggatgatttcactacactggatagtaggaaatggttactgcacccaggaggcactaaaatgcccgtgtgcgggtcgacaggagacgctttggtatttatagaaaaggccagtacacgctacgtagtgtctaccgacgttgctgtgaacgaggatagcttcctgcagattgattttgccgcctcctgtagcgttacagattcttgttacgccattgagttagagtactctgtggacctgggcttgtcctggcatcctctggtacgtgactgtctacccactaacgtcgagtgttcaaggtaccacctccaacgcattttggtgtctgacacattcaacaaatggactagaattacccttcctctgcctccatacacccggtcacaggcgacgagattccggtggcatcagccagcccccttcgacaagcagcagacatgggcaatcgacaatgtgtatattggagatgggtgtatcgatatgtgttccggacacgggagatgcattcaaggcaactgtgtttgtgacgagcagtggggaggactttattgcgatgatcccgagacatcactgcctacccagctgaaagacaatttcaacagggccccctcgtcccagaactggctgacagtgaatggaggaaagttaagtaccgtctgcggagccgtcgccagcggaatggcgctgcattttagcggaggttgttctcggttgctggttactgttgatctgaatttaaccaacgccgaatttatccagttttattttatgtacggttgcttgatcactcctaacaaccggaatcagggcgtgctactcgaatactctgtgaacggcggtataacttggaatttgctcatggagattttttacgaccaatactccaagccgggcttcgtgaatatcttgctgccccctgatgctaaggagatcgccacaaggtttcggtggtggcagcccaggcatgatggattggaccagaatgactgggccatcgataacgtgctaattagtggcagtgcagatcaaaggactgtcatgttggacaccttctcatctgcgcctgtcccacaacatgagcgaagccctgcggacgccggacccgtgggccggatcgcatttgatatgtttatggaggacaagactagcgtcaacgagcactggctgtttcatgacgattgcactgttgaaaggttctgtgacagccctgacggggttatgctgtgtggttcccacgatggcagggaagtgtacgcggttacacatgatctgactccaaccgagggctggatcatgcagttcaaaattagtgttggttgcaaagtcagtgaaaaaatcgcacagaatcagattcacgttcagtattctacagattttggggtcagttggaactatctggtgcctcagtgcctccctgcagaccctaagtgttccgggtcagtatcacaaccatccgttttttttcctacaaagggctggaaaagaatcacatacccattacctgaaagcctcgtggggaatccagtgagattccggttttaccaaaagtatagcgatatgcagtgggccatagacaatttttatctgggacccgggtgtcttgataactgtcgggggcatggcgactgtctccgagaacagtgcatctgtgatcctgggtacagcgggcccaactgttatttgactcataccttgaaaacttttttaaaagaacgctttgactccgaggaaattaagcccgacctgtggatgtccctagagggggggagtacctgtaccgagtgcggtatcttagcagaggacacggctctttacttcggaggttccactgtcaggcaggcagtgacacaagatctggatttacgcggcgctaaatttctgcagtactggggccggatcggcagtgaaaacaacatgacatcatgccacaggcccatctgtaggaaggagggcgtgcttttggattacagcaccgacggtggtattacatggacactgctgcacgagatggactaccaaaaatacatttccgtacggcatgattacatcttactacccgaagacgcgctcacaaatacaaccaggctaaggtggtggcagccctttgtaatatcgaacggcatcgtagtcagcggagtagagagggcacagtgggccttggataatatactgattgggggcgcggagattaacccctcccagctagtggacaccttcgatgatgaggggacgagtcacgaggaaaattggagcttctatcccaatgctgttcgcaccgccggcttctgtggcaatccctccttccatctgtactggccgaacaaaaagaaggacaaaacccataatgccttgtcttcgagggaattgatcatacagcccggttatatgatgcagtttaagattgtagtgggatgtgaagcgacatcctgcggcgacctacattctgtcatgctggaatacaccaaggatgctcgttcagactcatggcagttggtacaaactcagtgcctcccatcttctagcaactctatcggatgctccccctttcagttccacgaggcaacgatctataattctgtgaactccagcagctggaaaagaatcaccattcagctacccgaccacgtgagttccagcgcaacccagtttagatggattcagaagggggaggagaccgagaagcagtcctgggcaattgatcatgtttatatcggcgaggcctgcccgaaactgtgctcggggcacggatactgtacaacaggtgctatatgcatatgtgatgagtccttccagggcgatgattgttctgtgttctcacacgacttgccgtcttatattaaggataacttcgagagtgccagggtcactgaggctaattgggagaccatccaagggggggtgatcggaagtggctgcggacaactcgctccatatgcccacggggacagcctgtattttaatggctgccagattagacaggcggcaacgaagccgttggatttgacccgggcatcgaaaattatgttcgttttgcagatcggctcgatgtcacagacggactcctgtaactcagatctgtcaggtcctcatgccgtcgataaggccgtgctcctccagtatagcgtgaataatggcataacctggcacgtgattgcccaacaccagcctaaggattttacacaagcccagcgagtgagttataatgttccattggaggcccgtatgaagggagttctcctgaggtggtggcaaccgaggcataatgggacaggccacgatcagtgggcattagaccacgtggaggtggtactgtag

SEQ ID NO: 26104 - DNA, 1668 bp, Artificial Sequence
  Description of Artificial Sequence: Synthetic coding sequence
atgaagaagcacgacttcgccgagaacctgcccagcagcctgctgataattatacttgtgatttttaccctctcaggaagtaagtttggcagggggactggactgactcagcctagccagcgtacctcagcaagaaggagctttggccgctccaaacgtttttctattactagaagccttgatgatctggagtctgctaccgtaagtgacggcgagctgactggagctgacctgaaggattgcgtgagcaacaacagcctgagctctaacgcctctttaccgtctgtgcaatcttgcagacgattgagagagcgccgagtggccagctgggccgtttccttcgagaggcttttgcaagaccccgtgggtgtgaggtactttagcgactttctccggaaggagttttctgaagagaacatactgttctggcaagcctgcgagtacttcaaccatgtgccagcccacgataaaaaagaactttcctatcgggctcgggagattttctctaaattcctttgctctaaggcaacaacaccagtcaacattgattctcaggcacagctcgctgacgatgttctgagggctccccatcccgacatgttcaaggaacagcagctccagatctttaacctgatgaagtttgactcatacactcggttcttgaaatctcccctgtaccaggaatgcatcctcgccgaagtggaaggcagggcccttcctgatagccaacaggtcccttcaagccctgcctcaaaacactccttaggttccgatcactctagtgtgagcacaccaaaaaaactttcaggaaaaagcaaatctggccgctcactcaatgaggagctgggagatgaggacagcgaaaagaaacggaaaggagccttctttagctggagtcggaccaggtcaaccggtcgatcacaaaaaaagcgcgaacatggcgaccacgcggatgatgccctgcatgcaaacggaggcttatgcaggcgggaatctcaaggtagcgtgtcatccgccggcagtctggatctgtcagaggcctgtaggactctggctcctgagaaagacaaagcgaccaaacactgttgtatccatttgcctgatggcacctcctgcgtggtagcagtgaaagcaggatttagtatcaaagatattctgagtggactctgcgagaggcacggcatcaacggggctgcggcagacctttttctggttgggggcgacaaacctcttgtgctgcatcaggatagctcaatcctggagagcagggatttaagactggagaagaggacgctttttcgcctggatctcgtccctatcaataggagcgtcggtcttaaggctaagccgacaaaaccagttacggaagtgcttcggcctgtagtggcacgatatggattggacctctctggcctgctagtgaggctcagcggcgagaaggagccgcttgatctgggagcccctatctctagcttggatggccagcgagtggtgctagaagagaaggacccctctcgcggcaaagccagcgccgacaagcagaagggagtgccggttaaacagaacacagccgtcaacagttccagcagaaaccactccgcgacgagttttctgtcgctgttcccaaagctgcgagctacagaacagatgactaatgtgggttgctag

SEQ ID NO: 26105 - DNA, 4131 bp, Artificial Sequence
  Description of Artificial Sequence: Synthetic coding sequence
atgttccgggccggcgaggccagcaagcggcccctgcccggccccagcccaccaagggtgagaagtgtggaagtcgctcggggccgcgcgggttacggctttactctctctgggcaagcgccgtgtgtgttgtcttgcgtcatgaggggatctcccgccgactttgtgggacttagggcaggagaccaaatcctggctgttaatgaaattaacgtgaagaaggcttctcatgaggatgtggtgaaactaatcggcaagtgttcgggtgtgttgcacatggtcatcgcagagggtgtgggacggttcgaatcctgttcttccgacgaagaggggggactctatgaaggaaaaggctggctcaagccaaagctagacagcaaagcccttgggattaacagggcagaacgagtggtggaggaaatgcagagtggtggcatcttcaacatgattttcgaaaatccctcattgtgtgcaagcaactcagaaccgctaaaattaaaacagcgctccttgagcgaatctgccgccacccgtttcgacgtggggcacgagtctattaataaccctaaccccaacatgctgtctaaggaagaaatatctaaggtgattcatgacgattcagtgtttagcattggactggaatcccacgacgacttcgctcttgacgcctcaattctgaacgttgccatgatcgtcgggtatttgggctccatcgagctgccctccacgtcttccaatttagagtctgattctctgcaggctattcgtgggtgcatgcgcaggctgcgagccgagcagaaaatacatagcttggtgactatgaagattatgcatgattgtgtccagctgtctaccgacaaggccggagtcgtggccgagtatccagcggaaaagctggcattttctgcagtgtgccccgacgacagaaggtttttcggcttggtcacaatgcagaccaacgacgacggcagcctagcccaggaggaagaaggtgcactgaggaccagctgccacgttttcatggtcgaccctgacctgtttaatcacaagatccaccaagggatagccaggcgcttcggcttcgagtgcacagccgacccagatactaacggctgcttagagttccctgctagctccctgccagtgctgcaatttatctcagtcctgtatagagacatgggagagcttatagaaggcatgcgtgctcgggcgtttctcgacggagacgcagatgcacaccagaataattccacatcttcaaactctgactctggcatcggcaattttcaccaggaagaaaagtctaatagagttctcgtggtggaccttggcggctcctcgtcacgacacggcccggggggcagtgcgtgggatggcgtaggggggaggggagcccagccctggggggcgccgtggacaggaccattttgtccagaccccgagggttcacctccatttgaagccgcacatcagactgaccgtttttgggatcttaataaacacttagggcccgcttcacctgttgaagtgccaccggctagcctaaggtccagcgtgccaccatccaaacgcggtacggtgggcgcaggctgcggatttaaccaacgctggctccctgtgcatgtactcagggaatggcagtgcggtcacaccagtgatcaggatagctacaccgactccacagacggctggagtagcattaactgtgggacgttgcctccgcccatgagcaagatccctgccgatagataccgtgtcgagggtagcttcgcgcagccaccactaaatgctcctaagcgagagtggtctcgaaaggcttttggcatgcagtccatattcggaccccacaggaacgttcgaaagacaaaggaagacaagaaaggttccaagttcggccgggggaccggactcacccagccatcccaacggactagcgcacgacgtagcttcgggaggtccaagcggttctctattacgagatctctggacgatctcgagtctgccacggtaagtgacggcgaactgacgggcgctgatctaaaagattgcgtctcaaataactctttgtctagtaatgcatccttgcccagcgtgcagagctgccgaaggctcagagaacgaagggtggcgagctgggctgtgagcttcgagagactgcttcaagatccagtcggagtgcggtacttttccgattttttgcgcaaggaattttccgaagaaaacattctcttttggcaggcctgcgagtactttaatcacgtcccagctcacgataaaaaagagctgagttacagagctagggaaattttcagcaaattcctttgttctaaggcgacgactcctgtgaatattgactctcaggcccagcttgctgacgacgtgctgagggccccccaccccgacatgtttaaagagcaacagttgcaaatatttaatttaatgaaattcgacagctacactaggttcttgaagagtcctctgtatcaggagtgtatcctggctgaagtggaaggtcgggcactgccagactcacagcaggtgccttcctcacccgcttctaaacactccctgggcagcgaccacagttcagtaagcactccaaagaagctatctgggaagtcgaaaagcggacgttcactaaacgaagaactgggtgacgaggacagtgagaagaaacgcaagggtgccttcttcagctggtctcgcaccaggagtaccggacgttctcagaagaaaagagagcacggcgaccatgccgatgatgcactccacgcaaatggaggcctatgtcgtagagaaagccagggatccgtctcatcagccggtagtctggatctgtccgaggcctgcagaacactggctccggagaaagacaaggccacaaagcattgctgcattcacctgccagacggaaccagttgtgttgtggccgtgaaagcaggattctccattaaagatatcttgagcgggttatgtgagagacacggcatcaatggggcagcagccgaccttttcttagttggcggggataagcccctggtgttgcaccaggattcttccatcttggaaagtcgggatctcaggctggagaaacgcactctattccggttagacttggtgcccattaataggtccgtcggcctgaaagctaagcctaccaagcccgtgactgaggttctcaggccggtggtggcgcgttacggccttgacttgagcggcctgttagttagactgagcggcgagaaggagccactggatctcggagcacctatttcgtccctggacgggcagcgggtggtgctcgaggaaaaagacccttccagaggcaaggccagcgcagataagcagaagggggtgcccgtgaagcaaaacactgctgtgaattcctcaagccgaaaccacagcgctactggagaagaaaggaccctcggcaaatcaaactctatcaagatcaagggggagaacggcaagaacgcccgcgatcctagactcagtaaacgggaagagtcaatcgctaaaatcggtaagaaaaaatatcagaagatcaatctggatgaagccgaggaattcttcgagttgataagcaaggcccagtccaacagagctgacgatcagcggggcctactgcgcaaggaagatcttgtgttgcctgagtttctgcggctcccccccggcagcacggagctcactctgcctacacctgccgccgtcgcaaagggtttcagtaaacgtagcgctactgggaatggccgagaatctgcctctcagcccggcgagcagtgggaacccgtacaagaaagttctgacagccctagcacaagcccaggcagcgcctcctccccgccaggaccaccagggacaacaccccccggccagaagagcccatccggccctttctgcactccccaatctccagtctctttggctcaggagggcaccgcacaaatatggaaacgccagtctcaggaagtcgaagctggggggatccagaccgtggaggatgaacacgtcgccgagctcaccctaatgggggagggtgacatcagctcaccaaactcaacgctgctgccacccccaagcaccccacaggaggtaccaggtcctagtaggcctggcacttcgagattctag

SEQ ID NO: 26106 - DNA, 2400 bp, Artificial Sequence
  Description of Artificial Sequence: Synthetic coding sequence
atgaacctgggcaaggagctgagcaacgagacccacgtgagcaacgaccagcaaagtgccacagtttctgatggcgaactcacaggggctgacttgaaggactgcgtctccaacaactcactgagttcaaatgccagcctgcctagcgtgcaatcttgcaggcgcttacgtgaacgccgagttgcttcatgggccgtgagtttcgagcgcttactgcaggaccccgtgggagtgcgatatttcagcgactttctgagaaaggagtttagcgaagaaaacattctgttttggcaggcatgcgagtacttcaaccacgtgcccgcacacgataaaaaggaactttcttacagggctagggaaatcttcagcaagttcctgtgtagcaaagcaacaacaccagtgaatatcgattcacaggcgcagctagctgatgacgtcctgcgcgccccgcacccggacatgtttaaagagcagcagcttcaaatctttaacctaatgaagtttgatagctacacacgatttctgaaatcgcccctgtatcaggaatgtatcctcgctgaggtggagggccgcgccctgcccgacagccagcaggtgccgtcttctcccgcttccaagcattccctgggctccgaccatagcagcgtgagcactcctaaaaagctaagtggcaaatcaaagtcaggcagatctctcaatgaagaacttggtgatgaggatagcgaaaaaaaacgaaagggcgctttcttcagctggtcccgaacccgttctacaggacggtcccagaaaaagcgtgagcatggcgaccacgccgatgatgccctgcacgccaatgggggtttatgtcgcagggagagccaggggagtgttagcagcgcaggcagccttgatctgtcagaagcatgtcgaaccctagcccccgagaaggataaagccacaaagcactgttgcatccacctgccggacggtacaagttgcgttgtcgccgtaaaagcaggtttttctatcaaagacattctgagcggcctttgtgagcgacacggtattaatggggccgcagccgacctgttcctggtcggaggcgataaaccactggttttgcatcaggacagttcgattttggagtcacgggatctgcgactcgagaaaaggaccttgttcagattagatttggtgccgatcaatcgcagtgttggcctgaaggccaagcccactaaaccagtgacagaagttctgagacccgtcgttgctagatacgggctagacctgtcaggcttattagtgcgactgagcggcgaaaaagaaccactggatctgggggccccaatctcctccttggacgggcagcgggttgtgctagaagaaaaagaccccagtcgaggcaaagcttccgctgacaaacagaaaggcgtgccggtcaagcagaacacagccgtgaacagctcaagcaggaaccactctgctaccggcgaggagaggacactgggaaagagcaatagcatcaaaatcaaaggggagaatgggaagaatgctcgcgacccacggttgagcaagcgtgaggagagtatcgccaagattggcaagaaaaaatatcaaaagattaatttggatgaggccgaagaattcttcgagctaatttctaaggcccaatcaaacagagctgacgaccagcgagggctcttgcgcaaagaggacctagtactgcccgaattcctccgcctgcctccaggcagcactgaattgactttgcccacgcccgcagcggtcgcaaaaggcttctcaaaaagatctgccaccggcaatggacgcgagtcagcatcacaaccaggagaacagtgggaacccgtgcaagaatcatcagacagccctagcacctcgccaggatccgcttcgtcccctccagggcctcctggtacaacaccccctgggcaaaagtccccctccggccccttctgtactccccagtcgcctgtctctctagcccaggaaggtactgcccagatttggaaaagacaatcccaagaggtcgaggctggtggaattcagactgtagaggatgaacatgtagccgaattgactcttatgggagagggagatatcagcagccccaactccactctcctgcctcctcccagtacacctcaggaggtacctggacctagtaggccgggcagtggcactcacggctccagggatctgccagttaatagaattattgacgtcgacctggtcacagggtccgcacctggccgggacgggggcattgcgggagcacaagccggaccagggaggtcacaagcgagtggaggacccccaacatccgatctcccagggctcggtccagttcctggcgaaccagccaaaccaaagaccagtgctcatcatgccacattcgtatag

SEQ ID NO: 26107 - DNA, 4344 bp, Artificial Sequence
  Description of Artificial Sequence: Synthetic coding sequence
atgttccgggccggcgaggccagcaagcggcccctgcccggcccctctccccctagggttagatcagtagaggtggcaagaggacgcgctggttacgggttcacactgagcggacaggccccatgcgtactgagctgcgtcatgcgagggtcacctgctgatttcgtcgggcttcgggcaggcgatcagattctggctgtgaacgagataaatgtcaagaaggctagccatgaggacgtcgtcaagctgattggcaaatgctcgggagtgctgcatatggtgattgcagagggggtaggcagattcgaatcatgttcctcagacgaggaggggggcctatacgagggaaaaggctggctcaagcctaaactggatagcaaggcactcggcatcaaccgggccgagagagtggtcgaagaaatgcagtcagggggaatcttcaacatgatatttgaaaatccgagcctatgtgctagcaactcggaaccccttaagctcaagcaacgcagcctgagtgaatcggccgcaacacgtttcgatgtgggccatgaatcgatcaacaaccctaatcccaatatgttgtcaaaagaggagatttccaaagtgattcacgatgactctgtctttagtatcggtttggagtcacacgatgattttgctctcgacgcatctatccttaatgtggctatgattgtcggctatctggggtccattgagctgccctcaacgtccagcaaccttgagtccgatagcctgcaagctataagaggatgtatgcgcaggctgagagcggagcagaagattcactcacttgtgactatgaagatcatgcacgattgtgttcaacttagcaccgacaaggctggagtagtcgctgagtatccagccgagaaactagccttttctgctgtatgccctgacgatagacgctttttcggtctcgttaccatgcagacaaatgacgatgggagcctggcacaggaggaagaaggtgccctgcgcacttcttgtcatgttttcatggtcgaccccgatctgttcaaccacaaaattcatcaaggcatagcacgtcgctttgggttcgagtgcactgccgaccctgatacaaacggctgtttggaatttcctgcgagctcactgccggtgttacagttcatatcagtcctgtaccgcgatatgggcgaactaattgaggggatgcgagcaagggcgttcctggatggcgatgccgacgcccaccagaacaattctacaagctccaactctgacagtggcattggaaattttcaccaggaagaaaaatcaaatcgggtcttggtagtggacctggggggtagttcaagtaggcatggcccggggggatccgcctgggacggggtaggaggaaggggtgcacagccctggggagcgccctggacaggaccattctgcccagatccggagggatcaccaccatttgaggctgcacatcaaacggatcggttttgggatctgaacaaacatctgggccccgcctcacctgtggaggtgcctccagcctctctgcggagctccgtgcctccaagcaaacgtgggaccgttggtgccggatgcgggtttaaccagcggtggcttccagtgcacgtcctacgtgagtggcaatgtggccacacttccgaccaagacagctatactgattctaccgacggctggagctcaatcaattgcggcaccctaccacccccgatgagcaaaatccctgctgatcgctacagggtggaaggcagcttcgcgcagcctccgcttaacgcgcctaaaagagagtggagtcggaaagcatttggaatgcaatccatctttggaccacatcggaacgttaggaagaccaaggaagataagaaaggatccaaattcggacgggggacagggctaacacagcccagccaacgaacatctgctagaaggagtttcggccgatcaaaaaggttcagcattaccaggagtctcgacgaccttgaatccgctaccgtcagcgacggagaactgaccggagccgacctcaaggattgtgtgtcgaacaatagcctatctagtaatgcctctctaccttctgtacagtcctgcaggcgcttgcgcgagcgaagagttgcatcctgggccgtgagtttcgagaggctgctccaggaccccgttggtgtgcggtactttagcgactttctacgcaaagagttctcggaggagaatattttattctggcaggcctgcgagtactttaaccatgttcctgcccatgacaagaaggaattgagttatcgagcaagggagattttcagtaagttcttgtgctcaaaggcaactacccccgtgaatatagactcccaggcgcaactagctgacgacgtattaagggccccccatcccgacatgttcaaggaacaacaattgcagatattcaacctgatgaagttcgattcctacaccagatttctgaagtcacccttgtatcaggaatgcatattggctgaagtcgagggacgtgctctcccagactctcagcaggttccctcctccccagcttcaaagcactcccttggtagcgaccacagctctgtgagcacccccaagaagctctctggcaagtccaaatccggcaggtccctgaacgaagaactgggagatgaggactcggaaaagaagcggaaaggggcgttcttctcgtggtcacgcactcgcagcactggtcgctcccagaagaaacgtgaacacggcgaccatgctgatgatgctctccacgctaacgggggactctgcaggcgggagtctcagggtagtgtctctagtgccggatctttggacctgagcgaggcatgtcggacactcgcgcctgagaaagacaaagccaccaaacactgctgcattcaccttcctgatgggaccagctgtgtcgtcgcagttaaggccggattttctattaaggatattctgagcggactctgtgagaggcacggcattaacggtgctgcggccgacttgttccttgtgggcggcgacaagccattggtcctgcatcaagactcctcaatactggaatctcgggacctacgccttgagaaaagaacactgttccgactggacctggtcccaatcaatcggtccgtgggcctgaaagcgaagcccacaaaaccagtcacagaggtcctgcggccagtcgtggctaggtacggactggacttgtctggtctgttggtgaggttgtctggggagaaggagcctctggacctgggtgccccaatttcgagcttggatggacagcgggtggttctcgaggaaaaagaccccagccgcgggaaagcatctgccgataagcagaagggggttcccgttaagcagaatactgccgtgaacagctcctcaagaaaccactctgccacaggagaggaacgcacactggggaagtcaaatagcatcaaaatcaagggtgaaaatggtaaaaatgcgcgggaccctaggttaagcaagcgcgaagagtcaatcgccaaaatcggaaagaagaagtatcaaaagatcaatttagacgaagctgaggagttcttcgagctgatttctaaggcccagtctaatcgcgcagacgaccagagggggctccttcgaaaggaggacttagttctgcccgaattcctaaggctgcctcctggcagcacagaattgacgcttcccacacctgctgccgtggcaaaaggattttccaagcggagcgccacagggaacggaagagagagcgctagccagccgggcgagcaatgggaaccggttcaggagtcatcagacagcccatccacctctccaggtagtgcctctagcccacccgggccgccaggcaccacccctcccggccaaaagtctccttctggacctttctgcactccacagtcccccgtgtccctggcccaggaaggtacagctcagatttggaaaagacaaagccaggaagtggaagcaggcggaatacagaccgtggaggacgaacacgtggccgagcttacattaatgggcgagggcgatatctcctcacctaatagcacacttctgcctccccctagcacaccgcaggaggtgcccgggccgtccagacctgggtctgggacccacggctccagagatctgccggtgaaccggatcatcgacgtggacttggtcacggggtccgcacctggccgagatggaggcatcgctggagcccaggctggtcccggccgcagtcaagcctccggaggcccccccacaagcgacctcccaggcttggggcctgtcccgggcgaacctgctaagcccaaaacttccgcacaccatgctacttttgtatag

SEQ ID NO: 26108 - DNA, 4131 bp, Artificial Sequence
  Description of Artificial Sequence: Synthetic coding sequence
atgttccgggccggcgaggccagcaagcggcccctgcccggcccctccccaccaagggtgagatctgtagaggtggcacgtgggagagccggctatggttttactctgtcagggcaggccccgtgcgtcctttcttgtgtaatgcgcggaagtccagctgattttgtgggcctgagagccggagaccagatccttgcagttaatgaaatcaatgtgaagaaggcatcacacgaggacgtggtcaaactgattggaaaatgttcaggcgtgctgcacatggtcattgctgagggtgtgggcagattcgagtcatgcagttcagatgaggagggaggtctatatgagggaaagggctggctcaaacccaaactggatagcaaggcgctcggaattaatagggccgagcgcgtcgtggaggagatgcagtcaggagggatttttaatatgattttcgaaaatccctctctctgtgcgtccaactctgagccactcaaattgaaacagaggtctctgtcagaaagtgcagcgactcggtttgacgttggacatgagagtattaacaatcccaatcccaacatgctcagtaaagaggagatttcaaaggtcatacatgacgattcagtcttcagcattggactagaatcacacgacgattttgctctggatgctagcatcctgaatgtggccatgatcgtgggatacctagggtctatcgagctgccttctacaagcagtaacctggaatctgattctctccaggccatacggggttgcatgagaagactcagggccgagcagaagatccactcacttgttactatgaaaattatgcacgactgtgtgcaattgtcaactgacaaagccggagtggtagccgaataccctgccgaaaaattagccttctccgctgtctgtccagacgatcgaagattctttggactggtaacaatgcaaacgaacgatgatggctcactcgctcaggaggaagaaggagctctgcgcaccagctgccacgttttcatggtggaccctgacttgtttaaccataagatacatcagggcatcgcacggagattcggtttcgagtgtacagccgaccccgacactaatggatgcctagagttccctgcaagttcactgcccgtcctgcagtttatttccgttctctatcgcgacatgggtgagctcatcgagggaatgagggcacgggccttcctggatggtgacgcagacgcccatcagaacaactctacatcttccaactcagacagtggcatcggcaatttccaccaggaagagaagagcaatcgggtgctcgtggtggaccttggcggatcctcgtctcggcacggtcccggaggctctgcatgggatggagtgggagggcgcggcgctcagccatggggtgccccgtggaccggacctttctgccctgatcccgagggcagcccgccttttgaagccgcccaccaaaccgatcgattttgggatctgaacaagcatcttggtcctgcatcacccgtggaggttcctccagcttctttacggagttcagtgcccccttctaaaaggggaaccgtaggggccgggtgtggcttcaatcagagatggctgccagtgcacgtgttgagagagtggcagtgcggccatacctccgatcaagactcatatacagacagtaccgatggctggtcctcaatcaattgtggaacgctgccacctccaatgagtaaaatcccggccgaccggtaccgagtggaagggtccttcgcccagcctccgcttaatgctccaaagagagagtggagcagaaaggcttttggaatgcagtctatatttggcccacatagaaatgtgcgtaagacaaaggaggataagaaggggtccaaatttgggcgcggaactgggctgacccagcccagtcagcgcaccagcgccaggagatcatttggccgctcgaagcggttttctattacacgcagtctggacgacttggaatcagctacagtttctgacggggagctcactggcgccgatttaaaagactgtgtgtccaacaacagcctcagttccaatgcctccttgccctctgtgcagtcctgccgtcgcctcagagaaaggagggtcgcaagttgggctgttagctttgagcgcctgcttcaggaccctgttggcgtacgatacttctccgactttctgcgcaaagagttttcggaagaaaatattctgttctggcaagcatgcgagtacttcaatcatgtacctgcccatgataaaaaggagttatcttaccgggcgagagagatctttagtaagttcctgtgcagcaaggccaccaccccagtaaacatagactcccaagcgcagctagccgacgacgtcctcagggccccccaccccgacatgttcaaagaacagcagcttcagattttcaatctgatgaaatttgattcatatacacgatttctgaaatcgccactctaccaggagtgtatcctcgccgaagtggaggggcgcgcactgccagatagtcagcaggtgccctcatctcctgccagcaagcatagcctgggttccgaccacagctccgtgtctactccaaagaagctgagcggaaagtcaaagtcaggacgaagtctgaacgaggagctgggggacgaagactccgaaaagaaacggaaaggggcatttttttcctggagcagaacccggtctactggtcgcagccagaagaaacgggagcatggagaccacgccgatgatgcgctgcatgcgaacggaggactctgccgacgtgaatcccagggatcagtgtcatccgccggctcgctcgatctctctgaagcatgtcgaactctagcaccagaaaaggacaaggcgactaaacattgttgcatccaccttcctgacgggacctcctgtgttgtggctgtgaaagctggcttttccattaaagatattctgtccggtctatgcgagcgccacgggatcaatggcgctgccgcagacctgtttttagtggggggtgataagcctctggtactacatcaagattcttcgatcctggagtcacgtgaccttcgtctggaaaagcgaactctgtttcggctggatctggtgccaatcaacaggtccgtgggactcaaggcaaaacctaccaagcctgttaccgaggtcttgcggcctgtcgtagcccgctacgggctcgatttgtctgggctgctggtgcgcctgagtggagagaaagaacccctggatctaggggcccccattagcagcctggatggtcagagagtggtattagaagagaaggatccttcacggggcaaggcctccgcagataaacaaaaaggggtcccggtgaaacaaaatacagcagttaactcctcatctagaaatcacagcgcaactggcgaggagcgaactctcgggaagtcaaactccattaaaatcaagggcgagaatgggaaaaacgccagagatcctaggctatctaagagagaagagtccattgctaaaatcgggaaaaaaaagtatcagaagattaatctcgacgaagctgaagaattttttgagttgatttccaaagcccagagcaatcgagccgatgatcagagaggtctcctgcggaaggaagaccttgtgctgccggaattcctgaggcttccaccagggtccactgaactgaccctgcccacacccgcggcagtcgcaaaggggttctcaaagcggtcagctactggtaatgggagagagagcgctagtcagccaggcgaacagtgggaacccgtccaggaatctagcgactctccctctacctcccccggcagcgctagctctccaccgggtccgcccggaacgactccaccaggtcagaagtcccctagtggtcccttttgcacgccgcaatcccccgtgtcccttgcccaggaggggactgcccagatctggaaaaggcagtcgcaggaagtagaagctgggggaatccaaacggtggaagacgaacatgtggcagaattgactctcatgggagagggggatatcagcagccccaactccaccctgctgccccccccaagtacaccccaggaggtcccaggaccgtctagacccggcacgtctcgattttag

SEQ ID NO: 26109 - DNA, 1500 bp, Artificial Sequence
  Description of Artificial Sequence: Synthetic coding sequence
atgagcctgagcctgttcttccagagcgccaccgtgagcgacggcgagttaacgggggctgatttgaaggactgtgtgtccaataattcacttagttctaatgccagcctgccgtcagtgcagtcctgtaggcggttacgggaacgaagagtggccagttgggcagtgtcatttgaacgtctgctgcaggacccagtcggagttcgatacttttctgattttcttagaaaagagttttctgaagaaaatattctcttctggcaagcatgtgagtattttaatcacgtgccggctcatgataaaaaggaactgtcctacagggcccgtgagattttcagtaaatttctgtgttctaaagctacaactccagttaatattgatagccaggcacaactcgccgatgatgtattgcgtgcaccccaccccgacatgtttaaagaacaacagctgcagatcttcaacttgatgaaatttgattcttataccagatttctgaaatccccactttaccaggaatgcattctggctgaagtggaaggcagagcgttacctgactcgcagcaagtgccttcctctccagcgagcaagcattctttaggcagtgaccactcttctgtatctacccctaaaaaactctccggcaagagtaaaagcggacgctctctgaatgaggagttgggcgatgaagactcagagaagaagcgaaagggagcctttttttcatggtctaggacaagatccactggtaggtcccagaagaagagggagcatggagatcatgcggacgatgcactgcacgcaaacgggggcctgtgccgccgcgagagccagggcagcgtgagctccgccggcagcctggacctctccgaggcttgtcggactcttgccccagagaaagataaggccacaaagcactgctgtatccacctgcctgatggaactagctgcgtcgtagccgttaaagctgggttttccattaaagacatcttatcaggcctttgcgagcgccacggaattaatggagctgcagcggacctcttcctggtaggcggtgataagcctctcgttttgcaccaagatagttcaatcctggagtcccgcgatctgcgcctcgagaagaggacactgttcagactcgacctggtgccaattaatcgctccgtgggcctgaaggccaagccaacaaaacccgtgaccgaggtactcaggccagttgtggcccgatatggcttagatttgagtgggctgcttgtgaggctgtccggcgaaaaggagcccctagacctaggagcacccatctcgagcttggacggccagcgggtcgtgctggaagagaaggacccttcccgcggtaaggcatccgcagacaagcagaagggagtcccagtaaagcagaacactgccgttaatagcagcagccgaaatcactcagctaccagcttcttatctctgttccccaaactcagggctaccgagcagatgactaatgtcgggtgttag

SEQ ID NO: 26110 - DNA, 2004 bp, Artificial Sequence
  Description of Artificial Sequence: Synthetic coding sequence
atgttccgggccggcgaggccagcaagcggcccctgcccggccccagccctcctagggtgcggtccgtggaagtggccaggggaagagcaggatatggttttacactgtctgggcaggccccctgcgtgctctcttgcgtgatgcgcgggagccctgccgacttcgtcggcctgcgcgctggtgaccagattctcgccgtcaacgagatcaacgtcaaaaaagctagccatgaggacgtcgtcaagctaatcggtaagtgttcaggagtgctgcatatggtaatcgccgaaggggttggcaggtttgaatcctgttctagcgatgaggaaggcggcctatacgagggtaaaggatggctcaaacccaaattggattctaaggccctagggatcaaccgcgctgagcgtgtggtagaagaaatgcagagtggaggcatctttaacatgattttcgaaaacccttctctgtgtgcttccaattccgaacctctcaagcttaagcaacggagcttatctgaatcagcagcaactaggttcgatgtaggccatgagtcgattaataaccccaacccaaatatgctgagcaaggaggaaattagcaaagtgatccatgatgatagcgtttttagtataggactggagtcccacgacgactttgccctagatgcctctatcctgaacgtggccatgatagtggggtacctgggttctatcgagctcccgagcacgagctcaaatttggagagcgattccctacaggccattcggggctgcatgaggaggcttagagccgagcaaaaaattcactctttggtaaccatgaagattatgcacgactgtgtccagctatcaaccgacaaggctggcgtcgtggcagagtaccccgcagagaaactcgctttctcggcggtgtgccccgacgatcgccgtttttttgggctggtaactatgcaaaccaacgacgacgggtccctagctcaggaagaagaaggcgctctgcgtaccagttgccatgtcttcatggttgaccctgacctgtttaaccataagattcatcaaggcatcgcccggcgcttcgggttcgaatgcaccgcagatcccgacacgaatggctgcctagagtttccagcgtccagcctgccagtactgcagtttataagcgttctgtatagagatatgggagaattgattgagggaatgagagcgcgggcgttcctggacggagacgccgacgcgcaccagaacaacagcacaagctccaactccgactcaggaatagggaacttccaccaagaggagaaatccaatcgcgtgttggtcgtggacctgggtgggtcctcctcccgccacggtccgggagggagcgcgtgggacggtgtgggcggacgcggagcgcaaccgtggggcgccccctggactgggcctttttgtccggatcctgaaggatccccaccattcgaggccgctcaccagacagatcggttctgggacctcaacaagcatctgggccccgccagccccgtggaggtccccccagctagtttgcgatcgtcggtgccgccgtccaaacgtggaaccgtgggagccggctgcggctttaaccaaaggtggttgcctgtacacgttctgcgggagtggcagtgtggtcacaccagtgaccaggattcttatacagatagcacagatggctggtcctccatcaattgcgggacactgcctcctcccatgtctaagattcccgcagataggtatagagtggaaggttccttcgctcagccccctttgaacgccccaaagcgagagtggtcacgtaaagcatttgggatgcagtcaatcttcggcccacatcggaatgtgagaaagacgaaggaggataagaagggatcaaagttcggtcggggaacggggttgacacaaccctcccagcgtaccagcgcccgacgctccttcggaaggagcaaacgttttagtatcacccgcagcctcgacgacctggaatcgtag

SEQ ID NO: 26111 - DNA, 636 bp, Artificial Sequence
  Description of Artificial Sequence: Synthetic coding sequence
atgcagagcgccatgttcctggccgtgcagcacgactgccggcccatggataagagcgccggcagcgggcacaaatctgaggaaaaacgtgagaagatgaagcgtactctgctgaaagattggaaaacacggttaagttatttccttcagaattcaagtacacctgggaagccaaaaaccggcaaaaagagcaagcaacaggccttcattaagccatctcccgaggaggctcagctgtggagcgaggcattcgatgagttgctggctagcaaatacggcctggcagcgtttagagccttccttaagtctgagttctgtgaggaaaacatcgagttctggctggcttgcgaggactttaaaaaaaccaagtccccccagaaattaagtagcaaggccaggaagatttatactgatttcatcgaaaaagaggctcccaaggaaattaatatcgatttccagacgaaaacactgatcgcacaaaacatccaggaggcaacgagcgggtgtttcactaccgcacagaaacgcgtctattctctcatggagaacaattcctacccacggttcttggagtccgaattttatcaagacctctgtaagaagcctcaaatcaccacagaacctcatgccacatag

SEQ ID NO: 26112 - DNA, 4203 bp, Artificial Sequence
  Description of Artificial Sequence: Synthetic coding sequence
atgcccaagatcgtgctgaacggcgtgaccgtggacttccccttccaaccatacaagtgtcaacaggagtatatgactaaggtactagaatgcttacagcagaaggttaacggcatcctggagagtccaacaggtaccggcaaaacactttgtctcctttgcaccactcttgcctggcgggaacatctgcgagatgggattagtgcccgcaagatcgctgagcgggctcagggcgagttgttccccgatcgcgcacttagtagttggggaaacgccgcagcggcggccggggatcccattgcctgctacaccgacatacctaaaattatttacgcaagcaggacgcacagtcaactgacccaggtcatcaacgaactaagaaacacctcctaccggccaaaagtatgcgtactaggaagtcgtgagcagctatgtatccatcctgaggtgaagaagcaggagtccaatcacctgcagatccatctctgtcgaaaaaaagttgctagccgaagctgtcacttttataacaacgtagaggagaagtctcttgaacaggagctcgccagccctattctggacatcgaagaccttgtcaagtccggctcgaaacaccgcgtctgcccatattatctgagccgcaacttaaagcagcaagcggatattatcttcatgccttacaactaccttcttgatgcaaaaagtaggagggcccacaacattgacttgaagggcacggtggtcatcttcgatgaggcccataacgttgagaaaatgtgcgaggaatccgcgtcatttgatctgactccccacgacttagccagcgggctagatgtcatcgatcaagtcttggaggaacagacaaaggccgcgcaacagggggagcctcaccccgaattctctgcggacagtccctcgccagggctcaatatggagctggaggatattgcaaagctaaagatgattctgttaaggcttgagggagcaatcgacgccgtggagctccccggggacgattcgggcgttaccaagcctgggagttacatctttgaattgttcgccgaggcgcaaatcacttttcagacgaaaggatgcatcctggatagcctggaccagataattcaacatctggcaggcagagccggcgtattcaccaataccgctgggcttcagaagctggccgacataattcagatcgtattcagtgtcgacccttccgagggatcgcccgggagtcccgcaggccttggggccctgcagagctataaagtgcatattcaccccgatgcgggccaccggcgcacagcccagagaagcgacgcctggagcaccaccgcggccaggaaacggggaaaagtcctaagctactggtgtttttctcctggacacagcatgcacgagcttgttagacagggggtcagatcactcattcttactagtggaacgctcgctcctgtctcttcatttgcattggagatgcagatcccttttccggtttgcctggaaaacccccatataatcgacaagcaccagatttgggttggcgtagtgccccggggccccgatggcgcacagctgagttccgccttcgatcgacgattctctgaggagtgcctgagctccttgggtaaagctctgggtaatatcgcaagggttgtgccctacgggttattaattttttttcctagctatcctgttatggagaagtcattggagttctggcgcgcacgcgatctggccaggaagatggaagccttgaagcccctcttcgtcgagccccgcagcaagggctcctttagcgagacaatcagcgcatattacgccagagtggctgcccccggctctactggtgccaccttcctggccgtgtgtcgaggcaaggcatccgaaggattggacttcagcgataccaatggtaggggcgtgatcgtaactgggctgccataccccccgaggatggatcctcgagtcgtgctgaagatgcagttcctggacgaaatgaaaggacagggcggcgcaggcggacagtttctgagcggccaagaatggtataggcaacaggcatctcgggcagtaaaccaggcaatagggcgcgtcatcagacatcggcaagactatggggcagtgtttttgtgcgatcataggtttgcattcgccgatgctcgtgcccagctccccagttgggtaagaccccacgttcgggtgtatgataatttcggacatgtcatcagagacgtggcccagttttttagagtagcagaaaggaccatgcccgctcccgccccacgcgctaccgccccaagtgttcgtggagaggacgctgtgtctgaggccaaatccccaggacccttcttttccactaggaaggccaagagtttggatctgcatgtgccctccttgaagcagcgtagcagtggatcccccgccgccggcgacccagagtccagcttatgcgttgagtatgagcaagagccagtcccagctcgacagaggcctcgcgggcttttggcagcgctggaacactccgagcagcgggctgggtctcccggggaagagcaggctcattcttgcagcaccttaagtctgctgagcgaaaaaaggccagctgaagaacccaggggaggtcggaaaaagattcgtctcgtatcccatcctgaggaaccagtcgccggtgcccagacagaccgggctaaactgttcatggtcgccgttaaacaggaactgtcccaagccaacttcgccaccttcacccaggctctccaggattataagggctcagacgactttgccgccctggctgcttgtttgggtcctctcttcgctgaggatccgaaaaaacataatctcctgcagggtttctaccagttcgtcaggccgcatcataagcaacagtttgaagaggtgtgcatccagctgactggaagggggtgcgggtacaggccagagcattcaatcccacgaaggcagcgggctcagccagtgctagatcccaccgggcgtacggcgccggaccccaaattgactgtctctaccgccgcggcgcagcagcttgatccccaggagcatttaaaccagggtcgcccccacttatcacctcgcccgccccctaccggagacccgggcagccagccccagtgggggtcaggagtccctagagctggtaagcaggggcagcacgccgttagtgcctacttggcagatgctcgacgggcgttaggatccgccggctgttcacaattattggccgctcttaccgcctacaaacaggacgatgatctggataaggtcctggctgtactggccgcgctgaccacagctaagcctgaggacttcccactgttgcacagattttctatgtttgttcggccccaccataagcaacgcttttcccagacgtgcacggatctcacaggtcgcccttatcccggcatggaacctcccgggccacaggaagagcgcctcgctgttccacctgtgctcacccatcgagccccccaacccggtcccagtaggtcagaaaaaactgggaagacacaatcgaaaatttcgagcttcttacgccagaggcccgctgggaccgtgggcgccgggggggaggatgctgggccctcacaatcctctggtccaccgcacggccccgcagcatcagagtggggggaaccccacggcagagacatcgccggacagcaagcgacgggagctccaggaggaccactgtctgccggatgtgtatgccaggggtgcggagccgaggacgttgtgcccttccagtgtcctgcttgtgattttcagcgatgtcaggcctgctggcagcggcatctccaggcctctagaatgtgtcctgcatgtcacaccgcgagcaggaaacagagtgtgatgcaagtgttctggccggagccccacaaggatcatgagggagctgggggagcccgccccgttgccgctgtccccggcgtaggggcggcttgcccagccgccggcgctgggtgcactcgatccgggagaaacactcatctaccgctagccggacgaagggataggggagccgctggggtgaggccagtcccccccaggcacttgtgcgccgcagccgtgccccctcggcagccccacgatgtttggcccgtgagcactgctccactccacgctgtgttggaattaccaagggccctgccactgttacaaagaccattacgaggggcgtag

SEQ ID NO: 26113 - DNA, 1638 bp, Artificial Sequence
  Description of Artificial Sequence: Synthetic coding sequence
atgcccgcccccgccccccgggccaccgcccccagcgtgcggggcgaagacgccgtgagcgaggctaaatccccgggaccattcttttctacccgtaaggcaaaaagcctggacttacacgttccaagcttgaagcagcgcagctccggcagtcccgctgctggtgacccagaatctagcctatgcgttgaatacgagcaggagcctgttcctgcccgccaacgtcctcgtgggctcctggctgcacttgaacacagcgaacagagagctggcagccccggcgaggagcaggcccattcctgttcaacccttagtttgctgagtgagaagcggcccgctgaggagccccgcggaggtcggaaaaagattagactcgtgtctcatcccgaagagcctgtggcgggtgcccagacagatagagctaaacttttcatggtggcagtcaaacaggaactgtcccaggccaattttgctaccttcacacaggccctgcaggattataagggctccgatgatttcgctgcactcgctgcctgccttgggccccttttcgccgaagaccccaagaagcacaaccttctacaagggttttaccaattcgtacggcctcaccacaagcagcaattcgaagaggtgtgtatccagcttaccggcaggggttgcggatataggccagagcactctatccctaggaggcagagagcacaaccagtcctggacccgactggcagaacagcacccgacccaaaattaacagtgtccacagcagcggcacagcaactagatccacaagagcaccttaaccaagggcgccctcacctgtcccctcggcctcctcccaccggtgatccaggatcacagccgcagtgggggtccggcgtgccacgcgcagggaaacagggtcaacacgcggtaagcgcttacctggctgacgcccgaagggccctggggtctgctgggtgttctcagctgctcgctgctctcaccgcctacaagcaggacgatgatctggataaggtgttggctgtcttagctgctctgacaacggctaaacctgaggacttcccactgctgcacagattctctatgttcgtccgccctcaccacaaacagaggttctctcagacttgcactgacttaaccgggagaccatatccaggtatggaaccccctggcccccaggaagaacggcttgcagtgcctccggtgttaacacaccgcgcaccccagcccggaccttccagatctgagaagaccggtaagactcaaagtaagataagtagcttcctgcgccagagaccagcaggaacagtgggtgcaggcggcgaggatgctggacccagtcagtcgtctggaccaccccacgggccagccgcctcagaatggggtgaacctcatggaagggacatcgcaggccagcaggccactggtgcacccggagggccactgtcggcgggctgcgtgtgccagggctgcggcgccgaagacgttgttcccttccagtgtcccgcctgcgatttccagcgttgccaggcctgttggcagcgccatctgcaggcctctagaatgtgtccagcttgtcataccgcttcacggaagcagagcgtgatgcaggttttttggccggagccccagtag

SEQ ID NO: 26114 - DNA, 3660 bp, Artificial Sequence
  Description of Artificial Sequence: Synthetic coding sequence
atgcccaagatcgtgctgaacggcgtgaccgtggacttccccttccaaccatataagtgtcagcaggaatatatgacaaaggtattggagtgtctacaacagaaagtgaatggcattttagaaagtccaaccggtaccggcaaaacactctgtcttttgtgtacgaccctggcatggagagagcacttaagagatgggatctcagctaggaaaatcgccgagagagcacagggagagctcttcccagaccgagccctgtccagctggggtaacgctgcagcggctgcaggtgatcccatcgcatgttatacagatataccaaagattatttatgcgtctcggacgcattctcaacttacgcaggttatcaacgaactgagaaatacctcatatagacctaaggtatgcgtgctgggatcccgtgaacagctgtgcattcacccggaagtcaagaaacaggagtccaatcatctgcaaattcatttatgtcgcaaaaaagttgcctcaaggagctgtcatttctacaacaatgtggaggaaaaaagtctagagcaggaactggcttcaccgattctcgatattgaggatcttgttaagtcaggctctaagcaccgagtctgcccatattatctgagtcggaacctgaaacaacaggctgacataatttttatgccttataattatttgctggacgccaagtcacgacgggctcacaatatcgatctaaaaggaaccgtcgtgatttttgacgaggcccataacgtggaaaagatgtgcgaggagtctgcctctttcgatttgacaccacatgatctcgcctctggactagatgtgattgatcaggtgttggaagagcagactaaggctgcccagcaaggggagccacacccggaatttagtgcagactccccctctccaggccttaacatggagctggaggacatcgccaagctgaaaatgattctgctgcggctcgaaggggctattgacgccgtcgagctgcccggcgacgatagcggtgtgaccaagcctggatcgtacatctttgagctgtttgctgaggctcagattaccttccagacaaaggggtgcatcctggactcattggaccagattatccagcacctggccggtcgtgctggggtcttcacgaacactgccggcctgcaaaagcttgccgacattattcagatcgtgttctctgtggaccccagtgagggatccccaggatcccccgcaggactgggcgccctccagtcctataaggtgcacatccaccccgatgcgggccacagaagaaccgctcagaggtccgatgcctggtctactaccgctgctagaaaacggggcaaggtcttgagttactggtgtttctctccaggacattctatgcacgagctggttagacagggagtacgttctctcatccttacctccggcaccctcgcccctgtctcttccttcgcgctggagatgcagattccatttcccgtctgtctggaaaacccacacatcatagacaagcaccagatctgggtgggagtggtacctcgcggccctgacggggcccagctgtcaagcgctttcgaccgcaggtttagcgaggaatgtctgtcctcgctcgggaaagcccttgggaacattgcaagagtggttccctacgggctgctgattttttttccgagctacccagtaatggaaaagtccctcgagttctggcgtgccagggacctggcacggaagatggaagccttaaaacctcttttcgtcgaaccacgctccaagggaagcttctcagaaactatttcggcctattacgcaagggtggcagcccctggctcaaccggagctacttttcttgcagtttgtcgcggcaaggcctccgaagggctggacttctccgatactaatggaagaggtgtgattgtcactgggctgccctaccccccgagaatggaccccagagtagtgttgaagatgcagttcctggacgaaatgaaaggtcaagggggggcgggcggacagttcctcagcggccaggagtggtatagacagcaggctagccgtgctgtaaatcaggctataggtagagtcatcagacaccggcaggactatggtgcagtgtttctctgcgaccaccggttcgcattcgcagacgctagggctcagctgcctagctgggtgagacctcatgtgagagtgtacgacaattttggtcacgttatcagagatgtcgcccaattttttcgcgtggctgagcgaacaatgccagccccagcgcctagagcaactgcaccctctgtccggggggaggatgccgtgagtgaagccaagtctccaggcccattcttcagcacccgcaaggcaaagtcactcgatctgcacgtcccctcactaaaacagcgcagtagcggatcccccgcagccggagaccccgaaagttctctgtgcgtagagtatgaacaagaacccgtgccagccaggcagcgcccccggggactgcttgccgcactcgagcacagcgagcagagggctggcagccccggggaggaacaggcacacagttgctccaccctctctctgctgagcgaaaaaaggcccgcagaggaaccccgtgggggtagaaagaaaatcaggctggtgtctcatcccgaagagcctgtcgccggagcacagactgatcgggcgaagctctttatggtggcagtgaaacaggaactgagtcaggctaatttcgccaccttcacccaggccctacaggattacaagggctccgacgatttcgccgcactggcagcatgtctggggcctctcttcgcagaggatccgaagaagcataatctgctgcagggattctatcagttcgtccgacctcaccacaaacaacagtttgaagaggtatgtatccagctaaccggcaggggctgcggatatagaccagagcattccattccaaggcggcaacgcgctcagcccgtgcttgaccctacgggacggaccgctcccgatcctaagctgaccgtcagcactgccgcggcccaacagctggacccccaggagcacctcaaccagggtaggccacatttgtcgccccgtccccctcccaccggagacccaggatcccagccgcagtggggaagcggagttcccagagctggtaagcagggtcaacacgcagtgtccgcttatttagcggacgctcgtcgagctttgggctctgcaggctgctcacagctgttagctgctctgaccgcttacaagcaggatgatgacttggataaagtgctggcagtcctagccgccctgaccaccgctaaacccgaagacttccctctgttgcataggttttccatgttcgtcaggccccaccataagcagagattctctcagacatgtaccgacctcaccgggcggccatacccagggatggaaccccctggaccccaggaagagagactggccgtcccaccagttctgactcatcgagccccacagcccggccccagcagaagtgaaaagacaggcaagacccaaagtaaaatctcttccttcctgcgccagcggccagccgggactgtcggcgccggaggcgaagacgccggaccatctcaatcttcaggccccccgcacggccccgccgcaagcgaatggggcctgtag

SEQ ID NO: 26115 - DNA, 3732 bp, Artificial Sequence
  Description of Artificial Sequence: Synthetic coding sequence
atgcccaagatcgtgctgaacggcgtgaccgtggacttccccttccagccctacaagtgtcagcaagagtatatgaccaaagttctggagtgcttgcagcagaaggtgaacggaatactcgagtcaccgaccggtacaggaaaaacactgtgcctgctgtgtactactctagcctggcgcgaacacctgcgggatggcattagcgctcggaagattgctgagcgagcacagggtgagcttttcccagacagggctctgtcctcctgggggaatgctgctgccgcggccggtgatcccatcgcatgctacacagacatccccaaaatcatctatgcgtcgagaactcactcccaactcacccaggttattaatgaattgcgaaacacctcataccggagcagatgcagagcaaccctatgggtccttgagactgcccctcctagacccacagtactgtcacccacccgtccaaaggtgtgcgtcctggggagtagagagcaactgtgtatccaccccgaggtaaagaagcaagaatccaatcacctgcagatccatttatgccggaagaaggtcgccagccggtcctgtcacttctacaataacgtggaagaaaagtctctcgagcaggaacttgcatcccctattctggatattgaggacctggtgaagagtgggtctaagcatagagtgtgtccatactacctgagtcggaacttaaaacagcaggccgacatcattttcatgccttataactacttgctagatgctaaatctaggagagcccataacattgacttgaaaggcacagtggtgatcttcgatgaggctcataacgtggagaaaatgtgcgaagaatccgcctcttttgatttgacacctcatgacttggcaagtgggctggacgtaattgatcaggtactggaggaacagacaaaggcggcccaacagggagagccacaccctgaattcagcgccgactctccatctcccggactcaatatggagttagaagacatcgccaaacttaagatgatcttgctccggcttgagggagcaattgatgccgtggaactacccggggacgactctggggtcaccaagcccggcagttacatttttgagctgtttgcagaggctcagatcacctttcagacaaagggctgcatcctggatagtctggatcagataatccagcacttagccgggagagctggggtgttcactaatactgctggcctgcagaagctggcagacattattcagatagtattctcagtcgatccctctgaaggcagcccaggctctcccgccgggctcggagctcttcaatcctacaaggtgcacatccaccccgacgccgggcaccgacggactgcgcagagatctgatgcatggtctactactgccgctcgtaagcgcggaaaagtcctctcttactggtgctttagccctggccactcgatgcatgagcttgtcaggcaaggagttcgttctttgatactgacaagcgggactctggcccctgtgtcctccttcgctctagagatgcagatccccttccctgtttgcctggaaaatcctcatataatcgataagcatcaaatctgggttggcgtggtccctagggggcccgatggtgctcagctttctagtgcgtttgaccgtcggttttccgaagagtgtctctcttctttggggaaagctctgggtaatatcgctcgggtggtcccgtatggtctgcttatatttttccccagctaccccgtgatggagaaaagcctggagttctggcgggccagagatctggcaagaaagatggaggcgttgaagcccctatttgttgaaccccgtagcaagggaagcttctctgagaccataagtgcctattatgctcgcgtggctgcccctggaagtaccggggctacctttttggcagtgtgccggggcaaggccagcgagggccttgatttcagtgacactaatggtcgaggggtgattgtcaccggattgccctacccccctcgcatggatccaagagtagtcttgaaaatgcaattcttggatgaaatgaaagggcagggcggtgcaggaggtcagtttctctctggtcaggaatggtaccgtcagcaggcatcgagggccgtcaaccaggcaatcggcagggttatcaggcatcgccaggactatggcgctgtcttcctgtgtgaccacagattcgccttcgccgatgctagagcacagctgcctagttgggtgcggccccacgttcgggtgtatgataacttcggacatgtaattcgagacgtggcgcaattctttcgggtcgccgaaagaacaatgcctgcaccagcgccaagggcaacagcacctagcgtgcgtggagaagatgctgtttccgaagctaaatctccaggaccttttttctcaacaaggaaagcgaaaagcttggacctgcacgtgccatcactgaaacaacggtccagcggctctccggccgcaggggaccccgagtcctcactctgcgtggagtacgaacaagaacccgtacctgcccggcagaggccccggggcctgctggccgcactggagcactccgaacaacgcgcagggtcaccgggcgaagagcaggctcatagctgtagtacactgagcctgttatccgagaagcgacccgcagaggagccacgtggcggaagaaaaaagataaggcttgtttcacacccggaggagcctgtggctggcgctcaaaccgacagggcgaagctgtttatggtggccgtgaaacaggagctgagccaagccaactttgctactttcacccaggccctgcaggactataaggggtcagatgatttcgctgccttagccgcatgcttggggccgctgttcgcggaggatccaaaaaagcacaatctcttgcaggggttctaccagtttgtcagacctcaccataagcagcaatttgaggaagtttgcattcagcttacaggacgaggctgcgggtaccgacccgagcactcaattcctagacgccagagagcgcagcccgtgctagacccaacgggccgaacagccccagatcctaagcttaccgtaagtacggctgctgcccagcagctagatccccaggagcacctcaatcagggtcgaccacacctgtctccaagaccccccccgaccggggatcccggatcacaaccccagtgggggtccggcgtcccacgggctggcaagcagggccagcatgccgtgtccgcgtatcttgctgacgctcgaagggctttgggctccgcgggctgtagccagctgctcgctgctctgacagcctacaagcaggacgacgacctcgacaaagtgttagcggttctggcggccctcactactgccaaacccgaagacttccctctgttgcacagcaactccatgttcgtgcggccgcatcacaaacagagattcagtcaaacatgtactgatctcactggtcgaccctatccaggaatggagcctcccggacctcaagaagaacgcctcgctgtgccaccagtgcttacccacagggccccccaacccggccccagccgcagcgagaagacaggtaaaacacagtctaagatttcatctttcctgaggcagaggcccgcgggcaccgtgggtgccggtggcgaggatgcgggaccttctcagtcttcagggccacctcatgggcccgcagccagtgagtggggcctgtag

SEQ ID NO: 26116 - DNA, 3444 bp, Artificial Sequence
  Description of Artificial Sequence: Synthetic coding sequence
atggacatccggaagttcttcggcgtgatccccagcggcaagaagctggtttccgagacggttaaaaagaatgagaaaacaaagtctgacgaggaaaccctgaaggctaagaaggggatcaaggagattaaagtcaattcgagcagaaaggaagatgattttaaacaaaaacagcccagtaagaagaagaggatcatctatgatagcgacagtgagtcagaagaaaccttgcaggttaagaacgctaagaagccccccgagaagctgcctgtgtcttctaaacccggaaagatctcgagacaagacccagtcacctatattagcgaaaccgatgaagaggatgacttcatgtgtaagaaggctgcctcgaaaagtaaagaaaatgggcggagtacgaatagccacctgggaacttcgaatatgaagaagaatgaggagaatacaaaaacaaagaacaagcctctgtctccaattaagcttactccaacaagtgtcctggactatttcggcaccgggtcggttcagagatccaacaagaagatggtcgcgtcaaaacggaaagaactctcacagaataccgatgagtccggtctcaacgacgaggccatcgccaaacagctgcagctggacgaagacgccgagctagagagacaacttcatgaagatgaggagttcgccaggacactagctatgctggatgaagagcctaagacaaaaaaggccaggaaggatacggaagctggtgaaacttttagctccgtccaggctaatctcagtaaggccgagaagcacaaataccctcacaaagttaaaacagcccaggtgtccgatgaaaggaaaagttatagcccacgcaagcagtcaaaatatgagtctagcaaggagagtcaacaacacagcaagtctagcgcagataagattggcgaggtgtcttctccgaaggcctccagcaaacttgccattatgaagagaaaagaggaatctagttataaggagatcgagcccgtggcatcgaagcgtaaggagaacgcaattaagttgaagggggaaaccaagactcccaagaaaacaaagtcatcgcctgcaaagaaggaatctgtttcccccgaggacagtgaaaagaagaggacaaattatcaggcctatagaagctacctcaatcgggaaggacctaaggccctgggatcgaaagaaattcccaagggggccgagaactgtctggagggtttgattttcgtgattactggtgtccttgaatctattgagagggatgaagccaagtctctgatcgagcgctacggcggaaaagtgactgggaatgtctcaaaaaagacaaattatctggtgatgggccgcgatagcgggcagagcaaaagcgacaaagcagctgccctggggacgaagatcattgatgaagatggcctgttgaacctcatcaggacaatgcctggaaagaaaagcaaatatgaaattgctgtggagacagagatgaagaaggaatccaagctggagcgcaccccccaaaagaacgtgcagggcaagcggaagatctccccaagcaagaaggagagcgagtccaagaagtctcgccctacatcaaagcgagactctcttgcgaaaaccatcaagaaagaaactgacgtattttggaagagtctggacttcaaggaacaggtcgccgaagagacatctggagatagcaaagcccggaatctggccgatgattctagcgaaaataaggtcgagaacctgctgtgggttgataagtataaacctacatctcttaagactatcattgggcagcagggagaccagtcttgcgccaacaagcttttgagatggctgagaaattggcagaagtctagtagcgaagacaagaaacatgctaaattcgggaagttctcagggaaggatgacggttcatcttttaaagcagcactcctgtcgggtccgcccggcgtcggaaagacgaccaccgcctctctggtgtgccaggagctgggatacagctacgtagagctgaacgcatccgacacacggagcaagagctcactcaaagccatcgtggctgaatcactcaataatacatcaatcaagggcttttattcaaacggcgccgccagttcagtgtccaccaaacatgccctaatcatggatgaggtggacgggatggctggtaatgaggatcggggtggcattcaggagcttattggcctcattaagcacacaaagatccctataatctgcatgtgcaatgaccggaatcatcctaaaatacgctctctcgtccactattgtttcgatctgagatttcagcgccctcgggtggagcagataaagggtgccatgatgtccatagccttcaaagaaggcctcaagattcccccacccgcgatgaacgagattattctaggcgccaatcaggacattcggcaggtccttcacaacttgtccatgtggtgtgcaagaagtaaagcactgacctatgatcaggctaaggcagattcacatcgggcaaaaaaggacatcaagatgggcccattcgacgttgcccgcaaagtgttcgccgctggcgaagaaactgctcacatgagcctagtggataagagtgatctgttctttcacgattactctatcgctccactgttcgtccaggagaactacatacatgtaaagcccgtcgcagccggcggagatatgaaaaaacacctgatgctcctaagccgggcggccgacagcatttgcgatggggatttggtagacagtcaaatccggtcgaaacaaaattggtctttattgccagctcaggccatctacgcctctgtattacccggagagctcatgcggggttacatgacccagttccccaccttcccttcttggctggggaaacattcctccactggaaaacacgacaggatcgttcaagatctggctctgcatatgagcttgaggacttattcttctaaaagaacggtaaatatggactacttatctctattacgcgacgcgctcgtacaacccttaactagtcaaggtgtggacggcgtgcaggatgtagtggctctgatggacacttattacttgatgaaggaggatttcgagaacattatggagataagctcgtggggggggaagccatcccccttttcaaaactggatccgaaagtgaaggctgctttcactagagcgtacaataaggaggctcacttaacaccctactcgctgcaggccatcaaggcatctcggcactctaccagcccatctcttgatagtgagtacaatgaggaactgaacgaagacgactctcagagtgacgagaaagaccaggacgctatcgaaacagatgcaatgattaaaaagaagactaagagctcaaagccctccaaacctgagaaagataaggaacccagaaagggcaagggcaagagtagcaaaaaatag

SEQ ID NO: 26117 - DNA, 3447 bp, Artificial Sequence
  Description of Artificial Sequence: Synthetic coding sequence
atggacatccggaagttcttcggcgtgatccccagcggcaagaagctggtttcagagactgtgaagaaaaatgagaagactaaatcagacgaagaaactctgaaagcgaaaaaaggtattaaagaaattaaagtgaactcctccagaaaggaggacgattttaaacaaaagcaaccctccaagaaaaagaggattatctacgatagcgattctgagagtgaggaaactctccaggtgaagaatgcaaagaagcctcccgaaaagctgccagtgtcatccaaacctggaaaaattagtaggcaggatcctgtcacttacatctccgagaccgacgaggaggacgattttatgtgcaaaaaagccgccagcaaaagtaaggagaacggccggtcaactaactcgcatctcggaacgtcaaatatgaaaaaaaacgaagagaacacaaaaactaaaaataagcccctatcaccgatcaaactcacgccaaccagcgtgcttgattacttcggcacaggaagcgtgcaacgctctaataaaaaaatggtggcaagcaagcggaaggaactctctcagaataccgacgagagcgggcttaacgacgaagccattgcaaaacagttgcagctggatgaagatgcagaactcgaacgacagctgcacgaggacgaagagtttgccagaacacttgccatgctggatgaggagcccaaaaccaagaaagctaggaaagacaccgaggccggagaaactttcagctctgtgcaggccaacttatcgaaggccgagaaacacaaatatccccacaaagtcaagacggctcaggtgtcagatgagcgcaagtcttactccccccggaagcagagcaagtacgaatcatccaaagaaagtcagcagcacagcaaaagtagcgccgataagatcggtgaagtatctagtcctaaggcttcctccaagttagctatcatgaaacgaaaagaagagtcctcctacaaggagatcgagccagttgcttccaagcggaaagagaacgcaattaaactcaaaggagaaactaaaacacctaagaaaaccaaaagctctcccgcaaagaaggaaagcgtgtccccagaggacagtgagaagaaaaggacgaactaccaggcttatcgctcctatctgaatcgagaggggccgaaagccctgggctccaaggaaatacctaagggagccgaaaactgtttagagggtcttatttttgtgattacaggcgtgctcgagagtatcgaaagggatgaggcaaagagtcttatcgagcggtatggagggaaggtcaccggcaatgtaagtaaaaaaacaaattatctagtcatgggaagggactctgggcagtcaaagtccgacaaagctgccgcactggggaccaagattatcgacgaagatggcctcctcaatttgattaggaccatgcccgggaagaagagcaagtacgaaatcgctgtagaaacagaaatgaaaaaagagtcaaagctggaacgcaccccccagaaaaacgtccaagggaagcgcaaaattagcccatctaaaaaagaatccgagtcaaagaaatcccgcccaacgtcaaaacgcgatagtttggctaagactatcaaaaaggagacagacgtgttctggaagtcattggacttcaaagagcaggtggctgaggaaacctcaggggatagtaaggcacggaacctcgcagatgatagctctgagaataaggtcgaaaatctactctgggtcgacaaatataagccaacaagtctgaaaaccattatcggacagcagggtgatcaaagttgtgctaataagttactgagatggttacggaactggcagaagtcatcttccgaggataagaaacacgctgccaaattcggtaagttctctgggaaggatgatggctcttccttcaaggctgcccttctgagcgggcctcctggagtcggaaaaaccacgacggccagtctcgtctgtcaagaacttggctacagttacgtggaattaaatgcttcagatacgcgctctaagtccagcctcaaagccatagtcgcagagagcctcaataatacctcgataaaggggttttatagcaacggcgctgcaagttctgttagtacaaagcacgccctcattatggacgaggtggacgggatggccggcaatgaggacagagggggcatccaggagctgatcggccttatcaaacacacgaaaatccccataatctgcatgtgtaatgataggaaccaccctaaaatccggtccctcgtccattactgttttgacttacgctttcagaggccaagggttgagcagattaaaggcgccatgatgtcaattgccttcaaggaaggactgaagattccaccacctgccatgaacgagatcattttgggggccaatcaggacatcaggcaggtccttcataatttgtcaatgtggtgtgctagaagcaaggcactgacctacgaccaagctaaagccgacagccatcgcgcaaaaaaggacatcaagatgggtcccttcgatgtggcaaggaaagtcttcgctgcaggggaagaaaccgcacatatgagcctcgttgacaagtcggacctattttttcacgattattctattgcccctctgtttgtgcaggagaactatattcacgttaaacctgtggccgcggggggggatatgaaaaagcacctgatgttactttcccgcgcagcagacagcatctgtgatggtgacctggtcgattctcagattagatctaagcagaattggagccttctacctgcccaagccatctatgcctcagtgttgccaggcgaactcatgcggggatatatgactcagttcccaactttccccagctggcttgggaaacactcaagcaccggcaagcacgatcgcattgttcaggacctcgctctgcatatgagcctccggacatattcgtctaagagaacagttaatatggactatctctctttgctcagggacgcgctggtgcagccattgacaagccagggcgtcgacggagtccaagatgtggtggctctaatggacacgtattacctgatgaaggaggattttgaaaatattatggaaattagcagttggggtggcaaaccttccccattttctaagctagacccaaaggtaaaggccgctttcacccgggcctacaacaaagaggcccacttaacaccctactctctccaggcaataaaggcctctcggcatagtacatcaccctcgctcgactctgagtataatgaggaactgaatgaggacgacagtcagagcgatgagaaggatcaggatgctatcgaaacagatgctatgatcaaaaagaagactaagtcatcgaaaccgagcaagcccgagaaggataaggaaccgcgaaaaggaaaaggcaaatcgagcaagaaatag

SEQ ID NO: 26118 - DNA, 564 bp, Artificial Sequence
  Description of Artificial Sequence: Synthetic coding sequence
cccgaggacagcgagaagaagcggaccaactaccaggcctaccggtcttatctgaaccgtgaggggcccaaggccctgggcagcaaggaaattcccaagggggccgaaaactgcctggaaggcttaatttttgtgatcactggcgtactggagtctatcgaaagagatgaagcaaagagtttgatcgagcggtacggggggaaagtgacaggaaacgtttccaagaagacaaactatttagttatgggccgggattctggacagtccaagagcgataaagctgctgcgctgggaacaaaaatcatcgacgaagatggtctgctcaatctcattaggacgatgcccgggaaaaagtctaaatacgagatagctgtcgagacagaggagctcggttactcttatgtcgagttgaacgccagtgacacacggtctaagtcaagtctcaaggctatagtggctgagtccctgaataacacaagtatcaagggattctactcaaacggggctgcctcttccgtgtccactaagcacgcattgattatggatgaagtggatggaatgtag

SEQ ID NO: 26119 - DNA, 1851 bp, Artificial Sequence
  Description of Artificial Sequence: Synthetic coding sequence
atggtgggccagctgagcgagggcgccatcgccgccatcatgcagaagggggacacaaacattaagcccatcctccaggtgatcaacattaggcccatcacgactggcaatagtcctccccgctatcggttgctgatgagcgatggcttgaatacattgagctctttcatgctcgcgacacagctgaaccctcttgttgaagaagaacagctgagctccaattgtgtttgtcagatacatagatttatcgttaatactctgaaagatggcaggcgggttgtcatactgatggaactggaagtgttaaaatcagccgaagcggtgggagtgaaaataggtaatcctgtcccttataatgaaggtctcggccagccccaggttgcccctcccgcacccgcagcctcgcccgccgcatcatccaggccccagccacaaaacggtagttctggcatgggctccactgtgagcaaagcctacggtgccagcaagacattcggcaaggcagccggtcctagcctgagccacacctccggcggaacccaatccaaagttgtgccgatagcttccctgaccccctaccaatcgaagtggaccatctgcgctagggtgacaaataagtcacagatcagaacatggagtaactctcgtggcgagggaaagctgttttcactagagctggttgatgagtcaggagagatccgagcaaccgccttcaacgaacaggtggataagttttttcctctcattgaggttaataaagtatactacttttctaagggcacactcaaaatagccaacaagcagttcacagcagtgaagaacgactacgaaatgaccttcaacaatgaaacctccgtgatgccatgtgaagatgatcaccacttgcccacagtgcagtttgatttcaccggcattgacgatctcgagaacaagagcaaggactccctcgttgatataattggcatatgcaagagctacgaggacgccactaagattacagtccgcagcaacaaccgagaggtggcgaagagaaacatatatctaatggacacctccggaaaagtggtgactgctaccctctggggcgaggacgccgataagtttgacggcagcagacaacccgtgcttgcgattaagggagcgcgtgtgtccgatttcggtggacggagcctctctgtcttgtccagttccacaatcattgctaatcctgacattcccgaagcatacaagctgcgaggctggttcgatgccgaaggacaagctctcgacggtgtctcaattagcgatttgaagtctggaggggtagggggaagcaacacgaattggaaaaccttatacgaggtgaagtctgaaaacctagggcagggagacaagccagactacttttcgtccgtcgctacagtagtatatctgagaaaggaaaattgtatgtaccaggcatgccccacacaggattgcaataaaaaggtgattgaccaacagaatggcctgtaccgctgtgagaagtgcgataccgaattccccaatttcaagtatcgcatgatcctctcggtgaacatagctgattttcaggaaaatcagtgggtcacatgtttccaggagtcagctgaagccatcctaggccaaaacgctgcctatctgggtgagctgaaagataaaaacgagcaggcctttgaagaagtattccagaacgcaaattttaggagcttcattttccgcgttagggtcaaggtagagacatacaacgacgagtcacggatcaaagctacagtgatggatgtaaaacccgtggactatcgcgaatacggcagacgactcgtgatgagcataagacgatctgcacttatgtag

SEQ ID NO: 26120 - DNA, 2217 bp, Artificial Sequence
  Description of Artificial Sequence: Synthetic coding sequence
atgaccagcagcggccccggcccccggttcctgctgctgctgcccctgctgctgcctcccgcagcttcggcctcggacagaccaaggggcagggatccagtgaatcccgaaaagttgctcgtgatcaccgtggccacggcggagaccgaaggataccttaggtttttacgctcagccgaattcttcaattacacggttcggacccttgggctgggggaggagtggcggggtggggacgtcgctaggactgtaggggggggccagaaggttaggtggcttaaaaaggaaatggaaaagtacgcagatagggaagatatgatcatcatgtttgtggatagctacgacgtgatacttgccggcagtcccacagaactcttaaagaagtttgttcagtccggatccagactgctgttctctgcagaatcattctgctggcctgagtggggcttggcagaacagtaccccgaggtgggcacaggcaagcgttttctgaactccggcggcttcattgggtttgccacaaccattcaccagatcgtgaggcagtggaagtataaggatgatgatgatgatcaactgttttatacccgtttatacctagatccaggcctgagggagaagctgtcactgaacctggatcacaagagccgaatctttcagaacctaaatggagctctcgacgaggtggtcctcaaatttgacagaaatcgagtgcgaatcagaaatgtggcatatgacacattaccgatcgtggtccacggcaacggcccaacgaagctgcaattgaactatctcggaaattacgtgcccaacggctggacaccggaaggggggtgtggtttctgtaatcaagataggagaaccctgcccgggggtcagcccccccctcgcgtgtttctggcagttttcgtggagcagcccacgccctttctcccgaggttcctccagcgcctgcttttattagactatcctccagaccgcgtgacactgttcctgcataacaatgaagtctttcacgaaccgcatatcgccgactcctggccgcagcttcaggaccactttagcgccgtcaagctggtcggcccagaggaagcactctcaccgggggaggctcgcgacatggctatggacctgtgccggcaagatcccgaatgcgagttctacttcagtctcgatgcagatgccgttctcacaaatctccaaactctgaggatcctaatcgaagagaatcgaaaggtgattgccccgatgctaagccgtcatgggaagctttggtccaatttttggggtgccctctctccagatgagtactacgccagaagcgaggactacgtggagctcgttcagcgcaaacgggtaggggtgtggaacgtgccctacattagccaggcctatgtcattcgcggcgatacactgcgaatggagctgccccagagggacgtttttagcggatcagataccgaccctgatatggctttttgcaagtctttccgcgataagggaattttccttcatctgtccaatcagcacgagtttgggcggctgttggctacctctcgctacgacacagaacatttacaccctgacctgtggcagattttcgataacccagtggactggaaggagcagtatattcacgagaactacagtagagccctggagggggaagggattgtggagcaaccatgccccgatgtatactggtttcctctgctctcagagcagatgtgcgacgagctcgtggccgagatggaacattacggccagtggtccggaggacggcacgaagactcaagactcgccggcggctacgaaaatgtgcctaccgtagacattcacatgaagcaagtggggtatgaggaccagtggcttcagctcctccggacttatgtgggcccaatgacggaatcactattcccgggctaccacacaaaagctagagccgtgatgaactttgtggtacgctacaggcctgacgaacagccatctctgcggccacatcatgattcctccacctttaccctgaacgtggccttaaaccataaagggttggattatgaaggggggggctgtagattcttacgctatgactgcgtgatctcctctccaagaaagggctgggcacttttacatcccggtcgtctcactcactatcatgaagggcttcccaccacctgggggaccaggtatatcatggtctcgttcgtcgacccttag

SEQ ID NO: 26121 - DNA, 366 bp, Artificial Sequence
  Description of Artificial Sequence: Synthetic coding sequence
atggtggacatgatggacctgccccggagccggatcaacgccggcatgctggcccaattcatcgacaagcccgtttgcttcgtcggacggctcgagaagatacatccaaccgggaagatgttcatactgtcagacggagaaggtaaaaatggaactatcgaacttatggagcccttggacgaggagatttcagggatcgtcgaggtggtcgggagagttaccgcaaaagcaaccattctttgtaccagttacgtgcagtttaaagaagattctcatccattcgatttgggcctgtacaacgaagctgtgaagattattcatgatttcccgcagttttatccccttggtattgtccagcacgactag

SEQ ID NO: 26122 - DNA, 2787 bp, Artificial Sequence
  Description of Artificial Sequence: Synthetic coding sequence
atgccccccaagaccccccggaagaccgccgccaccgccgccgccgcggctgcagagcccccagcccctccacctcctcccccaccagaagaagacccagaacaagactctggccctgaggatcttcccctggttaggctcgaatttgaggaaactgaggagccagacttcaccgctctctgccagaagcttaagatcccagaccatgtaagagaaagagcgtggcttacgtgggaaaaagttagctctgtggatggcgtgctcgggggctatatacagaagaagaaagaactgtgggggatctgtatctttattgccgcggttgatctggatgagatgtccttcacattcaccgagctgcagaagaacatagaaattagcgtgcacaaattttttaatctgctcaaggaaattgacaccagcacaaaagtagacaacgccatgagcaggttactcaagaaatatgacgtgctgtttgctctgtttagcaagttggagcgaacatgtgaactgatttatctgacccagccctcctcttccatctcaacagaaatcaactccgcactggtgctaaaagttagctggattacctttctgttagccaaaggtgaggtgctgcagatggaggatgaccttgtgattagtttccaattgatgctgtgtgttctggattacttcataaaactgtcgccccccatgctgctcaaggaaccctacaaaacagctgtaatcccaattaacggtagtccgagaactccccgtaggggccagaataggtctgcaagaatcgcaaagcagctagagaacgacactcgaatcatagaagtgctgtgtaaggaacacgagtgcaatattgacgaagtgaaaaacgtttatttcaagaacttcataccattcatgaattctctgggtcttgtcacatcaaacgggctgcccgaggtcgagaatctttcaaagaggtatgaagaaatttacctcaagaacaaggacctcgacgcgagactgtttctcgatcatgataagacactgcaaaccgactccattgatagcttcgaaacgcaaagaacaccaagaaagtctaacttggacgaggaggtcaacgtgatcccaccacacaccccagtgagaacagtgatgaatacaatccaacagctgatgatgattttgaattccgcaagcgaccagccttcagaaaacttgattagttatttcaacaactgcacagttaaccctaaggagagcatcctgaaacgcgtgaaagacattggctatatattcaaggagaagttcgccaaggctgtggggcagggatgtgtggagatcggaagccagcgctataagctaggcgtaagactttactaccgcgtgatggaatcaatgttaaaatccgaggaggaaaggttatccattcaaaatttctccaagctgctgaatgacaatatttttcatatgtcactgctggcgtgcgcactcgaagtagtgatggccacttactccaggtcaacttcccaaaatttggactcgggaactgacctgagcttcccatggatcttgaacgtgcttaacctaaaggcgtttgatttctacaaggtcatcgaatcctttattaaggctgagggaaatctgacccgggagatgatcaaacatcttgaaaggtgcgagcatcggatcatggagagcctggcatggctgagcgattcaccactgtttgacttgatcaagcagtctaaggaccgggagggcccaaccgaccacctggagtctgcctgccctctcaacctgcctctgcagaataaccacaccgccgctgacatgtatctgtctccggtgcggtcccccaaaaagaaaggctcaaccacccgcgtaaacagcacggccaatgccgaaactcaggctacaagtgcattccaaacacagaagcccctgaaatctacatctctatcactgttctacaaaaaggtttatcgccttgcctatctcaggttgaatactctctgcgagcgcctgttgagcgagcatcctgaattagagcacattatctggacattgttccagcataccctgcaaaacgaatacgaactcatgcgggatagacacctggaccagattatgatgtgcagcatgtacggcatctgtaaggtcaaaaatatcgacctgaaatttaagattatcgtgactgcttacaaagatctgccacatgctgtccaggaaactttcaagcgggtgctgataaaagaggaggaatacgactcaattatcgtattctacaatagtgtgtttatgcagcggctgaaaaccaacatcctccagtatgcctccactcgcccccctacactctctcccattccacatatccctcggagcccttacaagttcccctcttcccctctgcgcataccaggtgggaacatctacatctctcccctgaagtccccctacaaaatcagtgagggcctgccgactccaaccaagatgaccccgagatcccgaattctggtcagcattggggagagcttcgggactagcgaaaaattccaaaagattaaccagatggtatgcaattctgaccgggtccttaagcggagcgccgagggctcgaaccctcctaagccacttaaaaagctgcgcttcgatattgagggcagtgacgaagcagatggaagtaagcaccttcccggtgagagcaagtttcaacagaaattggcagagatgaccagtacacgcacacgcatgcagaagcagaagatgaacgatagcatggacacctccaataaagaagaaaaatag

SEQ ID NO: 26123 - DNA, 162 bp, Artificial Sequence
  Description of Artificial Sequence: Synthetic coding sequence
atgccccccaagaccccccggaagaccgccgccaccgccgccgccgccgcggctgagcctccggcccctccacctccaccccctcctgaagaagaccccgaacaggactccggacccgaagatctgcctctcgttcgcggatctattacaaacggaagatag

SEQ ID NO: 26124 - DNA, 2724 bp, Artificial Sequence
  Description of Artificial Sequence: Synthetic coding sequence
atgccccccaagacccccccccccgaggaggaccccgagcaggacagtggccccgaagacctgccgctggtgcgcctggagttcgaagaaacggaagagcctgacttcaccgccctctgtcagaaactgaaaatcccagatcacgttagggagagagcctggctgacgtgggaaaaggtgtcctccgtcgacggcgttctgggcggctacatacagaagaaaaaggagctgtggggcatctgtatatttatcgccgcagtagacctggacgagatgagctttacatttacagagctgcaaaaaaatattgaaatttccgtgcataagttttttaacctgcttaaagagatcgatacctcaaccaaggtagataacgctatgagtcggcttttaaagaagtatgatgtcctcttcgccctgtttagtaaactggagcggacttgcgagctcatttatttaacccaaccaagctcctctatctctaccgagatcaactccgcactcgtgctgaaggtgagctggatcacgttccttctggcaaagggagaagtgttgcagatggaggacgaccttgtgatcagtttccagctaatgctctgcgtcttggactactttatcaagctctccccccccatgctgctgaaagagccatataaaaccgctgtcatccccataaacgggtcgcctaggacacccagaagggggcagaacagatctgctcggatagccaagcagttggaaaatgatacacgaatcatcgaagtattgtgcaaggagcacgagtgtaatattgatgaggtaaaaaacgtatattttaaaaacttcataccgttcatgaactcgctgggcctggtgacttccaatgggctgccagaggtggaaaatttgtccaagcggtacgaagaaatttatctgaagaacaaggatttggatgcccgcctcttcctggatcatgataaaaccctgcagactgacagtattgatagcttcgagacacagagaacacctaggaaaagtaatttggacgaggaggtgaatgtgattcccccccacacgcccgtgaggacagtgatgaataccatacaacaactgatgatgatactcaactcagcgagtgatcaaccaagcgaaaatctgatcagctactttaacaactgcactgtaaacccaaaagagtctatacttaagcgagtcaaggatatcgggtatatctttaaggagaagtttgccaaggctgtgggtcaaggatgcgtagaaattggatcccaaagatataaactgggagtgagactctactaccgggtgatggaatctatgctgaagagtgaggaggagagattgagcatccagaatttctcaaaactgctgaatgacaacattttccatatgtcgctccttgcctgcgcccttgaggtggtgatggccacgtactcccgatcaacctctcaaaatctcgattctggcacagatctcagcttcccctggatcctcaatgttctaaatctgaaggcattcgatttctacaaggtcatcgaatctttcatcaaggcggaaggtaatctgacgagagaaatgatcaagcatcttgagcgctgtgagcatcgcatcatggagtcacttgcatggttatccgactcacccctcttcgatctcattaagcaatcaaaagacagagagggtccaacagaccaccttgaatccgcctgcccccttaacctgcctctgcagaacaaccacaccgccgccgatatgtacctgtctcctgtgaggtcacctaaaaagaaaggatctactacacgcgtcaatagcaccgccaatgccgagacacaagccacaagcgcctttcagactcagaagcccctcaagtcgacctccctgagcttattttacaaaaaggtctacagactggcctacctaagactcaataccctctgcgaacgccttctgtcagagcaccctgaacttgagcatattatttggacattgtttcagcataccctgcagaacgagtatgagcttatgcgggataggcatctcgaccaaattatgatgtgcagcatgtacggcatctgcaaggtcaagaacattgacctgaagttcaaaatcatagtgaccgcttacaaggacctgcctcatgctgttcaggaaaccttcaaaagggtgctgatcaaagaagaggagtacgatagcattatcgtgttttataattcagtatttatgcagcgtctgaaaaccaacatcttacaatacgctagtacgcgccctccaacgctgtcccctattccacatatccctcgcagtccatacaagtttccttcttcaccactccgcattccaggcggcaatatttacatctcacctctgaaatcgccctacaaaataagtgaggggttacctacccctacaaagatgacccctagaagcagaattctcgtgagcataggggagagtttcggtacttcagagaaatttcaaaagatcaaccaaatggtgtgcaacagcgatcgtgtccttaaacgcagtgctgagggcagcaacccccccaaacccttaaaaaaactgcgttttgacatcgagggatctgacgaggcagacggatcaaaacatctgcccggggaatccaagtttcagcaaaagctggccgagatgacctctacaagaacccgaatgcagaaacagaagatgaatgattctatggatacctcgaacaaggaagagaagtag

SEQ ID NO: 26125 - DNA, 2694 bp, Artificial Sequence
  Description of Artificial Sequence: Synthetic coding sequence
atgaacatcagcggcagcagctgcggcagccccaacagcgccgacacctcgagtgattttaaggacctatggactaagctgaaagaatgccatgatagggaggtgcaaggccttcaggtaaaagtcaccaaactgaagcaagagaggatcctggatgcccaaaggttggaggaattctttacgaagaaccaacagttacgcgagcagcagaaggtactgcacgaaacgatcaaggtcttggaagaccgtcttcgtgccggcctttgcgatcgatgtgctgtgaccgaggagcacatgcgaaagaaacagcaggagttcgaaaatatcagacagcagaacctgaagctgattactgaactcatgaatgagcggaacacccttcaagaggagaataagaagctgtcagagcagctgcagcagaaaatcgaaaacgaccagcagcaccaagccgccgagctggagtgcgaagaggacgtgatacccgactctcccattacagctttcagtttttcgggggtgaatcgcctccgtcggaaagagaatcctcatgttcgctacattgagcagacgcatacgaaactggagcattctgtgtgcgccaacgagatgcgaaaggttagcaaatccagcactcatccgcaacacaatccgaacgaaaatgagatcctcgtggccgatacttatgatcaatctcagtcacccatggctaaagcacatggcaccagctcctacacaccagataagtcatcttttaacctggctacagttgtggccgaaacactgggcctcggagtgcaagaagagagcgaaacccagggtcctatgtcgcctctgggcgacgaactgtaccactgcttggaaggcaaccacaagaagcaaccgtttgaagagagcacccgaaacacagaggattctttacggttttctgactcgaccagcaagacgccaccacaggaggaacttccgactcgtgtctcatcccccgtatttggcgccacctcgagcattaagtctgggttggacttgaatactagcttgtccccatcactgctgcagcccggaaagaagaagcacctgaagaccctccctttctctaacacctgcatctcacgcctcgagaagacccgctctaaatctgaggactcagcactgttcactcaccattccctaggttcagaggtgaacaagattatcattcagagcagtaacaaacaaatcctcatcaacaagaacatctcagagagcctgggagagcagaatagaaccgaatatggtaaggatagcaacaccgacaagcatttagagccactcaagtctctgggggggaggaccagcaagcggaagaagacagaggaggagtctgagcacgaggtgtcatgcccacaggcatcctttgacaaagagaacgccttcccttttccgatggacaaccagttttctatgaatggcgattgtgtgatggacaagcccttagacctgtctgaccggttttctgcaattcagcggcaggagaagagccaggggagcgaaaccagtaagaacaagtttaggcaggtcaccctttacgaagccctcaagacaatccctaagggcttttcttcgtctcgaaaagcctccgacggcaactgtaccttgcctaaagacagcccaggcgagccctgctcacaagaatgtataattttacagcccttgaacaagtgttcacccgacaacaaaccctctctgcagatcaaagaagaaaacgccgttttcaagatacctttacgaccacgggaatctcttgagaccgagaatgtactagacgacatcaaatctgctggtagccacgaacctataaaaattcaaacccgcagtgaccacggcgggtgtgaactggcttctgtgctgcagctgaacccttgtaggaccggcaaaattaagtcactgcaaaacaatcaggacgtctcctttgagaatatacagtggtccattgatccgggagcagacctaagccagtataaaatggacgtgacagtcattgacacaaaagatgggagccaatcaaaactgggcggcgaaacagtggacatggactgcactctcgtaagcgaaaccgttttactgaagatgaaaaaacaggaacagaaaggagagaaatccagtaacgaggagcgtaagatgaatgacagcttagaggacatgtttgatcgcaccacacatgaggaatatgagtcctgtctcgcagactcctttagccaagccgccgatgaggaggaggaactcagcaccgccaccaagaaactgcatacacacggcgacaaacaggataaagtgaaacaaaaagcatttgttgagccatactttaagggggatgaaagggagacatctctgcaaaattttccacatattgaagtggtgcggaagaaggaggaaaggagaaagctgcttggtcatacgtgtaaagaatgtgaaatttactatgctgacatgccagccgaggagagggagaaaaaacttgcctcttgctctaggcaccgctttagatacatacctcctaacacgccagagaacttttgggaggtaggctttccgagcacgcaaacttgtatggagcggggatacattaaggaagacctggacccttgtcctcgccccaaacggcgccagccatataatgccattttctctcctaagggtaaggaacagaagacctag

SEQ ID NO: 26126 - DNA, 2709 bp, Artificial Sequence
  Description of Artificial Sequence: Synthetic coding sequence
atgaacatcagcggcagcagctgcggcagccccaacagcgccgacacgtcctccgacttcaaggacctgtggacaaaactcaaagagtgtcatgatcgagaagtgcaggggttacaggttaaagtcacgaaactgaaacaagaaagaatcttggacgcgcagcggctggaggaattcttcacaaagaaccagcagctgcgcgaacagcagaaggttcttcatgaaacaatcaaggttctggaggatcggttgcgcgccgggctctgcgataggtgcgcggtgacagaggaacacatgcggaaaaaacaacaagaattcgaaaatattcgacaacagaatctcaagcttatcaccgagctgatgaacgaacggaacactcttcaggaggaaaataagaaacttagcgagcaactgcagcagaaaatagaaaatgatcagcagcatcaagcagcagagctggagtgcgaggaagacgtgataccggactcgccgattaccgcattttcttttagcggggtcaatcgacttaggcgaaaagagaacccacacgtcagatatatcgagcaaacccatactaagctagaacactcagtatgcgcaaacgagatgcgaaaggtgagcaaatcatccacccatccgcaacacaacccaaacgaaaacgagatcctggtagctgacacttacgaccaatcacagtctccaatggctaaggcccacgggaccagcagctatacccctgacaagtcatccttcaacttggccaccgtcgtcgccgaaactctaggcctcggcgttcaggaagagagtgagacacaaggccccatgtcacctctgggggatgagctctatcattgcctcgagggaaaccacaaaaagcagccttttgaagagtctacacgaaacacggaggactccctgaggttctccgatagcaccagtaaaactcctccacaggaggaactgccaacaagagtctcttcccccgttttcggagccacttcaagtatcaagtccggactggatctcaatacgtcattgtctccgtcacttctccagccaggtaagaagaagcacctcaaaaccctgccgttctctaatacctgcatctcccggctggagaaaacccgcagcaagagtgaggacagtgccctgttcactcatcacagtctcggttcggaggtcaataagatcataatccagtcctccaataagcagattctgattaataagaatattagcgaaagcctaggcgagcagaatcgcacagagtacggcaaagattccaataccgataagcaccttgaaccgctaaagagtttagggggccgtaccagtaaacggaaaaagaccgaggaagaatccgaacacgaagtgtcttgcccccaggccagctttgacaaggagaacgcctttccgtttccaatggacaaccagttcagtatgaatggagactgcgtgatggataagccgcttgatttgagcgataggttctcagcgattcagaggcaggaaaaaagccagggctctgagacgtccaaaaataaatttagacaggtgacactgtacgaggccttgaaaacaattcctaaggggttttcaagttcacgcaaagccagcgatggtaattgcacacttcctaaagattcgcccggggagccctgttcacaagagtgcatcattctgcaacctttgaacaaatgcagccctgataataaaccgagtctccagatcaaagaggagaacgcagtctttaaaatacccttgcgacctcgagaaagcctcgagactgagaacgtcctggacgacattaagtccgccggaagccacgaaccaattaagatacagactcgatcagatcacgggggctgtgagttggcttccgtgctacagcttaatccctgcaggaccgggaagataaagtctctccaaaataatcaggatgtcagtttcgagaacatacagtggtctattgatcccggcgcggatctgagccagtataagatggacgtgaccgtcatcgacaccaaggacggtagtcagtcgaaactggggggcgaaacagtggatatggactgtacactggttagtgagaccgtgctgctgaaaatgaagaagcaggaacagaagggcgaaaaatcctccatgcttttctacatcgacgaggaaagaaagatgaatgactccttagaggacatgtttgatcgcacaacgcacgaagagtacgaaagttgccttgcggattcgttcagtcaggctgccgacgaggaggaagagctaagcacagcaaccaagaaactccatactcacggggacaagcaggacaaggtaaagcaaaaagcttttgtcgaaccgtactttaagggcgatgagagagaaactagtctacagaactttccccacatcgaagttgtgcgcaagaaggaagaaaggaggaagctgctgggccacacttgtaaggagtgtgagatttactacgccgacatgccagccgaagagagggaaaagaagcttgcttcctgttcccggcataggttcaggtatatcccacccaatacgccagagaacttctgggaggtcgggtttccctcaactcaaacgtgcatggagagaggctatatcaaagaagatcttgatccctgccctcggcccaagcgccgacagccctataatgcgatattctcccctaaggggaaagaacagaaaacttag

SEQ ID NO: 26127 - DNA, 2598 bp, Artificial Sequence
  Description of Artificial Sequence: Synthetic coding sequence
atgaacatcagcggcagcagctgcggcagccccaacagcgccgacacgtcttctgactttaaggacctttggactaagctgaaggaatgccacgacagggaagtccaggggctgcaagtaaaggtgacaaagctgaaacaagaaagaattctggacgctcagcggctcgaagaatttttcaccaaaaaccagcaactcagggagcagcagaaggtgcttcatgaaacaattaaggtcctagaggataggctgagagcgggcctctgtgacagatgtgctgttacagaagaacatatgcggaaaaaacagcaggaattcgagaatattcggcagcaaaatttgaagctgataaccgagctcatgaatgaacgtaacacattacaggaggagaataaaaagctgtcagagcagttacaacagaagatcgagaatgaccagcaacaccaggcagcagaattggagtgtgaggaagatgttattccagactctcctattaccgcattttcatttagcggggtaaacagactccggcgtaaggagaacccccacgtccgttatatcgagcagacacacaccaagctcgagcactcagtgtgtgcaaacgagatgagaaaggtctccaagtcctcgacgcacccacaacacaacccaaatgaaaatgagatattggtggctgatacttacgaccagagtcaatctcctatggccaaagcacatggcacctcttcttacaccccagacaaaagctctttcaatctagctaccgtggtagccgaaaccctggggctcggtgtgcaagaggagtcagagacacagggcccaatgtcacccttaggagacgaactgtaccattgcttggaaggcaaccacaagaagcagcctttcgaggagtcaacacggaatactgaggatagtctgaggttttccgatagcacaagtaagacaccaccccaggaagaactgcctacacgggtcagctcacctgtgttcggcgccacctccagcatcaaatctggactcgatctgaacacttctttatcaccatctctcttacagccaggaaagaagaagcatctcaagaccctccccttttctaacacgtgtatctcaagactcgagaagactaggtcgaaaagcgaggattcagccctgttcacacaccactcattgggctctgaggtgaataagattatcatccagtctagcaacaaacagattctcatcaataagaacataagtgagtcactgggcgagcagaaccgcaccgagtatggcaaagacagcaataccgacaagcacctggaacccctgaaaagcctgggcggtcgtacatccaaacgcaagaagaccgaggaggaaagtgagcacgaggtcagttgcccgcaagcgagtttcgataaggagaatgcttttcccttccctatggacaaccagttttctatgaatggcgactgtgtgatggacaaaccattggacctgagcgatcgcttctcagccatccaacgccaggaaaaatcacagggtagcgaaacctctaagaataaatttcggcaagtgacgctttatgaggccctgaaaactattccgaaaggtttctcgtcctctcgcaaggcaagtgacggtaactgcaccctgcctaaggattcgccaggcgagccgtgctcacaggagtgcattatcctccaaccacttaataaatgcagccctgataacaagccatccctgcagattaaggaggagaatgccgtgtttaagatccctcttcggcctagagagtccctggagaccgagaatgtgctagatgacattaagtctgcggggagtcatgaaccaatcaagatccagacccgctctgatcacgggggatgcgaactggcatctgtgctccagctcaacccctgcagaactggaaaaatcaaatctctgcagaacaaccaggacgtttccttcgaaaatatccaatggagtattgaccccggggcagatctctcacagtacaaaatggatgtaaccgtgatcgacaccaaagatggctcccagagcaaactcggcggcgagaccgttgatatggattgcactcttgtctccgaaacagtcctcctcaagatgaagaaacaggagcagaaaggagagaaatccagtaacgaggagagaaagatgaatgactcacttgaagacatgttcgacaggactacccacgaggagtacgaatcctgtctagcggatagtttcagccaggccgctgatgaggaggaggagctgtcaactgccacaaagaagctgcacacgcatggcgacaaacaggacaaggttaaacaaaaagcatttgtcgaaccatactttaaaggcgatgagagcatcatgcagatatgccagcagaagaaagagaagaggaattggttgcctgctcaggacacagatagcgccaccttccaccctacacaccagcggatattcggcaagcttgtattcctgccattacgcctggtgtggaaagaggttatcttgagaaaaatccttatactcgttctggtgcagaaggacgtcagcttaaccacccagtattttctgcagaaggccaggagtcgccggcattag

SEQ ID NO: 26128 - DNA, 2694 bp, Artificial Sequence
  Description of Artificial Sequence: Synthetic coding sequence
atgaacatcagcggcagcagctgcggcagccccaacagcgccgacacttcctctgactttaaagacttatggacaaaactaaaggagtgtcatgaccgggaggttcagggcctccaagtgaaagtgaccaagttgaaacaagagagaatcctggacgctcaacggctggaggaatttttcacaaagaatcagcagctccgagaacagcaaaaggtgctgcatgagacgatcaaggtgcttgaggacagactgcgagccgggctatgtgacagatgcgccgtcactgaagagcatatgcgtaagaaacaacaagagttcgagaacattaggcagcagaatctgaagctgattactgagctaatgaacgaaaggaataccctgcaggaggagaataagaagctttcggaacagctgcaacaaaaaatcgaaaacgaccagcagcatcaggcagctgaactggagtgcgaagaagacgttatccccgactccccaattactgccttcagctttagcggtgtcaatcgtttacggaggaaagagaaccctcacgtgaggtatattgagcagacccacaccaagctggaacactccgtgtgcgccaacgagatgcgtaaggttagcaaatctagcacccatccccaacataaccccaatgagaacgagatcctggttgccgatacttacgatcaatcccagagtcctatggccaaagctcacgggaccagttcctacacgcccgacaagagtagttttaatttggcaacagttgtagcagagacgcttgggttaggcgtgcaggaggagtcggagacccaaggtccaatgagccccctcggcgacgaattatatcactgcctggaaggcaaccacaagaaacaacctttcgaagaaagtacaaggaatacggaagatagcctgcggtttagcgattctaccagtaagactcctcctcaggaggagctgcccacacgggtgtcttcccctgtgttcggcgccacctcctctatcaagagcggcctcgacttgaatacaagcttgagcccatcactcttacagccaggaaagaaaaaacatctgaagacattgcctttcagtaacacttgtatcagccgactggaaaagacgcgttctaaatctgaggatagcgctctgttcactcaccactcactggggtccgaggtgaataaaatcatcatacagtcttccaacaaacagatcctgattaacaaaaatatctccgagtccctcggggagcagaacaggactgagtacggcaaggatagcaacactgataaacacttggagccactgaaaagcttaggcggtcggacctctaagaggaagaagacagaggaagagtccgaacacgaggtgtcttgccctcaagcgtcattcgacaaggagaatgcttttccattcccaatggacaatcagttttccatgaatggagattgtgtgatggataaaccactggacctctctgatcgcttcagcgccatacagcggcaggaaaaatctcagggcagcgagactagtaagaacaaatttaggcaggtgactttgtacgaagcattaaagacaatccccaaggggttttcctcaagcagaaaggccagtgacggaaattgtacactcccaaaagacagcccgggcgagccttgcagtcaagagtgcatcatcttgcagcccctcaacaagtgtagtcccgataacaaacccagtttacagataaaagaggagaacgccgtgttcaagattcctctgcgaccgcgtgaaagtttagaaactgagaatgtgctcgacgacattaaatcggctggcagtcacgagcctatcaagatccagacaagatctgaccacggtggttgcgaactggcaagcgtgctacagcttaatccgtgcaggacaggcaagattaaaagcctgcagaataaccaggacgtgtcattcgagaatatccaatggtctatcgaccccggggccgatctaagtcagtacaaaatggatgtgaccgtgattgacaccaaagatgggtcacagtctaagctcggaggagaaaccgtagatatggattgtaccttggtcagcgaaacagtcttactgaagatgaagaagcaggagcagaaaggagagaaatctagcaacgaggagcgcaagatgaacgatagccttgaggacatgttcgacagaacaactcacgaggaatacgaaagttgcctcgcagacagtttcagccaagccgccgatgaagaagaggagctatcaaccgccaccaagaaacttcatacacacggtgacaagcaggataaagtgaagcaaaaagcgttcgtggaaccttatttcaaaggcgacgagagagagacatctctgcagaatttccctcatatcgaggtcgtgcggaagaaggaagagcggaggaaactccttgggcacacctgtaaggaatgcgagatctactacgccgatatgcctgcagaagagagggagaaaaaactagctagttgctcaaggcatagatttcgctacatcccacccaacacaccggagaacttctgggaggtcggctttccctcaacgcagacgtgcatggaaagggggtacattaaagaggatctcgatccttgtccgaggccgaaacgccggcagccttacaatgcaatcttctccccgaaagggaaggagcaaaagacttag

SEQ ID NO: 26129 - DNA, 2604 bp, Artificial Sequence
  Description of Artificial Sequence: Synthetic coding sequence
atgaacatcagcggcagcagctgcggcagccccaacagcgccgacacgagctccgatttcaaagatttgtggacgaagctgaaggagtgccacgatagagaggtgcaagggttacaagtgaaagtgaccaaattgaagcaggaacgcatcctcgacgctcaacggctcgaagaattcttcactaaaaatcagcagctcagggagcagcagaaagtactgcacgaaacaattaaggtgctcgaagaccgcttgagagcagggctatgtgaccgctgtgccgtcacagaagaacacatgaggaagaagcagcaagagttcgaaaacattcgccagcagaatctgaagctgattacagaactcatgaacgaacgaaatacactgcaggaggaaaacaagaagctgagtgaacagctgcaacaaaagatcgaaaatgaccagcagcaccaggctgccgaactcgagtgcgaggaagatgttatccctgatagccctatcacagctttctcattttcgggcgttaaccgactgcggcgaaaggagaatcctcacgtgagatacatcgagcagacccatactaagttggaacacagcgtatgcgccaacgaaatgaggaaggtgagcaagtcatcgacccacccgcagcataaccccaatgagaatgagatattggttgctgacacgtacgaccagtcccagagccccatggcaaaggcccacggtacttcttcctatacgcctgacaaaagcagcttcaaccttgctaccgtagtggcggagaccttggggctgggggtgcaggaagaatcagaaacccagggacccatgtccccgctcggcgacgaactctatcattgcttggaaggaaatcacaaaaagcagcccttcgaggaaagcactagaaatactgaagactccctgaggttttccgacagcacctcaaaaacaccaccacaggaggagttgcccacaagggtctccagccccgtctttggggccacaagctccatcaaatctgggctcgatttaaacacctcccttagcccaagtctgttgcaaccagggaaaaagaaacacctgaagactttacccttctcaaacacttgtattagtcggttggagaaaacccggtcaaagtccgaggattctgcactgtttactcaccacagtctcggttccgaggtcaataagatcataattcagtcttctaataagcagatactcattaacaaaaacatcagtgagtcactcggggagcaaaatcggacagagtatggaaaagatagtaatactgacaagcacctcgagcccttgaaatccctgggggggcggacatcaaagcgcaaaaagactgaggaggagtcagagcacgaagttagctgtccgcaagcgagttttgataaagagaatgccttcccatttcctatggataaccagttctccatgaacggcgactgtgtaatggataagcccctggatctgtctgatcgattcagtgccatccagagacaggagaaatcccagggatcagaaacctccaagaataagttccgccaagtgacgctttacgaggcactgaagacaatacctaagggttttagctcctcacggaaagcaagcgatggcaactgtacactccctaaagatagtcctggcgagccgtgcagtcaggagtgcatcatactgcagccccttaacaaatgtagtccagataacaagccctccctacagattaaggaggagaacgccgtcttcaagatccccctccgcccacgggagtcccttgaaactgagaacgtcctagacgatattaagtccgccggatcacacgaaccaatcaaaatccaaacccgttctgatcacggtgggtgtgaactggcctccgtcctgcagcttaacccgtgccgcacagggaagatcaagtcgctacagaataatcaggacgtgagcttcgaaaatattcagtggagcattgatcctggtgcagacctgtcacagtacaagatggatgtcactgtcattgacaccaaggacggaagccagagtaagcttgggggcgaaaccgtggatatggattgtacgctcgtgagtgagactgtgctgctgaaaatgaaaaagcaggaacagaaaggcgagaagagctctaatgaagagcggaagatgaacgatagtctcgaagatatgttcgacagaactactcatgaggaatatgaatcatgcctcgccgattcattttcccaggccgccgacgaagaggaagagttgtcaactgctactaagaagctgcacacgcacggtgacaaacaggataaggtgaagcagaaggctttcgtggaaccatacttcaaaggcgatgagtcaatcatgcagatatgccaacaaaaaaaggaaaagagaaattggttgcctgcacaggacacagactcagcaacatttcatccaactcatcaaaggatattcgggaaacttgtattccttcccctgcggctggtgtggaaggaagtgatactgcgaaagattttgatcctcgtactcgtccaaaaggacgtgagtctaactactcagtacttcctgcagaaagccagatcccgccggcacaggagatag

SEQ ID NO: 26130 - DNA, 3045 bp, Artificial Sequence
  Description of Artificial Sequence: Synthetic coding sequence
atgttcgaggacaagccccacgccgagggcgccgccgtggtggccgccgcaggcgaggccttgcaggccctgtgtcaggagctgaacttggatgaaggtagcgctgcggaggccctggatgattttaccgccattaggggaaattactctttggagggagaggttactcactggcttgcttgttccctgtacgtggcctgtagaaagagcataatccccaccgtgggcaaggggataatggaaggtaattgtgtctctttgacacgcatcctccgcagcgcgaagctttccctcatccagtttttctccaaaatgaagaaatggatggatatgtccaatctgcctcaagagtttagagaacggatcgagagacttgagcgaaactttgaggtgtcgacagtgatcttcaagaagtacgagcccatctttctcgacatatttcaaaacccttacgaggagcctcctaagctgcctaggtctcgcaagcaacggcgcattccctgttcagtgaaagatctgttcaatttttgttggacgctgttcgtctacactaagggaaactttcgcatgataggagacgacttggtcaattcatatcacctgctcctatgttgtctggacctcatctttgcgaatgccattatgtgcccgaatcgacaagatctactgaacccttcttttaaaggattgccctccgatttccatacggctgactttaccgctagcgaagagccgccatgcatcattgctgtgctgtgtgagctgcatgatgggcttctcgtcgaggctaaaggtatcaaagagcactattttaagccctatatctctaaactgttcgatcgcaagattctgaaaggcgagtgccttttagacctctcatcttttactgacaacagcaaggcagtcaacaaggagtatgaagaatatgtcctgacggtcggggactttgacgagcgcatctttttgggtgcagacgccgaagaggaaatcggtaccccgaggaaatttaccagagacacgcctcttggcaagttaacagctcaggcgaacgtggaatacaatctgcaacagcactttgaaaagaagagaagttttgcaccctcaactccactaactgggcgccgatatttgcgagaaaaagaagcagtgataaccccggtggcgtctgctactcagtccgtgagcagactgcaaagcatcgttgcagggttaaagaatgcaccatccgatcaactgattaacatttttgagtcctgcgtacgcaacccagtcgagaatattatgaagattctgaagggcatcggagagacgttctgtcaacattatactcagagtactgatgaacagccggggagccacatagacttcgccgtcaacagattaaagctggcggaaatcctatactacaagatcctggaaaccgtgatggtgcaagaaaccagaagactccacggtatggacatgagtgtgctactcgaacaggacatttttcacagatcactgatggcttgctgccttgagatagtcctgttcgcctatagtagtcctcgtaccttcccttggatcatcgaggtgttgaatctgcagcccttttatttctacaaagtcattgaagtggtaatcaggagtgaggaaggacttagccgcgacatggtgaaacacctgaactcaatcgaggaacagatcttagaatcactggcgtggagccatgattccgccttgtgggaagctctgcaggtcagcgccaataaggttccaacttgcgaggaagtcattttccctaacaactttgagacagggaacggcggaaatgtccagggacacctcccattgatgccaatgtctcctctgatgcatcccagggtgaaagaggtccggacagactctggcagtctgagacgggacatgcagccactatcgccaatcagcgtacatgagaggtacagctcgccaaccgctggaagcgccaagaggaggctgttcggggaggatccacctaaagagatgctgatggacaaaatcatcacggagggcacaaagctaaagatcgccccctcaagctcgatcacagcagagaatgtgtctatcctcccaggacaaacacttttgaccatggccacagccccagtaaccggaactacaggacataaggtgaccataccactgcatggggtggcaaatgacgccggtgagataacgctgatccctctgagcatgaataccaatcaggaaagcaaggtaaagagcccagtgtccctgactgcccatagcctcatcggtgcctcccctaaacagactaatctcaccaaggcccaggaggtccattcaacaggcatcaatcggccaaagaggacagggtcgttggcattgttttatagaaaggtataccatttagccagcgttcgactcagagacctctgtctcaagctcgatgtaagtaacgagcttcggaggaagatctggacttgcttcgagttcacactcgttcactgccccgaccttatgaaggacaggcatctggaccagctgctattatgtgcattttatatcatggccaaagtaaccaaagaggagagaacatttcaggagattatgaagtcctaccgtaaccagccacaggcgaattcacatgtttatcgttctgtgttgctgaagagcattccgagggaagtcgtggcatataacaagaacattaatgacgacttcgagatgattgattgcgaccttgaagacgctacaaagaccccagactgtagctcggggccagtgaaggaggagcgtggagacctgattaaattttataacacaatttatgtgggtagggtcaaaagttttgctcttaagtacgacctggccaaccaggatcatatgatggacgccccaccactgtcccctttcccccatatcaaacagcagccaggcagtcccaggcgcatcagtcagcagcacagtatttacatttctccccacaagaatggaagcgggctaacacctaggagcgcgctgctatataaattcaacggaagcccctccaaagttcggtag

SEQ ID NO: 26131 - DNA, 3207 bp, Artificial Sequence
  Description of Artificial Sequence: Synthetic coding sequence
atgttcgaggacaagccccacgccgagggcgccgccgtggtggccgctgccggtgaagcactgcaggccctgtgccaggagcttaatcttgacgaggggtccgccgctgaggctctggatgacttcacagcgatccgcgggaactattcgctagagggtgaggtaacacattggctggcctgtagtctgtatgtcgcctgtcgcaagtctataattccgacagtgggcaaaggaatcatggaggggaattgtgtgagtcttacacggatcctccgcagcgccaagttatcgctgattcagttcttctccaagatgaagaagtggatggatatgtctaatttacctcaggagtttcgcgagcgcatcgaacggctagagagaaatttcgaggtatcgacagtgatatttaagaaatatgaacccatattcttggatatttttcagaatccatacgaggagccacctaagctgcctaggtctaggaagcagcgtcgcatcccttgcagtgttaaggatctgtttaacttttgctggaccctgttcgtttacacgaaaggaaactttcgcatgataggcgacgatttggtgaattcgtatcatctacttttatgttgccttgatctaattttcgcgaatgcaattatgtgtcccaatagacaagatctgctcaaccctagtttcaaggggctgccctctgacttccacaccgcagactttaccgcatcagaagagcccccgtgtattatcgctgtgctgtgcgagctccacgatggacttctggtcgaagctaaggggataaaagagcattacttcaagccttatattagcaaactgttcgatcgtaagatcctaaagggtgagtgtctcctggacctgagctccttcaccgataacagcaaggccgtgaataaggagtatgaggaatacgtgctaactgtcggcgactttgatgagaggatctttcttggggcagatgcggaagaggaaatcggaaccccgcgcaaattcactagagatactcccctagggaagctgaccgcccaagccaatgtcgaatacaacctgcagcagcacttcgaaaagaagcgttccttcgccccctcaacacccctgactggtcggcggtatctgcgggaaaaagaggctgtgattacccctgtggcctctgctacccagtcagtgtcgcgtcttcagtccatcgtggctggactgaaaaatgcacctagcgaccagctcattaacatcttcgaatcgtgcgtgagaaatccagtagaaaacatcatgaaaatactaaagggaatcggagagacgttttgccagcactacacgcagtctaccgatgagcagcccggctctcacatcgatttcgctgtgaatagactgaagctggcagaaatcctgtattacaagattttagagaccgtgatggtacaggaaacccggcgtctccacggcatggatatgagcgtgcttctggaacaggacattttccaccggtcgttgatggcttgttgcctggaaatagttctctttgcatactcttcacctcgaactttcccatggattatcgaagtactgaatctgcagcccttttacttttacaaggttattgaagttgtgattcggtctgaggagggtctgtcacgcgacatggtaaagcacctaaactctatcgaagaacagattttggagtctttggcctggtcacacgactcagcgctgtgggaggctctgcaggtgtccgcgaataaagtgcctacatgcgaggaggtgattttccccaataacttcgagactggaaacgggggtaatgtgcagggccacctgcccctcatgcccatgtctcccctgatgcatcctcgcgtgaaagaggtccgcacagacagcggctccctgcggcgggatatgcagcctctgtcaccaatttcggtccacgagcggtattccagccccaccgccgggtccgcaaaaaggcggctgtttggggaggatccccctaaagagatgcttatggacaagatcatcacagaagggacgaaactgaagatcgcgcccagctcctctatcacggccgagaacgtatctatactcccggggcagacgctgctcacgatggcgaccgctcccgtcaccggtaccacaggccacaaagtgactatccctctccacggcgtcgcgaatgacgctggtgaaataacactgatccccctgtctatgaacaccaaccaagagtcaaaggtcaaatccccagtgtctctgaccgctcacagtctgatcggtgctagtccaaagcaaaccaatctgaccaaagcgcaggaggttcactcgaccgggataaaccgccctaagcgtactggttctctggccctgttctacaggaaggtgtaccatttagccagcgttcggttgagggatctctgtctcaagcttgatgtgtccaacgaacttagacggaaaatctggacatgctttgaatttaccttggtccactgccctgacctcatgaaagatagacacctggaccagcttctcttatgcgccttctatatcatggccaaagtgacaaaagaggagagaactttccaggagattatgaagagctacaggaaccagccacaagccaatagtcacgtctatcggagcgttctactgaaaagcataccacgtgaggtcgttgcctataataagaacatcaatgacgacttcgagatgatagattgtgacctcgaggatgctactaaaacaccagactgctctagcggacctgtgaaggaagagcggggtgacctgatcaaattttataacacaatctacgtcggcagagtgaaaagctttgcactcaaatatgacctggccaatcaggatcacatgatggatgccccacccctgtccccgtttccccacatcaagcagcagcctggctccccccgccgcatcagccagcaacacagcatctatatatccccacacaaaaacggttccggcctgacacctcgttccgctcttttatataagtttaatggatccccctctaagagccttaaagatatcaataatatgatcagacagggcgaacaacggactaagaaacgggttatcgctatagactctgacgccgaatctccggcgaaaagagtatgtcaggagaacgatgatgttttgctgaaacgcctgcaggatgttgttagcgaacgtgctaatcactag

SEQ ID NO: 26132 - DNA, 3420 bp, Artificial Sequence
  Description of Artificial Sequence: Synthetic coding sequence
atgcccagcggcggcgaccagagccccccccccccccccccccccccagccgccgcagcttctgacgaggaagaggaggatgacggcgaggcagaggacgccgcccctcccgctgagtccccaacgccacagatccagcagcgattcgacgagttgtgcagccgacttaacatggatgaggccgccagggctgaagcttgggactcatatcggtctatgtccgaatcctatacactggaggggaacgatctgcactggctggcatgtgccctatacgtggcatgtcgaaagagcgtccctaccgtgtccaagggcaccgttgagggaaactacgtttccctgacgcgcatcctaaaatgctctgaacagtcgctcattgaattttttaataagatgaaaaaatgggaagacatggccaacttgcctcctcattttcgcgaaagaactgaaaggcttgagagaaatttcactgtctcggctgtgatcttcaagaaatatgagccgatttttcaggatatatttaagtacccacaagaggagcaacctcgccaacagcgcgggaggaaacaaagacgtcaaccctgcacagtgtccgaaatattccatttctgctgggtgcttttcatatatgccaagggtaattttccgatgattagcgacgatttagttaactcctatcatctgttgctgtgtgctttggatctcgtttatggaaatgctttacagtgttcaaatcgaaaggagctagtcaacccgaacttcaaaggcttgtcggaggactttcatgcgaaggacagcaagcccagtagcgacccgccatgcatcattgagaagctgtgttcactccatgacggccttgtgcttgaagccaaggggatcaaggagcacttctggaaaccatatatccgcaaactgtacgagaagaagcttctcaaaggaaaagaggaaaacctgaccgggtttctcgaacctgggaactttggggagtcgtttaaggccatcaataaagcatatgaagagtatgtactgtccgttggtaatctcgatgagcgcattttcttgggcgaagatgcagaagaagagattggcaccctttcaagatgcttaaacgctggaagcggcaccgagacggctgaacgggttcagatgaagaacatccttcagcagcacttcgacaagtcaaaagcgctacgtatcagtacccccttaaccggtgtcagatacattaaagaaaactcaccctgcgtgacacctgtgtccaccgctacccacagtctcagccgactacatactatgctgaccggtctgcggaatgccccctccgagaagttggagcagatcctgcggacctgttctagggacccgacgcaagcgatcgccaatagactcaaagagatgttcgaaatttactcgcagcactttcagccagacgaggacttcagcaactgtgctaaggagatcgcctccaagcattttcgctttgccgagatgctttactacaaagtgttggagtcagtaattgagcaggagcaaaaacgactgggagatatggatctgagcggcatcctggaacaagatgcatttcatcggagcctgctggcctgttgtttagaggtggtgaccttctcctataaaccccccggcaattttccttttattactgagatattcgatgtcccactctaccatttctataaggtcatcgaggttttcattcgtgctgaagatgggctctgcagggaggtggtcaaacacctgaaccaaatagaagaacagattctagatcatttagcttggaagccagagagccctttgtgggaaaaaatccgggataatgaaaaccgcgtacctacatgtgaggaggtgatgcccccgcaaaatttagagcgagccgatgagatctgtattgctggctctccgctgacccccagacgggtcaccgaggttagagccgataccggtggattaggtcggagtataacctctcctaccacgctgtacgaccgctactctagtccacccgcatcgaccacccggagaaggctttttgtcgagaatgactcgccttccgacggcggcacccccggcagaatgcccccacagcctctagtcaatgccgtacccgttcagaacgtgtctggtgagacagtctcggtgaccccagtaccgggccagaccttggttaccatggccaccgctacagtgactgctaacaatggccaaacagtgactattccagtccagggcattgcgaacgaaaatggggggattaccttcttcccagttcaggttaacgttggcggccaggcccaagctgtgactggaagcatccagcccctatccgcccaggcgctggccgggagcctgtcttctcagcaggttacagggaccacactccaagtccctggtcaggtggccattcagcagatctcccctggtgggcagcagcaaaaacagggacagtctgtaaccagttccagtaatagacccagaaagactagctcactgtcccttttctttcggaaagtgtatcacctagctgctgtcagattgcgggacctctgcgcaaagctggacatctccgatgaactaagaaagaagatctggacctgctttgaattcagcattatccagtgcccggaattgatgatggaccgccacctagaccagctgctgatgtgcgccatttacgtgatggccaaggtgacgaaagaagataaaagtttccaaaacatcatgagatgttaccgtacacaaccacaagcacggagccaggtataccgaagcgtcctgattaaaggcaaacgaaagcggcggaattcaggatcctcagacagcagaagccaccagaattcccccaccgaactgaataaggaccgcacctccagggactcttctccggttatgagatcctcctccacactgcccgtcccccaaccctccagtgcaccgccgacacctactagactcactggggctaatagcgatatggaagaggaggagcgcggtgatttgatacagttttataataacatttacataaaacagatcaaaacgttcgcgatgaagtattctcaggcaaacatggacgcccctcccctgtctccctatccttttgtcaggacagggtctccacgacggatacaactctcccagaaccatcccgtgtatatctctcctcataagaacgagacaatgctgagccctcgggaaaagatcttctactatttcagtaactcaccctccaaacgccttcgtgagatcaattcgatgatacgtacaggcgaaactcccacgaagaagcgcggcattctcctagaggacggctccgagtcacccgctaaaagaatttgccccgagaatcacagtgcccttctgaggagactccaggatgtggccaatgacagggggtcacattag

SEQ ID NO: 26133 - DNA, 2550 bp, Artificial Sequence
  Description of Artificial Sequence: Synthetic coding sequence
atggagagccggtgcgtggcccaggccggcatgcagtggcacgacctgggcagcctgcagcccctaccgccgaggtttaagaggtttttttgtctctcactcctgagctcctgtgaatacagcaaggcgataaataaagcttatgaggagtatgtgttgagcgttggcaacctggatgagcgaatatttctaggtgaagatgccgaggaggagataggtacactatcgaggtgcctgaatgcaggaagtggcactgagaccgctgagcgagttcagatgaagaacattcttcagcagcactttgacaaaagcaaagctttgcgaatctccacacccctgaccggagtgcggtacatcaaagagaactctccctgcgttacacccgtgagcaccgcaacacattcccttagcaggctgcacactatgctgacagggctcaggaacgctcctagcgagaagttagaacagatcctgcggacttgctcccgcgatcccacgcaggccattgcaaaccgactgaaggaaatgttcgagatttatagccaacacttccagccagacgaggacttttcgaattgtgctaaggagatagcaagcaagcatttccgctttgccgaaatgctgtactacaaggtgttagaatctgtgattgaacaagaacagaagcgcctgggcgacatggatctgtctgggatcctggaacaggacgcctttcatagatccttgctggcatgttgtcttgaggtggtgacgttttcctacaagcctcccgggaatttccctttcatcacagagatatttgacgtccctctgtaccacttctataaagtcatcgaggtgttcatcagggccgaggacggactatgccgcgaagtagtcaaacatctgaaccagatcgaagaacaaatcctcgaccacctggcctggaagcctgaaagcccattgtgggaaaagatccgcgacaatgagaatagggtgcctacttgcgaggaggtcatgcctccacagaacctggagagggccgatgaaatctgtatagccggatctccgctcacgccccgccgggtgactgaggtcagagccgacactggagggctgggccggtcaattactagtccaactaccctgtatgatcgatactcctcgccaccagctagtactacacgcaggcggctgtttgtggagaacgacagcccgtctgatggggggacaccagggagaatgcccccacagccgctggtgaacgcagttcccgtgcagaatgtttccggagagaccgtgagcgtcacaccggtgcccggccaaactctggtgacgatggccaccgcaacggtaaccgccaataacggacagaccgtcacaatcccagtgcagggcatcgctaacgagaatggggggataaccttctttcctgtccaggtcaatgtcgggggtcaggcgcaggccgtgaccggctctatccagccactttctgcccaggctctagcaggtagcctcagttcccaacaggtcactggtaccacactccaggtgcccggccaggtggcgattcagcagatctcccccggcggacagcagcagaagcaggggcagagtgtgaccagttcatctaaccggcccaggaaaaccagctcactttccctcttcttcagaaaggtgtatcatctggccgctgttcgcttaagggatctctgtgctaaactcgatatctcagatgagctacgcaaaaaaatttggacatgcttcgaattctcaataattcagtgtccagagctgatgatggatcgccacctagaccagctactgatgtgtgctatctacgttatggcaaaagtgaccaaagaagacaaatctttccagaatatcatgcggtgttataggacccagccccaggcaagatcacaagtgtaccggtctgtgctgataaaagggaagaggaagaggaggaactcaggctcatccgactctcggagccaccagaatagtcctacggaactcaacaaagacagaacctcccgtgacagttcccctgtgatgcgctcgtcctccacactgcctgtcccgcagccatctagtgcacctccaacccctactagactcacgggcgctaatagtgacatggaggaggaagagcgcggcgacctaatccagttttataacaacatctacataaaacagattaagaccttcgcaatgaagtattcacaggccaacatggacgctcctccgctttcaccttatcctttcgtcaggaccgggagtcccagaaggattcaacttagccaaaaccacccagtctacatctcccctcataagaacgagaccatgttgtcccctagggagaagattttctattacttcagtaatagcccgagtaagcgccttcgcgaaatcaactctatgattcggaccggcgagacccctacaaagaagcggggaatcctgctggaggacggctccgagagccccgccaagcgtatctgtcctgaaaatcactcagctcttctccggcgtctgcaggacgtggctaatgaccgcggttcacattag

SEQ ID NO: 26134 - DNA, 1668 bp, Artificial Sequence
  Description of Artificial Sequence: Synthetic coding sequence
atgcagagcctgaccaagggcaacgacctgcactggctggcctgcgctctttatgtggcctgcaggaaatccgtcccaactgtgtctaaaggcacagtagagggaaactacgtgtccctgacaaggatactgaagtgtagtgagcaatcattgatcgaattctttaataagatgaaaaaatgggaggacatggctaatttgccaccacacttccgcgaacggacagagcgactggagaggaatttcacagtttcagccgttatattcaagaaatacgagcccatattccaggatattttcaaatacccccaagaggagcaaccacgccagcaaagaggtcggaagcagagaagacagccgtgtaccgtgagtgagatctttcatttttgctgggtgctgttcatctacgctaaggggaattttcccatgatcagtgatgaccttgtgaatagttatcatctgctgctctgtgcactggatttggtttatggcaatgccctgcagtgttctaataggaaagagctggttaatccaaatttcaagggcttgtctgaggatttccacgctaaagattccaagccatcttctgatcctccatgcatcattgagaaactgtgttccctacacgacggcctggttcttgaagctaaaggtattaaagagcatttttggaagccttacattcgtaagttatacgaaaaaaaactccttaagggtaaggaagagaaccttaccgggttcctcgaacccgggaatttcggcgagtctttcaaagccatcaacaaggcttatgaagaatacgtgctcagcgtgggcaacctcgatgagcggatattcttaggtgaagatgccgaagaggaaatcggaactcttagcaggtgccttaatgcaggctctggaacagagacagccgagcgagtccagatgaagaacatattgcagcagcacttcgataagagtaaagctctgcgcatctccactcctttgacaggcgttcgctatattaaagaaaacagcccttgcgtgaccccagtgtccaccgccacccacagcctcagtcgcttgcacacaatgctgactggcctccgcaacgccccttcggaaaagctggagcagatcctccgaacctgcagccgggatcctacccaggccattgcgaaccggctcaaggagatgtttgaaatctattcccagcactttcagccagatgaggatttttctaactgtgccaaagagatcgcttccaagcatttccggttcgctgagatgctctattataaagtgttagagtcagtgatcgagcaggaacagaagcgcttaggcgatatggatctctcggggatcttggagcaggatgcgtttcacaggtctcttttagcctgctgtttggaagtcgtcactttcagttataaaccaccaggtaatttccccttcatcaccgaaattttcgacgtgccactctaccacttttataaagtcatcgaagtgttcatccgagccgaggatgggctgtgtcgcgaggttgtgaagcatctgaatcaaatcgaggagcagatattagaccacctagcctggaagcctgagagtcccctgtgggaaaagatccgagacaatgagaaccgggtcccgacttgcgaggaagtcatgccacctcagaatctcgagtag

SEQ ID NO: 26135 - DNA, 1557 bp, Artificial Sequence
  Description of Artificial Sequence: Synthetic coding sequence
atgatcagcgacgacctggtgaacagctaccacctgctgctgtgcgccctggatctagtctatgggaacgctcttcagtgttctaaccgcaaggaacttgttaacccaaacttcaaagggctgtcagaggatttccacgctaaagactcgaaaccaagcagcgaccctccgtgcatcatcgagaaactgtgcagcctgcacgacggccttgtgctggaggcaaaagggattaaggagcacttctggaagccctatatcagaaagttatacgagaagaagctgctgaaaggaaaggaggaaaatctgactggctttctggagccgggcaactttggggagagttttaaggctatcaataaggcttacgaagaatacgtactgtctgtggggaacctcgacgagcgcatatttcttggagaggatgctgaggaggaaattgggaccttgagtcgctgcctgaatgccggaagtggtaccgagacagcggagagagtccagatgaagaatattctacaacagcacttcgacaaatccaaggccctgcgaatctctacccccctgaccggggtgagatatatcaaggagaactctccctgcgttacacccgtaagtacggctacccacagtctgagtcggctccatacaatgttgaccggcctgcgaaacgcgccaagtgaaaagttggagcaaattctgcggacatgctctagggaccctacccaggctattgcgaatcgccttaaggaaatgttcgagatctacagccagcacttccagcccgacgaggacttctctaattgtgccaaagaaatcgcctcaaaacacttcaggtttgccgagatgctctattacaaagtgctggagtccgtcatcgagcaagaacagaagcgcctgggcgatatggatcttagcggcattctcgagcaggatgccttccacaggagcctgctggcgtgttgtctggaagtcgtgactttctcatacaaacctcccgggaatttcccatttatcactgagatttttgacgtgccgttgtatcatttctataaggtgatagaagtctttattcgcgccgaggacggcctctgtcgggaggtggtaaagcacctcaatcagatcgaggagcagatacttgaccacctagcttggaagcccgagtcacccctctgggagaagattcgcgataacgaaaatagggttccaacatgcgaggaggtcatgccacctcaaaatttggaacgcgccgatgagatttgtatcgccgggtctccaagaagaatacaactgagccagaaccacccagtgtatatctctccacacaagaatgagacaatgctgtcaccccgtgagaagattttttactacttcagcaattctccgtctaagagactccgggaaattaactctatgatccgtaccggcgaaacaccaactaagaaaaggggaatcttgctggaagacggcagtgaaagtcccgctaagaggatctgccccgagaaccacagcgcactcctacggagattgcaggacgtcgctaacgacagaggttcacactag

SEQ ID NO: 26136 - DNA, 1347 bp, Artificial Sequence
  Description of Artificial Sequence: Synthetic coding sequence
atgttcgactgcatggacgtgctgagcgtgagccccggccagatcttggacttttatacagctagcccttctagctgtatgctacaagagaaagccctgaaagcatgcttcagcggactcacccaaacagagtggcagcacagacacactgctcagtccatagagacccagtcaaccagctctgaagaactggtcccaagtcccccctcccccttgcccccaccaagagtttacaagccttgctttgtctgtcaggacaaaagctcgggctaccactacggtgtgagcgcctgtgagggatgcaaaggattcttccggaggtcaatccagaaaaacatgatttacacttgtcatcgcgacaagaattgcgtgataaataaggttacccgtaaccggtgtcagtattgtcgactccagaagtgttttgaagtcggtatgtctaaagaatcagtcagaaatgatcgtaataaaaaaaaaaaggagacaagcaagcaagagtgcaccgagagctatgagatgacagccgagctcgacgatctcactgaaaagattcgaaaagcgcaccaggagacattcccttcgctgtgtcaactcggaaaatacaccactaattcctcagccgaccatcgggtgcgactggatctcggattatgggataagtttagcgaactagcgacaaaatgcatcattaaaatcgttgagtttgcgaagcgcctaccaggctttacagggcttacaatcgctgaccagattaccctactgaaggccgcgtgtctggacattttgatcctgcgcatttgtactaggtatacaccggagcaggacacaatgactttcagcgacggtttgacacttaaccggacacagatgcacaacgccgggttcggccccctaacggacctggtctttacctttgctaaccagctgctgccactcgaaatggatgacaccgagaccggactcctgtccgccatctgtctcatctgcggagataggcaggatttggaagaacctacaaaagtggataaactccaggaacctctactggaagcattgaagatttacatcagaaaaagacggcccagtaaaccacatatgttccccaaaatcctgatgaagatcactgatctccggagcatcagcgcaaaaggcgccgaacgcgtcattacacttaagatggagatcccagggtccatgcccccactaatacaggagatgctggaaaatagcgaaggccatgaacctctaacgccttcctccagcgggaatacagctgagcatagcccctcaattagcccctcgtctgtcgagaattccggcgtctcccagtcccccctcgtccagtag

SEQ ID NO: 26137 - DNA, 1368 bp, Artificial Sequence
  Description of Artificial Sequence: Synthetic coding sequence
atgaccaccagcggccacgcctgccccgtgcccgccgtgaacggccacatgacccactaccctgctacaccctatccactcctatttccacctgtaatcggcggtctctctctgcctccccttcacgggcttcacggccacccacctcccagcggatgctctacacctagccctgcaaccatcgagactcagtctacatcctccgaggagctcgtcccgtctccaccatcgccccttccccctcccagggtgtataaaccttgctttgtgtgtcaggataagtcctccggctaccactacggagtgtcagcctgcgagggttgcaagggtttctttaggcggagcatacagaaaaacatgatttatacttgccaccgggataagaactgcgtgatcaacaaagtgacacgcaaccgctgtcaatactgtaggctgcaaaagtgctttgaggtgggcatgtcaaaagagtcagtgaggaacgacaggaataagaaaaaaaaggagacttctaagcaggaatgcactgagtcttatgagatgaccgcagagctagacgacttaaccgaaaagataagaaaagcacatcaggagactttcccgagcctctgccagctgggcaagtatactactaacagctccgcagatcatagagtccgtttagatctgggcctgtgggataaattttccgaactggctacgaagtgcatcattaaaatcgttgagttcgctaaaagactgcccggctttaccggtctgaccatcgcggatcagatcactctcctgaaggccgcgtgcctggacatactgatactccgtatttgcacccgctatacgcccgaacaggatacaatgacgtttagtgacggtttgaccctaaaccggacacagatgcataacgcaggatttggccccttaaccgaccttgtgttcacgtttgctaatcagctgcttcctctcgaaatggacgataccgaaacagggctgctctccgcaatctgtctgatttgtggggacagacaagatctggaagagccgaccaaagttgacaagctgcaggagcctttgttggaggcgctaaagatctacatacgcaaaaggcggccctccaaacctcacatgttccctaagatcttgatgaagatcaccgatttaaggtcaatcagcgctaaaggtgcagagagagtgatcacccttaagatggaaatccctggatcaatgcctcccctgatccaagaaatgctggagaatagtgaaggccacgagccactaaccccgagctcgtctggcaacacagccgagcatagtccctctatcagccctagttcggttgagaattcgggtgtatctcagtcccccctggtgcagtag

SEQ ID NO: 26138 - DNA, 1011 bp, Artificial Sequence
  Description of Artificial Sequence: Synthetic coding sequence
atgatctacacctgccaccgggacaagaactgcgtgatcaacaaggtgacccgaaatcggtgccaatactgtcgcctccaaaagtgtttcgaggttggcatgtctaaggaaagcgttcggaatgaccgcaacaaaaaaaagaaagagacatccaaacaggagtgtaccgagtcctatgaaatgaccgcggaattggacgatctgaccgagaaaatccgcaaggcacatcaggagactttcccttccctgtgtcagttgggcaaatacacaacgaacagtagtgctgatcatcgagtgcgtctggacctcggcctctgggacaagttttccgagctggcaacaaaatgcataataaagatcgtcgaattcgccaaacgtctgcccgggttcactggcctcacaattgcagatcaaattactctgctcaaggctgcgtgtttggacatcctgatccttagaatttgtacgaggtacaccccagaacaggataccatgacgttctccgatggacttacgctgaaccgcactcaaatgcataatgccggcttcggccccctgaccgacttggtgttcacattcgccaaccagctgttaccgttggaaatggatgacaccgagaccgggttactaagtgcaatttgtcttatatgcggagaccgccaggatctggaagagccaactaaggtcgataagctgcaggagcctctcctggaggcattgaagatctatattcgcaagcggcggccaagtaagccccacatgttccctaagatattgatgaagattaccgacctgaggagcattagcgccaagggggccgagcgggtgatcaccctgaaaatggaaataccaggatctatgccccccttaatacaggaaatgctggagaattccgaaggacacgagccacttactccgtctagctctggcaacaccgcagagcactcccccagcatttccccctctagcgtggaaaatagtggcgtgagtcagtcaccattggtgcagtag

SEQ ID NO: 26139 - DNA, 1011 bp, Artificial Sequence
  Description of Artificial Sequence: Synthetic coding sequence
atgatctacacctgccaccgggacaagaactgcgtgatcaacaaggtaacaagaaacaggtgccagtattgtcgcctccaaaaatgcttcgaggttggcatgtccaaagagtccgtcagaaacgatcgaaacaaaaaaaaaaaagaaaccagcaaacaggaatgcaccgaaagctacgagatgacggccgaattggatgatctgactgaaaagattagaaaagcccatcaggagacctttccgtctctgtgtcagttaggtaagtacaccacaaactccagtgctgatcaccgcgtgcgcctggaccttggattatgggacaaattttcagagctggcaactaagtgtattatcaagatcgttgaattcgccaagagactacccggattcactggactcactatcgccgaccagattaccctgctgaaagctgcttgtctcgacattctgattctgagaatctgcactcggtatacaccagaacaagacactatgacattctcggacgggctgacattgaatagaactcaaatgcacaatgctggctttggccccctgactgacctggtgtttacgtttgccaaccagctcctgccactggaaatggacgacacagagactggtctcttgtccgccatatgcctaatttgtggtgatcgtcaggacctggaagaacctacaaaggtagataagctccaagaacctctcctggaagctttaaaaatctacatcagaaaaagacgtccgagcaaaccacatatgtttccaaaaatactaatgaaaatcaccgatctgcgatccatttccgcaaagggcgccgaaagggtcataacattaaagatggagatcccgggctccatgccgcccttgattcaggagatgctcgaaaatagtgagggccatgagccactcaccccctcatcctcagggaataccgccgaacatagcccaagcatttcaccttcctctgtggagaatagtggcgtctcgcagtctccgctggtgcagtag

SEQ ID NO: 26140 - DNA, 1326 bp, Artificial Sequence
  Description of Artificial Sequence: Synthetic coding sequence
atgaccaccagcggccacgcctgccccgtgcccgccgtgaacggccatatgacgcactaccccgcgactccatatccactgctatttccacccgtgattggagggttatcactgcctcctctgcacgggctgcacggccacccaccgccaagcgggtgttctaccccatcgcctgccacaattgaaactcagagtacttcctccgaagagctcgtgccctccccacctagtccgttgcccccccctcgagtgtacaaaccatgttttgtgtgtcaggacaaaagttctggataccactacggagtaagcgcatgtgaagggtgtaaaggattttttcgaaggtccatccagaaaaacatgatatacacctgccaccgtgacaaaaattgtgtcattaacaaggtaacgcggaatcgatgtcagtattgtcggctgcagaagtgcttcgaggtgggaatgtccaaagagagcgtccgcaacgacagaaacaaaaagaagaaagagaccagtaaacaggaatgtaccgagtcttacgagatgaccgccgagctggacgacctgaccgagaagatccgcaaggctcaccaagagacctttccctcactgtgccagcttggaaagtatacaacgaatagctcagcagaccacagggtaaggcttgatctaggcctgtgggacaagttttcagagctagccaccaagtgtattattaagattgtggagttcgccaaaagacttcctggcttcacgggtctgacaatcgccgaccaaattaccctcctaaaggctgcatgtctcgacattttgatccttaggatctgtacacggtacacccccgagcaggatacaatgaccttctctgatgggctgacactgaacagaacacagatgcataacgccggctttggacctctaaccgacctggtctttacattcgccaaccagctccttccactggaaatggatgataccgaaacaggcctgctgtctgctatctgtctgatctgcggcgataggcaggacttggaagagcccacgaaagtcgacaaactgcaggagccgttactggaagcgctgaagatttatatcagaaaacggcgtccaagcaagccgcatatgtttcctaaaattctgatgaagatcaccgaccttagatccatatcagcaaagggggccgagcgcgtcatcactttgaagatggaaattcctgaggggcatgaaccactgaccccaagctcatctggcaacaccgccgagcacagcccttcaatttccccatcttcggtggagaacagcggagtttcacaatctcccctggtgcagtag

SEQ ID NO: 26141 - DNA, 462 bp, Artificial Sequence
  Description of Artificial Sequence: Synthetic coding sequence
atggacccccccgccggcttcgtgcgggccggcaaccccgccgtggcagccccccaaagcccattgagtccggaaggagctcacttcagagcggcgcatcaccctagaagcaccggctcccgttgccccggaagtctccagccgtcgcgacctctggtcgccaactggctgcagtcactgcccgaaatgccagtggacttcactggctactggaaaatgctggtgaacgaaaacttcgaagagtatctgcgggctttggatgtgaacgttgcactgcgcaagattgcaaatctgctgaagccagataaggaaatcgtacaggatggcgaccatatgattattcggacattgagtacattccgcaattacatcatggacttccaagttggcaaagaatttgaagaagatctcactggaattgacgatcggaagtgtatgtccgagactggcttctcttcctag

SEQ ID NO: 26142 - DNA, 405 bp, Artificial Sequence
  Description of Artificial Sequence: Synthetic coding sequence
atgacccgggaccagaacggcacctgggagatggagagcaacgagaattttgaaggctacatgaaggccctagacattgatttcgcgacgcgcaagattgcagtgagactgacccaaactaaggtgatcgaccaggacggagacaattttaaaaccaagaccacttctacattccgaaattatgatgtggactttactgtcggagttgaatttgacgagtataccaagtcactggataatcgccacgtcaaggccctggtaacatgggagggagacgtcctagtgtgtgtgcaaaaaggggagaaagaaaatcgtggttggaaacagtggatcgaaggcgataagttgtacctagaattaacatgtggcgaccaagtatgtagacaagtcttcaagaaaaaatag

SEQ ID NO: 26143 - DNA, 474 bp, Artificial Sequence
  Description of Artificial Sequence: Synthetic coding sequence
atggacccccccgccggcttcgtgcgggccggcaaccccgccgtggcagcaccccagagccctctatcccccgaaggtgctcactttagggccgcccaccatccaaggtcaactggatctagatgccccggatctcttcaaccatctaggccccttgttgcaaattggctccagagcctccctgaaatgcccgtggatttcaccggttattggaaaatgctagtaaatgagaatttcgaagaatatctcagggcacttgatgtgaatgtcgctctgcgcaagatagccaacctgctgaaacccgacaaggaaatcgtacaagacggtgatcatatgatcatacggactctgtccacattccggaactatattatggacttccaggttggcaaggagtttgaggaagatctgacggggattgatgaccgcaaatgtatggctggagtgcagtctagggatctttcgtctctctag

SEQ ID NO: 26144 - DNA, 3756 bp, Artificial Sequence
  Description of Artificial Sequence: Synthetic coding sequence
atgcggcggggcggctggcggaagcgggccgagaacgacggctgggaaacgtggggcggttatatggccgctaaagtgcagaaactggaagaacaattcaggagtgacgcggccatgcaaaaagacggcacaagcagtactatatttagcggagtagctatatacgttaacggatataccgaccctagtgcggaggaactgagaaagctgatgatgctccacggagggcaataccacgtgtactattctagatctaagaccacacacattatcgccactaatctgccaaacgcgaagatcaaagaactgaagggggaaaaagttattcggcccgagtggatcgtcgagagcattaaagccggcagactgttgtcctacatcccttaccagctgtatactaaacagtctagcgtccagaaggggctttccttcaacccagtgtgcaggccagaagatccactgccgggcccaagtaacatcgctaagcagctgaacaacagggtgaatcacattgtgaagaagatcgaaaccgagaatgaggtcaaggtaaacggaatgaatagctggaacgaggaggatgagaataacgacttttcctttgtagacctggaacagacctcacccggacgaaagcagaatggcatcccgcatcccaggggctctaccgccatattcaatggccacaccccctcaagtaacggggccctgaagacacaggactgccttgtgccgatggtgaactcagtcgcatctagattgtctccagctttcagtcaggaagaagataaagcagagaaaagctcaaccgatttcagggattgcacgttgcaacagctccagcaaagtacccgtaatacggatgcactccggaatcctcaccgcacgaatagcttctcactgagtcctctgcattctaataccaagatcaatggtgcccatcattccacagttcagggcccgtccagcaccaaatcaacatcctctgtgtcaaccttcagtaaggctgctcctagcgtcccctccaagccttctgactgtaattttatctcaaatttctattcacactcaaggctccaccacattagcatgtggaagtgcgagctgaccgaatttgtaaatacattacagaggcagagcaatgggattttccccggtcgtgagaaactcaaaaaaatgaaaactggaaggtctgctctggtcgtgaccgatactggagatatgagtgtgttgaacagcccaagacatcagtcatgcattatgcatgtggacatggattgctttttcgttagcgtgggcatccgcaacaggcccgacctcaaagggaaaccggttgctgtcaccagcaacagaggaacgggccgtgcacccctgcgccccggtgccaatcctcagcttgagtggcaatattaccagaacaaaatcctaaagggcaaggcagctgacatcccagacagttccctctgggaaaaccctgacagtgcccaagcaaatggtatagactccgtgctgtcacgagccgagattgcctcctgcagctatgaggcccgacagcttggcattaaaaacggtatgttctttggtcacgccaagcagctgtgccccaacctgcaagctgtgccttacgatttccacgcctacaaagaagtggctcagaccctctacgagaccctggcctcttacactcataatatcgaggctgtctcatgtgatgaagcgctggtagatatcacagaaatcctggcagagaccaagctgacccctgatgagttcgcgaacgctgtacgtatggagattaaagatcagaccaagtgcgccgcctccgtcggcatcgggtccaatattctccttgctagaatggccacccgcaaggctaaacctgatggacagtaccatctcaaaccagaggaggtggacgacttcatccgaggtcaactcgtcacaaacctgccgggagtgggccacagcatggagagcaaacttgcttcccttggcataaagacgtgtggcgatctccaatacatgacgatggctaagctgcaaaaggaattcggtccgaagaccggccaaatgctctatcgtttttgcagaggtctggacgataggccagtccgcaccgagaaggagcgaaaaagtgtgtctgccgaaattaattatggcattcggttcacccagcccaaagaggcagaggcctttctcctgagcttaagcgaggagattcagcggagactggaagctaccggaatgaaggggaagcgccttacactgaaaattatggtgcgaaagcctggtgcccccgtggagacggctaagtttggcgggcacgggatctgtgataatatcgcccggaccgtgacgttggatcaggccacagataacgctaaaattatcggcaaggccatgctaaatatgtttcatacgatgaagctgaatatttcagacatgcgaggagtgggcatccacgtaaatcaactcgtgccaactaaccttaatccgtctacttgtccctctcgaccctccgttcaatcaagccacttcccgagtggatcttattccgtccgggacgtctttcaggtgcagaaggccaaaaaatccacggaggaggagcacaaggaggttttccgggccgcggtcgatcttgaaatctcttccgcaagccgcacatgtacatttctccccccgttccccgctcatctgcccacttcacccgacacaaataaggcagagagctccggcaagtggaacggcctccatactccggtctccgtgcagtctcggctcaatctttctattgaagtacccagccccagccagttagaccagagcgtgctagaagcactgcctcctgacctgcgagagcaggtggagcaggtgtgcgctgtgcagcaggccgagagtcatggcgacaaaaagaaagaacccgtcaacggatgcaatacgggaattctacctcagcctgttggaaccgtactccttcaaattcccgagccacaggaaagcaactcagatgccggcattaacctgatcgctctgcccgctttcagccaggttgatccagaggttttcgctgcacttccagccgaactacagagagagctgaaggctgcttacgaccagaggcaaagacagggagagaactcgacccaccagcagagcgccagcgccagtgtccccaagaatccccttcttcacctgaaggcagctgtcaaggaaaaaaagcgcaacaaaaaaaagaagaccatcggcagtccaaaacgtatccaatctccactcaataataagcttctgaactcccctgccaagaccctccccggcgcttgtgggtccccacagaaactgatcgacggctttcttaagcatgaggggccccccgccgaaaaacccttggaagagctgagcgctagtaccagcggtgtacctggcctttccagcctccaatctgatccagcaggttgtgtgcggccgcccgcacctaacttggccggagccgtggagttcaacgatgtgaagaccttgttgcgcgaatggataaccacaatctcagaccccatggaagaagacattctgcaggtggtcaagtattgtaccgatttaattgaagagaaggacctggaaaagctagaccttgtcatcaaatacatgaagcgcctcatgcagcagtcagtggaatctgtgtggaacatggccttcgattttattctggacaatgttcaagttgtgctccaacagacttatggttccactctcaaagttacctag

SEQ ID NO: 26145 - DNA, 3753 bp, Artificial Sequence
  Description of Artificial Sequence: Synthetic coding sequence
atgcggcggggcggctggcggaagcgggccgagaacgacggctgggaaacttggggtggatatatggccgcgaaagtgcaaaagctggaggagcaattccgaagtgacgctgcaatgcagaaggatggcacatcatcaacaattttttcaggtgttgccatctatgtcaacggctatacagaccccagcgctgaagaactgagaaaactcatgatgctacacggcgggcagtatcacgtgtattatagccggtcgaagaccacacatattatagccacaaacctgccgaacgctaagattaaagaactgaaaggcgagaaagtgatccgtccagagtggattgtcgagtccataaaggcgggccggctgctgtcctacattccatatcagctatacactaaacagtctagcgtccagaagggcctgagctttaatcccgtatgccggccagaggaccctttgcccgggccctccaatatcgcgaagcaactgaacaaccgggtgaatcacatcgtgaaaaaaatcgaaaccgaaaacgaggtgaaagttaacggcatgaattcttggaacgaagaggacgaaaacaacgatttcagtttcgttgacctcgagcagacatctcctggcagaaagcaaaatggcattccacatccgcggggctccaccgcaatctttaatgggcataccccgagtagcaatggggctcttaagactcaggactgcttggtgccaatggtgaattctgtggcttcaaggctctctccagcattctctcaggaagaggacaaggctgagaagtcatcaacagactttcgggattgtaccctccaacagctgcaacagtctacgcgcaacaccgatgcattaagaaacccgcaccgcactaactctttcagcctgagtccccttcatagcaacaccaagatcaatggtgctcatcactcaactgtgcagggaccctcttctactaagagcaccagctctgtgtccaccttttccaaggccgcgccatcagtgccctcaaagccttcagattgcaattttatcagcaacttctattcccactctcgtctccaccatatttctatgtggaaatgcgagctcacagaatttgtgaatacattacagcggcagtccaatggcatctttccgggtcgagaaaaactaaagaaaatgaaaacaggacgctccgccctggttgttaccgatactggagacatgagtgtcttaaatagcccacgacatcaatcctgcatcatgcacgtggacatggattgtttcttcgtttctgtcgggatcaggaatagacccgatctgaagggcaaaccagtggcagtgacatctaacagggggactggtcgtgcgcccctgcggcccggggccaatcctcagctggagtggcagtactatcagaataaaattctcaaagggaaggccgatatcccggattcttctctgtgggagaatccggactcagcacaagccaacggaattgattcagttcttagtcgagctgagattgctagctgcagctacgaggctaggcagctcggaataaaaaacggaatgttcttcggccacgccaaacaactgtgtccaaatcttcaagcagttccctatgattttcatgcctataaggaagttgctcagacactctatgagacactcgcatcttatacacacaacatcgaagcggtgtcttgcgacgaagcactggtggacattactgagatcctcgctgagaccaagctgacacccgacgaattcgctaacgccgtccgtatggaaattaaggatcagactaaatgcgccgctagcgtggggatcggttcaaacattctcctggcacgaatggccacaagaaaagcaaagccagacggacaatatcatctgaagcctgaggaagtggacgatttcatacgcggccagttggtgaccaatctgccaggagtggggcactccatggaatcaaaactcgctagcttgggaataaagacatgcggtgatctccaatatatgacgatggcaaagctgcaaaaggaattcggacctaaaaccggccaaatgctttaccggttttgcagaggtcttgatgaccgccccgtgcggaccgagaaggagaggaaaagcgtcagtgccgaaattaactacgggattaggttcacacaaccgaaggaggctgaggcattcctgctttcactcagcgaggaaatacaacggcgactagaggccacgggcatgaaaggcaaacgcctgaccctgaagattatggtaagaaaaccaggagcccccgtcgagacagcaaagtttggaggccacggtatctgcgataacatcgctcgtactgtgacgctggatcaagcaactgataatgccaaaattatcgggaaggccatgctcaatatgtttcataccatgaagctgaacattagtgacatgcgaggcgtgggcattcatgtcaaccagttggtcccaactaaccttaatccttccacttgtccaagccgccccagcgtgcagtctagtcacttccccagcgggtcatactcagtgagagacgtgttccaagtgcagaaggccaagaaatctaccgaggaagagcacaaggaggtttttagggctgcagtggacctggagatcagctccgcctctagaacatgcactttcctgccacctttccccgcacacctgcccacttccccagacactaacaaggccgagagctcagggaagtggaatgggctgcacacccctgtctcagtccagtcacgactcaacctgtcgattgaggtaccatccccctcccagctcgaccaaagcgttttggaggccctaccccccgaccttcgggagcaggtcgaacaggtgtgtgctgttcagcaagctgagagccatggtgataaaaaaaaggaaccagtgaacggctgcaacactggaatcttaccgcagcctgtgggaactgttctgctgcagatccctgaaccccaagaaagcaactctgatgccggtataaatctgattgccctgcccgccttctcccaagtggatcccgaggtttttgccgccttacccgccgagcttcaaagagagttgaaggccgcctacgatcaaagacagaggcaaggagaaaattctacgcaccagcagagcgcaagcgcttcagtgccaaagaatcccctgctgcatttaaaggccgcagtcaaggagaagaaaaggaacaagaagaagaagaccatcggctctcctaagcgcatccagagccccctaaacaataagcttctcaactcccctgccaagactctccctggagcatgcgggtccccacagaaactcatcgacggttttctcaagcatgagggacctcccgccgagaagccattggaggagctgtcagcatccacaagtggggtgccggggctgtccagtctgcagtcagatccagctgggtgtgtgcggccccccgcgcctaaccttgcaggagcggtcgaattcaatgatgtgaaaactctgttgagggagtggatcaccacgatcagtgatcccatggaagaagacatcttacaagtggttaagtactgtactgatttgatcgaagagaaggacctagagaagctcgatctcgtgatcaaatatatgaagagactgatgcagcagtccgtcgaaagcgtgtggaacatggcttttgactttatcctcgataacgttcaggttgtgctgcagcagacttacggctcgacactcaaggtaacctag

SEQ ID NO: 26146 - DNA, 2916 bp, Artificial Sequence
  Description of Artificial Sequence: Synthetic coding sequence
atggccaccgtgcgggccagcctgcggggcgccctgctgctgctgcttgccgtggcgggagttgccgaggtggctggcggtcttgcgcctggctccgcaggtgctctgtgctgtaatcacagtaaagacaatcaaatgtgcagggatgtttgcgagcagatcttttcttccaagtctgagtcacgactgaagcacctgctgcagcgggcccccgactattgccctgagaccatggtggaaatttggaattgcatgaattcctcacttccgggtgtgttcaaaaagtctgacgggtgggtgggcctgggatgctgtgagctggccatcgccctggagtgtcgccaagcgtgtaagcaggcttcttccaagaatgatatctccaaggtgtgcagaaaggagtatgaaaacgccctcttttcatgcatctctcggaacgagatggggagtgtgtgttgctcttacgcaggccaccataccaactgccgcgagtattgccaggccatcttccgcactgacagtagccccggccccagccagatcaaagctgttgaaaactattgtgcctcaatcagcccacagttgatccattgcgtcaataactacactcagagctaccccatgcggaacccaactgactcattgtattgctgcgatcgcgccgaagaccacgcatgtcagaacgcatgcaagcgaattttaatgtcaaaaaaaacagaaatggagattgttgacgggttgatcgaggggtgcaaaacccagccacttccgcaggatcctctctggcagtgcttcctggaaagcagtcaaagtgtgcacccaggagttactgtccatcctcctccaagcacaggcctcgacggagctaaactgcactgctgctcaaaggcaaatacctccacctgtcgggaactgtgcactaagctgtattcgatgagctgggggaatacgcaaagttggcaggaatttgatcgcttctgtgagtacaatcccgtcgaagttagtatgctcacctgtctggctgatgtacgtgagccgtgccagcttggttgccgcaatctgacctactgtacaaactttaataatcgccctacagaattgttccgatcatgtaacgcccagagcgatcagggagccatgaacgacatgaagttgtgggagaagggaagtattaaaatgccttttatcaatatcccagtgctggatatcaagaagtgccaacctgaaatgtggaaggccatcgcctgctcgctgcagatcaaaccttgtcacagcaaatccaggggcagcataatttgtaagtccgactgcgtcgagatcttaaagaagtgtggagatcaaaataagttccccgaggatcatacagccgagtctatttgtgaactgttatccccaactgatgatctgaagaactgcattcccttagatacctacctgcggcctagcacactgggcaatatcgtcgaagaggtgactcacccttgcaacccaaacccatgtcccgccaacgagctgtgcgaggttaatcgtaaaggatgccccagtggagacccttgcttaccatacttctgtgttcagggctgcaaactcggggaggcgtcagacttcatcgtcagacagggaacactgattcaggtaccttcatcggcgggagaagtcgggtgctataagatctgcagctgcggtcaaagcggcctgctggagaactgtatggagatgcactgtattgatttacagaaatcgtgtattgtcggggggaagaggaagtctcacggaacaagctttagtatcgattgcaatgtatgttcttgttttgctgggaatctggtatgtagtacccgattgtgtctttccgagcactctagtgaagatgaccggaggacatttaccggcctgccctgcaattgcgccgatcagttcgtgcccgtgtgtggtcagaacggcaggacatacccctcggcctgcattgcccggtgtgtgggactacaggatcaccagttcgagtttggctcctgcatgagcaaagatccgtgcaaccccaatccgtgtcaaaagaatcagaggtgtatccccaagcctcaggtgtgtctgacaacattcgataagttcggatgttcacaatatgaatgtgtacctcggcagctagcctgtgatcaggtgcaggaccccgtctgcgatacagaccacatggaacacaataatttgtgcaccctatatcagaggggtaagtctctgtcgtacaaaggaccgtgccagccattttgcagggccactgagccagtgtgcggtcataatggagaaacatacagctctgtgtgcgcagcctattccgatagagtcgccgttgactactacggagactgccaagccgtaggtgttctcagcgagcacagttccgtggctgagtgcgccagtgttaaatgcccatccctcctggcagccgggtgcaagccgatcatcccccctggcgcctgttgtccactttgcgctgggatgctgagggtgctcttcgacaaagagaagttagacaccatcgcaaaagtgaccaacaaaaaacctattaccgtactggagatccttcagaagatccggatgcatgtatctgtcccccagtgtgatgtatttggctacttctcgatcgaatccgagatcgtaatcctcataattcccgtggaccactatccaaaggctctccagatcgaagcttgtaataaggaggctgagaagattgagtcattgatcaatagcgatagccccacccttgcctcccacgtgcccttaagcgcattaataatcagccaggtgcaggtgtcgtcctctgtgccctccgcaggggtaagggccaggccttcctgccacagcctgctgctgcctcttagcttgggtctagcgctgcatttactgtggacatacaattag

SEQ ID NO: 26147 - DNA, 735 bp, Artificial Sequence
  Description of Artificial Sequence: Synthetic coding sequence
atgaaggagcggcgggccagccagaagctgagcagcaagagcatcatggaccccaaccaaaacgtaaagtgcaaaatagtggtcgtcggtgactcacagtgcggcaaaactgccttactacacgtgttcgccaaagactgtttccctgaaaattatgtaccaacggtgtttgagaactataccgctagttttgagattgatacccaacgcattgagctgagcttgtgggatacctccgggagtccatactacgataacgtgcgccctctgtcctatccggactctgacgccgtgctgatctgcttcgacatctccagaccagaaacactggactcagtgttaaagaaatggaaaggtgaaatacaggagttttgcccaaacacaaaaatgctacttgtggggtgtaagagcgacctccgaaccgacgtctccactctcgtggagctgtcaaatcatcggcaaacgcccgtctcctatgatcagggcgctaatatggcaaagcagatcggcgctgcaacctacattgaatgttcagcattgcagtccgagaattctgttagagacattttccatgtagccacactggcctgtgtcaataagacaaacaagaatgtgaagagaaacaagagtcagcgagccaccaagcgaatatcacatatgccgtcaagacccgagctgtcggctgtcgctactgacctcagaaaggacaaggctaagtcctgcactgtcatgtag

SEQ ID NO: 26148 - DNA, 735 bp, Artificial Sequence
  Description of Artificial Sequence: Synthetic coding sequence
atgaaggagcggcgggccagccagaagctgagcagcaagagcatcatggatcctaaccagaatgtaaaatgcaaaatcgttgtggtgggcgatagtcaatgcggaaagaccgcactgttgcacgtattcgccaaagactgttttcctgaaaactacgtgccaacagtttttgagaattatactgccagcttcgagatcgacactcagcgcatcgagctttctctgtgggacaccagcggcagtccttattatgacaatgtgcggccattgtcctaccccgacagtgacgccgtgttaatctgtttcgacattagccgtccagaaaccctagacagcgtgctaaaaaaatggaaaggcgagattcaggagttctgtccaaacactaaaatgttgttggtcggctgcaaaagtgatctgcgaaccgacgtgtccaccctggttgaactgtcaaaccaccggcaaactccagtgtcatatgaccagggggctaacatggcaaaacagattggtgccgccacatatattgaatgctctgcgctgcagtccgaaaactctgttagggatatcttccacgtagctaccttggcctgcgtgaacaaaacaaataagaatgtaaaacgcaataagagtcaacgagcaactaagaggatctctcacatgccctcccggcccgaacttagcgctgtggccacagatctgaggaaggataaagctaagtcttgcaccgtcatgtag

SEQ ID NO: 26149 - DNA, 348 bp, Artificial Sequence
  Description of Artificial Sequence: Synthetic coding sequence
atgctgctggtgggctgcaagagcgacctgcggaccgacgtgagcacactggtggaactgagcaaccataggcaaacacctgtaagttacgatcagggggccaacatggcaaaacagattggagctgcaacttatatcgagtgctccgccttacaatccgaaaactcggtgcgggacatttttcacgtcgctactctggcctgtgtgaataaaaccaataagaacgtgaaacggaacaaaagccagcgcgctacgaaacgcatcagtcacatgccgtccaggcctgagctgtcagcagtggcgactgacctcaggaaagataaagctaagagttgtaccgtgatgtag

SEQ ID NO: 26150 - DNA, 351 bp, Artificial Sequence
  Description of Artificial Sequence: Synthetic coding sequence
atgaaggagcggcgggccagccagaagctgagcagcaagagcatcatggaccctaaccaaaacgttaagtgtaagatcgtcgtggttggcgacagccaatgcggaaagactgcactcttgcacgtgttcgccaaggactgcttccccgaaaattacgtgcccactgtgtttgaaaactacaccgcaagcttcgaaatagacacccaaaggatcgagctcagcctatgggataccagtggcagcccttattatgacaacgttcgtccactgagttaccctgacagcgatgccgtcttgatctgcttcgacattagcaggcctgagaccttagatagcgtgctgaagaagtag

SEQ ID NO: 26151 - DNA, 351 bp, Artificial Sequence
  Description of Artificial Sequence: Synthetic coding sequence
atgaaggagcggcgggccagccagaagctgagcagcaagagcatcatggatcccaatcagaatgtgaaatgcaaaattgtggtcgtgggtgacagccagtgtgggaagacagccctcttgcatgtttttgctaaggactgcttccccgaaaactacgtgcctaccgtttttgaaaactataccgccagcttcgagatcgatactcagaggattgagttgagcctgtgggatacttcagggtccccttactatgataatgtgaggcccctttcataccctgattcagatgccgttcttatctgttttgacatcagccgaccagaaactctggacagcgtgctaaagaagtag

SEQ ID NO: 26152 - DNA, 615 bp, Artificial Sequence
  Description of Artificial Sequence: Synthetic coding sequence
atggccgagcaggagcccaccgccgagcagctggcccagatcgccgcagagaatgaggaagatgagcatagcgtaaactataagccccctgcccagaaatcaattcaggaaattcaagagttagataaggatgatgagtcactgcgaaagtacaaagaagcactgcttggaagagtcgccgtctcggctgatcctaacgtgcccaacgtcgtagtgaccgggcttactttggtgtgttcctccgcgccaggcccattggaactcgatctgaccggcgatctcgagtccttcaaaaagcagtctttcgtcctgaaggagggagtggagtatagaattaagatctcctttcgcgtgaacagagagatcgtgagtggtatgaagtacatacagcacacctaccgaaagggcgtaaaaatcgataaaacagactacatggtggggtcttacggacctcgggccgaggagtacgaattcctcaccccagttgaggaagctcccaaaggaatgctagcccgcggtagctattcaattaaatcgaggttcacagatgacgataagacagatcacttatcttgggagtggaacctgaccattaagaaggactggaaggattag

SEQ ID NO: 26153 - DNA, 537 bp, Artificial Sequence
  Description of Artificial Sequence: Synthetic coding sequence
atggccgagcaggagcccaccgccgagcagctggcccagatcgccgcagagaacgaggaggacgagcacagcgtgaattacaaaccccctgcacagaaatctattcaggagattcaggaattggacaaagatgacgagagtctaagaaagtacaaggaggccttactaggcagagtggctgtcagcgccgatcccaacgtgccgaatgttgtggtgacagggttgaccctggtatgcagtagtgcccccgggcccctcgaattagacctaaccggggacctggaaagtttcaaaaagcagagctttgtcctaaaggagggggtggagtacaggattaaaatttcattcagggtcaatagggagatcgtcagtgggatgaaatacatccagcatacgtacaggaagggtgtgaagatcgacaaaacagattacatggtgggttcctactctatcaaatcaagattcacagatgatgacaaaacagaccacctttcctgggagtggaacctaaccatcaagaaagactggaaggattag

SEQ ID NO: 26154 - DNA, 615 bp, Artificial Sequence
  Description of Artificial Sequence: Synthetic coding sequence
atggccgagcaggagcccaccgccgagcagctggcccagatcgccgctgagaatgaggaagacgaacattctgtgaactacaagccccctgcacagaagtccattcaagaaatccaggagttggacaaggacgatgagtccctcagaaaatataaggaggccctgttgggtagagtagctgtgagtgccgacccaaacgtgccaaacgtggtcgtaacgggcctgaccctggtctgctcctctgcccccggccctttggagcttgatttgactggggatctggagagcttcaaaaaacagtcttttgtactgaaggagggcgtggaatacagaattaagatcagcttcagggtgaaccgcgagatcgtgagtggcatgaaatacattcagcacacttatcggaaaggtgtgaaaattgacaaaaccgattacatggttggatcctatggccctagagcggaggagtacgaatttctgactcccgtcgaggaggcccccaaggggatgttagcccgcgggagctactccataaaaagccggttcacggacgacgacaaaaccgaccatctaagttgggagtggaatctgacaattaagaaggactggaaagactag

SEQ ID NO: 26155 - DNA, 3576 bp, Artificial Sequence
  Description of Artificial Sequence: Synthetic coding sequence
atggaggccatgagcccccagcaggagaccctgggcggccagcccgggaggagcagctcactcacaggggtttcgcggctggcagggggctcttgcactaagaaaaaaatgaagacattggcagagcgcaggcgcagcgccccctcactgattctggataaagcgcttcagaagagaccaactacaagagatagcccgtctgcatccgttgacacatgtacatttctgtcatctcttgtttgttctaacaggacccttttgatcgacggccgtgccgaactcaaacggggactgcagcgccaggagaggcatctgttcttattcaacgatctgtttgtcgtcgccaagattaaatacaacaataactttaaaatcaagaataaaatcaagctcaccgacatgtggacagcttcctgcgtggatgaggtaggcgagggcaacacaaatgccatgaagtcctttgtcctggggtggcccactgtaaacttcgtcgccacgttctcgagtcctgaacaaaaggataaatggctctctctcctgcagagatatattaatctggagaaggaaaaggactacccaaagtcaatccctctgaagattttcgctaaggacatcgggaattgcgcttattcaaagacaattactgtaatgaactctgatacagctaacgaagtaatcaacatgagtcttccaatgctcggaattactggctccgagcgggactatcaactctgggtaaactcaggcaaagaggaagctccataccccctgattgggcatgaatacccttacgggatcaagatgagccacctgcgggattccgctctgctgacacccggcagcaaagactccacaactccttttaacctgcaagaaccctttctcatggaacagctgccaagagaaatgcagtgccagtttattttgaaaccgagtcgcctcgccgctgcgcagcagctgagcgacagcggccacaaaaccttcaagcgaaggaggtcaattattaattgggcattttggcgcggaagcagcactcatctggacaacctacccagctccccaacctctcccatgcctggccagttgttcgggatttcactcccaaacatttgtgagaacgacaatctgcctaaacctgttctcgacatgctcttcttcctaaaccagaaagggccactgacgaagggaatctttcgtcaaagcgccaatgtgaaatcatgcagggagctgaaggaaaaactaaattcaggagtggaggtgcacctagactgcgagagcatttttgtcattgcatctgttctgaaggactttttgcgtaacattcctggatccattttcagcagcgacctctacgatcactgggtctctgtgatggaccaaggcaacgacgaggagaaaattaacaccgtgcagaggcttctggatcaacttccccgggcaaacgtggtgctgttaagatacctctttggagtgctgcataatatcgagcaacactcatcatcaaaccagatgaccgctttcaacttggccgtgtgtgtcgccccttccattctgtggccacctgccagtagtagcccagagcttgagaatgaatttaccaagaaagtctctctccttatccagtttctcatcgagaactgtctcaggattttcggggaggaaattacatctttgtttcgggaagttagtgtgcggtgcgacaccagggaaaatgcgtcagatatcagctgcttccagttgaacgatagctcgtatgactccctggagaacgaactgaatgaagatgtcgatgccccgtgtagcgacctcgtgaagaagctgggccagggcagtcgctcaatggattccgttctgactctttccgactatgacctggaccaacctgaggtagaaggcctcctgaccttgtctgatttcgatctggcccacagtaaagatgaagacgtgcaaatgaagagacccctagagagcaagcctgtaaacatcttggtgtatacaaagattcctctgcgggatcacgccagagcgcccagcgccatgtgtacgccctcttatctcagtacagctgcagccaatgccgccaaaagtctccgacggcacagacggtgcagtgagccttctatagactaccttgactccaagctgtcatatcttagggaattttaccagaaaaagctgagaaaaagctcgtgtgatgcaattttgtcccagaaagacgaggactacctgaagcaaaaccagcctctacaagaggaaggcaaaacctgtttcaagcagagcctcgtgacgggaacagacgtgtccaagaagaacgccacgactcagaacactaaaaaaaagtcattgtcagggagtgagggcaatcacgtgaaattattccccaaatctaaaccggtcgccatctctgtggccagttatagccccatgtcgtcacaggaccattctaaaaaccagccatttgatgtgaacacatcaggctactctcctcctcataccgcagacgcccttaaaggcccacgtactcatcgtcgatgctctgagcccaacatcgaggatcaaaacaggaagctcacctacttgagaggaatttactcgaaaaagcagcacaaaactagttgcgaggctggcctcctccatggggaggaggactaccttaaacgacataaatcccttcaaatggaaggtcagaaactgatcaaccagagcctcgttatgggtatcgaagtgggcaaaagtagtgccaccaaccaaaataccgagaaagtactgccccccagactgaacctgtgtcctcgaacaagctacagttcactgtcttctccgggaacctcgccctcgggctcatccgtgtctagccaagatagcgccttttcccaaatctccgagcacagtgtttttacacccactgaaacaagctctccaatcgactgcaccttccaggcgcaacgcaagcgcgaggatctgtcgcccgatttttctaacgcctcacacgtcagtggaatgcctggtccaagcagcgggcaggcctgttccagacctgcctacaccaagaaggacacaatggagtggcacagccaaatgcacagcgtgaccttgcacccctctacttggctccgtaacggagtggcctctttaaaaaattggtctctcaagaagaaagccaaggcggctagacctgaagaggaaaagatagcatcaccaaagggacccctggaacctcccccacatgcgagtggcgtgccagaggctaactcactccaggaggaacagaaggatctgccattgcgtgctgctgaggggttatccccggttcagagcgcgcagaggtgctcgtcatctccattccaggattccgagagacattgttcaagccccttctcccttgtggagagccgtctgaagctgtgtatgaagtcccatgaggagattgagccaggatcccagtcgagctctgggagtttaccttgggagagggcaagcgcttcgtcctggaccctggaggatgcgactagccccgattccgggccaactgtcgtatgtgatatcgaagacagatatcttacgaaagatatctag

SEQ ID NO: 26156 - DNA, 3498 bp, Artificial Sequence
  Description of Artificial Sequence: Synthetic coding sequence
atgaccttctggatcatcatcaacaagaagatgaagaccctggccgaaagaagacgcagcgctccgtctttgatcctcgataaagcgctccagaagcgtccaactactcgggattccccaagcgcctcggtcgacacatgcacgttcctgagtagtttggtgtgctccaaccggactctgctgatcgacggcagagcagaactgaaacgaggtctccagcggcaggagcgccacttgttcttgttcaatgacctctttgtggtggccaaaatcaagtataataacaactttaaaatcaagaacaaaataaagctgacagacatgtggactgcctcctgcgtcgacgaggtaggcgaaggtaacacaaacgcgatgaaaagttttgtgctgggatggcccacagtgaacttcgttgccacattctcctcgcccgaacaaaaggacaaatggctctcactgctgcagcgttacataaatctcgaaaaggaaaaggattatcccaagtccattccattgaagattttcgctaaggatatcggcaactgcgcctacagtaagacgataactgtaatgaattccgacacggccaatgaagtgataaatatgagcttaccaatgctgggcataaccggcagtgaacgggactaccaactgtgggtaaatagtgggaaagaggaagccccataccccttgatcggccatgaatacccctatggaataaagatgtcgcatctgcgcgactcagctttgcttacccccggctctaaggactccaccacaccatttaacctgcaggagccctttctcatggaacagctgccgcgggaaatgcagtgccagttcatactgaagccgtcccggcttgcggcagctcagcagctgtccgactctggacacaaaacatttaagcggcgccgcagcatcattaactgggccttctggcgaggcagtagcacgcacctagataacctgccctctagtcccacttcacctatgcctgggcagctgtttggtatcagcctccccaacatatgtgaaaacgataacctgcctaagccagtgctggatatgctctttttcctgaatcagaaaggtccattaactaaggggatcttcagacagtctgccaacgtcaagtcctgtcgcgagttaaaggaaaagctgaactcaggtgtcgaggtgcacttggactgcgagtcaattttcgtcatcgcaagcgtactgaaagactttctacgcaacataccaggaagtattttttcctccgacctgtacgaccattgggtaagcgtgatggaccaaggaaacgacgaagagaagattaatactgttcagcgactgctggaccagctgccgagggccaatgttgtgctgttgaggtacctttttggcgtgctgcataatattgagcagcactcttcctccaatcagatgactgcatttaatctagccgtgtgtgttgccccttcaatcttgtggccaccggcaagctcgtctcccgagctcgagaacgaatttaccaaaaaggtgtctctcctcatccagtttctcattgagaattgcctgagaatctttggggaggaaatcactagtttgttcagagaagtcagcgtgaggtgcgacacgagagaaaatgcaagcgacataagctgcttccagctgaatgatagttcttatgactccttggaaaacgagctgaacgaggatgtggacgccccatgctcggaccttgtgaagaagctcggacaggggtccaggagcatggacagcgtgctgacactgagcgactatgatctggatcagcccgaagtggagggtctcctaactctgagtgacttcgacttagcacacagcaaagatgaggacgtccagatgaaacggcccctcgaatctaagcctgtaaacatcctggtctataccaaaattcctctgcgagatcacgccagagctccatcagcaatgtgtactccatcatatctctcaaccgctgcagcaaacgcggccaaatcactgagaaggcatagacgttgctctgagccttccattgattacctggactccaagctgagttacctgcgagagttttatcaaaagaaactgcggaagtcaagctgtgatgccatcctgtcacagaaggacgaagactacttaaaacagaaccagcccctgcaggaggagggcaagacctgtttcaagcagagcctggttaccggcactgacgtgtctaagaagaatgcaactactcagaacaccaaaaaaaagtctctaagtggctctgaggggaatcatgtgaagctattccctaagtccaagcccgtcgctatcagtgtcgcttcctacagtcctatgtcctcacaagatcacagcaagaatcagcccttcgacgtaaacacatctgggtatagtcctcctcacactgccgacgccctcaagggcccaagaactcatcggcgctgcagcgagcctaatattgaagaccagaatcggaagttaacctacctgcgagggatctactctaaaaaacagcacaaaacaagttgcgaggctggactgctccatggtgaggaggattatttaaagagacataaaagcctgcaaatggaaggccaaaaattaattaatcagtccctggttatgggaatagaagtgggaaagagtagcgctactaaccagaacacagagaaagtgttaccccccaggttgaacctgtgtcctcgaactagctactcaagcctgtccagccccgggacaagcccaagcgggtcctccgtctcttcgcaggactccgccttctcccagatatcagaacattccgtttttacaccaactgagacatccagccctatagattgtacctttcaagcacagcgcaaaagggaggatctaagccccgattttagcaacgcttcacacgtgtcgggcatgccagggccctcttccggacaggcatgttcacgccctgcctataccaaaaaagatacaatggaatggcatagtcagatgcatagcgtcacgttgcacccaagtacctggctgagaaatggcgtggcttctttgaagaattggtcgttaaagaagaaagcaaaagctgccaggccggaggaggagaaaattgcttctcccaagggccccttggaacctcccccccatgcctcaggcgtaccggaagctaacagcctacaagaggagcagaaagatttacccctcagagcagccgagggcctaagccctgttcagtccgcacagagatgtagctcttcccctttccaggactcagagagacattgctcctcaccattcagcctggtggagtcaaggctcaagctgtgcatgaagagtcatgaagagatcgaaccgggctctcagagttcaagtggctcactcccatgggaaagagcttctgcctcatcatggactctggaggacgccaccagcccggatagcggacctactgttgtctgcgacattgaagatcgttatcttactaaggatatctag

SEQ ID NO: 26157 - DNA, 3507 bp, Artificial Sequence
  Description of Artificial Sequence: Synthetic coding sequence
atgagcgcccgggagcggcagcccgccctgaagaagaagatgaagactctcgctgagcgaagaagaagcgctcctagtctgattctggataaggccctgcaaaagagacctaccacccgcgatagcccctcggccagcgtagatacctgcacattcttgagctctctcgtctgctccaacagaacgctgctgattgacgggagagctgagctgaaacgaggactgcaaagacaggagcgtcacctgttcttatttaacgacctcttcgtggtggccaagatcaagtataataataactttaagatcaaaaacaaaatcaagctgacggatatgtggaccgcctcttgtgtggatgaggtgggcgaaggcaacaccaatgccatgaagtcctttgtgctcggctggccgacagtaaatttcgtggctacgttttctagcccagaacagaaagacaaatggctgagccttttgcagagatatattaacctggaaaaagagaaggattaccccaagtcaataccgctgaagatcttcgccaaggatataggcaactgcgcatacagcaaaaccatcaccgtaatgaactcagacacagctaacgaagtcattaacatgagtctaccaatgttaggcattaccggatccgaaagagactatcagctgtgggtgaactcgggaaaggaagaagctccttaccctttgataggccacgaatacccctacggtattaaaatgagtcaccttcgcgatagcgctctattaacacctggcagtaaagactctaccacaccttttaatcttcaagaaccatttttgatggagcaactgcccagggagatgcagtgccaatttatcctcaaaccgagtcgactggccgcggcacagcaactgagtgattcgggacacaaaacttttaagcgtaggcgttccattattaactgggccttctggcgaggaagcagtactcatttagacaatctaccttcctcaccaacatctcccatgcctggtcagctcttcgggatcagcttgccaaatatctgcgagaacgataacctgcccaaacctgttctcgacatgctgttttttcttaatcagaaaggtccactgaccaagggcatttttcgacagtcagcaaatgtcaagtcttgcagggaacttaaggagaagctgaactcgggcgtcgaagtgcacttggattgcgaatctatttttgtcattgcaagcgtgctgaaagacttcctgcgaaatatccccggaagcatcttttcctccgacttgtatgaccattgggtgtctgtaatggatcaggggaatgacgaggagaaaatcaatactgtgcagcggctgctggatcagctgccacgagcaaatgtggtcttattaagatatctcttcggcgtgctccacaacatcgagcaacatagcagcagcaatcaaatgactgcttttaacctggcagtttgtgtggccccctcgatcctgtggcctcccgcaagttccagtccagaacttgaaaacgagttcacaaaaaaagtcagtctcctcatccagttcctaattgagaactgtcttaggatattcggggaggaaattacttcactctttcgcgaagtgtctgttcgatgtgatacgcgcgaaaacgcctctgatattagctgcttccagctaaatgacagctcctatgatagcctggagaacgagctgaacgaagacgtggacgccccctgctccgaccttgtgaaaaaactcggacagggctccagaagcatggactctgtccttaccctgagcgactatgacctcgaccaacctgaggtggaggggttgctcacgctgagcgatttcgatttggcgcactccaaagatgaagacgtccagatgaaacggcctttggagtctaaaccagtgaatattctggtgtacaccaagatccctcttagggatcacgcccgggcgccttccgctatgtgcaccccatcgtatttatctactgccgccgcaaacgcagccaaatccctccgccggcacaggagatgcagcgagccatctattgattacctggactctaagctcagctatctgcgtgaattttaccaaaagaaactcaggaagtcctcctgtgatgccatcctatcccagaaggacgaggattatctcaaacagaaccagcctctgcaggaggaaggcaaaacatgttttaaacagagcctggtaaccgggaccgacgtgagcaagaaaaacgctactacacagaataccaaaaagaagagcctctcaggatctgaaggaaatcatgtcaaactgtttcctaagtctaaaccagttgccatctcggttgcgtcttactctcctatgtcgtcccaggatcattcgaaaaatcagccatttgacgtgaataccagtggctacagccccccccatacagccgatgcactaaagggccctaggacacaccgcagatgctccgagcccaacatcgaggatcagaaccgtaaactgacatatctgagggggatctatagtaaaaaacagcacaagaccagctgcgaggctggactgctccatggggaggaggattatctcaaacgtcacaagtccctccagatggagggtcaaaagctgatcaatcaatctctcgtaatggggattgaggtgggcaaatcctccgccacaaaccagaatactgagaaggttctccctccgagactgaatctgtgccctcgcacttcttatagctcattgtcctcaccagggacgtcacctagtggaagttctgtctccagccaggacagcgcattttcccagatctccgaacattcagtcttcactcctactgagacttcctcccccatagattgcacctttcaggcccagcgtaagagagaggatctgtcccccgacttttcaaacgctagccacgtctcaggcatgccgggccccagctctggccaggcctgctcccgaccggcgtacacaaagaaagacaccatggagtggcactcacagatgcactcagtgacattgcatcctagcacctggctgcggaatggtgtagcctctctcaaaaactggtcgttaaaaaaaaaggctaaggccgcccgccctgaggaagaaaaaattgcgagccccaagggacccctcgagcccccaccacatgcctccggagtgcctgaggccaacagcctccaagaagaacagaaggaccttcctctccgtgccgcagagggcctgtcccccgtgcagagcgctcagagatgttctagcagtccctttcaggactccgaaagacactgctcaagtccctttagtctggtcgagagtcgcctgaagctctgtatgaagtcgcatgaagagatcgaacccgggtcccagtcctcgtccggctctctgccctgggagagggcatctgcatcatcatggacactggaagacgccacatccccagatagtggcccaactgtggtttgcgatattgaggacaggtatcttacaaaggacatttag

SEQ ID NO: 26158 - DNA, 3468 bp, Artificial Sequence
  Description of Artificial Sequence: Synthetic coding sequence
atgaagaccctggccgagcggcggcggagcgcccccagcctgatcctggacaaagccctgcagaaacgtcccacgacaagagacagcccttccgcatctgttgacacctgtacgtttctgagtagcctcgtttgtagcaataggaccctccttatagacgggagagccgagctgaaacggggcctgcagaggcaggaaagacacctgtttttgttcaatgacctgttcgtggtagcgaagattaagtataataataacttcaagattaagaacaagattaaattgacagacatgtggactgccagctgtgtagacgaagttggcgagggaaatacaaacgccatgaaatccttcgttctcggttggccaacggtgaattttgtggccaccttcagctcgcccgaacagaaggacaaatggctgtctttgctgcagcgctacatcaatctggagaaagaaaaagattaccccaaaagtatccctctgaagatctttgccaaagacattgggaactgtgcctacagcaaaaccattacagtgatgaacagtgacacagccaatgaggtcataaacatgagtctgccaatgcttgggattacaggctcagaacgcgactaccagctgtgggtgaacagtggtaaggaggaggccccatacccactgatcggccacgaatatccctacggtatcaagatgagccatctccgtgattccgccctacttacaccggggtctaaagattctacgacaccttttaacctgcaagaaccctttctgatggagcaactgcctcgcgaaatgcagtgccagtttatccttaaaccgagtcgcctcgccgcagcccagcagctttccgatagtgggcacaagacttttaagcgtcgccggtcaattatcaactgggccttctggagaggctcatccacacacctggacaacctgcctagcagtcctacctccccgatgcccggccagcttttcggcatttctctgcccaatatttgtgaaaatgataacctccctaaaccagtcctggacatgctgttctttttaaatcagaagggtccactgactaagggcatctttagacagtctgccaacgtgaagagctgtcgcgagctcaaggagaaactgaactctggggtggaggtgcacctcgactgcgagagcatttttgtgatcgccagtgtgctgaaagatttcttgcggaacatccccggttctatcttttctagcgatctatacgaccactgggtgagcgtgatggaccaaggcaacgatgaagagaagatcaatacagtgcaacgcctgcttgaccagttgcccagggctaacgtggtgcttctgagatacctgtttggagttctgcataatatcgagcagcactcatcctccaaccaaatgacagccttcaatctggcagtctgcgtcgctccgtccatcctgtggccaccggcatccagtagccctgagttagagaatgagttcaccaagaaggtgagtctgctgattcaattcctgattgagaattgtctgcgtattttcggcgaagagataacttcgctgttcagggaagtgtccgttcgctgcgatacccgcgaaaatgccagtgatatatcatgcttccagctgaatgactcctcatacgatagtttagaaaatgaattaaacgaggatgttgatgctccatgttccgatctagtcaagaagctggggcaaggtagcaggtcgatggattcagtgctgaccttaagtgattatgatctggatcagccagaagtggaagggttattgacactgagtgattttgaccttgcacacagcaaagatgaggacgtccagatgaaaagaccactggaatccaagcccgttaatattttggtgtacacgaagatacctctccgtgatcatgccagggcccctagtgcaatgtgcactccctcatatctgtcaacagctgcagctaacgcagcgaagagtttgcgaaggcacagaagatgtagtgagccaagcatagattaccttgattctaaattgtcatacctccgggagttttaccagaaaaagctgcgtaaatctagttgtgatgccattctgtcccaaaaggatgaagattatctgaagcaaaatcaacctctgcaagaagaaggcaagacatgttttaaacagtctctggtcactggtacagacgtgagcaagaagaatgctacaacgcagaacacaaaaaaaaaatctctctctggtagcgagggcaaccacgttaagttgttcccaaagagcaagcccgtggccatctccgtcgcatcttactcgcccatgagctcacaagatcattcaaaaaaccaaccattcgacgtaaatacctccggatatagcccaccacataccgccgatgcgttgaaaggcccacggacccaccgacgatgttccgagccaaatattgaagatcagaacaggaaattgacttaccttcggggcatatacagtaaaaaacaacacaagactagttgtgaggctggcctgctgcatggggaggaggattacctcaaacgccacaaaagtctgcaaatggaggggcagaagcttatcaaccagtcccttgttatgggaatcgaagtcggtaaaagttccgccacaaaccagaacaccgagaaagtgcttcccccccgtctgaatctctgtcccaggactagttactcttctctgtcctcccccgggacgtccccctcaggctcttcagtgtctagtcaggactcggcattcagtcaaattagcgaacactccgtgtttacccccaccgaaacaagctcaccaattgactgcacttttcaggctcagcggaagagagaggacctatccccagatttctctaacgccagtcatgtgtctggaatgcctggtcctagtagtggacaggcttgttctagacctgcctatacaaaaaaagacaccatggagtggcactcacaaatgcactccgttacccttcatccaagcacttggctgaggaacggtgtggcttcgttaaagaactggagcctgaagaagaaggcaaaggccgccaggcctgaagaagagaagatcgcttcgcccaagggcccgttggagcccccgccccacgcctctggtgttcctgaggcaaacagcttacaggaagagcaaaaggacctgccattgagggccgccgagggcttgtcccccgtgcagtcagcccagagatgtagttcctccccttttcaggactctgagagacactgttcttctccattctccctggtggaatcaaggctaaaactttgcatgaaatcacatgaggaaatcgagcccggttcgcagagctcatctgggtccctaccttgggaaagggccagcgccagctcttggaccctggaagacgctacttcacccgattccggcccaaccgtcgtatgtgatatcgaggaccgctatctgaccaaggatatctag

SEQ ID NO: 26159 - DNA, 3468 bp, Artificial Sequence
  Description of Artificial Sequence: Synthetic coding sequence
atgaagaccctggccgagcggcggcggagcgcccccagcctgatcctcgacaaggctctgcagaagcggccgacaactagagactctccgtcggcctctgtagatacttgtaccttcctgtcttctctcgtgtgtagtaacaggactttgctgattgacggccgggccgaattgaagcgcgggttgcagcggcaggagagacatttatttctgtttaacgatctgtttgttgtggccaagattaagtacaacaacaactttaagataaagaacaaaatcaaactgaccgatatgtggaccgctagctgtgtggatgaggtgggggaaggcaatactaatgccatgaagtcattcgttctcggatggcccacggtgaactttgttgcgactttctcctcacccgaacaaaaggataagtggctgtccctgttacagaggtatatcaatctggagaaggaaaaagactaccctaaatcaatacccctgaaaatttttgccaaagacatcggcaattgtgcctattcaaaaacaattacggtcatgaacagtgacactgccaatgaagtgattaatatgtctctgcccatgctgggaatcactggatctgagcgcgactaccagttatgggtcaattctgggaaagaagaagccccctatccccttattggccacgagtatccatacggaataaagatgtcacatctgcgcgatagtgcactactcactccgggatccaaagacagtaccactccattcaatctgcaggagccatttttgatggagcagctcccgcgggagatgcagtgtcagtttattcttaagccctcccggcttgcagcggcccaacagctgtcggattcaggacacaaaacattcaagagacgacgaagcatcatcaactgggccttctggcgaggaagcagcacacacctggacaacctccccagcagtcccacttcaccaatgcctgggcagctgtttggtatatcattacccaatatctgtgagaacgacaatttacccaagcccgtgctagacatgttgttcttcctcaaccagaagggcccgctcaccaaggggatttttcggcagagcgctaacgtcaagagctgcagggaacttaaggagaagctcaatagcggagtggaagtccacctcgactgtgagagtatattcgtgattgcctcagttctaaaggattttcttagaaatatacccgggagcatctttagttccgatttatacgaccactgggtctcagtgatggatcagggaaatgatgaggaaaaaatcaacactgttcaacggctgttggatcagctcccacgtgccaatgtagttttgctgcggtacctgttcggcgtgttacacaatattgagcagcatagttcttcaaaccagatgactgctttcaatttagctgtgtgcgtcgccccatccattctgtggccccccgccagcagttcgcctgagttggagaacgagtttaccaaaaaggtgagcttgctgattcagtttcttattgagaattgcctcaggatatttggggaggagatcacctcgttattccgcgaagtctccgtgcggtgtgatacaagagaaaatgcatcagatatatcctgttttcaacttaacgattccagctacgacagtcttgaaaatgaactaaacgaagacgttgacgccccttgcagtgacctggttaaaaaactgggacaggggtcccggtcaatggacagcgtgttgaccctctctgattacgacctggatcagcccgaggtggagggactgctcacactcagcgacttcgacctggcccactcgaaagacgaggacgttcagatgaagcggcctctcgaaagcaaacccgtgaacatcctggtttatactaagatccctctccgggaccacgctcgggcaccctccgcaatgtgtacaccttcttacttatctactgcagcggctaatgcagcgaagtcactacgccgccacagacgatgctcagagccctcaatcgactacctggattctaagctaagctacctgcgggagttctaccagaagaagctgcggaaatcgagctgtgacgccatattatcccaaaaggatgaggactacttaaaacaaaatcaacccctacaagaggaggggaaaacgtgctttaaacagagcctggtgactggcaccgatgtgtctaaaaagaacgcgactacacagaacaccaaaaagaaatccctctcgggatcagaggggaatcacgtgaagctatttccgaagtctaagcccgttgccatctcagtggcttcctattcaccaatgtctagtcaagaccactcaaaaaatcagccattcgacgtgaacaccagcgggtatagccctccccacaccgctgacgcattaaagggcccccgcacccacaggaggtgcagcgagcctaacatcgaggatcagaacaggaaacttacgtatttgcggggcatttacagtaagaagcagcataagacgtcttgcgaagcggggcttctgcatggtgaggaagattacttaaagcggcataagagtctccaaatggaagggcagaagctcattaatcagagcctcgtgatgggcatcgaggtaggtaaatcatctgccaccaatcagaacaccgagaaggttctgccccctagactgaatctgtgcccccgaactagttattcttctctttcgtcccctggtactagtccgtccggctcatccgtttcatcccaggactccgcattctcccagatttctgagcatagcgttttcacccccaccgaaactagtagtccaatagattgcacattccaggcccagaggaaaagggaggacctgagcccagatttctctaacgccagccacgtctccggtatgccaggtcctagcagcggacaagcctgctctaggcctgcatatacaaagaaagacacaatggaatggcattctcaaatgcacagtgtcaccctccacccgtccacttggcttcgcaatggggtggctagcctgaagaattggagcttgaaaaaaaaagcaaaggcggcacgccctgaagaagaaaaaatagcttccccaaagggaccactggagcctccaccgcatgcatcaggggtgccagaagccaatagtctccaagaggaacaaaaagatctgccactgcgggctgccgagggattgagccccgtccagtccgcccagaggtgctcgtcaagtcctttccaagatagtgagcgtcactgttcgtctcccttttcactggttgagtccaggctgaaactgtgcatgaagtcccatgaggaaatcgaacctgggagccagagttcttccggctctctaccctgggagcgggctagtgcatcatcttggacattggaagacgcgactagccctgattccggacccactgtggtttgcgatatcgaggatagatacctcacaaaggatatatag

SEQ ID NO: 26160 - DNA, 2196 bp, Artificial Sequence
  Description of Artificial Sequence: Synthetic coding sequence
atggaccagggcaacgacgaggagaagatcaacaccgtgcagcggctgcttgaccagctgcctcgagctaacgtagtgcttcttagatacctgttcggcgtcctccacaatatagaacagcacagctcgagcaatcaaatgacagcctttaacctggcagtctgcgtcgctccaagcatcctgtggccccctgccagctcgagcccagaactagagaatgagttcaccaagaaagtgtcactcttgatacagttcttgatcgagaattgccttcgcattttcggcgaggaaatcacgtctttatttagggaagtatcagtgcgctgcgataccagagagaatgctagtgatatttcctgtttccagctgaatgactcttcgtatgacagtttggagaacgagctgaatgaggacgtagacgctccgtgttctgacctcgtcaagaagttgggccaagggtccagaagtatggatagcgtactgaccttgtcagattacgatctagatcagcccgaagtcgagggcctcctgaccctgtccgatttcgaccttgcccatagtaaggacgaggacgtgcagatgaaacggcccctcgaatcaaagccagtgaatatcctcgtttataccaagataccactgcgtgaccacgcgagagccccatcagcaatgtgtactccttcttatctgagcactgcggctgccaatgctgctaagtccctcaggcgtcacaggcgatgttccgagcctagtatcgactacttggatagcaagctctcatatctgcgggagttctaccagaagaaactgcgcaagtcctcgtgtgacgccattctgtcccagaaagacgaggactacctgaagcagaatcagcccctgcaggaagaaggaaagacttgctttaagcagtccctggtcaccgggaccgacgtgtctaagaagaatgctaccacccagaatactaaaaaaaagtccctatctgggagtgaggggaaccacgtgaagctgttccctaaatctaagcctgtggcgataagcgtggcttcctactctcctatgtcgtcgcaggaccattcgaaaaatcagccatttgacgttaacacttccggttacagcccaccccacaccgccgatgcccttaaggggccccgtacccatcggcgatgctctgaacccaacatagaagatcagaatcgcaaactgacttatcttagaggaatttactctaagaaacagcataagacatcctgtgaggctgggctcctgcacggagaggaggactatctgaaacgtcataagagtcttcagatggagggtcagaaactgataaaccaatctctagtcatgggaatcgaagtggggaagtcttccgccaccaaccaaaacaccgaaaaagtgttgcctccccggctgaatctgtgccctcggaccagttactcaagcctgtcttcccctggcacttcgccctcaggcagcagcgtcagttctcaggatagcgccttttcccagatctccgagcactctgtcttcacaccaaccgagacttctagtcccatcgattgcacttttcaggctcaacgcaagagagaggacctgtctcccgacttcagtaacgcctcacacgtctcaggcatgccaggtccttcttcggggcaggcttgcagtcggcctgcctacactaaaaaggataccatggagtggcacagccagatgcattccgtgaccctacacccaagtacctggttgcgtaacggcgtggcatctcttaaaaattggtctttgaaaaagaaagctaaggctgcccggcctgaggaggaaaagattgccagcccaaaggggcccctcgagccgcctccacacgcctctggcgttccagaagctaacagtctgcaggaggagcagaaagatctgccactgagagctgcagaaggattatcccccgtgcagtctgcgcagagatgttcttccagtcccttccaggattcagagcggcactgttcatctccttttagcctggtggaatcccgcttgaaactgtgtatgaagtcacatgaggagatcgaaccaggaagtcagtctagttctggcagtctgccctgggaaagggcctccgcttcctcttggacgctcgaggatgccacaagccctgacagcggaccgacagtggtatgcgatatagaggaccggaactgttgctag

SEQ ID NO: 26161 - DNA, 3498 bp, Artificial Sequence
  Description of Artificial Sequence: Synthetic coding sequence
atgaccttctggatcatcatcaacaagaagatgaagaccctggccgaacgaaggaggtctgccccctcactgatcttggacaaggccttacagaaacgccccaccacccgcgacagcccttctgcctccgttgatacgtgcacgtttctcagcagcctagtgtgttcgaacaggaccctgctcattgatggccgcgcggagctgaaacgagggctgcagcgtcaggaacgtcatctttttctgtttaacgatttgttcgtcgtcgcaaaaataaaatataacaacaattttaaaataaaaaacaaaatcaagcttacagacatgtggaccgcttcatgcgtggatgaagtcggggagggaaacaccaatgctatgaagagcttcgtcctcggctggcccacagttaacttcgttgctacgtttagctccccagaacagaaagataagtggctttctctgctacagagatacatcaatctggagaaggagaaagactaccccaagtcaatcccactgaagatctttgctaaagacatcgggaattgtgcctactccaaaacaattacagtcatgaactcagataccgcaaatgaggtcataaatatgagcctgcctatgttgggaataactggatccgagagggactaccagctctgggtcaactccgggaaggaagaagctccataccctctcattggccatgagtacccctatggaataaaaatgagtcacctgcgggattcagcactgctcactccgggatctaaagattcaaccacgccatttaatctccaagagccttttctaatggaacagttacctagggagatgcagtgccaattcatcctgaagccctctcggctggcagcggcccagcagttgtctgacagcggccataagacatttaagcgtcgacgttccatcatcaactgggccttttggcgcggatcttcaacacatctggataacttgccctcatctcccactagccctatgcctggacaacttttcgggatctcacttcccaatatttgcgagaacgacaaccttcccaagccagtcctggacatgctgttttttcttaaccagaagggtcccctgactaaggggatttttagacagtcagccaacgtgaagtcctgccgggaactcaaggaaaaactgaactcaggggtggaggtccatctggactgtgagtccatctttgtgatagcttcggtcctgaaggacttcctgcgaaatatcccaggtagcatcttttcaagtgacttgtacgaccactgggtcagcgtcatggaccagggcaacgacgaggagaagattaacaccgtgcagcgcctcctggaccagctgcccagggccaacgtagtcctgctccgatacctgtttggtgttctccataatatcgagcagcactcttcctccaaccagatgacggcttttaatcttgctgtctgcgtcgctccatcaattttgtggccacctgcttcctcctcaccggaattggagaacgagtttaccaagaaggtgagcttgttgatacaattcctgatagagaattgtctgcggatatttggcgaggaaataacatctctcttccgagaggtatctgtccggtgtgacacgcgtgagaacgcatctgatatatcctgcttccagctcaacgattcctcatacgatagtctagagaacgagctgaatgaggatgtagatgctccgtgctctgatctggtcaagaagctggggcagggttctaggtctatggatagcgtcctaaccctctccgactatgatctggatcagcctgaggtggaaggactactaactctcagcgattttgacctcgcccactccaaggatgaggatgttcagatgaagcgcccattagagagtaaacctgtcaacattttagtgtatactaagataccactccgggatcatgccagagctccttcagctatgtgcactccgagttacttgtccacagccgctgccaatgctgctaaaagtctgcgtagacatcgacgatgctctgaacctagtatagactacctcgactctaagttgtcctaccttagagaattctatcaaaaaaaacttagaaagtcgagctgtgatgccatactgtcacagaaggacgaagactacttgaaacaaaaccagccgcttcaagaagaggggaagacctgtttcaaacagtcactcgtgactggcacggacgtgtccaagaaaaatgcaaccacacaaaacaccaagaaaaaatctctgtctgggagcgaaggcaatcatgtaaagctgtttcctaaatccaagcccgttgcgatcagcgtggcctcttattctcccatgtctagtcaagatcattctaaaaatcagccctttgacgtgaatacgtccggctactcaccccctcacacggccgacgcacttaagggtccaagaacccacaggaggtgcagtgagcccaatattgaagaccaaaacagaaagctgacctacctacgcggaatctactctaaaaaacaacataaaacatcttgtgaggccggactcttgcatggagaggaggactatttgaagaggcacaaatctctgcagatggaaggacagaaacttatcaaccaatccctcgttatgggtatcgaggtagggaagtcttctgcaacaaatcaaaatactgaaaaggttctgccacccagactgaacctctgcccacgcacttcatactcaagtctttcgtcacctggcacctccccctctggaagttctgtttcttctcaagactcagctttcagccagatttctgaacattcggtttttacacccaccgaaaccagttccccaatagactgtacatttcaggcccagaggaaacgcgaagacttatccccagacttctcaaatgcttcccatgtgagcggaatgcccggcccttcatctggccaggcttgtagccgaccggcatatactaagaaggacaccatggaatggcactcccagatgcacagcgttactctgcacccatctacctggctgaggaatggcgtggccagccttaaaaactggtccctaaagaagaaggccaaggccgcgaggcctgaggaggagaagatagcgagtcctaaagggcccctcgagcctcctccacatgccagcggggtgcctgaggccaactccctacaggaggaacagaaagacctgcctctccgcgcagcagaggggctgtcacccgtgcagtctgcacagcgatgtagcagctctcctttccaggattcagagcggcactgttcttcaccatttagcctagtcgagtcacggctcaagctgtgtatgaagtctcatgaagagatagagccaggctcgcagtcttctagtggatcacttccatgggaaagggccagcgccagctcctggaccctggaggacgccacctcgcctgattccgggccgaccgtagtgtgcgatatcgaggaccgttaccttaccaaagatatctag

SEQ ID NO: 26162 - DNA, 4542 bp, Artificial Sequence
  Description of Artificial Sequence: Synthetic coding sequence
atgatgatggcccggaagcaggacgtgcggatccccacctacaacatttcggtcgttggtctctccgggacagagaaagagaagggccagtgtggaatcggaaaatcctgcctgtgcaataggtttgttcgcccttctgctgatgaatttcatctggatcatactagtgtactttccaccagtgatttcggcggtcgagtcgtgaacaacgaccactttctttattggggtgaagtgtctagatctctggaggattgcgtggagtgcaaaatgcacatcgtggagcagaccgaatttatcgacgatcagacttttcagccccaccgcagtacagccctgcaaccttacatcaagagagccgccgctaccaagctggcttccgccgagaagctcatgtacttttgtacagaccagctcggcctcgagcaggacttcgagcagaaacagatgcccgatggcaaactacttgtcgacggcttcctgctaggcattgacgtgtcccggggaatgaatcgaaattttgatgatcaacttaagtttgtatcaaacctgtataaccagctcgcaaaaaccaagaagccgattgtcgtcgtgctgacgaagtgcgatgaaggtgtagaacgatatatcagggacgcacataccttcgccctgtccaaaaaaaatttgcaggtggtcgagacttctgctcgatcgaacgtcaatgtcgacctggctttttctaccctggtacagttaatagacaagagccgcggaaagactaagattattccatatttcgaagccctcaaacagcagtcccagcagatcgcaactgcaaaggacaagtatgaatggcttgtgagcagaatcgttaagaaccataatgagaattggttatctgtttccagaaaaatgcaagcatctcccgagtaccaggattatgtgtacctcgaggggacgcagaaggccaaaaagctatttcttcaacatatacatcgactaaaacacgaacatatcgaacggcgaagaaaactttacttggcagccttaccactggcctttgaagcattaattccaaacctggatgaaatcgaccatcttagctgtattaaggctaagaaactgttggagaccaagccagaattcctgaagtggttcgtagtgctggaagagacaccatgggatgctacatcacacattgataacatggaaaatgaacgtattccgttcgatctgatggacacagtacccgcagaacagctctacgaagcccacttagagaaactccgcaacgaacgaaagcgcgtggagatgcggcgggcctttaaggagaatctggagacatccccatttattacacctggaaaaccctgggaagaagcgcggtcatttataatgaatgaagatttttaccaatggctcgaggagtccgtatacatggatatttacggcaagcatcagaagcaaattatcgacaaagctaaggaggaatttcaggagctcctgctcgagtactcagaactgttctatgagctggaactggacgctaaaccctcaaaagaaaagatgggggtgattcaggatgtcctcggcgaagagcagagattcaaagctcttcagaagttgcaggcagaaagagacgcgctgattcttaagcatatccacttcgtctatcaccccacaaaggagacgtgcccctcctgccctgcttgcgtggacgccaagattgaacatcttatctccagtcggttcattaggccaagtgaccgaaatcagaagaatagtctctccgacccgaacattgacagaattaatctcgttatcttgggtaaagacggtctcgctcgggagctggctaatgaaatacgcgccctatgtactaatgatgataagtatgtcatagatggtaagatgtacgagctgagcttgcgacccatcgaaggcaacgtgcgactcccagtgaattcctttcagactcccacctttcagccacacggttgtctctgtctctataattctaaagagtcactgagttacgtcgtggaatctattgagaagagccgtgagtcaactcttggtaggcgggacaatcatctggtccacctgcctctcaccttaattctcgttaataagaggggtgacacctctggtgagactctgcacagtctgattcagcaagggcaacagatcgctagcaagctgcagtgcgttttccttgaccctgcctctgcaggcattgggtacggcagaaatattaacgagaaacagatttctcaggtgctcaagggcctactcgattctaaacgcaacttgaacttggtgtcctctactgcaagtatcaaggatttagctgatgttgatctgcgtatcgtgatgtgtctcatgtgtggggaccccttttcggctgacgatattctgtttccagtcttgcagagccagacttgcaagtcttctcactgcggcagcaacaacagcgtgttacttgagttgcctatcggacttcacaagaaaagaattgagctgtcagtcttgtcataccattcttcattttctattcgcaagagcagacttgtgcacggctacatcgttttttactcggctaagaggaaagcttcgctagcgatgcttagggcctttctctgcgaagtccaggatatcatcccaattcaactggtcgcactgacagacggcgcagtggacgttcttgacaacgatctgtctcgagagcaactcacggaaggcgaagaaatcgctcaagaaattgatggtcgctttaccagcatcccgtgctcccagccgcaacataaactggaaatttttcaccctttttttaaggatgtggtagagaagaaaaacatcatcgaggctacacatatgtacgataatgccgcagaagcctgctcaaccacggaggaggtgttcaattccccacgtgcagggagcccactgtgtaactcaaacttgcaggacagcgaggaggatatcgagccttcttatagtctattcagggaggacacgtcactaccatccctttcaaaagatcacagtaaactgagtatggagctggaaggcaatgacggcttatcttttatcatgagtaattttgaatctaagctaaacaacaaagtgccaccccccgtgaagcctaagcctccagttcactttgagattaccaaaggtgaccttagctatctggatcagggacatcgagatgggcagcgaaagtcggtgtcctctagcccctggcttccacaagatggcttcgatccgtccgactatgcggaacccatggatgctgtggttaaaccccgaaacgaggaagagaacatttatagtgtgcctcatgacagcacccagggaaaaatcataacaatccggaacatcaacaaggcccagtcgaacgggagtggaaatggaagcgactccgaaatggatacaagttccttagagcggggacgcaaggtaagtatcgtgtcgaaaccagtgctctaccgaactcggtgcacaaggttgggccggtttgcttcttaccggacgtccttttctgtggggagcgatgacgagcttgggcctatacgaaaaaaggaggaagaccaagcatcccagggttacaagggtgataatgccgttattccctatgaaacagacgaggaccccaggagacgaaacattctgaggtcactgagacgaaatactaagaaacctaaacccaagcctcgcccatctattacaaaggctacgtgggagagcaactacttcggcgtgccgctaactaccgtagtaacgccagaaaagccaatcccaatctttatcgagcggtgtatcgagtatattgaagctacgggactttctaccgagggtatctatagagtgagtggaaataagagcgaaatggagagtctccagaggcagtttgaccaggatcacaaccttgacttagcggaaaaggacttcaccgttaatacggtcgccggagccatgaagtccttcttctctgagttaccagaccctcttgtgccctacaacatgcaaattgacctagttgaggctcataaaattaatgacagggaacagaagctgcacgctctgaaagaagttctgaagaagttccccaaggagaatcatgaggtattcaagtatgtgattagccacttgaataaagtcagtcataacaacaaggtgaacctgatgacttccgaaaatctctccatctgtttttggcccaccctaatgagaccggacttctctactatggacgcccttacggccacacgcacttaccagaccataatcgagctgttcattcagcagtgccctttcttcttctacaaccgccctataaccgagcctcccggagcaagaccaagctcacctagcgcagtcgcttccaccgtaccttttctgacatccacccctgtgacctcccaaccttctccccctcaatcgccgccacctacaccacagagcccgatgcagccactgctgccaagccctctccacccccatcgcccaactcctcaaccctcgaggaacatcccctggcagacaaaagagcactag

SEQ ID NO: 26163 - DNA, 4500 bp, Artificial Sequence
  Description of Artificial Sequence: Synthetic coding sequence
atgatgatggcccggaagcaggacgtgcggatccccacctacaacatcagtgtggtcggactatctggcacggagaaggaaaaagggcaatgtggaatcggcaaaagttgtctctgcaacaggttcgtgcggccgtctgcagatgaattccaccttgaccacacttccgtattatccacaagtgatttcgggggtcgcgtggttaacaacgaccatttcctttactggggggaggtgtctagatctttagaggactgcgtcgaatgtaaaatgcacattgtcgagcagaccgagttcattgatgaccaaacgtttcagccccatagatctactgccctgcagccctatattaagcgggcagcagcaacgaaactggcgtctgccgagaaactcatgtacttttgtaccgaccagctgggcctcgaacaagacttcgaacagaaacagatgcccgacggcaagctgctggtagatgggttcctgcttggcattgacgtgagccgcggcatgaacaggaattttgatgatcagctaaaattcgtctccaacctgtacaaccagcttgctaaaactaaaaagccgattgtggtcgtgctcactaagtgcgatgaaggtgtggaaagatatataagagatgcccatacatttgcgctgagcaagaaaaatctgcaagtcgtcgaaacctccgctcgctccaatgttaatgtggatttagccttctctaccctcgtgcagcttatagacaaatccaggggaaaaactaaaattatcccttatttcgaggccctcaagcagcaatcacaacagattgctaccgctaaagacaagtatgaatggctggtttcaagaatagttaagaaccacaatgaaaattggctcagtgtgtcgcgcaagatgcaggcttcccctgaatatcaggattatgtctacttggaaggcacccagaaagcaaaaaaactgttcctgcaacatatccaccgcctgaaacacgaacacattgaacggcgcagaaaattgtacttggcagccctgcctctggcattcgaggctcttatcccaaacctggatgagatcgatcatctatcctgcattaaagcaaagaagcttttggaaacgaaacctgagtttctcaagtggtttgtggttcttgaggagaccccttgggatgctacctctcacattgacaatatggaaaatgagcgcataccattcgacctgatggacaccgtccctgccgaacaactgtatgaggcccacctggaaaagctgagaaacgagcggaaacgggtcgaaatgcggagggcttttaaggagaatctggagacttcaccctttattacccccggcaagccctgggaagaagcgagatcttttatcatgaacgaagatttctaccagtggttggaggaatccgtttatatggacatctacggcaagcaccaaaagcagatcattgataaggcgaaagaggaattccaagaattgttgttagagtattctgaactcttctacgaactggaactggatgcaaagcccagcaaagagaagatgggagttattcaggacgtgctgggggaagaacaacgatttaaagctcttcaaaagctgcaggctgagcgagatgctctaatcctgaagcacatccattttgtgtaccaccccacgaaagagacctgtcctagttgtcctgcttgcgtggatgccaagatcgaacacctgatttcttctcgttttatccgcccctctgaccggaatcagaagaactccctgtcggaccccaatatcgaccgtataaacttagtgattttgggcaaagatggactggcccgagagctagccaatgaaattcgcgctctgtgcaccaacgacgacaagtatgtgattgacggtaaaatgtacgagctctcattaagacccattgaagggaatgtgagactgccagtgaactcctttcagaccccaacctttcaacctcacggctgtttatgtttgtacaactctaaagaaagtctgagttacgtcgtggaatccatcgagaaatccagggaatccaccctcggccgaagagacaatcacctggtccacctgcctcttaccctcattctcgtgaacaagagaggggatacctctggtgagacccttcattctctcatacagcagggccaacagatcgccagcaaactgcaatgcgtcttcctggatcctgcgtctgcaggcatcggttatggccggaatatcaatgaaaagcagatatcgcaggtcctaaaaggcttgctggactccaagcgaaatctcaatctggtctccagtacagctagcattaaagatctcgccgacgtcgatctacgcattgtcatgtgcctgatgtgtggagaccccttctcagctgatgacatcctatttcctgttctccagagccagacctgtaagtcttctcactgtggatccaataactccgtcttacttgaactccctatagggctccacaagaaaagaatcgagttatccgtactttcttatcattcttctttttctattaggaaatcccgtcttgttcatgggtatatagtcttctattcagcaaagcggaaagcatctcttgcaatgctgagagctttcttgtgtgaggtccaggatatcataccaattcagctagtcgcccttaccgatggagccgtcgacgtcctggacaatgatctcagtcgcgagcagttgaccgagggtgaggaaatcgcccaggagattgatggaaggtttacaagcatcccttgcagccagccacaacataagctagaaatattccaccctttctttaaagatgtggtagaaaagaagaatatcattgaagccacacatatgtatgataatgctgcagaagcttgttccacaactgaggaagtgttcaactctcctcgagctgggagtcccctgtgtaacagcaacttgcaggactccgaggaggacattgaacctagctattctctatttagggaggacacatccctgccctcactgagcaaggaccactccaagctctctatggaacttgagggtaatgatgggctgtcgtttatcatgtcaaattttgagtctaagttgaataacaaggtcccgccgcccgtcaaaccaaagccacccgtccacttcgagataaccaagggtgacttatcttatttggatcagggacaccgagatggccagagaaagagtgtatcttctagtccttggttaccacaagatgggtttgatcctagcgactatgctgagcccatggacgccgtggtgaaacctcgcaacgaggaggagaatatttatagcgtgccccatgactctacccagggaaaaatcatcactattcgtaatatcaataaggcccaaagtaatggcagcggtaacgggagcgacagtgagatggatacgagttcactcgagaggggacggaaggtcagtatcgtgtctaagcctgtcctttacagaacccggtgtacccggctgggacggtttgcaagttaccgtacaagcttctcagtaggtagtgacgatgagctcgggccaatcaggaaaaaggaggaagaccaagcctctcaagggtacaagggagataatgcagtgatcccttatgagacagatgaagacccacggcgaaggaacattctgcgatctcttcgccgtaataccaaaaagcccaagcctaaaccacgcccatcaatcacaaaagctacatgggaatcaaactacttcggtgttcctctgacaacagtggtgacaccagagaagccaatccctatctttattgagagatgtatagagtacattgaagctaccgggctgagcactgaggggatctacagagtatctggcaataagagcgagatggagtcactgcagaggcagtttgatcaggaccacaacctggacttggccgaaaaggacttcaccgttaataccgtcgccggagctatgaagtccttttttagcgaactacccgatcccctggtaccatacaatatgcagatcgaccttgttgaagcccacaagatcaacgatagagaacagaaactccatgcactgaaagaagtgctgaagaagtttcctaaagagaaccacgaagtgtttaagtatgtaatatcccacctcaataaggtgtcacataataataaagtcaacctcatgacgagcgaaaacctcagtatttgtttctggcctaccctgatgcgacctgatttcagtacaatggatgctctgactgctacaaggacctatcaaactattattgagttatttatccagcagtgcccattttttttctacaaccgacctatcaccgagcctccgggggcccggccatccagccccagcgccgtcgcatcgactgtcccgtttctcacttctactcccgttacaagtcagccctctcccccacagagtccgcctcccacccctcagtcccccatgcaacccctcctgcctagtcaactgcaggccgagcataccctgtag

SEQ ID NO: 26164 - DNA, 2250 bp, Artificial Sequence
  Description of Artificial Sequence: Synthetic coding sequence
atgatgatggcccggaagcaggacgtgcggatccccacctacaacatcagcgtggtgggactgagtgggaccgagaaggagaagggtcagtgtggcatcgggaaaagctgcctgtgcaacagattcgtgaggccttcggccgatgagtttcatctcgatcacacctcagtcctcagtacctccgattttggtgggagagtggtcaataacgatcatttcctctattggggcgaggtctctcgctccttggaggactgtgtggagtgtaagatgcatatagtcgagcagacggaattcatcgacgatcagaccttccaaccccataggagcaccgcacttcagccttatatcaagagagccgcggcaacaaagctcgcctcggccgagaagctgatgtatttctgtacggaccaactaggactggagcaagacttcgaacaaaagcaaatgcctgacgggaagctgctcgtcgacggattcctactcggcattgacgtctctcggggaatgaaccgaaacttcgatgaccagctcaaatttgtgtctaacttgtacaatcaattagccaaaaccaagaaaccaatcgttgttgtgctgaccaagtgtgatgagggcgtggagcggtacatcagggacgcccacacatttgccctgagcaagaagaacctccaggttgtagagacctccgccaggtctaacgtgaacgttgacctggcttttagcactttagtgcagctaatcgataagagccggggcaagaccaagataatcccttacttcgaagctctgaaacagcaaagccagcagatagcgacggccaaggataaatatgagtggttggtcagcagaatcgtaaaaaaccataatgaaaactggctgagcgtgagccgcaaaatgcaggccagtcccgagtaccaagattacgtctatcttgaaggaactcaaaaagcaaaaaagctgtttctgcaacacattcacagattgaagcacgagcatattgaaaggagacgaaagctctatttagctgctttgccgttggcctttgaggctctgattccgaacctggacgagatcgatcacctatcgtgcatcaaggcgaagaagttactggagactaagccagagtttctaaagtggttcgtggttctcgaagagaccccgtgggacgcaacgtcccatattgacaacatggaaaatgagcgtattcccttcgaccttatggacactgtgccagctgagcagctatatgaggcccacttggaaaaattgaggaatgaacggaaaagagtggagatgcggcgagcatttaaagaaaacctggagaccagccctttcatcactccgggaaagccatgggaggaagcacgcagttttatcatgaacgaggatttctatcagtggcttgaggaatcagtgtatatggacatctatggtaaacaccagaagcagattatcgacaaagcgaaagaggaattccaggaactgctgcttgaatattcagagctattctacgaacttgaacttgatgctaaaccgagtaaagagaaaatgggcgtaatccaggatgtgctgggggaagaacagcgctttaaggctctgcagaagctccaagcagaacgtgatgctttgatcctcaagcacatacacttcgtttatcaccccacaaaggagacctgcccttcatgtcctgcctgcgtagatgcaaagatagagcacctaatctcatcaagattcataagaccctcagaccgcaaccaaaagaattcgctgtcagatccgaatatcgatcgcattaaccttgtgatcttgggcaaggatggcctcgccagagagctggcgaacgagattcgggctctctgtaccaacgatgacaaatacgtcatcgacgggaagatgtatgagctcagcttgcgtccaatcgaagggaatgttaggctgcctgtgaattcattccagacacccacttttcagccccacggatgcctctgcctgtataatagtaaggaaagtctgtcttatgttgtggaatccatcgaaaaatcccgagagtctacattgggaaggagggataaccatctcgtgcatctgccactgacactcatactggtgaataaacgcggcgacacttctggcgagactctccactccttgattcagcaggggcagcagatcgccagtaagctgcagtgtgtcttcctggatccagcctcagcgggcgcagccgacttgtcctggctggggcccatctag

SEQ ID NO: 26165 - DNA, 978 bp, Artificial Sequence
  Description of Artificial Sequence: Synthetic coding sequence
atggacatgtggaccgccctgctgatcctgcaggccctgctgctgcccagcctggccgacggcgccacccctgctctgaggtttgtggccgttggcgactgggggggagtgccaaacgctccctttcataccgcacgggaaatggccaacgccaaggagatcgcgcgtaccgtacaaattttaggtgctgactttattctctcattgggggataacttttattttaccggggtacaagacatcaacgataaacggtttcaggagacattcgaagacgtcttcagcgatcgcagtcttaggaaggtgccttggtacgtactggcagggaaccacgatcatctaggtaacgttagcgcacagattgcctacagtaaaataagcaagagatggaattttccaagtcctttctacagactgcattttaaaatcccacagaccaacgttagcgtggcaatctttatgcttgataccgttacactctgtggcaatagcgatgatttcctttcacagcagcctgaacgtccccgcgacgttaagttagcgaggacccaactttcatggctgaagaagcagttggccgctgcccgcgaggactacgtgttagtggccgggcattatcccgtatggtccattgctgaacatggcccaacccactgcctagtcaaacagctgcggccattgctggcaacctatggagtcactgcctatctttgtggccatgaccataacctccaataccttcaggatgaaaatggcgtgggatacgtgctgtctggcgccgggaatttcatggacccaagcaaacggcaccagcggaaggtgccaaatgggtaccttcgattccactacggaactgaggacagcctcggtggtttcgcctacgttgagatctcatcaaaggagatgacggtcacctacatagaagcgagcggaaagtctttgtttaaaactcgactcccaaggagagcacgtccctag

SEQ ID NO: 26166 - DNA, 2349 bp, Artificial Sequence
  Description of Artificial Sequence: Synthetic coding sequence
atgaacagcgccgagcagaccgtgacctggctgatcaccctgggcgtgctggaatctccaaagaagaccatatctgatcccgagggcttcctacaggccagtttgaaagatggagtggtgctatgtcgactcctcgagcgtctgcttcccggcacaatcgaaaaggtttatccggaaccacggtccgaatcagaatgcttgtccaatattagggagtttcttcggggctgtggcgcctcattaaggcttgagactttcgacgcaaacgacctgtaccagggacaaaatttcaataaagttttgtcaagcctcgtaacactcaacaaggttaccgctgatatcggcctggggagcgacagtgtgtgcgcccgcccctccagtcaccgcatcaagtctttcgactcactcgggagtcagagcctgcacacaagaaccagtaagctcttccaggggcagtacagaagcctcgatatgacggacaatagtaataatcaattagttgtcagggcaaaattcaatttccagcagaccaacgaggatgaactgtccttctccaagggcgacgttattcacgtgacacgggtagaagaaggggggtggtgggaaggaaccctgaatggacgcactggttggttcccatctaactatgtgcgagaggtcaaggcgtccgagaagcctgtgagtcctaagagcggaactttgaagtcgcccccgaaaggattcgatacaacggccatcaacaaaagttattataacgtggtgcttcagaacattctggaaaccgagaatgagtactccaaggagttgcagacggttttatcaacctatctgcgacctctccagacctccgagaaattgagcagcgccaacatcagctatttaatggggaacctagaggaaatctgctcgtttcagcaaatgcttgttcagagcttagaggagtgtacaaagctgccggaggcacagcaacgcgtcggggggtgtttcctcaatttgatgccacagatgaagaccctctatctaacatattgcgccaaccacccatccgcggtgaacgtgctcactgaacatagcgaagaactcggcgaatttatggaaacaaagggcgcaagtagccctggaatcctcgtcctgacaactgggttaagcaaacctttcatgagactagataagtaccccacccttctaaaagagctcgaacgccacatggaagactatcatactgaccgccaggacattcaaaagtcgatggctgcattcaaaaacttgtctgctcagtgtcaggaggtaagaaagcgcaaggagcttgagctccagatcttaactgaagccattagaaattgggaaggagatgacataaagactctggggaacgtcacttacatgagccaggtcttgatccagtgtgccgggtctgaagaaaaaaacgaaaggtatctgcttctcttcccaaacgtgctactcatgctcagtgccagtccacgaatgagcggctttatctatcagggcaagctgcccactacgggcatgacaataaccaaactagaggactcagagaaccacagaaatgcctttgagattagtggctctatgattgagcgcattttggtcagctgcaacaaccagcaagatctgcaagaatgggtggaacacctgcagaagcagacaaaggtgactagcgtgggaaatcctaccataaaacctcactctgttcctagtcacaccctgccctcacaccccgtgactcccagctccaagcacgcagactctaagcctgctcctcttacacccgcctaccatacgctgcctcatccttcccaccatggtacaccccatacgacgattaattggggtccactggagccaccgaagactcccaagccttggagcctcagttgtctaaggcctgccccccccctcagacctagcgctgcattatgctacaaggaagatctttccaaaagtccaaagactatgaagaaattgttgccaaagcgcaagcctgaacgcaaacccagcgatgaagagttcgctagccggaagagcacagcagctcttgaggaagacgctcagatcctgaaggtgatagaggcctattgcacatcagctaaaactcggcagaccctaaacagtacttggcaggggacagacttgatgcataaccacgtgctggcagatgacgaccagcctagtctggacagtctaggacgtcgcagttcgctttccagactcgagccttcagaccttagcgaggattcagattatgactccatttggacggcacactcttacaggatggggagcacatccagaaagagctgttgttcctatataagtcatcagaactag

SEQ ID NO: 26167 - DNA, 2196 bp, Artificial Sequence
  Description of Artificial Sequence: Synthetic coding sequence
atgaacagcgccgagcagaccgtgacctggctgatcaccctgggcgtcctggaatctcccaaaaagacaatcagcgatcccgagggttttctccaagcatcactcaaagatggagtcgttctttgtcgcttactcgaacggctccttcctgggactattgagaaggtgtacccagagcccaggtctgaaagcgagtgtttgagcaatatccgtgagttccttaggggctgcggcgctagcctgagactggaagacatgaccgataattcaaacaatcagcttgtggttcgggctaaattcaatttccaacagacgaatgaagacgagctgagtttttccaagggagatgtgattcacgttaccagggtggaagaaggcggatggtgggaaggaacactcaatggacgtacgggatggttcccatctaactatgtgcgcgaagtcaaagcctccgagaagcctgtcagcccgaagtcaggcaccttaaaatcaccacccaagggattcgacaccacagctatcaataaaagttactataatgtagtactccagaatattctggagaccgagaacgagtacagtaaggagctgcaaacggtgctgagtacttacctccgaccccttcagaccagcgaaaaactgagctcagcaaacattagttacttgatgggaaacctggaggagatatgtagttttcagcaaatgctcgtccagtcattggaggagtgcacaaagcttcccgaagctcagcagcgggtgggcggttgcttcttgaatttgatgccacagatgaaaaccctgtacctgacatattgcgcaaaccacccctctgcagtaaatgtcctgacggagcactcagaggaattgggagaattcatggaaaccaagggggcgtcctcccccggcatcctggtcctgacaaccggcctgtctaagcctttcatgcgtctggacaaatatcctaccctgttgaaagaactggagcgtcacatggaagactatcatactgaccggcaggatatccagaagagcatggctgcttttaagaatctgtctgcccagtgccaggaggtccggaaaaggaaagaactggaactccagatacttacagaagctatccggaattgggaaggcgatgacatcaaaaccctgggaaacgtcacatatatgagccaagttctgatacagtgcgccggcagcgaggaaaaaaatgagagatacctgctgttgttccccaacgtcttgctgatgttgagcgcgtccccacggatgtccggattcatttatcagggaaaattaccaaccaccggcatgactatcaccaagttggaggactccgaaaatcaccgcaacgcatttgagatttcagggagcatgatcgagagaatcctcgtgtcttgcaacaatcaacaagatctacaggagtgggttgagcacctacagaaacagactaaagtgacttcagtggggaacccaactatcaagccacattccgttccatctcacactctgccatctcatcctgtgacgccatcctcgaaacacgccgactcgaaaccggccccattgacacccgcctaccatactctcccacatccgtcacaccacggcaccccccacactacaatcaattggggtcctcttgagccgcctaagacaccgaagccatggagcttgagttgcttgcgtcccgcacccccactcagaccatcggcggcactctgttacaaggaggacctctccaagagccccaagacaatgaaaaaactcctcccaaagagaaagcccgagcgcaaaccttccgatgaggagtttgccagtcggaagtcaacagccgcactcgaggaggatgctcagattctcaaggttatcgaagcttattgcactagtgccaagactcgccagacgttgaacagcagcagtcgcaaagagtccgccccccaggtgctcttaccagaggaagaaaagattatagttgaagagactaagtcaaatggccagacagtaatcgaggagaaaagtttggttgatacggtttacgctcttaaagacgaggtacaggaactacggcaagataacaagaagatgaagaaatccctcgaggaggagcaaagggcacgcaaggacctggagaagctggtccggaaggtactgaagaatatgaatgatcctgcttgggatgagaccaacctgtag

SEQ ID NO: 26168 - DNA, 1878 bp, Artificial Sequence
  Description of Artificial Sequence: Synthetic coding sequence
atgaccgacaacagcaacaaccagctggtggtgcgggccaagttcaacttccagcaaaccaacgaagatgaactgtccttctctaagggcgatgtgatccacgttacgcgggtggaggaaggtggctggtgggagggaacactgaacggcaggacaggatggttcccttctaattatgttagagaggtgaaagcaagcgaaaagccagtaagtcccaaatccgggactttaaagagtccacctaaggggtttgacacaaccgcaatcaataaatcgtactataacgtggtattacagaatattctggaaacagaaaatgaatacagtaaagagctgcaaaccgtcctgtctacatacctcagacctcttcaaacatccgagaaactgagctcggcaaacatcagctacttgatggggaatctggaagagatttgtagtttccaacagatgttggtacaaagcctggaggagtgtacaaagctgcccgaggcacagcagagagttggcggatgcttcctgaacctcatgcctcagatgaaaaccttgtaccttacgtattgtgctaaccacccatcagccgtcaacgtgcttacggaacatagcgaggagctgggggaattcatggagactaaaggcgcatcctccccgggaattctggtgctgacgacaggcttgagcaagcctttcatgcgcctagataagtaccccaccctactcaaggagctggagcgccacatggaagactaccacacagatcgccaggacattcaaaagagcatggcagccttcaagaatcttagcgcgcagtgtcaggaagtcaggaaacgcaaggagcttgaactgcagattcttaccgaggccatccgtaactgggaaggggacgacatcaagactcttgggaacgtcacttacatgtcccaggtcctcattcagtgcgccggaagtgaagaaaagaacgagcgttatcttctgctgttccccaacgtacttttgatgctgagtgcctctccccgcatgagcggttttatttaccaaggcaagctcccaacaacgggcatgaccataacaaaactcgaggattccgaaaatcatcggaatgccttcgagatctcaggctcgatgatcgagcgcattcttgtgtcttgcaacaatcaacaggacctgcaggaatgggtggagcatttgcaaaagcagacaaaagtgacatctgtggggaacccgactatcaagcctcattctgttccatcacatactctgcccagtcaccctgttacccccagttctaaacatgcagattctaagcctgctcccttaacaccagcctaccacactcttccccacccttcccaccacggcacgccgcataccacgatcaactggggacctctggagccgcctaaaactcctaagccttggagtctgagctgtttgaggccagcgcctcccctacgacctagcgcggcactttgctacaaggaagacttgtctaagtctcctaaaactatgaagaaactgctgcctaaaaggaaaccggagcggaaaccaagtgatgaggagttcgccagtagaaagtccactgccgctttagaggaggacgcgcagatccttaaagtgattgaggcctactgtaccagcgcaaagacaagacagaccttgaattccacttggcaaggtaccgacctcatgcacaatcacgttctggctgacgatgatcagccaagcctagattcattaggacgcagaagctcgctgtcccgcctggagccatccgatctgagcgaggattcagattacgattccatctggactgctcattcatacagaatgggctcgacttctagaaagagttgctgctcttacatatcccaccagaactag

SEQ ID NO: 26169 - DNA, 1941 bp, Artificial Sequence
  Description of Artificial Sequence: Synthetic coding sequence
atgaccgacaacagcaacaaccagctggtggtgcgggccaagttcaactttcagcaaaccaatgaagatgagctgtcattcagcaaaggggatgtgatccacgtgaccagagtggaggagggcggatggtgggaaggaaccctgaacggtcggactggttggtttccctccaattacgtgcgcgaggtaaaggcttcggagaagcctgtgtcaccaaagagtggtactctcaagagtccaccaaaggggtttgacacgaccgctatcaataaatcttattataatgtggtacttcaaaatatcctggagaccgagaacgagtactccaaagagcttcaaacagtgctatcgacgtatctcaggcccttgcagaccagtgagaaactgtcttccgctaacatctcatatttaatgggtaatcttgaagaaatctgttcctttcagcaaatgttagtgcagtcactagaagaatgcaccaaacttcctgaggcccagcaaagggtgggtggttgttttcttaacttgatgcctcagatgaaaaccctatatctgacctactgcgcaaatcacccgtccgctgtcaacgtgcttactgaacacagcgaggagctgggcgagtttatggaaaccaaaggcgcttcatctccagggattctggttttaactaccggtctgtccaagccttttatgcggcttgataaataccctacgctactaaaggagctggaaagacatatggaggactatcacaccgaccgacaggatatccagaagagcatggccgcttttaagaatctgtctgcacaatgtcaagaagttcgcaagcgtaaggagctcgagcttcagatcttgaccgaggccattcgcaactgggaaggtgatgacatcaaaaccctgggcaatgttacctacatgtcacaggttctgatccagtgcgcagggagtgaagagaaaaatgagaggtatctgctactcttccctaacgttctgctaatgctctctgcctcgcctagaatgtctggcttcatttatcaggggaaactccccacaactgggatgactatcacaaaactggaagactccgagaaccaccggaacgcttttgagattagtgggagtatgattgagcgcatcctcgtgtcctgcaataatcagcaggacttgcaggagtgggtcgagcatttgcagaaacagaccaaagtgacgagtgtaggtaatcccactatcaaacctcacagcgtcccaagccatacgctccctagccatcccgttacaccttctagcaagcatgcagatagtaaaccagcacccctaacacccgcgtaccatactctaccccacccgtcgcaccacggaactccccacaccaccatcaactggggccccttggaaccacccaagacccctaagccttggtctttgtcctgcctacgccccgccccgcctctgcgcccttctgctgccctgtgttacaaggaggacctcagtaaaagccccaagaccatgaagaaactgcttccaaaaaggaaaccagaacggaaaccctcggacgaggagttcgcctcccgcaaatccactgccgctctggaagaagacgctcagattttgaaagtaatagaggcatattgtacttccgcaaagacacgacaaaccctcaactcctcttcacgaaaagagtcagctcctcaggtgcttctcccagaagaggagaaaattatcgtagaggaaaccaagtctaacgggcaaaccgtaatcgaggaaaaatccttggttgataccgtttacgcactcaaggacgaggtgcaggaattgaggcaggataacaagaagatgaaaaagtctctcgaggaggagcagcgggccagaaaggacctcgagaagcttgttcgcaaggtactcaaaaatatgaacgatcccgcgtgggatgagactaatctgtag

SEQ ID NO: 26170 - DNA, 2166 bp, Artificial Sequence
  Description of Artificial Sequence: Synthetic coding sequence
atgaagaccttcgacgccaacgacctgtaccagggccagaacttcaacaaggtactttcttccctggtgaccctgaataaagttaccgccgatatagggctgggcagcgattccgtgtgtgcgcggcctagcagtcatcgtatcaagagtttcgacagcctcggatcccaaagcttgcacactcgcacatccaaactgttccaaggccagtataggagtctggacatgactgacaactctaacaatcaactcgtggtgagggcgaaatttaactttcagcagacaaacgaggatgagctctcttttagcaagggcgacgtcattcacgtgactcgagtggaggagggagggtggtgggagggaaccctgaatgggagaaccggctggtttccgtccaactatgtcagggaggttaaagcttcagaaaagcctgtgagccctaagagcggcacgctgaaatctcctcccaagggatttgacactaccgcaattaataaatcctactacaatgtcgttcttcagaatatcctggagactgaaaatgagtattccaaggagctccagaccgtgctcagcacatacctgaggcctttacagacttctgagaaactgtcctccgccaatatatcctacctgatgggaaatttagaagagatctgcagctttcagcagatgctagtccagagcctggaagaatgcactaagctgccagaggcgcaacagcgagtggggggttgcttcctgaacctgatgccacaaatgaagacgttgtatctgacttattgcgcaaaccacccctcagctgtcaacgtgctaacagaacactccgaagagctcggggaatttatggagactaagggtgcctcctccccagggatcttggtgctaacaaccggtctgagcaaaccctttatgagactcgataagtaccctaccctgttgaaggaactggaacgccacatggaggactatcatacagacagacaggacatccaaaaatcaatggctgcctttaaaaatctcagtgcgcaatgtcaagaagtgcgtaagcgtaaggagctggagttgcagattcttacagaggccattcgaaattgggaaggcgatgacattaagaccctggggaatgtgacgtatatgagtcaggtactcattcagtgcgccgggtcagaggaaaagaatgagaggtatcttctcctgtttcccaacgtcctccttatgctgtctgcaagcccccggatgtcgggttttatttatcaaggcaaattacccactacagggatgaccattaccaagctggaggattctgaaaaccaccggaatgcctttgaaatctctgggagcatgattgaaaggatcctagttagttgcaataaccagcaggacttgcaggaatgggtggagcacctacagaaacagacaaaagtgacatctgtggggaatcctactataaaacctcattccgttccctcccatactttaccttcacacccggtcacacctagctcaaagcacgcagattccaagcccgccccgctcacacctgcttaccacactttgccgcacccttcccaccacggaaccccacatacaacgattaattgggggcccctggaacctcccaagactccaaaaccctggtcactgagttgtctgcggccagcacctcctctccgtccgagcgccgcactgtgttacaaggaagacttatcaaaatcccctaagaccatgaagaagttgcttccaaaaagaaaacctgagcgcaaaccaagtgatgaagagtttgcatctcgtaagtccacagccgccttggaggaagatgcccagatactcaaggtgattgaggcatactgcacgtctgcaaagaccaggcaaaccctgaatagcagctccagaaaggaatctgctccacaggttctgttgccggaagaggaaaagataatagtcgaagagaccaagagcaacggtcagaccgtgatcgaggaaaaatcattggtggacacagtctatgccctgaaggacgaggttcaggagctgcgccaggataacaagaagatgaaaaaaagtcttgaggaggaacagcgcgcaagaaaggacctggagaaactcgtgaggaaagtgttaaagaacatgaatgatccggcttgggacgagaccaatctgtag

SEQ ID NO: 26171 - DNA, 2262 bp, Artificial Sequence
  Description of Artificial Sequence: Synthetic coding sequence
atgaacagcgccgagcagaccgtgacctggctgatcaccctgggcgtcttggaaagccccaagaagactattagtgatccggaggggtttttgcaggcttccctaaaagatggagtcgttctctgccggctattggagcggctgttgccaggcacaatcgaaaaaactttcgatgcaaatgatctctatcagggccagaattttaacaaagtcctcagtagccttgtgacactgaacaaagttactgcagacatcggtttggggtcggactccgtgtgcgctcgcccttcaagccacagaattaaaagcttcgattcgctgggtagtcagagcttgcatactagaacatcaaaattgtttcaggggcagtacagaagccttgatatgacagacaatagcaataaccagctcgtcgtcagagcgaagtttaattttcagcagacgaatgaagacgagctgagctttagcaagggagatgttatccacgtgacccgcgtcgaggaaggcggctggtgggaagggactctcaacggcaggaccggatggttccctagcaactatgtcagagaggtgaaagcatcagagaaacccgtctcacctaaaagtggtaccctcaaatcccccccgaaagggttcgatactaccgctatcaataagtcttattataacgtggtccttcagaacattctggagacggagaatgagtattctaaggagttgcagacagtgttgtcaacctacctgaggccattgcagaccagtgaaaaactgtcttctgcaaacatatcgtatctgatgggaaacttggaagagatttgtagctttcagcaaatgctggttcagagtttggaggagtgcactaaacttccagaagcacagcaacgcgtgggaggatgttttctgaatctgatgccacagatgaagactctgtacctgacatactgtgcaaaccatccatcagcggttaatgtgctcaccgaacactctgaagagctgggagaattcatggagactaagggagcttcttcccccggaattttggtgctgactactggcctttctaaaccattcatgcgcttggataagtacccgacactgctgaaagaacttgaaaggcacatggaggactaccataccgatagacaggacatccagaaatcaatggctgcatttaagaacctttcagcccagtgtcaggaggtccggaaaagaaaggaactcgagctgcagatactgacagaagccattcgcaactgggaaggggacgacatcaaaaccttggggaacgtcacatacatgtctcaagtgctcatccagtgtgccggcagtgaggagaaaaatgagcgctatctgctgctgtttcctaatgtcctgctgatgctgtcagctagcccgaggatgagcggctttatataccagggaaagctgcccactacaggtatgacgataacaaagttagaagatagtgagaatcataggaacgcctttgaaatctctggtagcatgatcgaacgcattctagtatcatgcaataaccagcaggacctacaggagtgggtcgagcatctacagaaacagaccaaagtaacctctgtggggaatcccaccattaagccccattccgtgccttctcacacactgccaagtcacccagtgactccttcctctaaacatgccgacagcaagcccgcgcccctgacccccgcttatcatactcttcctcacccctcccaccacggaaccccccacacaacgattaactgggggcccctcgaaccacctaagacgcccaagccttggagtctctcatgcctgaggccagcgcccccactgcgaccaagtgctgcactgtgctataaggaggacctcagcaaaagccccaaaactatgaaaaagcttctgcccaaaagaaaacccgaacgaaaaccaagtgacgaagagttcgcgtcccgcaagagcaccgccgcactggaggaagatgcccagatcctgaaagtcatagaggcgtattgtacgtcggctaagacacggcaaacactgaacagcacttggcagggaaccgacctgatgcacaaccacgtcctggccgacgacgaccaacccagtttggactccctgggacgtcggtcttcattgagtcgcttggagccttccgatctgagtgaagattccgactatgactccatttggacggcccactcatacagaatggggtcaacatcaaggaagtcttgctgttcctacataagtcaccagaactag

SEQ ID NO: 26172 - DNA, 2412 bp, Artificial Sequence
  Description of Artificial Sequence: Synthetic coding sequence
atgaacagcgccgagcagaccgtgacctggctgatcaccctgggcgtccttgagtctccaaaaaaaactatcagcgatccagaggggttccttcaggcgagtttaaaggatggcgtcgtactgtgtcgtctgctcgaacggctgctgccaggcaccatagagaaggtctatcctgagccccgcagtgaaagtgagtgtttaagcaacatcagggagttcctgaggggctgcggggcgtccctacgtctggaactcttatttccgccatcacagccaccacagcacctggtgacgaccatactgctcagtgctagtacttttgatgcaaacgacctttatcagggacagaacttcaataaagtgctgtccagccttgttacactcaataaagttactgccgacatcggcctcggcagtgatagcgtgtgtgctaggccaagtagccataggatcaaaagtttcgattcattggggtcccagtctctgcacactaggacctccaagctgttccaggggcaatatagatcacttgacatgaccgataactctaataatcagctggttgttagagctaaattcaatttccagcagacaaatgaagatgagctgagcttctctaaaggggacgttattcatgttactagggtggaggaagggggctggtgggagggtacccttaatggccgcactggctggtttccgtcaaattacgtcagagaggtaaaggcctccgagaagccagtgagtcccaaaagcgggactctaaagagtccccccaagggcttcgataccacggctatcaacaagtcctactacaacgtcgtacttcagaatatcctggagaccgagaatgaatatagcaaagagctgcagacagtcctgagcacctatctcaggcctctgcagacatcagaaaagttaagttccgccaatatctcctatctgatgggaaacctcgaagagatctgctccttccagcagatgctggtgcaatcactggaggagtgtacaaagctgccagaggcgcagcagagagtgggtgggtgcttcttgaacctcatgccgcagatgaagactctctatctaacctattgcgccaatcatccatccgctgtgaacgtgctgactgagcactctgaagagctgggcgagtttatggagacaaaaggggcttcctcaccaggcattctcgtgctgaccactgggctgagcaagccttttatgcgcctggataagtacccaacactgctgaaggaattggagcgccacatggaagactatcacactgacagacaggatatccagaagagcatggcggcattcaagaatttgagtgcccagtgccaggaggtccgaaagcgcaaagaattggaactccagatcctgacggaagcaatccgcaattgggaaggggacgacatcaagacactgggcaatgtgacgtatatgagtcaggtgcttatccagtgcgcgggatctgaagagaagaatgagagatatctccttctgtttcccaacgtcttattgatgctcagcgcatcaccgcgaatgtcaggcttcatttaccaagggaagcttcccaccactggaatgacgattaccaagcttgaagattctgagaaccatcgtaacgcctttgaaatttccggaagcatgattgagaggatcttagtctcatgcaataaccaacaggatctccaggaatgggtcgaacatttacagaaacagacgaaagtgacgagtgtgggcaaccccaccatcaaaccccactcagtgcctagccatacactgccaagccacccagtcactccatcatcgaagcacgctgactccaaacctgcacccttaactcctgcctaccacaccctgccacacccgtcgcatcatggaacacctcacacaacaatcaactggggcccgcttgaaccgcccaaaacccctaaaccatggtcactcagctgtttaagacctgcccctcccctccggcccagcgctgctttatgttataaggaggacctgtctaagagccctaaaaccatgaaaaagttgttgccaaagagaaagcccgaacggaaaccctccgacgaggaattcgcctcacgaaaaagtacagcagcgttggaagaggacgctcagattctcaaggtgattgaagcttattgcacgtccgcaaagaccagacaaacactaaacagtacatggcaggggaccgatcttatgcacaatcacgttcttgctgacgatgaccagccaagcctggattctctcggacgacgctcaagtttatcccggttggaaccaagtgatctgtccgaggattcagattatgacagcatatggaccgcacattcatacagaatgggctcaacatcacgaaagtcctgctgttcctacatttcacatcagaactag

SEQ ID NO: 26173 - DNA, 1941 bp, Artificial Sequence
  Description of Artificial Sequence: Synthetic coding sequence
atgaccgacaacagcaacaaccagctggtggtgcgggccaagttcaattttcagcaaaccaacgaagatgaactgagtttctccaaaggtgacgtgattcacgtaacacgagtggaagagggcgggtggtgggaggggaccctgaatggcaggactggctggttcccctcgaactatgtgagggaagtcaaggcttcagagaagcccgtgagccctaaatcaggcaccttaaaaagcccgcccaagggctttgacaccaccgccattaacaaatcatattacaacgtcgtcctccagaacattctggagaccgaaaatgagtactcgaaagagttgcagaccgtgctgtctacatatctgagacctctgcagacgagtgagaaattatccagcgcaaatatcagctacctgatgggcaatttggaagaaatctgctcattccagcagatgctggttcagtctttggaggagtgcacaaagctccctgaagcacagcagcgcgtcggaggatgctttctgaatctgatgcctcaaatgaagactctctacctcacttactgcgcgaaccacccaagtgcagttaacgtgctgaccgagcattccgaggagctcggtgagttcatggagacaaaaggggcctcctccccaggaatccttgtgttaactacaggactgagtaaaccgttcatgcggctagacaagtatccaactctgctgaaggagctggaaagacacatggaggattatcatacagaccgacaggatattcagaagtcaatggctgcttttaaaaatctctccgctcagtgccaggaggtacggaagcgcaaagaactggagcttcaaatattaacagaagccatccgcaattgggaaggtgacgatattaagactctggggaacgtgacttacatgtcccaggtgttgatccaatgtgccggctctgaggagaaaaacgaacgatatttgctgctgttccctaatgtcctgttgatgttgagtgcctctccgcgtatgtccgggttcatctaccagggcaagttgccaacaacagggatgacgatcacaaagcttgaagacagcgagaaccacaggaacgcttttgaaatctccggatccatgatagagcggatactggtgagttgcaacaaccagcaagatctccaggagtgggtggaacatctgcagaaacagaccaaggtgacatctgtggggaatcccacaattaagccccattctgttccaagccatacactcccgagccaccccgtaacgcctagcagcaaacatgcagatagcaagcctgcacctctgactcccgcctaccacaccttgccccacccatctcatcacggcacaccacatacaacaataaattggggcccgctggaacctcccaaaacacccaagccttggagtctttcatgtcttaggcccgccccgcccctcagacccagtgccgccctgtgttataaggaggacctctctaagagccctaagaccatgaaaaagctgctgcctaaaaggaagccagaaaggaaaccctcagacgaggagttcgccagcaggaaaagtacagccgccctggaggaggacgcccagatcttgaaagtgattgaagcttactgtaccagtgctaagactaggcagactttgaactccagcagccggaaagaaagtgccccccaggtgctgcttcccgaggaggagaaaattattgtggaagaaacaaagagcaacggacagaccgttattgaggagaagtcactcgtcgatacagtttacgccctgaaggacgaggtccaggagcttcgacaggacaataagaaaatgaagaagtcactggaggaggaacagcgcgcgagaaaggacctggagaaacttgttcggaaggtgctaaagaatatgaatgatccagcttgggatgaaacaaatctgtag

SEQ ID NO: 26174 - DNA, 201 bp, Artificial Sequence
  Description of Artificial Sequence: Synthetic coding sequence
atgaccgacaacagcaacaaccagctggtggtgcgggccaagttcaactttcagcagacaaatgaggacgagttaagtttttccaaaggtgacgttattcacgtaacccgggttgaggagggaggctggtgggaaggcacactgaatgggaggacaggatggtttcccagcaactatgtgcgtgaagtgaaagctagttag

SEQ ID NO: 26175 - DNA, 1344 bp, Artificial Sequence
  Description of Artificial Sequence: Synthetic coding sequence
atgaccgacaacagcaacaaccagctggtggtgcgggccaagttcaattttcagcagaccaatgaggacgaactgtctttcagtaaaggtgatgttattcacgtgacgagggtcgaggagggaggctggtgggaagggacactgaatggacgcaccggttggtttccctctaattacgtaagggaagtcaaagcatccgagaaaccagtcagtcctaagagcggtacactgaaatcacctccaaaaggattcgataccaccgccattaataagtcttactataatgtcgtcctccagaatatcctggagacggagaatgagtattcaaaagaactccaaacagtgttgtcaacctaccttagacctctccagacctcagaaaagctgagctcagccaacattagctatctgatgggcaacctggaggagatctgcagcttccagcagatgctagtgcaaagcctggaggagtgtacaaaattgcccgaagctcagcaacgcgttggcggctgctttctaaatcttatgccccaaatgaaaaccttatatcttacgtactgcgccaatcacccctcagccgttaacgttctgaccgagcatagcgaggaattgggggagtttatggagactaagggcgcctctagtccaggaatcctggtgctaaccacaggtctgagtaagccctttatgcgcctggataagtatccgactttgctgaaagagctggagcggcacatggaggactaccacaccgacagacaggacatccagaagtcaatggccgcttttaaaaatttaagcgcccagtgtcaggaagtgaggaaacgcaaggagcttgagctgcagatcttgactgaggcaattcgtaactgggaaggcgatgatattaagaccttaggaaacgtcacttacatgagtcaagtccttatccagtgtgcaggaagcgaggaaaaaaatgagaggtacctgctgctgtttccgaacgtattgctaatgctgagtgcctcacctcgtatgtctggttttatttaccagggaaagctgcccacaactggaatgacaatcacgaagctggaggatagcgagaatcacagaaatgcctttgagatcagcgggtcaatgattgagcgtatcttagtgtcatgtaacaaccagcaggatctgcaagagtgggtggagcacctgcagaaacagaccaaagtgactagcgtggggaatccaacaatcaagcctcacagcgtcccttctcacacgcttcctagccaccctgtgacacccagctctaaacacgccgatagtaagcccgccccactgaccccggcttaccacactctccctcattag

SEQ ID NO: 26176 - DNA, 186 bp, Artificial Sequence
  Description of Artificial Sequence: Synthetic coding sequence
atgaccgacaacagcaacaaccagctggtggtgcgggccaagttcaatttccagcagacgaatgaggacgagctgtcatttagtaaaggggatgtgattcacgtgacccgagttgaggaaggcggatggtgggagggtacattaaacggtaggaccgggtggtttcctagcaactacgttcggtag

SEQ ID NO: 26177 - DNA, 120 bp, Artificial Sequence
  Description of Artificial Sequence: Synthetic coding sequence
atgaccgacaacagcaacaaccagctggtggtgcgggccaagttcaactttcagcagactaacgaggacgaattgtccttttctaaaggggacgtcatacatgtcacccgggtagaatag

SEQ ID NO: 26178 - DNA, 546 bp, Artificial Sequence
  Description of Artificial Sequence: Synthetic coding sequence
atgtgcttcccccggagcagcgtgaccaccgacgaccaccagctggatggtataaaaagcactagggcaccagccccaggttgttgttgctgtccaagtgaaacactgagaagtggggaggtggcccggtcaagtgccgagagccggagactgctgtttaaaccagacgccaccgatgaaaatccagttcctcacgtgctctgtcagagtcccttttgcagcgagtgcccacatgggacacaggactatcacactgacagacaagatatccagaagtcaatggctgcctttaagaatctgtccgcccagtgccaggaggttcggaagagaaaagaactcgagctacagatcctgaccgaggcaatcagaaattgggaaggggacgatattaaaacacttggaaatgttacttatatgagccaggtcctcatacagtgtgcggggtcagaggagaagaacgagaggtatttgctgctgtttcctaacgtgctactcatgttgtcggcaagtccacgcatgtctggcttcatctatcagggcgcttag

SEQ ID NO: 26179 - DNA, 2070 bp, Artificial Sequence
  Description of Artificial Sequence: Synthetic coding sequence
atcccccccagcaagcccctgcggggcagcagcctgtggggctgctggtcaaggcctaagactatctccgatcccgaaggatttttgcaggcttctttgaaggacggagttgtactgtgtcgcctgcttgagagattgctgcctggcacaatcgagaaagtctatccggaacctagatccgagagcgaatgtttgtcaaatattagagaatttcttagaggatgcggtgctagtctgcgcctagaaacattcgacgctaacgacttatatcagggccagaatttcaataaagtgttgtcgagtttggtgactctcaacaaggtcaccgcggatatcgggctgggaagtgactccgtatgcgcacggccctcgagccaccgaatcaaatctttcgactctctggggagccaaagcctgcatactaggacatcgaaattgttccagggacagtacaggtcattggacatgactgacaacagcaacaaccaactggtagttcgggcaaagtttaactttcagcagaccaatgaagacgaactttccttttctaagggtgatgttattcatgtaacaagggtggaggaaggaggctggtgggaaggcaccctaaatggtcgaacaggttggttcccctctaattacgtcagggaggtgaaggcatcggagaagccagtgagtcccaagtctggcacgctgaaatccccacctaaaggcttcgacacaaccgccatcaacaaatcttattataacgtcgttctgcaaaatattctagaaaccgagaacgagtactccaaggagcttcagaccgtgctgagcacctatcttcgtcctctgcagaccagcgaaaaactctcatccgcaaacatcagttacttaatgggtaacctggaagagatctgtagctttcagcaaatgctcgtgcagtcactggaggagtgtaccaaactacccgaggcccagcagcgggtaggcgggtgtttcctcaacctgatgccacaaatgaagacactctatctgacatactgtgcgaaccacccttctgccgtgaatgtactcacagagcatagtgaggagctgggcgaattcatggaaactaagggcgcaagttctcctggaatcctggtactaacaactggcttaagcaagccgtttatgcgtctcgacaagtacccaaccctgctcaaggagctggagaggcatatggaagattatcatacagatcgccaggatatacagaagtccatggcggccttcaaaaacctcagcgcgcagtgtcaagaggttcggaagcggaaagagttagagctgcagatccttactgaggctattcgaaactgggagggtgatgacataaaaaccctcggtaatgtaacttacatgtcccaggtcttgatccagtgcgctggctccgaggaaaagaacgaacgctatctgctgctctttcctaacgttctgctcatgttgtctgcgtcacccaggatgtccggtttcatttaccaagggaagttgcctaccaccggaatgacaattacgaaactcgaagattctgaaaatcatcgaaacgcctttgaaatctcaggatctatgatagagcgcatcctggtgagctgtaacaaccagcaggacctgcaggagtgggtggaacatctgcagaaacagaccaaagtgacatcagtgggcaaccctactatcaagccccattctgtaccttcacacaccctgccgtctcaccccgtaacaccctcttcaaaacacgccgactcaaaacccgccccgctgactcccgcctaccacacactcccccatccatctcaccacggaacaccccacacaactatcaattggggccctctagaaccccccaagacccccaaaccttggagtctgtcttgccttagaccggccccacccctgcggccatcggcggccctttgttataaagaggacttgagtaaatcaccaaaaaccatgaaaaagctgctgccaaagagaaagccggagcggaaacccatgagatcttctaggccaggcaaggcccagctgctttggaagaagatgttgaggttttag

SEQ ID NO: 26180 - DNA, 4065 bp, Artificial Sequence
  Description of Artificial Sequence: Synthetic coding sequence
atgagcaccggcgacagcttcgagacccggttcgagaagatggacaacctgttacgagatccgaagagtgaggtcaactcagactgtttgttagatgggctagatgcgctggtgtacgatcttgactttcctgctctgaggaagaataagaatatagataacttcttgagtaggtataaggatactattaataagatccgggatctgagaatgaaagcagaggattacgaggtggtgaaggttatcgggcgcggcgcctttggggaagtgcagctggtcaggcacaagagtacgcggaaggtctacgctatgaagctcctcagtaagtttgagatgattaagcgtagtgactccgcctttttttgggaagaaagagacattatggcttttgctaactccccatgggtcgtgcagctattttatgccttccaggacgaccgctacctgtacatggtgatggaatatatgccaggcggagacctggttaacctaatgtctaactatgacgtgccagagaagtgggcaaggttttacacagctgaagtagtcttggcgttggacgctatacactccatgggcttcatccatagagacgttaagccagataatatgctgttggacaagtcaggtcatcttaagctagctgatttcgggacatgcatgaaaatgaataaggagggcatggtaaggtgcgatactgccgttggaacgccagactacatatctcccgaagtgctgaagtcccagggtggagatggatactacggccgagaatgtgattggtggtccgttggcgtttttctctatgagatgttggtgggagacacaccattctacgctgactctctggtgggtacatatagtaaaatcatgaaccataaaaacagcctgacctttccagacgacaacgacatttccaaggaggcgaagaacctgatctgtgcttttctcacagacagagaggtgagactcggtcgtaatggcgttgaggagattaagcgccacctttttttcaagaacgatcaatgggcctgggaaacgcttagggacaccgtggcccctgtggttcctgatttgagtagtgacattgatacctctaacttcgacgacctggaagaagacaagggggaggaagaaacgttccctattccgaaggccttcgttggaaaccagctgccatttgtgggcttcacatactactcaaatcgccggtacctgtcatctgcgaaccccaatgataaccgtacctcaagcaatgccgacaagtccctgcaggaaagcctacagaagactatctacaagctggaagaacagctccacaacgaaatgcaactgaaagatgaaatggagcagaagtgtcggaccagcaatatcaagctggacaagattatgaaggagctggacgaggaaggtaaccaacggcgaaatctcgagagcacagtgtcacaaattgaaaaagaaaaaatgctgctgcagcacagaattaacgagtatcagcgcaaagccgaacaggagaatgagaagcggaggaacgtggaaaacgaggtgtcaactctgaaggaccagctagaagatctgaaaaaagtgagccagaactctcaattagctaacgaaaagctaagtcagctgcagaagcagctggaggaagccaatgaccttctacgaactgagagcgatacagctgtgcgactgcggaagtcgcatactgaaatgtctaaatccatttctcagctagagtcactaaatcgtgagttgcaggagaggaaccggattttggaaaactctaagtcccagacggataaggactattaccaactccaggccattctcgaggcggagagacgcgataggggacatgatagcgagatgatcggagacttgcaggctcgcattaccagtctacaggaagaggtgaaacacctgaaacacaacctggaaaaggtcgaaggcgagcgcaaggaggcccaagacatgctgaaccattccgagaaagagaagaacaatctggagatcgacttgaattacaaactgaagagcctgcagcagcgactggaacaggaggtgaatgagcacaaggtgaccaaggcccgattaaccgacaagcaccagtctattgaagaagctaagtccgtcgccatgtgtgagatggagaagaaattaaaggaggagagagaggcaagggagaaggctgaaaacagggttgtgcaaattgagaagcaatgtagcatgctggatgtggaccttaaacaatcacagcagaaactcgaacacctgaccggaaataaagagcgtatggaggacgaagtgaaaaatttgacattacagctggaacaagagtctaacaagcgactcctacttcaaaacgaactgaagacacaggcctttgaggccgacaacctcaagggtctcgaaaagcaaatgaagcaggaaattaacacacttctagaagccaagcgcctgctggagttcgagctggctcagctcacaaagcagtaccggggaaacgaggggcagatgagagaattacaggatcagttagaggctgagcaatatttcagtaccttatataaaactcaagtgaaagagctaaaggaagagatcgaggaaaaaaatcgggagaatctcaaaaagattcaggagctgcagaatgagaaagaaactttagcaacccaattggacctggcggagactaaagccgagtctgaacagctggcacggggactgctagaggagcaatacttcgaactgacacaggaatctaagaaggccgcctctagaaatcgtcaagaaatcaccgataaagaccacacagtgtcaaggctggaagaagccaactccatgttaacaaaggacatcgagatactgcgccgagagaacgaagagctcacagaaaaaatgaaaaaggcagaagaggaatataagcttgagaaggaagaagaaatttccaatctcaaggcggccttcgagaaaaatattaacactgagagaaccctgaaaacccaagcagtgaacaaactggccgaaatcatgaacaggaaagatttcaagatcgaccggaagaaagctaacacacaggacctccgcaaaaaggagaaagagaatcgtaagctgcagcttgaactgaaccaggagcgcgaaaagttcaatcaaatggtcgtgaaacaccaaaaggaattgaatgacatgcaggctcagctagttgaggaatgtgcacacagaaatgagttgcaaatgcagttggcaagcaaggaatccgacatcgagcaacttcgtgccaaactgcttgacctatcagactccaccagtgtggccagcttcccatccgcagatgaaacagacggcaatcttcctgaatctcgcattgagggctggttgtccgtgcccaacagaggaaatatcaaacgctacggttggaaaaagcagtacgtagtggtcagcagcaagaaaatcctcttttacaatgatgaacaggataaggagcaatctaacccttctatggtcttagacatcgataagctgtttcacgtacggccagttacgcagggggatgtctaccgggccgaaacagaagagattccaaagatctttcagatcttatacgctaatgaaggggagtgccggaaggatgttgaaatggagcctgtccagcaggcggaaaagaccaactttcagaatcacaaagggcatgagtttatccctacactctaccacttccccgctaactgcgatgcatgtgcaaagcctctatggcatgttttcaaaccgccacctgccctggagtgtcgccgctgccacgttaagtgccaccgggaccacctggataagaaagaggatctgatttgcccttgtaaggtatcctacgatgtgacatctgctagagacatgctgctactggcgtgctctcaggatgagcagaagaagtgggtcacacatctggtaaaaaaaattccaaaaaaccccccctctggttttgtgcgagccagcccccggactctttccacccgctctaccgccaaccagtccttcaggaaagtcgttaaaaacacaagtggcaagacctcatag

SEQ ID NO: 26181 - DNA, 471 bp, Artificial Sequence
  Description of Artificial Sequence: Synthetic coding sequence
atggcccccgcccgggccggcttctgccccctgctgctgctgctgcttctcggactgtgggtagctgaaatccctgtgagcgctaaacccaaagggatgacgtcaagccagtggttcaagatccagcacatgcaacctagtcctcaggcctgtaactcagcaatgaagaacattaataagcatacgaagcgatgcaaggatctgaacacatttcttcatgaacctttctcctcagtagctgccacttgccaaacccccaaaatcgcatgtaagaatggggataagaactgtcaccagtctcacggtgccgtctccctcaccatgtgcaagctcacctcaggcaagcaccccaactgtcgctataaggagaaacggcaaaataaatcttacgtggtagcttgcaaacctccacagaagaaggattcacagcaattccatctcgtgcccgtacacctggaccgtgtactgtag

SEQ ID NO: 26182 - DNA, 471 bp, Artificial Sequence
  Description of Artificial Sequence: Synthetic coding sequence
atggcccccgcccgggccggcttctgccccctgctgctgctgctgctcctgggactatgggtggcagagatcccagtgtcagccaaacctaagggcatgacatcgtcccagtggttcaaaattcaacacatgcaaccctctccgcaggcatgtaacagcgctatgaaaaacatcaataaacacacaaagaggtgcaaggacctgaacacatttctgcacgagcccttttcctcagtggcggctacttgtcaaacccccaaaattgcgtgtaagaatggggacaaaaattgccatcagagtcacggggccgtctccctcacaatgtgtaaactcacgagcggaaaacaccctaactgcagatataaggagaaacgccagaacaaatcatatgttgtggcttgcaagcccccccagaagaaagattcccagcagtttcatctggtccctgtccacctggacagagttttgtag

SEQ ID NO: 26183 - DNA, 831 bp, Artificial Sequence
  Description of Artificial Sequence: Synthetic coding sequence
atgctgcagcaggacagcaacgacgacaccgaggacgtgagcctgttcgacgccgaggaagagactactaaccggccccgcaaggccaaaattcgacaccctgtggcctcttttttccacctcttcttcagggtgtccgccataatcgtgtgtctgttgtgtgagcttctttcaagcagctttatcacatgcatggtaactatcattctgctgttatcttgcgacttctgggcagtaaaaaacgttaccggcagactgatggtaggtctcaggtggtggaatcacattgacgaggatgggaaatctcactgggtctttgagagccggaaggaaagcagtcaggaaaataagactgtctccgaagccgaaagcaggatattctggctcgggctcatcgcctgctctgtcctgtgggtgatctttgcgtttagcgctctattctcctttaccgtgaaatggctacgccgctcccggcacatcgcccaaacaggactgaaagtgctgggcagtcgtgatccaccggctagcgctttccaatctgcgggcattacaggcgtgtcacggtgcccgggacacccttctcggaagttccatcaagtggatattaattcctttactcggattacagacagagccctgtactggaagcccgcacctcggctgtcctcaccgccactgagggctgcccctggcaattgtcagcagatggcccctgccaggctgttcctttctttgaggctctgggcttggcgtggcggcggtgagtctcccaacagccgcgggacaggcgaaccaggacccaagttccacctggcttcaggcatgcactag

SEQ ID NO: 26184 - DNA, 1419 bp, Artificial Sequence
  Description of Artificial Sequence: Synthetic coding sequence
atggaccacggcggcgtgggcccctacgagctgggcatggagcactgcgagaagtttgaaatcagcgagacgtcagtgaatagggggcccgagaaaatcagaccagagtgttttgaactcctacgggtcttaggtaaggggggttatggcaaagtcttccaggtgaggaaggtcacgggcgccaacactgggaaaatttttgcaatgaaggtactgaagaaagctatgatcgttagaaatgcaaaagatacggcgcacacgaaagcagaacgcaatatactggaggaggtcaaacatccctttattgtagaccttatttatgcttttcagactggtggtaagctgtacttaattcttgaatatctgtctggcggtgagctgttcatgcagttggagagggagggaatcttcatggaagacactgcatgcttttacttggcagaaattagcatggcactcggtcacctgcaccagaaaggcatcatatacagagacctaaaacctgaaaacataatgctgaaccaccagggtcatgtcaaattgaccgactttgggctatgtaaagaatcaattcatgacgggacagtgacccacaccttctgtggcacaattgagtacatggctccggagatcctcatgaggtcagggcacaatagggccgtggattggtggtctctgggagccctgatgtacgacatgcttactggagcaccaccatttaccggtgagaacaggaagaaaaccattgacaaaatattgaaatgcaaattgaacctccctccctacctgacccaagaggcaagggatctgctgaaaaagttgctcaagagaaacgccgccagtcggttaggggccgggcctggggacgccggtgaagttcaagcccatccgttttttagacatatcaattgggaggagctgcttgccagaaaggtggaacctccatttaaaccactgcttcaatctgaggaggacgtcagtcaatttgattcgaaatttactaggcaaactcctgtggattctcccgacgactctactcttagcgagtccgccaatcaggtgttcctcgggtttacctatgttgcccctagtgttttagagtccgttaaggagaaattcagttttgagcctaaaattaggagccccaggcggttcattggttcaccacgtacccctgtaagccccgtaaaattctcccctggcgatttctgggggcggggagcttcggcctctaccgcgaatccccagacgccggtggagtatcctatggagacgtccggtattgagcaaatggatgtaacgatgtccggtgaggctagcgcccctctgccaatccggcaacccaactccggtccctacaagaaacaggcgtttccgatgatctcgaaacgtccagagcacttgagaatgaatctctag

SEQ ID NO: 26185 - DNA, 1356 bp, Artificial Sequence
  Description of Artificial Sequence: Synthetic coding sequence
atgcggcggcggcggcggcgggacggcttctaccccgcccccgactttagagaccgcgaagcagaggacatggctggggtcttcgacatcgatttagaccagccggaagatgccggcagcgaagatgagctggaagagggaggccaattgaatgaatcgatggaccatggaggcgtcggcccctatgaactcgggatggagcactgcgaaaagtttgaaatcagcgagacatcagtaaaccggggcccagagaagataaggcccgaatgcttcgagcttctacgggttctcggtaagggagggtacgggaaggtattccaggtgcgcaaggtaacaggagctaatacaggcaaaatattcgccatgaaagtgttgaaaaaggccatgatagtgaggaatgccaaggatactgctcacaccaaggctgagaggaacattctggaagaggtgaaacacccattcattgtcgacctcatctacgcgttccagaccggcggaaaactgtaccttatcctcgaatacctgtcagggggtgagctatttatgcagctagagagagaggggattttcatggaagacacagcatgcttttacctggccgagatcagtatggcactgggacacctacatcaaaagggtattatctaccgcgatttaaagcccgagaatatcatgttgaaccaccagggccacgtgaaattgactgacttcggactctgtaaggaatccatccacgacggcactgtcacacatactttctgcggaactattgagtacatggcccctgagattctaatgcgcagtggacacaaccgcgccgttgactggtggagtctgggagcactgatgtatgatatgcttactggcgcaccgcccttcaccggcgaaaatcgaaagaaaaccatcgacaaaattctgaaatgtaagctgaatcttccaccttatctgacgcaggaagcccgcgatttgttaaaaaaattactgaagagaaatgcagcctcaaggcttggtgccggaccgggtgacgccggtgaggtacaggctcaccctttttttcgccatatcaattgggaagagctgctggctagaaaggtggagcctccatttaaacctctgttacagtcagaagaggatgtaagccagttcgacagcaaattcacaaggcagacccctgtggattcccccgatgacagcaccctgtccgaatcagccaatcaggtgttcctcgggtttacctacgtggcccctagcgtgctggagtccgttaaagaaaagttcagttttgaacccaaaatcaggtccccaaggaggttcattggatcaccccgcacccccgtgagtacagccatgtgttag

SEQ ID NO: 26186 - DNA, 1509 bp, Artificial Sequence
  Description of Artificial Sequence: Synthetic coding sequence
atgcggcggcggcggcggcgggacggcttctaccccgcccccgactttcgagacagagaggctgaggacatggccggggtgtttgacatagaccttgaccagcccgaggatgctggcagcgaggatgaacttgaggagggagggcaactgaatgaatctatggaccacggcggagtgggtccttatgaactgggcatggaacactgtgaaaaatttgaaatttctgagacttcggtgaacagagggcctgagaagatccggcccgagtgtttcgaattgctgagggtcctcggaaagggcgggtacggcaaggcaatgatcgttagaaacgccaaggataccgcccataccaaagcggaacggaatatccttgaggaggtcaagcacccatttattgtagacttgatctacgcctttcagactggaggaaagttatatctgatcctagaatacctgtcagggggagagctgttcatgcagctggagcgggagggaatttttatggaagatacagcatgcttttatctggctgagatctctatggcattagggcacttgcaccagaaaggaattatctacagagaccttaagccagagaacatcatgctcaatcatcagggacatgtaaagctgaccgatttcggtctgtgtaaagagtccattcacgatgggaccgttactcataccttctgcggaactatagagtatatggcacctgagatactgatgcgttcaggccacaaccgagccgtggactggtggagcctgggagcactgatgtacgacatgctgactggcgcgcccccttttaccggagagaatagaaaaaagacgatcgacaagattcttaagtgcaaactaaacctgccaccttatctgactcaggaggcgcgagacctgctgaaaaagctgttgaaacgaaacgctgcttcgaggctaggcgcaggtcccggagatgctggggaagtccaagctcacccgttcttcaggcacattaactgggaggaactgcttgcccgtaaggttgaaccacccttcaaaccactcctgcagtcagaggaggacgtgtcccagtttgacagcaagttcacacgccagacacccgtggattctcctgatgacagcacgctcagcgagtctgcaaatcaggtctttctcggcttcacatatgtcgcgccctcagtgctggagtctgtgaaggagaagttctcttttgaacccaagattcgatctcctagacggttcattggctctcctagaactcctgtgtctcccgttaagttttcccccggagacttctggggacgcggagccagcgcgagtactgctaacccccagacaccagtagaatatcccatggaaacctccggaatcgaacagatggacgtgactatgtccggtgaagcttccgcacccctgcctattagacaaccgaacagcggtccttacaaaaaacaggccttccctatgatatcaaaaaggccagagcacttacggatgaacctgtag

SEQ ID NO: 26187 - DNA, 1932 bp, Artificial Sequence
  Description of Artificial Sequence: Synthetic coding sequence
atgaaggtgctgaagaaggccaccctgaaggtgcgggaccgggtgcggactaagatggagcgcgacattcttgccgacgtcaaccacccgttcgttgtgaaactgcattacgcttttcagacggagggcaaactttatctgattcttgattttcttcgtggtggcgatctcttcactagactgtccaaagaggtaatgtttacagaggaagatgtgaagttttatcttgctgagttggcactgggcctggatcacttacatagccttggtataatttaccgggaccttaaacctgagaatatcctgttagacgaagaaggccacatcaagttaacggattttgggttgtcaaaggaagctatcgatcacgaaaagaaagcctatagtttctgtgggacggtggagtacatggctccagaggtcgtgaaccgccagggacactcccactccgccgactggtggagttatggcgttcttatgtttgaaatgctcaccgggagcctgccatttcagggaaaagacagaaaagaaacaatgacactgattcttaaagccaaactggggatgccccagttcctgtcaactgaagctcagtccctgttgagagcattatttaagcggaatcccgccaaccgcctcggctcaggacccgatggagctgaagaaattaagagacacgttttttactccacaatcgattggaataaactatatcgtcgggagattaagcctccattcaaacccgcagtggcccaacctgatgacacattctattttgataccgaattcactagcagaacccctaaggattctcccggcatccccccttctgctggggcacaccagctcttccgaggctttagcttcgttgcgaccggccttatggaggacgacggcaagcctagggctccacaggctcctctgcacagtgttgtccagcagctgcacggtaaaaatctcgtattcagtgatggttacgtggtgaaagagaccatcggggtcgggagctactccgagtgcaagagatgtgtccataaggcgactaacatggaatatgctgtaaaggttatcgacaaaagcaaaagagatcctagcgaggagatcgagatactgctcaggtatggtcagcacccgaacatcatcaccctcaaagacgtgtatgatgacggtaagcatgtctatctggtcacagaattgatgagaggcggagaactgctcgataaaatcctgagacaaaagtttttctcagagcgtgaagcgtccttcgttctccacaccataggtaaaacagtggaatatctacactcccaaggcgtggtgcaccgcgatcttaaaccctcaaatattctgtatgtggatgagagcggaaaccccgagtgtctgagaatctgtgacttcggattcgccaagcaactgcgggccgaaaatggactgctgatgacgccatgttacactgctaattttgtggcacctgaagtgctgaagcgccaggggtatgacgaagggtgcgatatttggtccctgggaatcctgctgtacacgatgctggctggttacaccccgttcgccaatggaccatcagatacccccgaggagattttaacccgaattggatcaggcaaatttacccttagcggaggtaactggaatacggtctcagagaccgcaaaagacctcgtgagcaagatgttacatgttgacccccaccaaagactcactgctaagcaggtgcttcaacatccgtgggtgacacagaaagataagctgcctcaatcacaactgagtcaccaggacctccagctcgtaaagggagcgatggccgccacttactccgcactgaacagctctaaaccgacaccacaactgaaaccaattgaatcttcaatattggctcagcgccgggtccgcaagttgccttcaacaacgctgtag

SEQ ID NO: 26188 - DNA, 687 bp, Artificial Sequence
  Description of Artificial Sequence: Synthetic coding sequence
atgccccagttcctgagcaccgaggcccagagcctgctgcgggccctcttcaaaagaaaccctgccaatcgtctgggcagtggaccagacggcgccgaagagattaagcggcacgtgttctattctaccattgattggaataaattgtaccggagggagatcaagccaccatttaagcctgctgtggcccagccagacgataccttctactttgatacagagttcaccagcaggactcccaaggattcccctggcatcccgccttctgccggtgcccaccagttatttaggggattctccttcgttgccacgggcctcatggaggacgacggaaagccgcgagcacctcaggctccactccacagtgtggtgcaggttatcgacaagtctaagagagacccttccgaggaaatcgagatccttctgcggtacggacagcaccccaacatcattacactgaaggatgtgtatgatgacggcaaacatgtgtacctggtaactgaattaatgagaggaggggagctcttggacaaaatcctacgccaaaagtttttctccgagcgggaagcttcattcgtcctccataccattggcaagactgtcgaatacctgcatagtcagggcgtggtccatcgagacctgaaacccagcaatattctctacgtcgatgaaagcgggaacccatag

SEQ ID NO: 26189 - DNA, 2208 bp, Artificial Sequence
  Description of Artificial Sequence: Synthetic coding sequence
atgcccctggcccagctgaaggagccctggcccctgatggagctggtcccgctggatcctgaaaacggacagaccagcggcgaggaagcaggactgcagcccagcaaggatgaaggagtcctcaaggagatcagtattacacatcatgtgaaagccgggtccgaaaaggcagatccttctcacttcgaactgctgaaggttcttggccaagggtctttcggcaaggtgttcttggttcggaaggtgacaaggcccgattctggacacctatacgcaatgaaggtgctgaagaaggccaccctgaaggtccgtgatagagtgcgaacaaaaatggagagagatatattggctgacgtgaatcatccgtttgtggtcaagttgcactatgccttccagacggagggaaaactttatctgatattagattttctgagaggcggcgatctttttaccagactgtccaaggaagttatgtttacagaggaagacgtcaaattctacctcgccgagctcgctttggggctggaccacctccattctctgggtattatttatagggaccttaagccggaaaacattttattggacgaagaggggcatataaaactaactgattttggattaagtaaagaggccattgatcatgagaaaaaggcctactccttttgcggaacagttgagtatatggccccggaggtcgtgaatcggcagggacacagccattccgctgattggtggagctatggcgtgttaatgttcgagatgctcacagggtctctgccttttcagggcaaagaccgcaaggagaccatgacacttatcttaaaggcaaagctaggcatgccccaattcctttcaactgaggctcaaagtctgctgagggccctatttaagagaaacccagcaaataggctgggttcagggccagatggggccgaagagattaagcggcacgttttttactccaccattgattggaataagctctatcgtcgggagattaaaccgccttttaagccggcagttgcacagcccgatgacaccttttattttgacacagaatttacttccaggacaccaaaggatagccccggcattcctccttccgccggcgctcaccagctctttagagggttctcctttgtggccacagggctgatggaggatgatggcaagccgagagcccctcaggctccgctgcattctgtcgtgcaacagctgcacggcaaaaatctcgtcttttcagacggttacgttgtaaaggagacaataggcgtagggtcctactctgaatgcaagcggtgcgtccataaagcaactaacatggagtatgctgtcaaggtcatcgataagagcaagcgtgacccctccgaagagatagagattctcttaaggtatggccagcatcccaatatcatcactctgaaggatgtctatgacgacggcaagcatgtttatctcgtgaccgagctcatgaggggcggcgagctgcttgataagattttacgccagaagtttttttcagagagagaggcctcatttgttcttcacactatcgggaaaaccgttgaatacctccacagtcaaggtgtcgtgcacagggatctgaagccgtcgaatatcctgtacgtggacgaaagcgggaatcctgagtgcctgaggatctgtgacttcggcttcgcaaagcaacttcgcgccgagaacgggctgctgatgacaccttgctatacggccaatttcgtggctcccgaggttctcaagcgccagggatacgacgaggggtgcgacatctggtctcttggtattctcctgtatacaatgctggccggctacactccttttgctaatggcccttccgacacccccgaagaaatactgacaaggatcggttccggtaaatttactctcagtggcggtaattggaacacggtttccgaaacggcaaaggatctcgtgtctaaaatgctccacgttgatccccatcagcgcctcaccgcaaaacaggttctgcagcacccatgggtgacccagaaggacaagctccctcagtctcagctgtcccaccaggacctccaacttgtgaagggggcaatggcagcgacttattcagccctgaattctagcaagccgactcctcagctgaaaccaatagagagtagcatcctggcgcagcgacgcgtgcgaaagttaccaagtacgacactttag

SEQ ID NO: 26190 - DNA, 501 bp, Artificial Sequence
  Description of Artificial Sequence: Synthetic coding sequence
gcccagcccgacgacaccttctacttcgacaccgagttcaccagccgaactcctaaggattccccaggcattcctccatctgcgggagcgcaccagctgtttagagggttttccttcgtggccaccggtctgatggaggatgatgggaaaccacgggctccacaggctccactgcattccgtagtgcaagtgattgacaaatctaaaagggacccgtccgaggagattgagatattgcttagatatggccagcaccctaacattatcacgctcaaggatgtgtacgacgacggaaagcacgtttatctcgtgactgaattgatgaggggaggtgaactgctggacaaaatcctgagacagaaattcttcagcgagcgggaggcctcatttgtcctgcacaccatcggcaaaacagtcgagtacttgcacagccagggcgttgtacatcgcgatttgaagcccagcaatatcttgtacgtggacgagtctggcaacccgtag

SEQ ID NO: 26191 - DNA, 2160 bp, Artificial Sequence
  Description of Artificial Sequence: Synthetic coding sequence
atgcagacccccgccgacttcccccgggtggagcgggacctggtgccttgtcccagaaaagatgaaggagtgctaaaagagatcagcattacccaccatgttaaggccggatcggagaaggccgacccgtctcacttcgagttgctcaaggtgttgggtcagggtagctttgggaaggtgttcttggttcggaaggtgactcgccccgactccggacacctgtatgctatgaaagtcctgaagaaggccaccctgaaagtgagagacagagtcaggactaagatggagcgagatattctcgcggacgtaaatcacccttttgtggtgaaactccattacgctttccagaccgaggggaaattgtatttaatcctggacttcctgcgcggcggcgatttattcactcgactgtctaaggaggtgatgtttaccgaggaggatgtgaaattttacctggccgaactagctctgggcctggaccacttacactcactcggcattatttatagggacttgaagccagaaaacatactgctggacgaagagggacatatcaagttgaccgattttggcctcagtaaggaagccatcgaccacgagaagaaggcctacagtttctgcggaacagtggagtacatggcccctgaagtggtcaaccggcaggggcactctcactctgctgattggtggtcatatggggtcctcatgttcgagatgctgactggctctttgcctttccagggcaaagatcggaaagaaaccatgacactgatcctgaaagcaaagcttgggatgccccagttcctgtcgaccgaagcacagtctctgttgagggcactcttcaaaagaaaccccgcaaatcggctggggagcggacccgatggagccgaggagatcaagagacatgtgttctactccaccattgactggaacaaactatatcggagggagatcaagcctccctttaaacccgccgtcgcgcagcctgacgacacattctatttcgataccgaatttactagcaggacccctaaagacagtcctggcattccgccttccgcaggggctcaccagctgttccggggatttagcttcgtggcgaccggtctgatggaggacgacggcaaacccagagccccccaggcccctttgcattccgtggtgcagcagctccatgggaagaacctggtctttagtgacggttacgtggttaaggagaccattggcgtgggatcctattctgagtgtaaaaggtgtgtccacaaagcgacaaacatggagtatgctgtcaaggtcatcgacaagtctaagcgcgaccccagcgaggagattgagatccttcttcggtacggccaacaccctaatattataaccctgaaagacgtatacgatgacggaaaacacgtgtatctggtgaccgaattgatgagaggtggtgagctgctggataaaatactgagacagaaattcttttctgaaagagaggcctctttcgtgctccataccattggcaaaaccgttgagtatctccactcccagggggtagttcatcgcgacctcaaaccttcaaatattttgtacgtggacgagagcgggaacccagagtgtcttagaatttgcgactttggcttcgcgaagcagctgagagcagaaaatggactgctcatgacgccgtgctatacagcaaactttgtggcccctgaggtccttaagcgacagggatatgatgaaggctgcgatatttggagcctcgggatcctgctctacacaatgctggctggctacactccattcgccaatgggccatccgacaccccagaggagatcctgaccaggataggctccggcaaattcaccttgtctggcggtaattggaacactgtgagcgaaacagccaaagacctggtaagtaagatgctgcacgtggatccccaccagcgactgacagctaaacaggtgctccagcacccctgggtcacccagaaggacaagctgcctcagagccagctgtcccatcaagatcttcagttggtgaaaggggcgatggctgctacctattctgctctgaatagctcaaagccaaccccccaactcaagcccattgagagtagtatattagcgcagcggcgcgtccgtaagcttcctagcaccacgttgtag

SEQ ID NO: 26192 - DNA, 2202 bp, Artificial Sequence
  Description of Artificial Sequence: Synthetic coding sequence
atggacctgagcatgaagaagttcgccgtgcggcggttcttcagcgtgtacctcagaagaaagagtcgtagcaaatcttcaagcctgagcaggttggaagaagagggcgtggtaaaggaaattgacatttcccatcacgtaaaggagggtttcgaaaaagccgatccatcccaattcgagctgctgaaggtgctgggccaaggctcatatgggaaggtgtttctagtgcggaaggtgaaagggtccgatgccggtcagctttacgccatgaaagtcttgaagaaggctacacttaaggtgagagatcgcgtccgctccaagatggagagagatatcctcgctgaagttaatcacccattcatagttaagctgcactatgcctttcaaacagagggtaagctatatttaatcctcgactttctacggggcggcgatctgtttacacgactgtccaaggaggtcatgtttactgaagaggacgtcaagttttacctagccgaactggctctagcactggatcacctccattctctcggaataatttacagagacctaaaacccgaaaacattcttttagacgaggagggacacatcaaaatcacggacttcgggctgtctaaggaggcaatcgaccatgataagcgggcctactccttctgcggcacaatcgagtatatggccccagaagtggtgaaccgcaggggacacactcagtcagctgactggtggtcgtttggagtcctgatgtttgaaatgctgacaggttctctaccctttcaggggaaagaccgtaaagaaaccatggctctgatccttaaagcaaagctcggtatgccccagtttctgagcggcgaagcacagagcctgctgcgcgccttgtttaaacgtaacccttgtaacagactgggtgccggtatagatggtgtggaagaaatcaaacgtcatccattttttgttacaatagactggaacaccctttatcgaaaggagattaaaccccctttcaaacccgccgttggtcgaccagaagacacatttcatttcgacccggaatttactgcacgaacacccactgacagtcctggcgtaccacctagcgccaatgctcaccatctttttagggggttttcatttgttgcaagtagcctcattcaggagccatcccagcaggacctccacaaggtccctgtacacccgatcgttcagcaactgcacgggaacaacatccattttacagacggctacgaaatcaaagaagatatcggggtgggcagctactccgtttgtaaaaggtgcgtgcacaaggccaccgatacagagtacgccgtgaaaatcatcgataaatctaagcgagatccctctgaggagattgagatcctactccgctacggtcaacaccctaacatcatcacactaaaggatgtgtacgacgatgggaagtttgtttatttagtcatggagcttatgagaggaggcgagctcctggatagaatactgcggcaaagatactttagtgagagggaagcatccgatgtcctctgcaccatcaccaagacgatggactacctccacagtcagggagtggtacacagggacttaaagcctagcaatattctttatcgtgacgaaagcggtagccccgagtcaatcagggtgtgcgattttggctttgccaaacaactgagggccggaaacgggttgcttatgactccatgttataccgctaactttgttgccccggaagtgctgaagcgacagggttatgacgctgcctgtgacatttggtccctaggtatcctcttatacactatgctggccggatttaccccctttgctaacggcccagatgatacgcccgaggagatcctggctagaatcggcagtggcaaatacgcattgagcggcggaaactgggattccattagcgatgccgcaaaggacgtagtgtcaaagatgctccatgttgatccacaccaaaggttgacggctatgcaggtgctgaagcatccttgggtagtaaatagagaatacctttctcccaatcagctttcgagacaggatgttcacctagtgaagggagcaatggctgccacgtacttcgcactcaatcgcacaccccaggctccgcgtctcgaaccggtcctttcgtcaaatctcgcccagaggcgcggcatgaagagactgacctccactcgtctgtag

SEQ ID NO: 26193 - DNA, 501 bp, Artificial Sequence
  Description of Artificial Sequence: Synthetic coding sequence
atgttcaccgaggaggacgtgaagttctacctggccgagctggccttagcactggatcatctgcacagtctgggaattatatatagggatctgaagcctgagaacatcctgttggacgaggaaggtcatattaaaatcaccgacttcgggctctctaaggaagccatagatcatgacaagagggcctattccttttgtggcaccatcgaatatatggctcctgaagtggtgaatagacgcggtcatactcagtctgcagattggtggtctttcggcgttcttatgtttgaaatgctgactggatctcttcccttccaaggtaaggacaggaaagaaactatggctcttattcttaaggccaaactgggaatgcctcagttcctgtctggcgaggctcagagcttactcagggccctattcaagcggaacccttgcaatcgcctcggagaaaagaccgctttatgcccaagagtcagctgcagcaggctactcgggttctag

SEQ ID NO: 26194 - DNA, 1935 bp, Artificial Sequence
  Description of Artificial Sequence: Synthetic coding sequence
atgaaggtgctgaagaaggccaccctgaaggtgcgggaccgggtgaggtctaaaatggaacgtgatatcctggccgaagtcaaccatccatttattgtgaaacttcactatgcgtttcagactgaaggaaaactgtatcttatcctcgattttttgaggggaggagacctgtttaccagactgtctaaggaagttatgtttaccgaggaggatgttaaattctacctcgccgagctcgccctcgcactcgaccacttacactctctgggcattatctatagggacctaaagcccgagaatatcctgctagatgaggaagggcacattaaaattaccgatttcggactgagtaaggaagccatagatcatgataaacgagcttactctttctgcgggaccatagagtacatggctcccgaggtcgttaaccgccgcggtcacacacagtctgctgattggtggtccttcggcgtcctcatgttcgagatgctgaccggaagcttacctttccagggtaaagacaggaaagaaactatggcattaatactgaaggcgaaattaggaatgcctcagtttctgagcggggaagcccagagcctcctcagagccttgtttaaacgcaacccctgtaatcgcctgggggccggaatcgatggggtggaagagattaaacgccatcccttctttgtgacaattgattggaacaccctttataggaaggagataaaaccccctttcaagccggctgtcgggcggccagaggacaccttccattttgatccagagttcactgctcgtacaccaacggattctcccggagtgccccctagtgccaacgctcaccacttatttcgcgggtttagcttcgttgcttcaagcctcatacaggaacccagccagcaggatctccacaaagtccccgtgcaccctatcgtgcaacaattgcatgggaacaatattcatttcacggacggctatgaaatcaaggaggatattggcgtaggatcttatagcgtgtgtaagaggtgcgtccataaagctacagataccgaatacgcggtgaagattattgataagtctaagcgcgacccatccgaggagatcgaaatactactccggtatggtcagcaccctaatatcatcacgctgaaggatgtgtatgacgacggcaaattcgtttatctcgtaatggagctgatgcgcggcggagaattgttggatagaatcttgcgacaacgctatttctccgagcgtgaggcatctgatgttctgtgcacaattacaaagacgatggattacctgcattcacaaggagtagtacatagagacctgaaaccaagcaacattctgtaccgtgatgaaagcgggagtcctgagagtatcagggtatgtgattttggcttcgctaagcagctacgagcaggaaacggcctgctcatgactccttgctacaccgcaaactttgttgcgcctgaggtactgaagagacaaggatacgatgcagcctgcgatatctggagtctagggatcctgctgtacaccatgctcgcaggcttcaccccgttcgcaaacggacctgacgacacccccgaagaaattctcgccaggatcgggtctgggaaatatgctctgtcaggcgggaactgggactccatatctgacgccgccaaggatgttgttagcaagatgttgcacgttgacccccaccaacggcttacagccatgcaggtccttaaacatccctgggtggtgaatcgcgagtatctatcaccaaaccaactgtcgcgccaagacgtgcacctagtcaagggagcaatggctgccacgtactttgccctgaaccggacgcctcaagccccccgtctcgagcccgttctctcttcaaatttggcccagaggcgtggtatgaaacgcttgacctctaccaggctgtag

SEQ ID NO: 26195 - DNA, 1935 bp, Artificial Sequence
  Description of Artificial Sequence: Synthetic coding sequence
atgaaggtgctgaagaaggccaccctgaaggtgcgggaccgggtgagatcaaagatggagcgcgacattctcgccgaggtcaaccatccctttatcgtgaaattgcattacgctttccagaccgaaggtaagctttacttgatcctggacttcctgagggggggcgaccttttcactagactcagcaaggaagtgatgttcaccgaagaggatgttaaattctacctcgcagagctggccctcgccctggatcacttgcacagtttggggattatctatagagatctgaaacccgagaatattttgctagacgaggaaggccacatcaagatcacagatttcggactgtctaaagaagctattgaccatgacaagcgggcatacagtttctgcggcaccatcgaatacatggctccagaggtggtcaaccgccgcggccacacccagagtgctgattggtggagctttggtgttctcatgtttgagatgctgacaggctcgctgcccttccaggggaaggaccggaaagaaactatggctctcatactgaaagccaagcttggcatgccccaattcctaagtggcgaggctcagtccctcctgagggccctgttcaagaggaacccttgcaatcgtctgggcgccgggatagatggagttgaagagataaagcggcatcccttcttcgtgactattgactggaataccttatatcggaaggagattaagccgccgttcaagcctgctgtgggtcggcctgaggatacattccacttcgaccctgagtttactgcccggactcctacggactcccccggggttccccctagtgccaacgctcatcacctctttaggggattttccttcgtagcgtcctctctgattcaggagccaagccagcaggacctgcacaaggtgcccgtccaccccattgtccagcaactgcacgggaacaatatacacttcacagacggctacgaaatcaaggaggacatcggtgttggtagttactcagtgtgcaagaggtgtgtgcataaagctacagatacagagtacgccgtgaaaattatcgataaaagcaagagagatcccagcgaagaaatcgaaatactactgcgctacggccagcacccgaatatcattacactgaaagacgtatacgacgatggtaagttcgtctacctcgtcatggagttaatgcgggggggcgaactgctcgacagaattctgcggcaacgctacttctcagagcgcgaagccagcgatgtgctgtgtaccattacaaaaacaatggattacctgcattcccagggagtcgtccaccgcgacctcaagccaagtaacatcctttacagagatgagtcaggttcccctgaaagtatccgggtatgcgactttggtttcgccaagcagcttagagccggcaatggacttctcatgaccccttgctacactgctaactttgtggcccctgaagtgttgaaaagacaggggtatgacgctgcctgtgacatctggtcgctgggtattttgttatacactatgttagcaggctttactccgttcgccaacggccctgacgatacgcccgaagagatcctggcccggatcggctccgggaagtacgctctctccggcggaaactgggactcaattagcgatgccgcaaaagacgttgtctcaaagatgttgcacgtggacccccaccagagactgaccgcaatgcaagtactgaagcatccgtgggttgtcaacagagagtatttgtctccaaaccagctatcacggcaggacgtccatcttgtaaagggcgccatggctgctacttatttcgcgttaaacagaaccccccaggcgcccaggctggagcctgtgctgtcttcaaatctggcgcaacgaaggggtatgaagcgcctaacgagcactcgtctgtag

SEQ ID NO: 26196 - DNA, 2226 bp, Artificial Sequence
  Description of Artificial Sequence: Synthetic coding sequence
atgcccatcgcccagctgctggagctgtggaagaagatcgaggtggagcccatggagatagagacaacagaggaggacctgaatttggatgtggagcccacgacagaagatactgccgaggaagaggagggagttgtgaaagaaatcgacatatcacatcacgtcaaggaaggtttcgagaaggctgaccctagccagttcgagctcctcaaggtccttgggcagggaagttacggaaaagtgttcctggtacgaaaggtgaaggggtcagatgctggccagctttatgccatgaaagtcctcaagaaggctaccctgaaagttagggatcgtgtcagatccaagatggagcgcgacattctggcagaggttaaccacccattcatcgtgaagctgcattatgccttccagacagaaggcaaactatacctcatccttgattttctgcgaggtggagatttatttacccgactgagcaaggaggtgatgttcacagaagaagacgtgaagttttaccttgctgaactggcactggcactcgatcaccttcatagtctggggattatataccgcgacctgaaaccagaaaacatactcctggacgaagagggccacataaaaattacagatttcggtctcagtaaagaggctatcgaccatgataagcgtgcctattctttctgtggaaccatcgagtacatggcccccgaggtggtgaaccgcagggggcatactcagagcgctgattggtggtccttcggtgtcctaatgtttgagatgctgacggggtcactgccattccaggggaaagataggaaggaaactatggctctgatcctcaaagctaagctgggaatgccccagttcctctcaggcgaagcacagtcgctgctgagagccctgttcaagagaaacccttgcaaccggctcggcgcaggcatcgatggcgttgaggagataaaacggcacccattcttcgttacaatagactggaataccctttatcgtaaagagattaagcccccatttaagccggctgtcggtagacctgaggatacttttcattttgaccccgaattcaccgctagaacccctaccgacagtcccggcgtcccgcccagcgccaatgctcatcacttgtttaggggatttagctttgttgcatcttcccttatacaggaaccttctcaacaagatcttcataaagttccagtacaccctatcgtccaacaactgcacggcaacaacatccattttactgacgggtacgaaattaaggaggacattggcgtgggatcatattccgtatgcaagcgatgtgtccacaaagcaacagacactgaatacgctgttaagatcatcgataaatccaagcgcgacccaagtgaggagattgaaatattgcttcggtatgggcaacacccaaatattattactctgaaagacgtctacgatgacggaaagttcgtgtacttagtgatggaactgatgcgaggtggagaactgctggaccggatactgagacagcgatacttttctgagcgggaagcctctgacgtgctgtgtaccattacaaagacgatggactacttgcactcacaaggggttgtgcacagggatttgaaacccagcaacatactctatcgagatgagtccgggtcacctgaatctattcgggtgtgcgattttgggttcgctaagcagctaagggccggaaatgggttactgatgactccttgttacaccgctaatttcgttgcccctgaagtgctgaagcgacaggggtacgacgcggcatgtgacatttggtctttggggattctgctatatactatgctggccggattcacccctttcgccaacggcccagacgataccccagaagagatcttggcacgcataggctccgggaagtacgcattaagcgggggaaactgggatagcatcagtgatgcagcaaaagacgttgtgtcaaaaatgctacacgtggacccccaccagaggctaaccgcaatgcaggttcttaagcacccgtgggttgtgaacagagagtatctatctccaaaccagttatcaagacaggatgtccatctggtcaagggagccatggccgcgacatatttcgcccttaatagaaccccgcaggcaccccgactggaaccagtactgagctctaacctggcccaacgccgaggtatgaagaggcttacaagcactcgcctgtag

SEQ ID NO: 26197 - DNA, 516 bp, Artificial Sequence
  Description of Artificial Sequence: Synthetic coding sequence
atgcccatcgcccagctgctggagctgtggaagaagatcgaggtggagcccatggagattgaaaccacagaagaggacctgaaccttgatgtagaacccacaaccgaagacaccgcggaggaagggaaatccgattccgcggcctgcaagacaaaggtagccggctcggtggaagaggagggagtcgttaaggagatcgatataagccaccacgtgaaggaaggctttgagaaagctgatccttcgcaattcgagctcttaaaggttctggggcaagggtcatacggtaaagtattcctcgtgcgcaaggttaagggctctgatgccgggcaactgtacgcaatgaaagttctgaagaaggccaccctgaaagtccgagatcgcgttcgctccaaaatggagcgggatattctggcagaggtaaaccatcccttcatagtcaagctacattacgccttccaaaccgaaggaaaactataccttatcctggactttctccgtggcggtgacctttag

SEQ ID NO: 26198 - DNA, 2277 bp, Artificial Sequence
  Description of Artificial Sequence: Synthetic coding sequence
atgcccatcgcccagctgctggagctgtggaagaagatcgaggtggagcccatggagattgaaactactgaggaggacctgaatctggatgtggagccaaccacggaggatacagctgaggagggcaaatcggactctgccgcctgtaagacaaaagtcgctggttcagtggaagaggagggcgtggtaaaggaaattgacatcagccatcatgtaaaggagggattcgagaaagccgacccctctcagttcgaactgcttaaagtgttgggtcagggttcctacggcaaggtgttcctcgtgcgcaaagtcaagggttctgacgcaggccagctttatgccatgaaagtgttaaagaaggctaccctgaaggtcagagatcgcgtccgctctaaaatggaaagggacatacttgcggaggtgaatcatcccttcatcgtgaaacttcactacgcctttcagaccgaaggcaagctctatctgatcctggatttcctccgaggcggggatttattcacacgactgagcaaagaggtgatgtttaccgaagaggacgtgaagttctacttggccgagctggctctcgcgttagatcacctccattctcttgggataatttatagggatctgaaaccagagaacatcctgctcgacgaagagggtcatatcaaaatcaccgacttcgggcttagcaaagaggctatcgatcatgataaacgggcctatagcttctgcggaactatcgaatacatggcccccgaagttgttaacagacgtggtcacacccagtctgccgactggtggagcttcggcgtattgatgttcgagatgctcactggctccttaccatttcaggggaaggatagaaaggaaactatggcactcatcttgaaggcgaagctcgggatgccacagtttcttagcggagaggcacaatctctgctgcgcgcattgtttaaacggaatccgtgtaacagactcggtgccggtattgatggagtagaggagatcaagaggcacccctttttcgtcaccattgactggaacactctgtatcgtaaggagatcaagccgccgtttaaaccggcggtgggaaggccagaggatacattccatttcgatccagagtttacagccaggacacccaccgatagtccgggggtgcccccctcagcaaacgcccatcatctatttcggggcttttcttttgtggctagttctcttattcaggaaccttctcaacaggatctgcacaaagtgcccgtgcaccccatagtgcagcagctacatggtaacaacatacatttcacagatgggtatgagatcaaggaggacatcggcgttggaagctacagcgtgtgcaagcgctgtgtgcacaaagccacggatactgagtacgccgtcaagataatcgataagagcaagagggacccctccgaggagatcgagatactgctacgatacggtcagcaccccaatatcattaccctgaaggatgtctacgatgacggaaagtttgtgtacctcgtcatggaattgatgcgcggtggtgagctgctcgaccggattttgagacagaggtacttcagcgaacgggaagcttccgacgtgctctgcaccatcactaagaccatggattacctccactcccaaggtgtggtacacagggacctgaaaccctcaaacatcctgtacagggacgagtccgggagccctgaatctatacgggtgtgtgattttggcttcgccaaacagctgagggcagggaatggcctcctgatgacgccctgctacaccgcaaactttgtggcccccgaggtgttaaagagacaggggtatgatgcagcatgtgacatatggtccctggggatactgctgtatacaatgctagccggtttcacaccatttgcgaatggacctgacgatactcccgaggaaatattggcgagaataggaagcggcaaatatgcactatcaggaggaaattgggattcaatcagcgatgctgccaaagacgtcgtctcaaagatgcttcacgtggacccacaccagcggctgaccgcaatgcaggtactgaaacatccctgggttgtgaatagagaatacctctcacctaatcagctctcaagacaagatgtccacttagtgaagggggcaatggctgcgacttacttcgctctgaaccggacgcctcaagctcctaggctagagccggtccttagcagcaatctggcacagagaaggggaatgaagcggcttaccagcacacgcctatag

SEQ ID NO: 26199 - DNA, 888 bp, Artificial Sequence
  Description of Artificial Sequence: Synthetic coding sequence
atgagcggcgccctggacgtgctgcagatgaaggaggaggacgtgcttaagtttctcgctgccggcacacatctgggcggcaccaacttagattttcaaatggaacagtacatatataaacgcaaatccgacgggatttatatcatcaaccttaagcgaacttgggaaaagctactgttggccgctagagcaatcgttgctatcgagaacccggctgacgtgagcgtcatctcaagccgaaataccggacagcgggccgtgctgaagtttgccgctgctacgggcgcaacacctatagccggcagattcacaccagggactttcaccaaccagattcaggccgcatttcgggagccaagactcctcgtggtcactgacccccgcgccgatcatcagccattgactgaagcttcctacgttaaccttcccaccatcgctttatgcaatactgacagtcctctgaggtacgtggacattgcaattccttgcaataataagggcgctcatagcgtgggcctgatgtggtggatgctggcaagagaagtcctgagaatgaggggcactatctctcgcgagcacccatgggaggtgatgccagacctgtatttctatcgagatcctgaagagattgagaaggaagagcaagccgccgctgagaaagccgtgacaaaagaggaattccaaggggaatggacagcccccgcgccagagtttacagcgacccagcctgaagtggccgactggtcagagggggttcaggtgcccagcgttcccatccaacagtttcccaccgaagactggtccgcccaacctgctaccgaagactggagcgccgcgcctaccgcacaggccactgaatgggtcggcgctacaaccgattggagctag

SEQ ID NO: 26200 - DNA, 795 bp, Artificial Sequence
  Description of Artificial Sequence: Synthetic coding sequence
atgagcggcgccctggacgtgctgcagatgaaggaggaggacgtgctcaaatttctggccgccggaacacatctgggtggtacaaacctggatttccagatggaacaatacatctataagagaaagagcgatgggatctatattatcaaccttaagaggacatgggaaaagctcctgctggctgcacgggccatagtggctatagagaatccggcagacgtaagcgtgatttcaagtagaaatacaggccagagagccgtgctgaagtttgccgcagcgaccggtgcgactcccattgccggccgattcacaccagggacattcacgaatcagattcaagctgcatttagggaaccacggctgctagttgtgactgatccgagggcagatcatcagcccctgacagaagcctcctatgtgaacctcccaacaatcgcgttgtgcaatactgacagccccttgaggtacgtggacattgctatcccatgcaacaacaagggagcgcacagtgtcggactcatgtggtggatgctcgcccgggaagtgttgaggatgcgcgggactatcagtagagagcatccgtgggaggttatgcccgatttgtacttttacagggaccccgaagagatcgagaaagaggagcaagccgcagcagagaaggcggtcacgaaagaggagtttcagggcgaatggaccgcccctgctcccgagttcactgccacgcagccagaggtcgccgactggagcgaaggggtccaggtcccaagcgttcccatccagcaatttccaacctag

SEQ ID NO: 26201 - DNA, 1458 bp, Artificial Sequence
  Description of Artificial Sequence: Synthetic coding sequence
atgggcgagcccggcttcttcgtgaccggcgaccgggccggcggcagatcttggtgtttgaggagagtgggtatgagtgccggatggctgctgttagaagatggctgtgaagtgactgttgggaggggcttcggagtcacataccagttggtcagtaaaatttgtccactgatgatctcaagaaaccactgcgtgctgaaacagaatccagaaggccaatggaccatcatggacaataagtctcttaatggggtgtggcttaatcgtgcccgactggagccgctaagagtctacagcatacaccagggcgactatatccaactgggagtgcctctggagaataaggagaatgctgagtacgaatacgaggtgacggaggaggattgggagaccatttacccctgcctttccccaaaaaatgatcagatgatagagaagaacaaggagctccgcactaaacgaaagttcagtctcgacgagctcgccgggccaggggctgagggtccgtctaatctgaagagtaaaattaataaagtgtcctgtgagagcgggcagccagttaaatctcagggcaagggagaagtggccagcactccgagtgacaatctagatccaaaactcactgccctggagccctctaagacaaccggagcaccaatctacccaggcttccccaaagtaacagaagttcaccacgaacaaaaggcctcaaactcttcggcctctcagaggtctttacaaatgttcaaagtgaccatgagcagaattctgcggctgaagattcaaatgcaggagaagcatgaagctgttatgaacgtgaaaaaacaaacacagaaagggaacagtaagaaggtggtccaaatggagcaagagctgcaagacctgcagagtcaactatgcgcagagcaggcacagcaacaggcacgggtagagcagttggagaagacgttccaagaagaagagcagcacttacaggggctcgagatcgctcagggcgaaaaggaccttaagcaacaacttgcacaggcccttcaggaacactgggccctaatggaggagctgaatcgaagcaagaaggactttgaggctattatacaagctaagaacaaagaacttgagcagacaaaagaagagaaagaaaagatgcaagcccagaaggaggaggtgctgtctcacatgaacgacgttctagagaacgaattgcagtgtataatttgttctgaatacttcatcgaagccgttaccctgaactgtgcacattccttttgttcctactgcatcaatgagtggatgaagagaaagattgagtgtccaatttgccggaaagacataaagtccaagacttactcattagtcctggacaactgcatcaacaagatggttaacaacttgtcgagtgaagtcaaggagcgtcgcatcgtgctgattagggagaggaaagccaaaaggctattttag

SEQ ID NO: 26202 - DNA, 297 bp, Artificial Sequence
  Description of Artificial Sequence: Synthetic coding sequence
atgggcgagcccggcttcttcgtgaccggcgaccgggccggcggccggtcttggtgcctgaggagggtgggcatgtccgccgggtggctactgcttgaagacggctgcgaggtgacagtgggaagagggttcggagtaacataccagttagtgagtaagatatgccccctaatgatctcccgcaatcactgtgtgctgaaacagaaccctgaaggacagtggaccatcatggacaacaaatctttcccctccgagaaagctgaggactttacagccgccggtgaaagatttttatag

SEQ ID NO: 26203 - DNA, 1347 bp, Artificial Sequence
  Description of Artificial Sequence: Synthetic coding sequence
atgggcgagcccggcttcttcgtgaccggcgaccgggccggcggcagatcatggtgcctacgtagggtgggcatgtcagctggatggctgcttctggaagacggttgcgaagttacagtggggagaggctttggggtgacatatcaactggtgagcaaaatatgtccattgatgattagccgaaatcattgcgtgctgaaacagaaccctgagggccaatggactataatggataataaaagtctcaatggagtttggctgaaccgcgctcggttggagcccctgcgggtctacagcattcaccagggtgactatattcaattgggagtcccacttgagaacaaggagaacgccgagtatgagtacgaggtgactgaagaagactgggagaccatatacccatgcttgtcccccaagaacgaccagatgattgagaaaaataaagaactccgcacgaaaaggaaattttccttagacgaactggccggccctggggcagagggcccctccaatttgaaaagcaagatcaataaggtctcgtgcgaatcaggccagcctgttaaatcccaaggaaagggcgaagtagcctccactccttctgacaacctggaccctaaattgaccgcccttgaaccatccaaaactacaggggcaccaatctatcctggcttccccaaagtcactgaggtccaccacgagcagaaggctagcaactcctctgccagtcagcgaagcctccaaatgtttaaagtgactatgtccagaatcttgcgcctgaagatccaaatgcaggagaagcacgaagccgtcatgaatgtcaagaaacagacccagaaaggtaattcgaaaaaggtggtgcagatggaacaggagttacaggacctgcaatcacagctgtgcgcggaacaggcacaacaacaggctagggtggagcaattggaaaagaccttccaggaagaagaacaacacttgcaagggctcgaaatcgcccagggtgaaaaggacctcaaacaacagctggcacaagctctgcaggagcactgggcgctgatggaggagcttaacaggagcaaaaaggattttgaggcaatcatccaagcgaagaacaaagaattggagcagactaaagaggaaaaggaaaagatgcaggcccagaaagaagaggtactcagccatatgaatgatgttcttgaaaatgagctgcagtgcatcatctgcagcgaatacttcatcgagcagagggattgctctgaagatcgggcactgcgcgcattcgagagactccccgggtccgccagcctgcgctggtcaggggggttctccttggcagttactccactgctgtag

SEQ ID NO: 26204 - DNA, 1593 bp, Artificial Sequence
  Description of Artificial Sequence: Synthetic coding sequence
atggccgacgacatcgacatcgaggccatgctggaggccccctacaaaaaagacgagaataagctgagttctgccaatggccatgaggaacggtctaaaaagaggaagaaaagtaaatctcgatcgcgttcccatgagagaaagcggtccaaaagcaaggagcgcaaaaggagcagagatcgggagagaaagaaatcaaagtccagggagagaaagcgctctaggtccaaggagcggaggcggtccaggtccaggtctagagaccggaggttccgcggacgatatagaagcccctattctggcccaaagttcaactcagccattcgtggcaagatcggattgccacactccataaagctgtcaaggcgcaggagcaggtctaaaagccctttcaggaaggacaaaagtcccgtgagagagccaattgataatctgaccccagaggaaagggacgctaggactgtgttctgtatgcaactggcggcacggattcgccctcgcgatctggaggagttcttttcaacagtcggtaaggttcgggacgtgcggatgatcagcgatcgaaatagtcgccgaagtaaaggaatcgcatatgttgaatttgtcgatgtgagctcggttcctttggccattggtctcaccgggcagcgggtgttaggcgtgccaatcatcgtccaggccagccaggccgagaagaatcgggcagcggctatggctaataacctgcagaagggatccgcagggcctatgagattgtatgtcggcagcttacacttcaacatcacagaggatatgctgaggggtatattcgagcccttcggtaggattgagtccattcaattgatgatggacagcgaaaccggacggagcaaaggctacggattcattaccttctccgactccgaatgcgcgaagaaagcactggagcagcttaacggattcgaacttgcaggtagacccatgaaggtgggacacgtgacggaaaggacagatgcctcttcagcctcctctttcctggactccgatgaacttgaacgaaccggtatcgacttgggcacgactggcagactgcagctcatggccaggttagcggaagggaccggccttcagatacccccggcagcccagcaggcccttcaaatgtctggcagcttggcctttggagcagttgctgagttcagtttcgttattgatcttcagacacgcctgtctcaacagacagaggcaagcgcactggccgcagccgcctcagtgcaacctctggccacccagtgctttcagcttagcaatatgttcaacccccagacagaagaggaagtgggttgggacactgaaatcaaagatgacgtgatcgaagaatgcaacaaacatggcggcgtcatccatatttatgtggacaaaaatagtgcgcagggaaatgtttacgtcaaatgcccatccatcgcagctgcgatagccgcagtgaacgcactgcacggccggtggttcgctggaaagatgatcacggccgcatacgtgcctttgcccacttaccacaacctatttccagatagcatgacggcaacacagctgctggtaccctcaaggcggtag

SEQ ID NO: 26205 - DNA, 1272 bp, Artificial Sequence
  Description of Artificial Sequence: Synthetic coding sequence
atggccgacgacatcgacatcgaggccatgctggaggccccctacaaaaaggacgaaaacaagctgtcctcagctaacggacacgaagagcgctctaagaagcggaaaaagagtaaaagccgctcacggtcacatgaacgtaaacgcagcaagtccaaagaacggaaacgctccagagatcgcgagcgcaagaagtcaaaatctcgcgagcggaagcggagcagaagcaaggaaaggcggcgcagccgctctagatcgcgggatagaagatttagagggcgttacaggagtccatattctggaccaaaattcaatagcgccatccggggtaagattggccttccccacagcattaaactgagccgacgtcggtctaggagtaagagcccattcagaaaagataaatcacccgttcgggagccaattgataacctcacccccgaggaaagggacgcaaggaccgtgttctgtatgcagcttgctgcacgaattaggccaagggacctcgaagagttcttttccactgtcgggaaggtcagagatgtgcggatgattagtgatcgtaattctcgcagatccaaaggaattgcctatgtggagtttgtggacgtcagtagcgtacccctcgctatcggattgaccggacaaagagtcttaggcgtgcctatcatcgtgcaggccagccaggccgaaaagaatcgggcagcagcaatggctaataacctccagaaagggtccgcaggtccaatgagattatacgtaggctctctccactttaatattaccgaagatatgctgcgaggaatctttgagccatttggacgcatcgaatctattcagctgatgatggactccgagactgggagaagcaaaggctatggcttcatcacattttcagattccgagtgcgccaaaaaagccctagaacagctcaatggcttcgagctggcgggcagacccatgaaagtcggacatgtaaccgaacgcactgatgcatccagcgctagctctttcctggattccgatgagcttgagcggaccgggatcgatcttggcacgacgggcaggttgcaactgatggctcgcctggccgaagggacaggactccaaataccccccgcagctcagcaggcactacaaatgtccggctcacttgcctttggcgccgtcgcggatctccagactagattgtcccagcagactgaggcactgttcgtcattatgttttggaacgagatctggagcgataacatgattacgctccagctgtag

SEQ ID NO: 26206 - DNA, 1575 bp, Artificial Sequence
  Description of Artificial Sequence: Synthetic coding sequence
atggccgacgacatcgacatcgaggccatgctggaggccccctacaagaaagatgaaaacaaactatcttctgccaacgggcacgaggagagaagcaagaagcgcaagaagagcaaatcacggagccgatcacatgagcgaaagcggagcaagtccaaagaaagaaagcgcagcagagatcgcgagagaaagaaaagtaagagtcgggagaggaaaaggtctcggagtaaagagcgacggcgatcacgctccagaagtagagatcggcgctttcgcggaaggtataggtctccatacagcggtccaaaattcaactcagctatacggggcaagatcggcttgcctcactcaatcaaactatcaagacgccgaagcaggtccaagagtccatttcgaaaagacaagtctcccgtgcgggaaccaatcgataacctgaccccagaggaaagggatgcccggacagttttctgcatgcagttggcagcaagaattcgccctcgcgatttggaagaattcttttccactgtgggaaaagtgcgggatgtccgcatgatctccgaccggaactcacgcaggtctaagggaatcgcatatgtggaattcgtcgacgtgagctctgtgccactcgccatcgggctaaccggccagcgcgtgctaggtgttccgatcatcgtgcaagcctctcaagctgagaaaaaccgcgctgccgcgatggctaacaaccttcagaagggtagcgccgggcctatgagactgtatgttggatcgctacattttaatatcacagaagatatgctgcggggtattttcgagccatttggcagaatcgagagcattcagctgatgatggactctgagacggggagatccaaaggctacgggtttattaccttcagcgactctgagtgcgcaaaaaaggcactggaacagttgaatggcttcgaattggccggcaggcctatgaaagttggtcacgtgaccgaacgcacagacgcgtctagcgctagcagctttttggattccgatgagttagagagaacaggtattgatttgggcacgaccgggcgactccaactgatggccagactggcggagggcactggcctgcaaattccccctgcggcacagcaggccctccagatgagtggttctttagcctttggcgccgtggcggaccttcagacacggcttagccagcagactgaggcctcggcgttagcagcagcagcatcagtccaacctctcgccacgcagtgttttcaactgtctaacatgtttaatcctcagacagaagaagaggtggggtgggacacagaaattaaggatgatgtgatagaggagtgcaataaacacgggggtgtgatacacatttatgtcgacaaaaattctgcccagggcaatgtgtatgtaaaatgtccttctattgccgctgctatcgctgctgttaatgctctgcacggacggtggtttgcaggaaagatgattaccgccgcttatgtccctctgccaacatatcacaatctcttcccagattctatgaccgccacacaacttctggtaccctcgcgccggtag

SEQ ID NO: 26207 - DNA, 696 bp, Artificial Sequence
  Description of Artificial Sequence: Synthetic coding sequence
atggccgacgacatcgacatcgaggccatgctggaggccccctacaagaaggatgaaaacaagctgtcctcagccaacggacacgaagagagatctaaaaaacggaaaaagtctaaatcaagatctcgaagccacgagcgcaaaagatcaaagtccaaagagcgcaagagatccagggatagagaaagaaagaagtctaagtctagggaaagaaaacgatccaggtcaaaagaacggcggcgctcgcggtcccggtctagagacagacgctttcgaggacgatacaggtctccctactccggtccaaagtttaacagtgcaatccgaggcaaaattggactgccgcattccatcaagctgagacgacggtctcgttctaagtctcctttcaggaaggataaaagccccgtcagggaacctatcgataatctcacacccgaagagcgagatgctaggaccgtgttctgcatgcagttggctgcacgaattagaccgcgcgatcttgaagaattctttagtacagtgggtaaagtacgagacgtgagaatgatttccgatcgaaactcacgccgatccaaaggaatcgcatacgtcgagtttgtcgacgtgagcagcgtaccccttgccatcgggctgactggccagcgtgttctgggggtgcctataattgtccaagcatcccaagcggagaaatag

SEQ ID NO: 26208 - DNA, 1122 bp, Artificial Sequence
  Description of Artificial Sequence: Synthetic coding sequence
atgcagctggccgcccggatccggccccgggacctggaggagttcttctcaactgtgggcaaggtccgagacgtgagaatgatctccgatcgaaattccaggcgttcgaagggcatagcgtatgtggagttcgtggatgtgagctccgtgcccctggcaatcggtttaacgggccaacgcgtcctgggtgtgcccattatagttcaggccagccaagctgaaaagaatagagctgccgccatggcgaacaatctgcagaagggtagtgccggtcctatgcgcttgtatgtggggagcctgcacttcaatatcactgaagacatgctcaggggaatttttgagccctttggccggatcgaatccatacaactgatgatggattcggagaccggccgttcgaagggatacggcttcattactttcagtgactcggaatgcgctaaaaaggcactggagcagttgaacggcttcgagctggcaggtaggcccatgaaagtgggccatgtgaccgagcggactgatgcttcctcagcctctagcttcctcgactctgatgagctggaacgtaccggaattgatctgggcacaacaggtcggctgcagctgatggcgcggcttgccgaaggtaccggcctgcaaatccctcccgcagctcagcaggctctgcagatgtctggaagcctcgcgttcggggcggtagctgagttttcctttgtgattgacctgcagacgaggctctcccagcagaccgaggcgtccgctttggctgctgccgcatccgtacagccactggccacacaatgttttcagttatccaatatgtttaatccccaaactgaagaggaggtcggctgggacaccgaaataaaagatgatgtcattgaagaatgcaacaagcacggaggggttatccatatctatgttgacaagaatagtgctcagggcaatgtgtacgtgaaatgcccctccatcgccgccgccatcgccgccgttaatgccttgcatgggcggtggtttgcggggaaaatgataaccgctgcttacgtgcccctccctacctaccacaatcttttcccagactctatgaccgccacccagctgctcgtccctagccgacgttag

SEQ ID NO: 26209 - DNA, 582 bp, Artificial Sequence
  Description of Artificial Sequence: Synthetic coding sequence
atggccgacgacatcgacatcgaggccatgctggaggccccctacaagaaggacgaaaataagcttagttcagctaatggacacgaggagagatcaaaaaaaagaaaaaagagtaagagtcggagtcgatcccacgagaggaagcggtccaagtcaaaggaacgtaaacggagcagggacagagaaagaaagaaaagcaagtccagggaaaggaagaggtccaggtctaaggagagacgtaggtctcggtcaagatctcgcgaccgccgctttcggggacggtataggagtccgtattcaggcccaaagtttaactcagccattcgtggaaagataggacttcctcacagcatcaagctgtctaggcggagatcccggtccaaatcccctttccggaaggacaagtctcctgtgagggagcccatcgataacctgacacccgaagagcgagatgcccgtacagtgttttgcatgcagctggctgcacgcatccgcccccgcgacttggaagaattcttctccaccgttgggaaagtgcgcgatgtacggatgattagcgatcgaaatagccggaggtcatag

SEQ ID NO: 26210 - DNA, 1014 bp, Artificial Sequence
  Description of Artificial Sequence: Synthetic coding sequence
tgaagccccttccggaaggacaagagccccgtgcgggagcccatcgacaacctgacaccggaggaacgggatgctcgtacggtattctgcatgcaactggccgctcgtataagaccgagggacctagaagagttcttctccaccgtgggcaaagtgcgcgacgtcaggatgatatctgaccggaatagccgtagatctaaggggattgcttacgtcgaatttgtggatgtgtcttctgttccactagctatcggattgacaggacagcgggtcctcggggtacctatcattgtacaagcttctcaggccgagaaaaaccgggccgcggcaatggcaaacaacttacaaaaaggtagtgccggacccatgagactgtatgtcggatcgctgcattttaatatcaccgaagacatgctcagagggatatttgaacctttcggtcgctttagcgatagcgagtgtgccaaaaaggccttggagcagctaaacggttttgagctggcgggccgcccgatgaaggttggccacgtgactgagagaactgatgccagtagtgcctcttcttttctggactcagatgagctggaaaggaccggcattgaccttggaaccacaggtcgtctgcaactcatggccaggttggctgaaggaacgggcctgcaaatccctcctgcagctcagcaggctctccagatgtctgggtccctcgccttcggggcagtcgccgagttcagttttgtgatcgacctgcagaccagactgagccagcagactgaggcctcagcccttgccgctgccgcctctgttcagcccttggccacccaatgttttcagttgagcaacatgttcaacccgcagactgaggaggaggtgggatgggataccgagattaaggacgacgtgatcgaagagtgtaataaacatggcggggtgatccacatatacgtcgacaagaacagcgcccagggaaatgtgtacgtgaagtgtcctagcattgcggcagctatcgcttag

SEQ ID NO: 26211 - DNA, 1527 bp, Artificial Sequence
  Description of Artificial Sequence: Synthetic coding sequence
atggccgacgacatcgacatcgaggccatgctggaggccccctacaagaaagacgagaataaactcagcagtgccaacggtcacgaagaacggtcaaagaagcgcaaaaaatcaaagtcccgctctaggtcccatgagagaaagcggagcaagtccaaagaacggaagagaagcagagatagagaacgcaaaaagtccaaatcgcgggagcgtaagcggagtcgcagtaaggaacggaggcgctcacgaagtaggtcacgagataggagatttcgcggcagataccgcagcccttacaggcggagaagccgaagcaagtcccccttcagaaaagacaaaagccctgtaagagaacctatcgacaacctgactccagaagagcgagatgccagaaccgtcttctgcatgcaactcgctgcacgaattcgccctcgcgacctggaggaattcttttctaccgttggcaaagttcgtgatgtgaggatgatcagtgacagaaattcgcgtcgcagcaagggcatcgcatacgtggagttcgttgacgtgtcttctgtaccactggctattggactgaccgggcagcgagttcttggagtgcccatcattgttcaggcatcgcaggcagagaagaacagggcagcagccatggcgaataacctgcagaagggctcagccggaccgatgagactttatgtgggaagtttgcattttaacatcacagaggacatgctccgaggcattttcgaacccttcgggcgcatcgagagcattcagctaatgatggacagtgaaacaggacgtagtaaagggtacggatttatcaccttttccgacagcgagtgcgccaaaaaagcactagaacaactgaacgggtttgaactggccgggaggcctatgaaagtgggccacgttaccgaaagaacagacgcaagctccgcttcctctttcctggactctgatgaactggagagaacaggtattgatctgggaaccacagggcgactccagctgatggccagactggccgaaggcacgggacttcaaatcccccccgcagctcagcaggcccttcagatgagcggcagtcttgcatttggggccgtagccgagttctccttcgtgatcgatctgcaaactaggctgtcacagcagaccgaagcctccgcattggcagctgctgcgagcgtccagcccttggcaacacagtgtttccaactgtccaatatgttcaatcctcagacagaggaggaggttggctgggacacagaaatcaaagatgatgtgatcgaagagtgtaataagcatgggggtgtgatccatatttacgtggacaaaaactcagcacaaggcaacgtgtatgtgaagtgccccagcattgccgcagccatcgccgctgtcaacgcgctccatggccgctggtttgctggaaaaatgatcactgccgcatatgtcccactgccgacgtatcataaccttttccccgatagcatgacagcaactcaactgctcgtaccttcccggaggtag

SEQ ID NO: 26212 - DNA, 1176 bp, Artificial Sequence
  Description of Artificial Sequence: Synthetic coding sequence
atggtggaggccgaccggcccggcaagctgttcatcggcggcctgaatactgaaaccaacgaaaaagccttggaagcggtctttggcaagtacggacgcattgtggaggtgctgcttatgaaagacagggaaactaataaatctagggggtttgcttttgtgacctttgagtcccccgccgacgctaaagacgctgcccgcgatatgaatggcaagagtcttgatggtaaggccatcaaagtggagcaggctactaaaccttcttttgagtcgggacggagagggcccccccctccccctaggagcaggggtccccctagaggtctgcgaggcggacgaggcggctccggtggtactcgcgggccgccaagcaggggcggtcacatggacgatggtggatactcaatgaacttcaacatgtctagctccagaggtcccctaccagtcaagcgaggacccccgccacgatcaggggggccaccacccaagcggagcgccccctccggaccggttcgcagctcgtccggaatgggcgggcgggctcccgtttcgaggggtagagatagttatggcggtcctcccagaagagaaccactcccctccagacgcgacgtgtatctctccccaagggatgacgggtactctacaaaagatagctactcttcgcgggattacccgagctcaagggacacgcgggactatgcccctccaccgagggattatacataccgcgactatggccatagcagttccagagacgattacccttctcgggggtactctgatcgtgacggctacggacgcgatagggactacagcgatcacccttcgggtggtagttatcgcgacagttacgagagttatggcaactctagatctgcacctcctaccagaggaccccccccttcctacggcggttccagcagatacgacgattattcaagctcacgcgatggttacggaggtagcagagactcttatagctcctcgagatcggatctgtacagctctggacgagatagagtcggtaggcaagaacgcggtctgccaccgagcatggaaagagggtacccaccccccagggactcatattccagcagcagccggggggctccgcggggcggaggacggggagggtcccggagcgacaggggaggcggcagaagccgctactag

SEQ ID NO: 26213 - DNA, 309 bp, Artificial Sequence
  Description of Artificial Sequence: Synthetic coding sequence
tgaatgttcatctgcccccaggagatgatgggcatcctgctgaagacggctattcaggctgaaatcactcaggtccttgtaatactagagatcatgcatcaccatcacgaaatcattctgacagtgattatggtgattcctgtacacgtgatgaccattcaccaggaggatattgcaatcgagatggatatggtggttatcgtcactatccagattatccaggtggaagtacccaccgagattcacatgcgcgttatggtgggagactttgctcattacggcaggggtgtgctgatcgactcccaatag

SEQ ID NO: 26214 - DNA, 591 bp, Artificial Sequence
  Description of Artificial Sequence: Synthetic coding sequence
atggtggaggccgaccggcccggcaagctgttcatcggcggcctgaataccgagacaaacgaaaaagcattagaagccgttttcggtaagtacggaaggattgtggaggtactgttgatgaaagacagagaaacaaataagtcccgggggttcgcctttgtcacgtttgagtctcccgcggatgccaaggatgccgccagggatatgaatggcaaactcctctatcacgttgaggagatcgtgatggaggttcacctggaggggaaccgctgccccctagtggaaatgtttatctgtccacaggagatgatgggaatactcctcaagaccgccatccaggccgaaattacccaggttctggtgatcctggaaatcatgcaccaccatcacgaaattatcctgacagtgataatggtgatcccagtgcacgtgatgaccattcatcaggaagacatcgctattgaaatggacatggttgtgattgttacaatccagataattcaggtggaggtacccactgaaatccacatgagagtgatggtcggagacttcgctcattacggaaggggtgtactgattgacagccagtag

SEQ ID NO: 26215 - DNA, 1137 bp, Artificial Sequence
  Description of Artificial Sequence: Synthetic coding sequence
atggtggaggccgaccggcccggcaagctgttcatcggcggcctgaatactgagacgaacgaaaaggctttggaagccgtatttggcaagtacgggaggattgtcgaggtactcctaatgaaggacagagagagtccggctgacgccaaagatgcagcccgagacatgaatggcaaaagcctcgatggcaaagcaataaaagttgaacaggcgactaaaccaagtttcgagtcaggccgtaggggtccacctccccctccgcggtcaaggggtcctcctcgcggactcaggggcgggcgcggggggagcggaggcacgcgcggcccacccagcagaggcgggcatatggacgacggcggttacagcatgaacttcaatatgagctcatccagaggcccactgccagtgaagcggggacccccccctcgctcaggcggtcctcctcccaaacgaagtgcgccctccggtcccgttcggtcttcttctggcatgggcggcagagcgccggtcagccgggggagggactcttatgggggtccccccagacgggagccgttgcctagccgaagagacgtctatctgtcaccgcgggatgacggctactccacaaaagattcctatagttcccgggactacccctcatcccgagatacacgggattacgccccccctccccgcgattatacctaccgggactacggccactcatcatcacgtgacgactaccccagccgcggctatagtgatagagacggatacgggcgagatcgcgactactccgaccacccctctggcggttcataccgggattcctacgagagctacggtaattccaggtctgcacctcctactaggggcccccctccatcttacggcggaagctccaggtacgacgattatagctcctcccgagatgggtacggcggatcaagagactcttactctagcagccggtcagatctgtattctagcggccgagatagggtgggaaggcaagaaagaggcctgcctccttctatggagagaggttatcccccaccacgtgatagttattcatccagttctcggggcgcacccagagggggcggcagaggcggttcgaggtcagacaggggcggcggccgcagccggtactag

SEQ ID NO: 26216 - DNA, 1443 bp, Artificial Sequence
  Description of Artificial Sequence: Synthetic coding sequence
atggccagcgacagcatcttcgagagcttccccagctacccccagtgctttatgcgcgagtgcatcctggggatgaacccatcgcgtgatgtgcacgacgccagcacctctagacggttcaccccaccttctactgcattgagcccaggtaaaatgtcagaggctttgccgttaggcgcccctgacgcaggcgctgccttggcggggaagttgcggagtggcgaccggtccatggttgaggtgctcgcagatcatcccggagaactggtgagaacagacagccccaatttcctgtgctccgttctgcctacacattggcgttgtaacaagacccttcctattgcctttaaggtagtggccctcggagacgtgccagatggcactttggtaacagtgatggcagggaatgatgagaactattccgccgagctgcgtaatgccacggccgcgatgaaaaaccaggttgcaagattcaacgacctccgcttcgtgggccgttccgggcgggggaagtcgttcaccctgacaatcacagtcttcactaaccccccccaggtggcaacttatcaccgcgcaataaagatcacagtggatggacccagggaacccagacggcaccgtcaaaaactcgatgaccagacgaagcccggcagcctgtcatttagcgaaagattgagcgagttggagcagcttcgccgcactgctatgcgcgtgtccccacatcaccccgcccctactccaaaccctcgagcctcactcaatcattccaccgcgtttaatccacagccccagagtcagatgcaggatacacgacagattcagccttcacctccctggagctatgaccagtcttatcagtatctcggtagtattgcatctccatcagtgcatccagcaacaccaatcagtcccgggagggcatcaggcatgacgacgctgtcagcggaacttagttcccggctgagcacagcccccgatctgacagctttctcagatccccgccaattccccgccctgccaagcatttcagacccgagaatgcattatcccggagccttcacatactccccaaccccagtaacatcaggaatcggaattggcatgtccgcaatgggtagtgctacccggtatcacacttaccttccgcctccttacccaggcagcagtcaggcccaaggggggccatttcaggcaagcagcccatcttaccatctgtactacggggcgagtgcgggcagctatcagttctccatggtagggggtgaacgcagccctccgcgaatcctgcctccatgcaccaacgctagcaccgggagcgccctgctaaacccgtcattaccaaaccagtccgacgtcgtcgaagccgagggctcccacagtaactcccctactaatatggcaccctctgctcgtttagaggaggctgtctggaggccatattag

SEQ ID NO: 26217 - DNA, 1407 bp, Artificial Sequence
  Description of Artificial Sequence: Synthetic coding sequence
atgcccgccgccccccggggccccgcccagggcgaggccgccgcccggacgcgcagcagagacgcctcaacttccagacgcttcactccaccttctaccgctctgagcccgggcaagatgagtgaggctctgcctctgggcgcacccgacgccggggcagccttggccggaaagctccgttccggagacagatctatggtggaagttctggccgatcaccccggagagctggtgcggaccgattcccccaactttttatgtagcgtgctccctacccattggaggtgcaacaagactttgcccattgcctttaaagtggttgccctgggggatgtgcctgacgggacactggtaaccgtgatggccggcaatgacgagaattatagtgcggaactgagaaacgcgaccgccgctatgaaaaatcaggttgctcgctttaacgacctgcgattcgtgggcaggagcggcagagggaaatcctttactcttactattacggtcttcacaaaccccccccaggtagcaacctaccacagggcaatcaagataactgtggatgggcctcgagagccaaggcggcataggcaaaaactggacgatcagactaagcccgggtccctgtcattctcagaaagactaagcgaactcgaacagctccggaggacagctatgagggtgtccccccaccaccccgcccccacgccgaacccaagagccagcctgaaccactccactgcctttaaccctcagccacagtcccagatgcaggataccagacagatccagccttcaccaccctggtcttatgaccagagttaccagtacctcgggtccatcgcaagcccatcagtgcatcctgcgacacctatttcccccgggcgcgcctccggtatgacgaccttgtccgccgagctgagttcgcggctgtcaacagcgcctgacctgacggcattcagcgatcctaggcagttcccagctctccccagcatctcagacccgcgaatgcattatccaggggcatttacctattcacctacaccagtgacttcaggcattggcataggcatgtctgcaatggggtccgctaccaggtaccacacttacctgcccccgccttatccgggcagttcccaggcacagggagggccattccaggccagcagtccgtcttaccatttgtactacggcgcctctgcagggtcttaccaattcagcatggtgggtggcgaacgctcacccccaaggatattacccccttgcactaacgcatctactggtagtgccctgctgaacccttctctgcctaatcagtccgatgtagtggaagcggaggggtcacactccaactcacctaccaacatggccccctcagcgaggctagaggaggccgtctggagaccatattag

SEQ ID NO: 26218 - DNA, 1362 bp, Artificial Sequence
  Description of Artificial Sequence: Synthetic coding sequence
atgcggatccccgtggacgccagcaccagccggcggttcacccccccctctacagcactgtctccgggcaagatgtctgaggcacttcccctgggcgctcccgatgctggtgcagcgctcgcgggcaagctgagaagcggcgatagatctatggttgaggtgttggcggatcacccaggcgagcttgtgcgaactgacagcccaaatttcctgtgctcagtactgcccacacactggcgctgcaacaaaacacttcccatcgcctttaaagtcgttgctctcggcgatgtgccagatggcactctggtcacagttatggctggaaatgatgaaaactacagtgctgaacttaggaatgccactgctgcgatgaagaaccaagtggctaggtttaatgaccttaggttcgtggggcggagcggccgcggaaagtcgttcacactgactataacggtgttcacaaaccccccccaagtggcaacatatcacagggccataaagataaccgtggacgggcctcgagaacccaggcggcatcgccaaaaactagacgatcagacaaagcccggcagtctttcatttagcgaacgcttatcagagctcgaacagctgcgtagaaccgctatgagggttagtccgcatcacccagccccaacgcctaaccctagagcatcactaaaccactcaaccgccttcaatccacagccccagtcccagatgcaggatacacggcaaatccagccatccccaccttggtcttacgaccaatcttatcaatatctaggaagcattgcatcccctagcgttcaccctgctaccccaatcagccctggccgagcttccggaatgacaactctctcagcagagctgtcgtctcgattaagcactgcccctgatcttactgccttcagtgatcctcgacagttcccagcgttgccttccattagtgatccacgaatgcattacccaggcgcgttcacctattccccgacccctgttacaagtggaatcggcattgggatgagcgcaatggggtctgcaacccgctaccacacatacctgccgcccccgtatccagggagttcacaggcccaggggggacccttccaagcatcctctccatcgtatcacctttactacggggcgtcagccggtagctaccaattttccatggtcggaggggagcgctcaccaccgcggatcttgcccccttgtaccaacgcatccaccggctcggctcttctgaatcctagcctgccaaatcagagcgacgtagtagaagctgaggggtcccactccaattctcccaccaacatggcaccatcagcacggcttgaagaggccgtatggcgaccatactag

SEQ ID NO: 26219 - DNA, 1428 bp, Artificial Sequence
  Description of Artificial Sequence: Synthetic coding sequence
atgaaccccagccgggacgtgcacgacgccagcaccagccggcggttcacaccacctagcacagcattgagcccaggcaagatgtctgaggctcttcccttaggggctccagacgccggagcagccctggctggaaaactcaggtctggcgatcgttctatggtggaggtcctcgctgatcatccaggagaactcgtccgaacagactctcccaattttctatgttcggtgctccctacccactggagatgcaacaagaccctgccaatcgcctttaaggtcgtagcactaggtgacgtccctgacggtacgctggtgactgttatggccggcaacgatgaaaattatagcgcagagctacgcaacgccacagccgctatgaagaatcaggttgcaaggtttaatgacctccgcttcgtgggccgctcgggtagaggaaagagttttactcttaccatcactgtttttaccaaccccccacaggtcgctacgtaccaccgcgctataaaaatcacagtcgatggaccacgggaacctcggagacatcggcagaaattagatgaccagacaaagcctggaagcctatctttcagcgagaggttgtccgagttggagcagctgcggcgaacagctatgagagttagcccacatcatcctgcccccacaccgaaccccagagccagcttaaatcattctacagcctttaatccgcagcctcaatcccagatgcaagatacccggcaaatacagcctagccccccttggtcctatgatcagtcttaccagtatttgggctctatcgcttctcccagcgttcaccccgctacacctatctcacctgggcgagcgagtggtatgaccaccctgtcagccgaactctcttcaagactgtctacagctcccgacttgactgcgttcagcgatccccgccaatttcccgccctcccgtcaatctcagatccaagaatgcattatccgggtgctttcacctactcccctacccccgtcacgagcggaattggaattggtatgtccgccatgggcagcgccacaaggtaccacacttatttaccccctccgtatcctggctccagccaggcacagggtgggcccttccaagcctccagtccatcgtaccacttgtactatggggcttcggctggaagctaccagttcagtatggtagggggagagagatcccccccgcggattttaccaccttgcacaaatgcctcaaccggctcagcattactaaatccaagccttcccaatcagtccgatgtggtggaagctgagggcagccactccaacagccccacgaatatggcacgcgcctcatgctcaaggcaggctaggcgtgatcccggaccttgggctaggccaccttcatggggccggggaagaccaacagctcggatatccctttag

SEQ ID NO: 26220 - DNA, 99 bp, Artificial Sequence
  Description of Artificial Sequence: Synthetic coding sequence
atggccagcgacagcatcttcgagagcttccccagctacccccagtgctttatgagggagtgcatccttggcatgaaccccagccgggatgtgcactag

SEQ ID NO: 26221 - DNA, 414 bp, Artificial Sequence
  Description of Artificial Sequence: Synthetic coding sequence
atgcaggacacccggcagatccagcccagccccccctggagctacgaccagtcttaccagtatctggggagtattgcctcgccatcggtgcatcccgcaaccccaatctctcctggaagggcctctggcatgactactctctcggctgaactgagcagccggttgtcaactgcccccgatttaacagccttcagtgacccccgccagttcccggctctccctagcattagcgaccctcgtatgcattatcctggagctttcacttactcacctacgcctgtcacttccggtataggaattggaatgtccgccatgggttctgcgacgcggtaccatacatatctgccaccaccgtacccggggtctagccaggcccagggcggccctttccaggccagcagcccatcttactag

SEQ ID NO: 26222 - DNA, 1443 bp, Artificial Sequence
  Description of Artificial Sequence: Synthetic coding sequence
atggccagcgacagcatcttcgagagcttccccagctacccccagtgcttcatgagggagtgcatcctgggaatgaaccccagtcgggacgttcatgacgctagcacctccaggagatttaccccccctagtaccgcactatctcctggaaaaatgagcgaggcacttcctcttggtgcacctgatgccggtgccgcattggctggcaagctacggtcaggcgatcgatcaatggtagaggtgctagcagaccaccctggggagctcgtccggaccgacagccccaattttctttgttctgtgctgcctacacattggcggtgtaataagactctgccgattgcctttaaggttgtggccctgggggatgtgccggacggcacactcgttactgtcatggctgggaacgatgagaattattcagccgagctgcgcaatgccaccgccgccatgaaaaaccaagtagcacgattcaatgacctgcgcttcgtcggaaggtccggccggggcaaaagttttacactgacaattactgtgtttaccaatccaccccaggtggcgacgtaccatcgcgccatcaaaattaccgtcgatggaccccgagagccccggaggcataggcaaaagctggatgatcagaccaaaccagggtccctttccttcagcgaaagacttagtgagctggaacagcttcgccggactgctatgagggtgtctccacatcatccagcacctacacccaatcccagagccagcttgaaccactccacagcttttaacccccagccccagagtcaaatgcaagacacccgacagattcagccgagtccaccttggtcctacgatcaatcctatcagtacttgggttcaatcgcctcaccatccgtgcaccccgccaccccaatatccccaggccgggccagcggaatgactacactgagcgccgagctttcgtctcgtctgagcactgctccggatctaaccgcgttcagcgaccctcggcagtttcctgctctaccaagcatttcggacccaaggatgcactacccaggtgcattcacatactctccaactccggtgacctcgggtattggcattggcatgtccgcgatgggatcggccacacggtaccatacctatctccccccaccatatcctgggagtagtcaggcccagggcggccccttccaggcctcgtcacccagttatcacctttactacggcgcctcagccggctcttatcagttcagcatggtagggggcgaacggtcgccacctcgtatcctgcccccctgtaccaatgctagcaccggtagcgctctgttgaatccttctctgcctaaccagtcggacgttgtggaggcggagggctcacatagtaatagtcccaccaacatggcgcccagcgccaggctggaagaagcagtgtggagaccttactag

SEQ ID NO: 26223 - DNA, 576 bp, Artificial Sequence
  Description of Artificial Sequence: Synthetic coding sequence
atgaaccccagccgggacgtgcacgacgccagcaccagccggcggtttaccccacctagtacagccctctcacccggaaaaatgagtgaggcattgcccctgggggcaccagatgctggggcagcactggccggaaagctccgatcaggcgaccgatctatggtagaagtgctagctgatcatcctggcgagctagtgcgaactgactcacctaatttcctctgctctgtcctgccaactcactggagatgtaacaagacgctgcccattgcgttcaaagtggtggcactcggggatgtcccggatggcaccctcgtgacagtcatggcgggaaatgacgagaactattcagctgagctgcgcaacgcaactgctgcaatgaaaaatcaggtggcgcgcttcaacgacctgagattcgtgggccgctcaggacgtgggaagtcttttactctgacaataaccgtgttcaccaaccctccccaggtggccacctatcaccgcgccatcaaaatcactgtcgatggaccccgcgaacctcgcaattctttgacttggcccaggtacccccacatttag

SEQ ID NO: 26224 - DNA, 753 bp, Artificial Sequence
  Description of Artificial Sequence: Synthetic coding sequence
atgcggatccccgtggacgccagcaccagccggcggttcacccccccgtccacggcgctatcaccagggaaaatgagcgaggccttgccgctgggagcccctgatgctggtgcggccctggccggaaaacttagatctggggatcgctcgatggtggaagtgttggcagaccaccccggcgagctcgtgcggactgactcgcccaatttcttgtgctccgtgctgcctacccactggagatgcaataagaccctccctattgcatttaaggtggtagcgctgggggacgtgcccgatggcacactagtcacagttatggctggcaacgatgaaaattacagtgctgaactcaggaacgccacagccgcaatgaagaatcaggtggcccgcttcaacgacttgcgctttgttgggagatccggaagaggaaaatctttcaccctgaccatcaccgtgtttactaaccctccacaagtggccacttatcaccgggcaattaagataacagtggacggccccagggagccacgaaggcacaggcagaagctggacgaccagactaagcccggcagcctcagtttttctgaacggttgtctgaactcgaacagctgcgccgtacggctatgagagtctcacctcatcacccagcgcctacacccaaccctcgcgcatccttgaatcacagcaccgcttttaacccacagccccagtcccaaatgcaagaagaggatacagcaccttggcgctgctag

SEQ ID NO: 26225 - DNA, 1770 bp, Artificial Sequence
  Description of Artificial Sequence: Synthetic coding sequence
atgctgcacagcccccacaagcagccccagaaccacaagtgcggcgccaactttctacaggaagatagtaagaagagtctcgtgtttaagtggctgatctcagctggccattaccagcctccccggcccacagaatcgttcaaggccgcaagtagtatctataacagaggctataaattctacctgaaaaagaagggagggacgatggcaagtaactctctgttctccaccgtcactccctgccagcagaatttcttctgggacccaagtacatccaggcggttcagcccaccctcaagtagtctgcagcccggtaagatgagtgacgtgtcccccgtggttgctgcgcagcagcagcagcagcagcagcagcagcagcaacagcagcaacagcagcagcagcagcagcagcagcaggaagctgccgccgcggccgcagctgccgcagctgccgccgccgcagctgctgcagtacccagactcaggccgccgcatgacaatcggactatggtcgagatcattgctgatcacccagctgagttggtccggactgacagtcccaacttcctgtgctccgtgctgccttctcattggcgctgtaacaaaacccttcctgtggcatttaaagttgtagccctgggcgaagtgcctgatgggacggtggtaactgtgatggccggcaacgatgaaaattactctgcagagttgcgaaacgccagcgcagtgatgaaaaatcaggtagccaggttcaacgacctaagattcgtgggccgaagcggccgcggtaaaagctttactctgactattaccgtgttcaccaaccctcctcaggtcgccacataccatcgggcgatcaaggtcactgtagatggccctcgagagccaaggaggcatcgacagaagctggatgattctaaaccttccttgttcagcgaccgactaagcgatcttggcagaatcccacatccctccatgcgagtgggtgtccccccacagaatccacggccaagcctgaactctgcaccgtcccctttcaacccccagggccagtctcagataacagatccacgacaagcccagagctcccctccgtggtcctacgaccagtcttacccctcctatctgtctcagatgacttcaccatctatacactcaactactccactatcaagcacgcgtgggacaggtctacccgccatcaccgacgtgcctcgccgaattagcgacgatgatacagcaactagcgacttttgtctgtggccttccacgttgtccaaaaaatctcaggcaggcgctagcgagctgggaccattcagtgatccaaggcagttccccagcatcagcagcctcactgaatcaagattttctaacccacgaatgcactatccagcgacgtttacctatacaccaccggtgacttccgggatgagtttaggcatgtctgcgaccacacactaccatacttacttacccccaccttacccagggagctctcagtcccagtccggcccttttcaaacatctagtaccccctatctatattatggcacaagtagcggttcctaccagttcccgatggtgccaggtggcgaccggtcccccagccgaatgttacctccctgcacgaccacgagtaacggttctaccctgctcaacccaaatctgcccaatcagaacgacggagtggacgcagatggttctcatagctctagccctacggtattaaactcatcgggaaggatggatgaatcagtttggcggccgtactag

SEQ ID NO: 26226 - DNA, 1524 bp, Artificial Sequence
  Description of Artificial Sequence: Synthetic coding sequence
atgcggatccccgtggaccccagcaccagccggcggttcagccccccttcgtcttcattgcaacctggcaagatgtccgacgtcagccctgtggtcgctgctcagcagcagcaacaacaacagcagcagcagcaacaacagcagcaacagcagcaacagcagcagcagcaggaggctgcggcagcagcggctgccgcagctgcggccgcagccgccgccgcagccgtgcccaggctcagacctccacacgataacaggacaatggttgaaatcatagccgatcaccctgcagagttggttagaactgatagccccaacttcctctgctccgtgctcccttctcactggaggtgtaacaaaacgctgcccgtcgcgtttaaggtggtagccctgggcgaggtgcctgatggcacagtcgtgacggtgatggcaggaaacgatgagaactatagcgccgagctgaggaatgcatctgctgtcatgaaaaatcaagtggcgcgatttaacgacctgagattcgtcggtaggtctggcagaggtaaaagcttcactctgactattacggtcttcacaaaccctccccaagtcgctacataccacagagcgattaaggtaactgtggacggcccacgtgagccacgtcgacatcgccagaagctggatgacagcaagccttccctgttctcggacagattatctgacctcggcagaattccccacccatctatgagggtgggcgtcccaccacagaaccccaggcctagcctaaacagcgcgccttccccatttaatccacaaggacagtcccaaatcaccgatcccaggcaggcgcagtcttccccaccctggagttatgaccagagttacccctcctatttgtctcagatgactagcccttccattcactccaccaccccgttatccagcacccgagggaccgggctacctgctatcacagatgtaccacggaggatttctgacgacgacaccgcaaccagcgatttttgcctgtggccgtccaccctgagcaaaaagtctcaggctggcgcctcagagttggggcccttttctgatcccagacagtttcctagcatttcttcattgacggagagccgcttcagcaaccctagaatgcactatcccgcgacttttacttacacaccgccggtgactagcggcatgagcctgggcatgtcagcaactacgcactatcacacctacctgccacccccatacccggggagttcacagtctcagagcggccccttccaaacttcatctactccttatctttactatggcacttccagcgggtcgtaccaattccccatggtccccgggggggaccggagccccagtagaatgcttcctccatgcacaactacgtccaatggttccactcttttaaacccaaacctccccaatcagaatgatggggttgacgcagatggttctcactctagctcccctactgtgctcaatagcagtggacggatggacgaatccgtgtggcgcccatactag

SEQ ID NO: 26227 - DNA, 1458 bp, Artificial Sequence
  Description of Artificial Sequence: Synthetic coding sequence
atgcggatccccgtggaccccagcaccagccggcggttcagccccccatccagctccctccagcccggtaagatgtcggatgtgtccccagtcgttgcagcccagcagcaacagcaacagcagcaacagcagcagcagcaacaacagcagcagcagcaacagcagcagcaggaggccgcggcagcagctgctgctgccgctgccgctgccgcagctgccgccgcagttccacgccttcggccccctcatgataatagaactatggtggagataatcgcagaccaccccgccgagctggtgagaactgatagtcctaactttctctgttcagtgctcccttcgcactggcggtgtaataagactctgcccgttgcattcaaagtggtagccctgggagaggtcccagatggcaccgtggtgacagtcatggctggcaacgatgagaattattctgccgagctgagaaatgcctccgcagttatgaaaaatcaggtcgcccgattcaatgatctgcggttcgtgggcaggtcaggtaggggaaaatcctttacactgactatcacagtgttcacaaacccaccccaggttgcaacataccatagggctattaaggtgacggtggacgggccccgggagccacgcagacaccgccagaaactagatgacagtaaacccagtctgttctcagatagattatccgatcttggacgaattccccacccttccatgcgagtaggggtcccaccccagaaccccaggcctagcctgaactctgcaccatcgcctttcaacccccagggtcagagccagattaccgaccctcggcaggcccagagctcacctccctggagctacgaccagtcatacccttcttatctgtctcagatgacgtctcccagcatacactcaaccactcccctctcttcgacacgaggcaccggcctcccagccattaccgatgtgcccaggcgcatctctggggcttctgagttgggtccattcagtgatccccgacagttccctagcatttcttccttgactgagagccggttctccaatccgaggatgcactaccccgctaccttcacctacactccacccgtgacaagcggaatgtcgctcggaatgagtgccaccacgcactatcacacttatttgcctccgccttaccccggcagttctcaatcccagagcggaccattccaaactagtagtacaccatacctgtactatgggactagctccgggagttaccagttccctatggtcccaggcggcgaccgctccccaagtcggatgttacccccctgtacaactacctcaaacggttctacattactgaatccgaacctgcccaaccagaacgatggtgtggacgccgacggcagccattcttcctctcccacagtgctgaactcttctgggcggatggatgagagcgtgtggaggccctactag

SEQ ID NO: 26228 - DNA, 1500 bp, Artificial Sequence
  Description of Artificial Sequence: Synthetic coding sequence
atggccagcaacagcctgttcagcaccgtgaccccctgccagcagaacttcttctgggatcctagtacatctaggagattcagcccaccaagttcctcgctgcagccaggtaaaatgtcagacgtttcccctgtcgtggctgcccaacagcaacagcagcagcagcaacagcaacaacagcagcagcagcaacagcaacagcagcagcagcaggaggctgcggccgctgcagctgctgccgccgcggcggctgcggccgccgctgctgttcccaggctgcgtccccctcacgataacaggacaatggtggagatcatcgccgaccaccctgcggaattggtccggacagactctcccaactttttatgcagtgtgctccctagccactggcgatgtaataagaccttgccggtcgctttcaaggtcgtagccctgggcgaagtcccagacggcaccgtggtgaccgtgatggcaggcaacgatgaaaattacagcgccgagctccggaatgcctcggcagtgatgaaaaatcaggtggctagatttaacgacctccggttcgtcggtcggtccggcaggggaaaatcctttacgctgacaatcactgtgtttaccaacccgccccaggtggccacgtaccaccgcgccatcaaggtaaccgtcgacgggccaagggagccacgccgccaccggcagaagcttgacgattcaaagccatccctgttcagcgacagactaagtgacctcggaagaattcctcacccatccatgcgggtcggcgtgcctccccagaacccccgcccgtcccttaactcggccccaagtccgttcaatccacagggccaaagccaaatcactgatcctcgccaggctcaatcctctccaccatggtcttacgaccagtcttatccctcctacttatctcaaatgacaagcccatcgatccactctactacccccctaagcagcaccagaggtactggactgcccgctatcaccgatgtacctaggcgaataagtggcgcctcagaactgggccccttctccgatccaaggcagttccccagcataagttccttgacggagtcccggttctccaatccaaggatgcactatccagcaacattcacctatacaccccccgtgactagtggaatgagcttgggcatgagtgcgaccacacattatcacacctacttgccgccaccatatcccgggtccagtcaaagccagtccggtccattccagacctccagcactccatacctgtattatggcacatcatccggatcatatcaattccccatggtccccggcggcgacaggtcacctagtagaatgttgcctccttgcacaacaactagtaacgggtccactcttctaaaccctaatctccccaaccaaaacgatggcgtggatgccgacggctcccattcctcgagcccaacggtgctgaactcaagcggcagaatggacgagtccgtctggaggccgtactag

SEQ ID NO: 26229 - DNA, 1566 bp, Artificial Sequence
  Description of Artificial Sequence: Synthetic coding sequence
atggccagcaacagcctgttcagcaccgtgaccccctgccagcagaatttcttctgggatcccagcacttccagacgattctcccctccctcatcgtcacttcagcctggtaagatgtccgacgtctcaccagtggtcgctgcacagcaacaacagcagcagcagcaacaacagcaacagcagcagcagcaacagcagcagcagcagcagcaggaagccgccgccgcagccgccgccgccgcggccgctgcagccgcagccgcagccgtccctagacttagaccccctcatgacaataggactatggtagagataatcgctgaccaccctgccgaactagtgcgcacagactcgccgaattttctgtgttctgtgctcccgtctcattggcggtgcaataaaacactccccgtagcatttaaagtggtggctctgggcgaagtccctgacggcactgtggtcaccgtcatggctggcaatgacgaaaattactcagccgagctgcggaacgctagcgctgttatgaagaaccaggtggcccgttttaatgatctcagattcgtaggccggtccggtagggggaaatctttcaccttaacaatcaccgtgttcactaaccctcctcaggtcgctacctaccaccgggccattaaggtgacggtggacggcccacgggaacctaggaggcacaggcaaaaactagatgacagtaagccctccctgttcagcgaccgcctgtctgacctcggaagaattccccaccctagtatgcgtgtgggcgtgccccctcagaacccccgcccctccctcaactctgctcctagcccatttaatccgcagggacagagccaaatcactgatcccaggcaggcccagagctcccccccttggagctatgatcagtcttaccctagctacttgagccagatgacctccccttccattcattctaccacgcctctgagcagtacacggggaaccggtctgccggccataaccgatgtgcctcgacggatcagcgatgatgataccgccacttccgatttctgcctgtggcccagcacactatcaaagaagtcccaagctggcgcatccgaactcgggcctttttctgatccaaggcagttcccttccatttcatcactgacagagtctagattttcgaatccccgcatgcattacccagccacctttacttatactccccctgttacttcggggatgagtctgggcatgagcgccaccacacattaccacacttatctgccaccgccttacccaggatccagtcagtcccaatcggggcctttccagactagcagcactccctacttatactacgggaccagttctggctcttatcagttcccaatggtacctggcggcgatagatcaccatcgagaatgctgccaccttgtactaccactagcaatgggagcaccttactcaaccccaatttgcctaaccagaacgatggagtggacgccgatggctcccattcgtcttcacctactgtgctgaatagctctggtcgcatggatgagagtgtctggaggccatactag

SEQ ID NO: 26230 - DNA, 1566 bp, Artificial Sequence
  Description of Artificial Sequence: Synthetic coding sequence
atggccagcaacagcctgttcagcaccgtgaccccctgccagcagaattttttctgggatcccagtaccagccgccgatttagtccccctagttcatctctgcagcccggtaagatgtctgacgtctcccccgtggtggccgcccagcagcagcagcagcagcagcagcagcagcaacagcagcagcagcagcagcaacagcaacagcagcaggaggctgccgcggcagccgcagctgccgcagcagccgccgccgcagctgctgcagtgcctcgtcttaggcctcctcacgataatcggacgatggtggagattatcgcggaccatccggccgagttggttcgcacagactctccaaacttcctctgcagtgtcctgccatcccattggcgctgcaataagacccttccagtggcattcaaggtcgtggctctcggggaggtgccagacggcaccgtcgtcaccgttatggccgggaacgatgaaaactatagcgcagagttgcgcaacgcaagcgctgtgatgaaaaaccaagtggccaggtttaatgatctcagatttgtgggacgatcggggcgcggaaaatcttttaccttgacgattacagtcttcacaaaccctcctcaagtcgcaacctaccacagggcaatcaaggtgaccgttgatggtccccgtgaacccagaaggcatcgccagaagctcgacgactctaagccgagcctgttttctgacaggctgagcgacttaggaagaatcccccacccgagtatgcgggttggagttccccctcagaatccacgtccaagcctcaatagcgcgccaagtcccttcaacccacaaggtcagtctcaaattacagacccacgacaggctcaatcttctcccccatggagctacgatcagtcgtatccatcctatctgagccaaatgactagtccatctatccactccacgacaccgctcagtagtacacgaggaaccggcctccccgctattacagacgtcccccgccgaatttccgatgatgacaccgccactagtgacttctgcctctggcccagcacattgtcaaaaaagagtcaggcaggcgctagcgagctagggcctttttcagatccacggcaattccccagtatctccagcttgacagagtctcgcttctcaaaccctaggatgcattatccagcaacgtttacatacactccaccagttacttctggcatgagtctcgggatgtctgctactacccattatcacacctatctgcctcctccctaccccggaagcagtcagtcgcaatccgggccctttcaaacatcatccactccttatctctactacgggacatcgtcaggttcataccagttccccatggttccgggcggtgaccggagcccgtctcgaatgctgcctccctgtactactacaagcaacgggtcgaccttactgaatccaaatctccctaatcaaaacgatggcgtggacgctgatggatcgcacagttcatccccaaccgtgctgaacagtagtggcaggatggacgagtcggtttggcggccctactag

SEQ ID NO: 26231 - DNA, 1704 bp, Artificial Sequence
  Description of Artificial Sequence: Synthetic coding sequence
atgctgcacagcccccacaagcagccccagaaccacaagtgcggcgcaaacttcctccaggaggactccaaaaagagcctggtctttaagtggcttatttccgccggccattatcagcctccacgccctacagagagttttaaggctgcgtcctctatatataacagggggtataagttttacctcaaaaagaagggcggaacaatggcctcaaactcgctgttttcgaccgtgaccccatgtcagcagaattttttctgggatccttccacctctaggagatttagcccccctagcagctcattgcaacctggaaagatgtcggatgtgtcccctgtggtagccgcgcagcaacagcagcagcagcagcagcagcagcagcagcagcaacagcagcaacaacagcaacagcaacaggaagccgccgctgccgctgcggccgccgctgcggcagccgccgcggccgctgcggtccccaggctccgcccccctcatgataacagaacaatggtagagattatcgcggatcaccctgctgaactagtcagaaccgattctccgaatttcttatgctctgttctccctagccattggcgttgtaacaaaaccctgcctgtggcatttaaggtcgtagctctgggcgaggttccagacggtacggtcgttactgtaatggctggtaatgacgagaactacagtgcggaactgcggaacgcatctgccgtgatgaagaaccaggtagctcgcttcaacgacctccgattcgtcggtcgtagcggacgtgggaagagtttcacacttacaatcaccgtatttaccaaccctcctcaggtcgcaacctaccacagggccatcaaagtcaccgtggacggcccgagagaaccacgtcgtcaccgtcagaaacttgatgatagtaagcccagcctgttctctgatcggcttagcgacctgggcaggatccctcatccctcaatgcgggttggagtgcccccccagaacccacgacctagcctaaacagcgcgccttctccattcaaccctcaaggccagtcgcagatcactgatccgaggcaggcacagagtagcccaccctggtcatatgatcagtcgtatccgtcatatctttcccaaatgacatccccctccatccactcaaccacgccgctgagctccaccaggggtaccgggctgcctgcaattaccgacgtcccccgtcggatcagcggagcctcagaactgggaccattcagcgatcctcgacagttcccgagcattagctctttaactgagtcacgcttctcaaaccctcgcatgcactatccagcaaccttcacttacacaccgccagtgacgtcgggtatgtccctcggtatgagtgctacaacacactatcatacctacctgccccctccttacccggggtccagccaaagccagagtgggccattccagacgtcaagtactccttacctgtattacggaacatcaagtggatcctaccagttcccgatggtgcccgggggcgacaggtcgccgagtagaatgctgcccccatgtacaacgacaagtaatggtagtaccttgctgaaccccaacctccccaatcagaatgatggtgtggatgcagatgggtctcactcctcatcaccaaccgtgctaaactcgtcggggcggatggacgaatcagtgtggaggccctactag

SEQ ID NO: 26232 - DNA, 1248 bp, Artificial Sequence
  Description of Artificial Sequence: Synthetic coding sequence
atgcggatccccgtggaccccagcaccagccggcggttcaccccccctagtcccgccttcccatgtggtggcggcggaggaaagatgggcgagaatagtggggccttgagcgctcaggctgctgtgggtcccggcggacgcgcccggcccgaggtccgaagcatggttgatgttctcgctgaccacgctggggaactcgtcaggacagattctcctaattttctgtgtagtgtcctcccctcacattggaggtgcaataaaaccctacccgtagccttcaaagtagttgccctaggcgacgtcccagatggtaccgtggtgacagttatggccggaaatgatgagaactacagtgcagagcttcggaacgccagcgcagtgatgaagaaccaggtagcccgctttaatgacctacggtttgtggggaggagtggccgcggcaagtccttcactttgaccataacggtgttcaccaaccccacacaagtggctacgtaccatcgggcaatcaaggtaaccgtagacgggccacgtgagccacgacggcatcgccagaaactggaagatcaaacgaagccgttcccggacaggtttggcgacctagagcggcttcggatgcgcgtcacacctagtactccttcacctagaggcagtctctctactacctcacatttttccagccagcctcagacccctattcaggggacttcagagctgaacccatttagcgatccaagacagtttgaccgctctttcccaaccctgcctaccctcactgagtctaggtttcccgatcctaggatgcattatcccggagccatgagcgccgcctttccttattcagcaacccccagcggaaccagcatctcatcactgtcagttgccggaatgccagccacatcacggtttcatcatacatatttgccccctccataccccggagctccacaaaatcagagcggccctttccaggcaaatccatccccctaccacttgtattatggaactagttcggggtcatatcagtttagtatggtcgctggttcatcgtcagggggagaccggtctcctacccgcatgcttgcttcctgtacctcctctgctgctagcgtggcagccggaaatctgatgaatccaagcctcggaggccagtcggatggcgtggaggcagatggcagccactctaattccccaaccgccctgagcacacccggccgcatggacgaggccgtgtggcgtccctattag

SEQ ID NO: 26233 - DNA, 1290 bp, Artificial Sequence
  Description of Artificial Sequence: Synthetic coding sequence
atggccagcaacagcatcttcgacagcttccccacctacagccccacattcatccgggacccctcgacatctagaagattcacaccgccatctcccgcctttccctgcggcggaggcgggggtaagatgggtgaaaactctggggccttgtcagcacaggccgccgtcggacccggtgggcgggccagaccagaggtaagatctatggtggatgtgctcgccgaccatgcaggcgaactggtacggacagattctcctaactttctttgttctgtgctcccaagccattggaggtgcaataagactcttcctgtggcttttaaagtggtcgcgctcggagacgtgcccgatggaactgtggttacagtgatggccgggaacgacgagaattattctgcagagttaagaaatgcatccgctgtcatgaagaaccaagtcgcacgattcaacgacttgagattcgtgggccggtcggggagaggcaaatcatttaccctcacaatcaccgtttttaccaacccgacgcaggttgccacataccatcgggcaattaaagtcaccgtggacggcccaagagaaccaagaaggcacagacagaaactggaggaccaaacaaagcccttccccgatcgatttggcgatcttgaaaggttacgcatgagggtgacaccaagtacaccttcaccaagaggctccttgagcacaacctctcacttttcctcgcagccacagactcccatccagggcacctccgagctgaaccccttcagtgatccccgtcagttcgaccgctcatttcctaccttaccaacgctcactgaaagccgattccctgacccaagaatgcactatccgggcgccatgagcgccgctttcccatactcagctaccccttcgggcacatcaatctcaagccttagtgttgcaggaatgccagcaacaagtcggttccatcacacctatctcccccctccttatcccggtgcccctcaaaaccagtctggcccatttcaagccaacccgagtccatatcatctttattacgggacatccagcggtagttaccagtttagcatggtcgcaggatcaagctctgggggtgatcgttcccccaccagaatgcttgcctcgtgcacctcctccgcagccagtgtggccgccgggaatctgatgaatccttcacttggcggtcagagcgacggagtcgaggctgatgggtcgcatagcaactccccaaccgcactgtctacacccggcagaatggacgaagctgtgtggcgtccctattag

SEQ ID NO: 26234 - DNA, 1290 bp, Artificial Sequence
  Description of Artificial Sequence: Synthetic coding sequence
atggccagcaacagcatcttcgacagcttccccacctacagccccacatttattagggacccttctacctcccggaggttcactcctcccagcccggctttcccatgtgggggggggggcgggaaaatgggcgagaactcaggagcattatccgcacaggccgcggtagggcctggtggccgggcacgccccgaggtgagaagcatggtggatgttctcgccgaccacgctggcgagcttgtgaggaccgattcgccaaattttctttgcagcgttttaccctctcattggagatgcaacaagaccttacctgtcgcgttcaaagtcgttgcactcggagatgtgcccgatggcacggtggtaactgtgatggcagggaacgatgaaaactacagcgctgagctgcgcaacgcctctgctgtcatgaagaatcaggtcgctcgctttaacgatctgagatttgttggtcgcagtggacggggcaaatcatttacgttaacaattaccgtgtttacgaacccgactcaggtggcaacttatcatcgcgccattaaggtgactgttgatggaccacgcgaacctcgtcggcatcgccaaaagttagaggaccaaacgaagccttttccagatcggttcggggatcttgaaaggctccgcatgagagtgactccctcaacaccctcccctagggggagtctgagcacaacctcgcactttagttcacaaccacaaactcctatccagggaacaagcgagctgaaccccttttccgatccccggcagttcgaccgctctttccctacactgccaactctgacagaaagccgctttcccgatcccagaatgcattaccccggcgccatgtctgctgcctttccatatagcgctaccccgagcgggacaagcatatctagcctctccgtagccggaatgccggctacctctcgcttccaccacacctaccttcccccaccatatccaggggcacctcagaaccagagcggcccttttcaggctaatcctagtccataccatctctattacggcacatcctcagggtcataccaattcagcatggtagccgggagctcatctggtggtgacagaagtcccactcgcatgcttgcttcctgtacgtcaagtgccgcctcagtcgctgcgggtaacttaatgaatccctccttgggaggccagtccgatggcgtggaggctgacggctcccattctaacagtcctacagccttgtctacaccgggacgcatggacgaggcagtctggagaccctattag

SEQ ID NO: 26235 - DNA, 1089 bp, Artificial Sequence
  Description of Artificial Sequence: Synthetic coding sequence
atgcggatccccgtggaccccagcaccagccggcggttcacccccccttcccccgccttcccatgtggaggcggcggtggtaagatgggggagaattccggtgccctcagcgcgcaagcagctgttggtcctgggggaagagctcgtccagaagtcaggtctatggttgacgtgctggccgaccacgcaggcgaattggtgcgcactgactctcccaacttcctgtgctcagtgctgccatcacactggagatgcaataagacactgcctgtggcgtttaaggtggtcgcgctcggggatgtgccggatggtactgtcgtgacggtaatggctggtaacgacgaaaactactctgccgaactgaggaatgcgtctgctgtgatgaagaatcaagtggcccgcttcaatgatcttagattcgtgggacgatctggcagaggaaaatcttttaccctgacaatcactgtgtttacgaaccctacgcaggtagccacttaccatagagccatcaaggtgacggtggatggcccacgggaacctcgccgaacatcagagctcaaccccttcagcgacccccggcagttcgataggtcttttcccaccctgccgacactgaccgagtcccggtttccagacccccgcatgcactaccctggcgccatgtctgctgccttcccatactcagctaccccgagcggaacctctatttcttctttaagtgtggcgggaatgccagcgacgtctcgcttccaccacacgtatttgccacccccctatcctggcgccccacagaaccagtccggacccttccaggctaatccttcgccctaccacctgtactacggtacttcctcaggatcttaccaatttagtatggtggccggatcttcctcaggcggcgatcgttctcctacaaggatgcttgcaagctgcacgagtagtgccgcatctgttgcagccgggaatttaatgaatccctcactgggtggccaatcggacggagtggaggcagatggatcgcacagcaacagtcccacggccctgtccaccccagggagaatggacgaggctgtctggcgtccatactag

SEQ ID NO: 26236 - DNA, 969 bp, Artificial Sequence
  Description of Artificial Sequence: Synthetic coding sequence
atggtggtggccctgggcgacgtgcccgacggcaccgtggtgaccgtaatggcggggaacgacgagaattattcagccgaactgagaaacgcctccgctgtgatgaaaaatcaggtagcccgattcaatgatcttagattcgtggggaggtctggtcgaggcaagtcatttaccctcacaatcacagtattcactaatccaacacaagtagctacatatcaccgcgcaattaaagtcaccgtggacggaccgcgagagcctcggagacaccggcagaagctagaggatcaaaccaagcccttccctgatcgctttggagacctggagcgcctgagaatgcgggtaacaccttccacacctagtccaaggggaagcctgtctaccacatcgcatttctcaagccaacctcagaccccgatccaggggacctcagagttaaaccctttcagtgaccccaggcagtttgatagatcgtttcccactcttcctacactgaccgaatctcggttccccgatccgagaatgcactatccgggtgcaatgtccgcagcctttccatactcggctacgccgtcagggacaagtatttctagcttgtctgtcgccgggatgcccgcgacgtcgcgctttcaccatacatatctgcctcccccctatccgggcgccccgcaaaatcagtcgggaccgtttcaggctaacccttcaccctaccacctgtattacggaacgtctagtggttcctatcagttttccatggttgcgggctcctctagtggcggagaccggtctcccaccagaatgttggcctcttgcacatccagcgcagcctctgtcgccgctggcaatctaatgaatccttctcttggcgggcagtccgatggggtggaagcagatggaagtcatagcaactccccaaccgcactatccacaccaggtcggatggacgaagccgtatggcgcccttactag

SEQ ID NO: 26237 - DNA, 2439 bp, Artificial Sequence
  Description of Artificial Sequence: Synthetic coding sequence
atggacttcagccggctgcacatgtacagccccccccagtgcgtgcccgagaatacagggtacacttatgctctgtcgagcagctactcgagcgatgcgctggattttgagacggaacataagctcgatccagtgttcgactctccgcgaatgtcaagaaggtctctgaggctcgccaccaccgcttgcacactgggtgacggtgaagccgtgggcgcagactccgggacatcatctgccgtgtccctgaagaatagagccgcacggactacgaaacagagacgctccacgaacaaaagcgcatttagtattaatcatgtcagccgacaggtgacgtcttctggagtgtctcacggaggcactgtgagtctccaggatgcggtgacaaggcgcccaccggtgctggacgagagctggatcagggagcagactacggtcgatcacttttgggggctggatgatgacggcgacctcaaaggaggcaataaagccgccatacagggaaatggcgatgttggagctgctgcagccacagctcataatggtttcagttgctcgaattgtagcatgctttccgagcgcaaggatgtactgacggctcatcccgccgccccaggcccagtatccagggtgtactcacgtgatcgcaatcagaagtgtgacgactgcaagggcaagcgacacttagatgcacatcctgggagagcggggactttgtggcacatctgggcttgtgccgggtacttcttactgcaaattttgagacgtattggagccgtgggtcaggccgtgtctcggactgcctggtctgccctgtggctagcggttgtggcccccggaaaggccgcgtccggtgttttctggtggctcggcattggatggtatcagtttgtgacgcttatcagctggctcaacgtatttctgttaacacgttgcctcaggaatatttgtaaattccttgtcctgctgattccccttttcctactgctggccggtttaagcctgcggggccaggggaatttctttagcttcctgcccgtgctgaattgggcatccatgcacaggacacaaagagttgacgatccgcaggacgtttttaaaccgaccacctctcgactcaaacagcccctgcagggagactcagaggcattcccatggcactggatgtcaggggtcgaacagcaggtcgcatccctgagcggccagtgccatcaccatggagagaacttgcgggaactgacaacactgttacaaaaactgcaagctagagtggatcaaatggaagggggggctgcaggaccttccgccagtgtgcgtgatgctgtgggccagccccccagggagactgactttatggctttccaccaggaacatgaggtacgcatgtctcatctggaagatatcctggggaagttgcgcgagaagtccgaagccatccagaaggaacttgagcaaaccaaacagaaaacaatttccgcagtcggggagcagctgctcccgacagtggaacacctgcagcttgagttggaccagcttaagtctgagttgtcttcgtggagacatgtgaaaactggatgcgaaacagtggacgccgttcaggaacgggtggatgttcaggtcagggaaatggtgaagctgctgttctccgaggatcagcagggagggtccctagagcagttgctgcagaggttttcctcacagtttgtgtcgaagggagatttacagactatgctcagggatttacagcttcagatcctccgaaatgtcacccaccatgtgtcagtcactaagcagttgcctacaagcgaggcagtggtctctgccgtgtccgaggcaggggcgagcggaattactgaggcgcaagcccgcgccattgtgaattccgctctaaagctctactctcaagataaaactgggatggttgattttgccttggaaagcggaggaggatccatcttgtctaccaggtgctccgagacttatgaaaccaaaaccgcgctgatgagtctgttcgggattccactgtggtatttctcccagtcaccacgcgtggtcattcagcccgacatatacccaggaaactgttgggcttttaaaggctcacagggctaccttgtggtgagactgagcatgatgatccatcctgcagcctttactcttgagcatattcccaagactctttcacccactggaaacataagttcagccccaaaggatttcgcggtttatggcctggagaacgagtaccaggaggagggacagctgctgggccaatttacttacgatcaagacggtgagtccctgcagatgtttcaggccctcaagagaccagacgacacagcctttcagatcgtggaactcagaatattttccaactggggtcacccggagtacacctgcctttatcgcttcagggttcatggggaaccagtcaagtag

SEQ ID NO: 26238 - DNA, 2109 bp, Artificial Sequence
  Description of Artificial Sequence: Synthetic coding sequence
atgagccggcggagcctgcggctggccaccaccgcctgcaccctgggcgatggtgaggcagttggtgcagacagcggtaccagtagcgctgtatcactgaagaacagggctgcccgcacaactaagcagagacggtccacaaataaaagcgcattctcaattaaccacgtgagtagacaggttactagttccggtgtttcgcacgggggcaccgtgagcttacaggatgccgtgacgcgccgccccccggtactggacgaatcatggatccgcgagcagactacggttgaccacttctggggcctggatgatgatggcgacctaaaagggggcaacaaagcagctatccaaggtaatggagatgttggcgccgccgccgccaccgcccacaacgggttctcgtgcagcaattgctcaatgctttcagagcgcaaggacgtgctgactgcccatcctgccgccccaggtccggtgtcgcgggtctacagccgcgatcgcaatcagaaatggaaagccgcctccggtgttttttggtggttaggaattggttggtatcagtttgtaactctgatctcatggctgaacgtgtttttactgacacgttgtcttcgtaatatctgcaagttcttagtgcttctcattcctctattcctgctcctcgcaggtctgagtctgagagggcagggtaatttcttcagtttcctgcccgtcctgaactgggctagcatgcacagaacacagcgcgtggatgatcctcaggacgtgttcaagccaaccacctcccggctgaaacagccattgcagggggactctgaggcttttccctggcactggatgtctggcgttgagcagcaggtagcctctctatcgggccagtgccatcatcacggagaaaatctgagggaacttaccacgctgcttcagaagcttcaggcacgcgtggaccagatggagggcggtgccgccgggccatcagctagcgtccgcgacgctgtgggtcagccccccagagaaacagacttcatggccttccaccaggagcacgaagtacggatgtcacatctggaggacattttggggaaactgcgagagaaatccgaggctatccagaaagagctcgagcaaaccaaacaaaagaccatcagcgccgtgggagagcagctactacccaccgtcgagcatcttcagctggagcttgatcagctaaaatcagagctgtcctcttggcgccacgtcaagacaggatgcgagaccgtggacgctgtgcaagagcgggttgacgtacaggttcgcgagatggtcaaacttctgttctctgaggaccaacagggcggctctctcgagcagctgttacagagatttagctcgcagttcgtgtctaaaggcgatttacagaccatgctcagagatctacagttacagatcctgagaaatgtgactcaccatgtgagcgtcacgaaacaactgcccacgtctgaagcagtagtctctgccgtctctgaagccggagccagtggaataactgaagcgcaggcacgagctatagtgaacagtgcactgaagttatattcccaagataagactggcatggtggattttgcattagagagcggtggagggtctatccttagcacacgctgttctgagacttacgaaacaaagaccgccttaatgagcctattcgggattccactgtggtacttctcacagagcccacgggttgtcatccagcctgatatctatccaggcaactgctgggcttttaagggttctcagggctatctggttgtgcggctcagcatgatgatacaccccgccgcctttacccttgaacacatacccaagactctgtcacccactggcaacatttcctccgctcccaaagattttgccgtctacgggctggagaatgagtaccaggaggagggccaactgctgggacagtttacctacgaccaggatggcgagtccctccaaatgttccaggctctaaagcgacccgatgataccgcattccagatcgtggagctgcgaattttctctaattggggacatccagagtacacttgtctatacaggtttcgcgtgcacggcgagcctgtgaagtag

SEQ ID NO: 26239 - DNA, 2358 bp, Artificial Sequence
  Description of Artificial Sequence: Synthetic coding sequence
atggacttcagccggctgcacatgtacagccccccccagtgcgtgcctgaaaatacagggtatacctacgcactttcatccagctacagcagtgacgccctggacttcgaaacggagcacaaactggatccggtgttcgacagccccaggatgagtcggcggagcctgcgcctcgccaccaccgcctgtacactgggagacggggaagctgttggagcagattcaggtaccagcagtgccgtctctctcaaaaatagagcagccaggacgactaaacagcgacgcagcacaaacaagtctgcatttagtatcaaccatgtgagccgacaggtgactagctcgggagtttctcatggcggtaccgtgagtctgcaggacgctgtcactcgtcggcctccagtgctcgatgagagctggatcagagagcagacaactgttgatcatttttgggggctggacgacgacggtgatcttaaaggtggaaacaaggccgctattcagggcaatggcgatgtcggagccgcagcggcaaccgcacacaatgggtttagctgcagcaattgttccatgttgtcggaacggaaagacgtgctgaccgcacacccagcggcaccaggtccagtaagccgggtttactcgagagatcgaaaccagaagtgctactttcttctgcagatactgaggcgaatcggagccgttggacaggccgtatcccggaccgcatggtcggccctttggctcgcggtggtggcccccggcaaggcggcgtctggggtgttttggtggctgggtatcggatggtatcagtttgtcacactgatcagctggctgaatgttttcctgttgacgcgctgcttgcgaaacatttgcaagtttctggttctcctgattccactgttcctgctcctggctggactcagcctgcgcggccagggtaactttttttcatttctcccagtgctcaattgggcttcaatgcataggacacagcgggtggatgacccccaggacgtctttaaacccactacaagtcgcctgaaacagcccctccagggcgatagcgaagccttcccatggcactggatgtcaggggttgagcaacaggtggcaagcttgtccggacagtgccaccaccacggtgagaaccttcgggagctgactacgctgctccagaaactccaagcacgcgtggaccagatggagggtggggcagcgggcccctcggcatctgtacgcgacgcagtgggacagccccctcgcgagactgactttatggctttccatcaggaacacgaagttcgaatgtcacatctcgaggatatccttgggaagctgcgggaaaagtcagaagcaatacagaaagaactggaacagacaaaacagaagacaatttccgctgtgggcgagcagctcctgccaaccgtggaacatctccagttggagctagaccagctgaaaagcgagttaagtagctggagacacgtgaaaaccgggtgtgagacagtcgacgctgtgcaagagagagtagacgtgcaagtacgcgaaatggtgaagctcctcttttcagaggatcagcaggggggaagtctagaacagctgctgcagagattctcaagccagttcgttagcaagggcgatctgcagaccatgttaagggacctgcagctccaaatcctccggaatgttactcaccatgtgagcgttaccaagcaattacctacttctgaagcagtggtctcagcagtctctgaagctggcgctagcggaattacagaagcccaggcccgagccatcgtaaatagcgctctgaagctgtacagtcaggataaaacaggtatggtggactttgccctcgagagcggaggcggaagtatactgagcactaggtgtagcgagacttacgaaaccaagaccgccctgatgtccctctttggaatacccctctggtatttctcacagtcccccagggtagtaattcagcccgacatttatcccggaaactgttgggcattcaagggttcccagggatatttggttgtcaggttgagtatgatgatccatcctgccgctttcaccctggaacacataccaaaaacactgtcccccacaggcaacatcagctctgctcctaaagacttcgcagtctatggactcgagaacgagtaccaggaggaagggcaactgctcggtcagttcacctacgatcaggacggcgaaagcctccagatgtttcaggccttgaaacgcccagatgacaccgcttttcagatcgtggagttacgcatcttttcgaactggggtcaccctgaatatacatgcctctacagattccgtgtgcacggtgagcctgtcaagtag

SEQ ID NO: 26240 - DNA, 774 bp, Artificial Sequence
  Description of Artificial Sequence: Synthetic coding sequence
atggacttcagccggctgcacatgtacagccccccccagtgcgtgcccgagaacactggttacacctatgccttaagtagctcctattcctctgatgccctcgacttcgagactgaacacaaattggacccagtttttgactctccccgtatgagccgacgcagcctgagactcgccacaaccgcctgcacactgggggacggagaggctgtaggcgccgacagcgggacatcgtcggcggtcagccttaagaaccgagccgcccggacgaccaagcagcgccgcagcacaaataaatccgctttcagtattaatcacgtttcccgacaggtcaccagttccggcgtgtctcatggaggcaccgtgtccctacaggatgctgtgacccgccgccctcccgtactggacgagtcctggataagggaacagaccaccgttgatcatttttggggtttggacgatgacggcgacctgaaaggcggtaacaaagccgctattcagggcaacggtgatgtgggggctgcagccgccaccgcacataacggattttcatgctccaactgcagtatgctgtcagagagaaaggacgttttaacggctcatcctgcagcccctgggcccgtttccagagtgtactcaagggacagaaatcagaagtgtaaatctcagagctttaaaacccagaagaaggtgtgttttcccaatttgatcttccctttttgtaaatctcagtgcctacactatctgtcgtggcggttaaaaattattccatag

SEQ ID NO: 26241 - DNA, 2469 bp, Artificial Sequence
  Description of Artificial Sequence: Synthetic coding sequence
atggacttcagccggctgcacatgtacagccccccccagtgcgtgccagaaaacacgggctatacctacgctctgtccagcagttattcaagtgacgccctggacttcgagaccgaacataaacttgaccctgtcttcgactcccctcgtatgtcacggaggtcgctaaggttagcaactacagcttgtactctcggagatggcgaagctgttggagcggactccggaacatccagtgctgtcagcttgaagaatcgcgccgctaggacaaccaaacagaggagaagcaccaacaagtctgccttttctatcaatcacgtgagccgtcaggtcacctcttctggggtatctcacggcggaactgtctccctccaggacgcggtcacaagaaggccgccggtactggacgagtcatggattagggagcagacaaccgtggaccatttttgggggctggatgacgacggcgatctcaagggcggaaataaggctgccatccaaggtaatggcgatgtcggcgccgccgccgctaccgcacataacggattctcctgtagtaactgttccatgctcagtgaacgcaaggatgtgctgacggcccacccagctgccccagggcccgtcagtcgggtgtattctcgcgacagaaaccagaaatgtgatgattgcaaaggcaaaaggcaccttgacgcccacactgccgctcacagtcagagtccacggcttccagggcgcgcaggaacactatggcacatctgggcctgtgccggctatttcctacttcagatcctgcgccggatcggggctgtggggcaagccgtaagccgaaccgcttggtccgcactgtggctggctgtggttgccccaggcaaggctgccagcggagtgttctggtggctgggcatcgggtggtatcaattcgtgacattgatttcatggctgaatgtgtttctcctcacgagatgtctgagaaacatatgtaagtttttggtgctgttgatcccgctgttcctgctcctcgcagggctcagtttacggggacagggcaattttttttctttccttccagtgctcaactgggcgtcaatgcaccgtacccagagggtggacgacccccaggatgtttttaaacctactaccagtaggctgaagcaacctctgcagggcgattccgaagctttcccttggcactggatgtccggagtggagcagcaggtcgcaagcttaagcggccagtgccatcatcatggagaaaatttgagggagctcactacactgttacagaagctccaggcacgagtggaccaaatggaagggggagctgccggcccaagcgcgtccgttagagacgcagtcggtcagccgccacgcgaaacagattttatggcctttcatcaggagcacgaggtgcgcatgtctcacctggaagacatcctggggaagctccgtgaaaaaagtgaagctatccaaaaggagcttgagcagaccaagcagaagaccataagcgcagtgggggagcagttattacccacggtggaacatcttcagctcgaactggaccagctgaagagcgagctctctagctggcgccacgtaaaaaccggttgtgagactgtcgatgccgtacaggaacgagtggacgtccaggtacgggagatggtcaagttgctgtttagcgaagaccagcaaggaggatctctggaacagctgcttcagcggtttagctcacaatttgtctcaaagggcgatctccagaccatgctgagagacctgcagcttcaaattcttagaaacgtgacacatcacgtcagtgtcaccaagcaactcccgactagcgaggctgtggtgagcgcagtctccgaggctggtgcgagtggcattacggaagcacaggcacgcgctattgtgaacagcgcacttaagttgtactcccaagacaagactgggatggtggatttcgccttggagtccgggggggggagcattctgtcaacgagatgttcagagacatacgaaactaaaacggccctgatgagcctgtttggaatccctctgtggtactttagccagtctcctagagtagtgatacagcctgatatatacccagggaactgctgggcgtttaagggctcccaggggtatttggtggtgcggctgtccatgatgattcatcctgccgccttcacgctggagcatatcccgaaaacactgtccccgaccgggaatattagcagtgctcccaaggattttgcagtatacggcttagagaatgagtatcaagaggagggtcagctgttgggacagtttacatacgaccaggacggcgagtcccttcagatgtttcaggccctcaaaagaccagacgacaccgccttccagatagttgaactgagaatttttagtaactggggccacccagaatacacttgcctttatcgctttcgggttcacggggaacccgtgaagtag

SEQ ID NO: 26242 - DNA, 1752 bp, Artificial Sequence
  Description of Artificial Sequence: Synthetic coding sequence
atgaagctgagctacgagagcgagaactacaagctgaagacccacgagagcaaagattgcgagtctgagtcttacaagtccaaaagtcacgaaagtaaggctcacgcatcatactacggccggatgaacgttcgagaagtgcttcgcgaagacggccacctatcggttaacggcgaggccctgtggaaagctgccagcggcgtcttttggtggctggggatcgggtggtaccagttcgtgactcttatatcttggctgaacgtctttctgctcacacggtgcctcagaaacatctgtaagttcctggttttgttgattcccctcttcttactgctcgccggtctatccttgcgtggtcagggcaatttcttctcattcttgcccgtactcaattgggccagtatgcatcggacacaacgcgtggacgatccccaggacgtatttaagcccactacaagtaggttgaaacaaccgcttcagggcgattccgaagcctttccctggcattggatgagcggtgtggagcagcaggtagcgtcattatccgggcagtgtcaccaccatggtgagaatctcagggaactgaccacactactgcagaaactgcaagcccgggtggatcagatggagggaggagcggcgggacctagcgcctcaacagactttatggccttccatcaggagcacgaggtgaggatgtcacaccttgaagacatcctcggaaagttgcgggaaaaatctgaggctatacaaaaggagctggagcaaactaaacagaaaactatttccgcagtgggggaacaactgcttcctactgttgaacacctgcaactcgaacttgatcagcttaagtccgaactttcaagctggcgccacgtaaaaaccgggtgcgaaacagtggacgctgtgcaggagcgtgttgatgtgcaggtgcgggagatggttaaactgctgttctctgaagatcagcagggggggagtctggagcagctgttacagcggttttccagccagttcgtctccaagggcgatctgcagaccatgctgagggaccttcaattacagatcctgcggaatgtgacccaccacgttagtgtaaccaagcaattacccacaagcgaagccgttgtgagcgctgtgagtgaggcaggagctagcggaattacagaggcacaagcacgtgcgattgtgaatagcgccctgaagctgtatagccaggataaaactggaatggtggactttgcccttgaatcaggcggtggatctatattgtcgactagatgtagcgagacttatgaaacaaagaccgcactgatgtctctatttggaatcccactgtggtacttctcccagtcacccagggtcgtgattcagcctgacatttatcccggcaattgttgggcctttaaagggtctcagggatatctagtcgtgaggttatcgatgatgattcaccccgccgcttttactctggagcacatcccaaagacactgtccccgacagggaatatcagctccgcccccaaagatttcgctgtctatgggttggaaaacgaatatcaggaagaaggtcagctattagggcagttcacttatgaccaagacggagaatcactgcagatgtttcaggctctgaagaggcctgatgataccgcctttcagattgtggagttgagaatctttagcaactggggccatccggagtacacatgtctttaccgtttccgggtgcatggagagcccgtgaaatag

SEQ ID NO: 26243 - DNA, 342 bp, Artificial Sequence
  Description of Artificial Sequence: Synthetic coding sequence
atggacttcagccggctgcacatgtacagccccccccagtgcgtgcctgaaaatactggctacacctatgcactttctagctcctattcatctgatgccttggatttcgagactgagcataagttggaccccgtgtttgatagtccgcgcatgtcccggcgatctctgcgtctagctacgactgcctgtacccttggagacggagaggccgtgggggccgacagcgggactagttcagccgttagtctaaaaaatcgcgcagccaggacaacaaagcagaggaggagcaccaataagagcgccttctccatcaatcacgtgtctcggcaggtcacatcttag

SEQ ID NO: 26244 - DNA, 267 bp, Artificial Sequence
  Description of Artificial Sequence: Synthetic coding sequence
atggacttcagccggctgcacatgtacagccccccccagtgcgtgccagaaaacaccggttacacatatgcactgtcgagctcttatagttccgatgcgctggacttcgagaccgagcataaattggatccagtattcgattctccccgcatgagccgtcgttccctccggttggccaccactgcctgcactttgggggatggagaggcagttggtgccgactcaggaacaagtagtgctgtctctcttaaaaatcgggctgcctag

SEQ ID NO: 26245 - DNA, 2109 bp, Artificial Sequence
  Description of Artificial Sequence: Synthetic coding sequence
atgagccggcggagcctgcggctggccaccaccgcctgcaccctgggcgatggcgaagctgtaggggccgacagtgggacatccagcgcagtttctctaaagaatagggccgcgaggaccacaaaacagcggcgatcaactaataagagtgcctttagcataaaccatgtgtctcgccaggtaacttcctcaggcgtcagccacgggggaaccgtgtctctgcaagatgcagtcacccgcaggcctcctgttctggacgaaagctggataagagagcaaacaacagtagaccacttctggggcctcgacgacgacggcgatctgaagggaggtaacaaggctgcgatacaagggaacggcgatgtaggagcagccgccgccacagctcacaacggttttagctgcagcaattgtagcatgctctcagagaggaaggacgtgcttacagcacatccggccgcaccaggcccggtgtctcgggtttattctcgagatcgcaatcagaagtggaaggcagcatctggagtattctggtggctggggatcggttggtaccagtttgtgactctgatatcatggcttaacgtgttccttcttacacgatgccttaggaacatctgcaaattcctcgtgctgcttatcccattgttcctcctgcttgccggactctcccttcgcggccaaggcaacttcttttcattcctgccagtcttaaactgggcgagcatgcatagaacccagagagtggacgatcctcaagacgtgtttaaacctactacttctaggctgaagcagccattgcagggtgactcagaggcctttccctggcactggatgtcaggtgtggagcaacaagtggcgtctctcagcggacagtgccaccaccatggggagaatttaagggaactgaccactcttttgcagaagctgcaagcgagggtcgatcaaatggagggcggggctgccggaccatctgcatctgttagagacgccgttggccagcccccaagagagacggacttcatggccttccaccaggaacacgaggttcggatgtcacacctcgaggatatcctcggcaaacttagagagaaatccgaggccatacagaaagagctcgagcaaacaaaacagaaaacaataagcgccgtcggagagcagctgctccccacagtagagcacctgcaactcgaattagaccaactgaaatctgagctgagtagttggaggcatgtgaagaccggatgtgagactgtagacgccgtccaggagagagtagacgttcaggtgagggagatggtcaagttgcttttctccgaagatcaacagggcggttctttggagcagcttctgcagcgattcagttcccagtttgtcagcaaaggggatctgcaaaccatgcttcgagaccttcaactgcaaatattaaggaatgttacacatcatgtgtctgtcaccaagcaactccctacatccgaggcagtggtatcagccgtctccgaagccggtgcctcagggatcactgaggcccaagctagggctattgtgaattccgcactgaagctctacagtcaggacaaaaccgggatggtggactttgcactggagagcggcgggggctccattctcagcacccgatgcagcgaaacttacgagacaaaaaccgccttgatgtctttatttgggatccccctttggtacttcagtcagtctccaagggtggtgatccaacccgacatctatcccgggaactgttgggcttttaagggtagccaaggttatctggtggtccggttaagcatgatgattcaccctgccgccttcacccttgaacatatcccaaaaaccctgtcacctacggggaacatcagctctgccccaaaggatttcgctgtctacgggcttgagaacgaataccaagaggaggggcagctgctcggccagtttacctatgatcaggatggagagtccctgcaaatgttccaggcactgaagcggcccgacgacaccgcctttcaaatcgtcgaacttagaatcttctccaactggggccatcctgagtatacttgcctttaccgtttccgcgtccatggagaaccagtgaaatag

SEQ ID NO: 26246 - DNA, 525 bp, Artificial Sequence
  Description of Artificial Sequence: Synthetic coding sequence
atggacttcagccggctgcacatgtacagccccccccagtgcgtgcctgaaaacacaggatacacctacgccttgagttcgtcgtactctagcgatgctctggacttcgaaactgagcacaaacttgatcccgttttcgattctcctcgcatgagcaggcggagcctgaggctcgccacaactgcatgcacactgggtgacggtgaggcagtgggggccgattccggaacatcgtcagccgttagtctaaaaaaccgcgccgcgagaacaactaagcaaaggagaagtactaacaagtctgcattctccatcaatcacgtgtcacggcaggtaaccagcagtggggtgagtcacgggggcacagtatcgctccaggacgccgtgactaggcgcccacccgttctggatgagagttggattagagagcagactacagtggaccacttctggggccttgacgacgatggggacctaaagggagggaacaaagcagcaatacaggggaatggggacgtgggcgcttag

SEQ ID NO: 26247 - DNA, 408 bp, Artificial Sequence
  Description of Artificial Sequence: Synthetic coding sequence
atggacttcagccggctgcacatgtacagccccccccagtgcgtgcctgagaacaccgggtatacatatgccctaagttctagttacagctccgacgccctggattttgagactgaacataagcttgatcctgtcttcgatagcccccggatgagtcgaagaagcctgaggctggctactaccgcctgcactctgggcgatggggaggcggtaggggccgatagtgggacatcctctgctgtgagcctgaagaatcgagccgctagaaccactaagcagcgacgaagcaccaacaagtctgccttttctataaaccacgtgagtaggcaggtcacatcatcaggtgttagccacggcgggaccgtgtcattgcaggacgctgtgaccaggcggcccccagtgctgtag

SEQ ID NO: 26248 - DNA, 267 bp, Artificial Sequence
  Description of Artificial Sequence: Synthetic coding sequence
atggacttcagccggctgcacatgtacagccccccccagtgcgtgccggaaaacacgggctacacctatgccctcagttctagctattcctccgacgcccttgattttgagactgaacacaagctcgacccagttttcgattccccacggatgtccagacgatccctgcgcctggcaactacagcttgcacattaggcgacggggaagcggtgggagcagattctggcacctctagtgcagtgagcctgaaaaatagggctgcttag

SEQ ID NO: 26249 - DNA, 2049 bp, Artificial Sequence
  Description of Artificial Sequence: Synthetic coding sequence
atggacttcagccggctgcacatgtacagccccccccagtgcgtgccggaaaatacagggtacacctatgcactgtcctcgtcctattcctcagacgccctagacttcgagacagaacataaacttgatccagttttcgacagcccccgcatgtctagacggagcctaagactcgcaaccaccgcctgtactctaggggacggtgaggccgtcggggcagatagcggcacttcaagcgccgtttccctgaaaaacagggccgcaaggacaacgaagcagcggcgtagtaccaataagtcagccttctccatcaatcatgtctcgcgacaggtaacgagcagtggcgtgtcacatggcggtacagtatccctccaagatgccgtgacccggcgccccccggtgctggatgagagctggatcagggagcaaacaacggtggaccacttttgggggaaggctgctagcggagtgttctggtggctgggtattggatggtaccagtttgtcactctgatttcttggctcaacgtgttcctgttaactcggtgcttgcgaaacatatgcaagttcctggtcctgctgatcccgctgttccttctgctcggactgtcgttgcggggacaaggcaattttttcagcttcctcccagttctcaattgggcaagcatgcacaggactcagagggtggacgatccacaagatgtattcaagccaactacctcgcgccttaagcagccacttcaaggcgatagcgaggcgttcccgtggcactggatgagtggcgtggagcagcaggtggccagcctcagcggacagtgccatcaccatggtgaaaatctccgggaactcacaactctgctccaaaaactgcaagctcgggtagatcagatggaggggggcgcagctgggccttcagctagcgttagagacgccgtggggcagcctcctcgtgagacggacttcatggcgttccatcaggagcatgaggtgaggatgagtcacctagaggacattctgggcaagctgcgagagaaaagtgaggcaattcaaaaggagctggaacagaccaagcagaagaccatcagcgccgtcggcgagcagcttcttccaactgtggaacacctgcagctggagctggaccagctgaagagcgagttgtcgagttggcggcacgtgaaaaccggatgtgagacggtggacgcagtgcaagaacgggtggatgttcaggtcagggagatggtcaagctcctgttcagtgaggaccaacaaggcggaagtctggagcaactgctgcagagatttagctctcagttcgtgtctaagggcgaccttcagaccatgctccgggacctgcagctccaaattcttcggaatgttactcaccacgtgtcagtgaccaagcagctccccacaagtgaagccgttgtgtctgccgtgtcagaggcgggtgcaagtgggattaccgaagcacaagcccgtgccatcgttaattccgctctcaaattgtattctcaagacaaaaccgggatggttgacttcgctcttgagtcgggggggggatcaattctgagcacccggtgcagcgaaacttatgagaccaaaacagcactcatgtcattgttcgggatccccctttggtacttctcccagtcaccccgggtggtgatccaaccagacatataccctggaaattgttgggcctttaaaggctcccaaggatatctcgtggtgaggctgtccatgatgatacacccagctgcatttactctggaacatattccgaagaccctcagccccaccggaaacatctcctccgcacccaaggattttgcggtgtacggcttggaaaatgagtaccaagaagaggggcagttgctgggacagttcacctacgatcaagacggcgagagcctacagatgtttcaagcactgaagcggcctgacgacacggcgtttcaaatcgtggagctgaggatcttcagcaattgggggcaccccgagtatacatgcctttaccgatttcgggtgcacggggagcctgttaagtag

SEQ ID NO: 26250 - DNA, 2925 bp, Artificial Sequence
  Description of Artificial Sequence: Synthetic coding sequence
atgggcgacgtgcggaaggccaaggaggccctggccgaggtgcagatccctccaccagatgccggtccatctcccagatgcaaacctcccccagccgagaggctcctcggccccggtcggaggaggcgcgggttaagaagaagacgtgaagccgtttggttcgaggttgttaatatggacttttcgcgcctccatatgtactccccaccccagtgtgtaccggaaaacacaggatatacctatgccctatctagtagctactcatccgacgcactcgattttgaaacagagcacaagctcgatcccgtgtttgacagtcctagaatgagcagaagatcactcaggctagccactacagcctgcacattgggggatggggaagctgtgggggcggacagcggcacaagctctgcagttagccttaagaacagggcagccaggaccactaaacaaagaagatctaccaacaaatctgccttctctatcaatcacgtgtcccgacaggtaacttctagtggagtgagccatgggggcaccgtgtctctacaggacgcagtgacacggagaccacccgtgctcgacgagagctggatcagggagcagactacagttgatcacttttggggcctggacgatgacggcgatctgaaaggcggaaacaaagctgcaattcagggtaatggagatgttggagccgcagctgctacggcgcacaacgggttctcatgcagtaactgtagcatgctatctgaaaggaaggatgtactgacagcccatccagctgcaccaggccctgtgagcagggtttactcccgggaccggaatcaaaagtgtggcgcttctttttatgtcaatcgcatcctgtggctcgcgcgttatacagcctcaagtttcagcagcttcctagttcaacttttccaggtggtgttaatgaagctttcttatgaatccgaaaattacaagctgaaaacccatgagtcaaaggattgtgagtccgagtcttacaagtctaaatctcatgaatccaaggcccacgctagttattacggcagaatgaatgtgcgcgaagtcctgagagaggatggacacctgtcagtgaatggcgaggctctgtgtgatgactgtaagggcaagcggcacttggatgcccacaccgctgctcactcacagtctccacgcctgcccggacgcgctggcacactttggcacatctgggcttgcgccggatactttctgctgcagattctgcgacggatcggagccgttggccaggcagtctcccggacagcgtggtcggcactgtggctggccgtggtagctcccggcaaagcagcgtctggggtcttttggtggctgggcatcggatggtatcagttcgttacattgattagctggctgaatgtatttttactgacaaggtgcctgcggaacatttgtaagtttctcgttttgctcatcccactgtttttgcttttagcggggctctccttgcggggccagggaaatttttttagcttcctgcccgtcttgaattgggcctctatgcatcgaactcaacgagttgacgacccgcaggacgtgttcaaaccaactacaagccggttgaagcagcctctacaaggggattcagaggccttcccttggcattggatgtccggtgtggaacagcaggtagcgagtttgtctgggcagtgtcatcaccatggcgaaaatctgcgcgaattgacgaccctgctgcagaagctgcaagcacgggtagatcaaatggaaggaggagccgccggcccctctgcatcagtgcgagacgcagttggacagccgcctagggaaacagacttcatggccttccatcaggagcatgaggtcaggatgtcccatctggaagacatattggggaaactcagggagaaaagcgaagctatccagaaagagctggagcagaccaaacaaaaaaccatctcggctgtaggcgagcagctgctgccaactgtagaacaccttcagctggaactggatcagctcaaatcagagctatcctcctggcgccatgtcaagacgggctgcgagaccgtcgacgcggtacaagagcgagttgacgtgcaagttagggaaatggtcaaactcttgttctccgaagatcagcagggaggaagcctggaacagctgctgcaaagattctcttcccagtttgtgtctaagggagacctacagacaatgctcagagatctacaattgcagattctgcgcaacgtgacccatcatgtgtccgttaccaagcagctccctacaagcgaggccgtggtgtccgcagtaagcgaagctggagcctccggcattaccgaagcacaggccagggcaatagttaactctgccctgaagctgtactctcaggataaaacgggtatggtggatttcgcgctggagtcgggcggtggctcaatcctatccactaggtgcagcgagacatacgagaccaaaaccgccttaatgagcctgttcgggatccccttatggtacttttcccagagccccagagtggtcatccagcccgatatctaccccgggaattgttgggcttttaaagggtcacagggctacctggtcgttcgcctgagcatgatgatccaccccgctgctttcactctggagcacattccaaagactctcagccctacgggaaatatctcatccgcccctaaggatttcgccgtgtacgggttggagaacgaatatcaagaggagggtcagttactcggccagtttacttacgaccaagacggcgagtcactccagatgtttcaggccctcaagcgcccagatgacactgcctttcaaatcgttgagctgaggattttttctaattggggacaccccgagtacacctgcctgtacaggtttagagtgcacggagagccggtgaaatag

SEQ ID NO: 26251 - DNA, 837 bp, Artificial Sequence
  Description of Artificial Sequence: Synthetic coding sequence
atgggccggatcagccccggcagccccggcctgccccggaccgtgtggttcgaggtcgtaaatatggatttcagccggttgcacatgtattctccaccacaatgcgtccctgaaaacacaggatatacatatgcactgtcctcctcttactcatcagacgctctggatttcgaaacagaacacaaactggatccagtattcgattctccaaggatgagccggaggtctttgagacttgcaacaactgcctgtaccctgggggatggggaggctgtcggggctgatagtggaacctctagcgccgtgagtctaaaaaaccgggccgcccgaacaaccaagcagcgtcgttccaccaacaaatctgcattctcgattaatcacgtcagccggcaagtaactagttccggcgttagccacgggggaacggttagtttacaggatgcagtaaccagacgcccaccagtgctagacgagtcctggattcgtgagcagacaaccgttgaccacttctggggcctggacgatgacggggatctgaaaggtgggaacaaggcggccatccaggggaacggagacgtaggagcagccgcagctacggcccacaatgggttctcttgttcaaactgcagcatgctcagcgagaggaaggacgtgctgaccgcccatcccgctgcccccggtcccgtttcgagagtatattctagagataggaaccagaagtgtaaatcgcagtccttcaagactcagaaaaaagtttgctttcctaacttaattttcccattctgtaagagtcagtgcctgcattatctgtcatggcgcctgaaaatcattccatag

SEQ ID NO: 26252 - DNA, 360 bp, Artificial Sequence
  Description of Artificial Sequence: Synthetic coding sequence
atggacttcagccggctgcacatgtacagccccccccagtgcgtgcctgaaaataccgggtacacttacgctctctcttcctcctattcctccgacgcattagatttcgaaaccgagcacaaacttgaccccgtatttgactctcctagaatgagtcggcgcagcctgagattggctaccactgcctgcacattaggggatggcgaggctgtcggagccgatagtggtacgtctagtgcggtgagcttgaaaaaccgggcagctaggaccacaaagcaacgacggtcaaccaacaaatccgctttttcgataaatcacgtgagccgacaggtgacctcttctggagttagccatggatag

SEQ ID NO: 26253 - DNA, 2352 bp, Artificial Sequence
  Description of Artificial Sequence: Synthetic coding sequence
atggtgatcatgagcgagttcagcgccgaccccgccggccagggccagggccagcagaagccattaagggtaggcttctatgatatcgaaaggactttgggtaaaggcaacttcgcagtagtaaaactcgcccggcacagagtcacgaagacccaggtcgctatcaaaatcatcgacaagacgcgtctcgactcttccaatttggaaaagatatatagggaagtccaactgatgaagctgctgaatcaccctcacattataaaactctaccaggtgatggagacgaaggacatgctctatatagtgactgaatttgccaagaacggagaaatgttcgactacctcaccagcaatggtcatctcagcgaaaacgaggcacgaaaaaaattctggcaaatcctgagcgcagtggagtactgccacgatcatcacattgtccatagagacctaaagaccgaaaaccttctcctggatggcaacatggacattaaactggccgatttcggcttcggcaatttctataagtctggcgaacctcttagcacatggtgcgggagtccgccctacgctgcccccgaggtctttgagggcaaagagtatgagggaccgcagttggacatatggagcctcggcgtagtgttgtatgtactggtttgtgggtccctcccattcgatgggccaaacctgcctacattacggcaaagggtcctggagggtaggttccgcatccctttctttatgtcccaggattgcgaatccttgatcaggagaatgttggtggtggaccctgccaggaggattactatcgcccagatccgtcagcacagatggatgagggctgaaccatgccttcccgggcccgcttgtcctgccttctccgcccacagttacacatctaacctgggcgactatgatgagcaggctttaggaattatgcagactctaggggtggaccggcagcgcacggtggaatccctgcagaatagcagctataaccacttcgctgcaatctactacctgctgcttgagcggctgaaagaatacagaaacgcacagtgcgcacgacctgggccagcccgccaaccacgtccaaggagcagcgatcttagcgggttagaggttccccaggaggggttatcaactgaccccttcagacccgcactactctgtccacaaccacagacacttgttcagtctgtcttgcaggccgagatggattgcgagctgcaaagttctctacaatggccgcttttcttccctgtggacgccagctgcagcggggttttcagaccacggcctgttagcccttccagcctacttgataccgctatctcagaggaggcccgccaggggccaggccttgaagaggaacaggatacgcaggagtcactgccatcgagtaccgggagaagacatactcttgccgaggtgtccacccgcttatctcccttaaccgctccatgtattgtggtgtcacccagcacgacagcgtctccagccgagggaacgagcagtgacagttgccttacattcagcgcctcaaagtctccagcgggcctgtcaggaacccccgctacacagggcctgctgggagcttgctcccccgtgcgattggcctcacccttcctcggctcacaaagtgcgacaccagtgttgcaagcccagggcgggctggggggagctgtgcttctgcctgtgtcttttcaggagggccgacgcgcctctgacacatcactgacgcagggcctgaaagcttttaggcagcaactgaggaaaactacacggacgaaggggttcctgggcctcaacaaaatcaagggactcgccaggcaggtgtgccaggcccccgctagtagagcatcccggggtgggctgtccccttttcacgctccagcccaatcaccaggcctacacgggggagctgccggatcccgagagggctggagtctcctcgaggaggtcctggaacagcagagactcctgcagttacagcaccaccctgcggcggctccagggtgttcacaggccccccagcctgcccctgcgccttttgtaatcgctccatgtgacggccccggggccgcacctctgccctcgacactgctgacttcggggcttcctttgcttcctccccccttgctccagacaggggcctcccctgttgcttccgccgcacagttgctcgatacacaccttcatatcggcacgggccctactgccttaccagccgtgccgccccctaggctggctcggttggcccccgggtgtgagcccctgggcctcctccagggcgattgcgagatggaggatctgatgccttgttccttgggcacttttgtgcttgttcaatag

SEQ ID NO: 26254 - DNA, 3744 bp, Artificial Sequence
  Description of Artificial Sequence: Synthetic coding sequence
atggaggacgccggcgccgccggccccggccccgagcccgagcccgaacccgaacctgagcctgagcctgcaccagaacctgaaccggagccaaaacctggcgcaggaacttctgaagcctttagtcgtctgtggactgatgtgatgggcatactagacgggtccctgggtaacatcgacgacctggctcaacaatatgccgactactacaacacatgtttttctgatgtttgcgagaggatggaggaactgcggaaacgacgggttagccaggatctcgaggtggagaaaccggatgcatcacccacttccttacagctgcggtcccagatcgaggaatccctgggcttttgctctgcagtttctaccccggaagtggagcggaagaatccccttcataaaagtaatagcgaagattcttctgtagggaaaggtgactggaagaaaaagaacaaatacttctggcagaatttcaggaagaatcagaagggcataatgagacagacgagtaagggcgaggacgtaggatacgttgctagcgagattacaatgtcggacgaagaacggattcaactgatgatgatggtgaaggaaaaaatgatcaccattgaggaagccctagcaagactgaaagaatacgaggcccaacatcggcagtctgccgcactcgaccctgccgattggccggacggctcgtatccgacgtttgatggatccagcaactgcaactcccgcgaacagtccgacgatgagactgaagaatcagtgaaattcaaaaggcttcacaagcttgttaatagcaccagacgggtgcgaaaaaaactcatacgggttgaggaaatgaagaaacccagcacggagggaggggaagagcacgtgttcgagaatagtcctgtgctggatgagcgttctgctctctactctggtgttcataagaaacccctatttttcgacggctcaccggaaaaacctccagaagacgactctgactcccttaccacttccccaagttcgagctccctggacacttggggcgcgggacgaaaactggtaaaaacttttagtaagggagagtcaagggggctcataaaaccccccaagaaaatgggaacttttttcagctatccagaggaggaaaaggcacagaaggtgtcaaggagcctgactgagggggagatgaagaagggtctgggcagcttgagtcatggtcgcacatgttcatttggcggatttgacctgacaaataggtcattgcatgtggggagtaataactcggatcccatgggcaaagagggtgactttgtttacaaggaagtaatcaaaagccccaccgcaagccgtataagtttgggtaagaaagtgaagagcgttaaagagacaatgagaaaaaggatgtcaaaaaaatactcctcttctgtctccgaacaggatagcgggttagatggaatgccaggttccccgccaccgtcccaacccgatcctgaacatctagataaaccgaaactgaaagccgggggctctgtggagagcctacgctcatcgctctcaggccagtcatcgatgtccggacagacagtatctaccaccgattcttccacttctaacagggaatccgttaagtcggaggatggagatgatgaagaacccccgtatagggggccattttgtggtcgcgcccgggtacacacagacttcaccccttcaccgtatgatacggacagcctgaaactgaaaaagggcgacatcatcgacataatctctaaaccacccatggggacctggatgggactactcaacaacaaggtggggactttcaagttcatatatgtcgatgtcttaagcgaggatgaggagaaaccgaagagacctactcgacgaaggcgaaagggccggcctccccagccgaaatctgtagaggacctattggacagaatcaaccttaaggagcacatgccaacatttctgtttaatgggtacgaggacttagatactttcaaactgctggaagaggaagacctggacgaacttaatatacgggaccctgagcaccgagcagttttattgactgccgtcgaactcttgcaggagtatgacagcaattctgaccagtctggatctcaggaaaagctcctggtagactcccagggcctttccgggtgcagcccaagagactccggctgctatgaatcaagcgagaacctggaaaatggcaagacacgcaaggcctctctgttatccgctaagtccagtaccgaaccctctctgaaaagtttttcacggaatcaacttggtaattatcccaccctcccactgatgaaatcaggggacgccctcaagcagggacaagaggaggggcgcctgggcggcggtctggcgcctgacacgtcgaaatcctgtgatccaccaggcgttactggtctcaacaagaacagaaggagccttccagtgagcatttgtcggtcctgtgaaaccctcgaaggtccacaaacagtggatacctggccacggagccacagtctcgacgatctgcaagtggagccaggagccgaacaggacgtgccaacagaagttacagagcccccacctcaaattgtgcctgaggtccctcagaagactaccgcaagctcgacaaaggcgcagccacttgagcaggattctgctgtggataacgccctactcctgacccagtcaaaaaggttcagtgaacctcagaagctcaccacaaagaaacttgagggttccatcgccgccagcggaagaggtttgtcacccccccaatgcctccccaggaactatgatgcacagccgccaggtgccaaacatggcctggccaggactcccttggaggggcatcggaagggccacgagttcgaaggcactcaccatccactggggacaaaggaaggcgttgacgcggagcagcgaatgcagcctaagattcccagtcagccacctcccgtgccagccaagaaatccagagagcgactggcaaatgggttgcacccagtacccatggggccatcaggagccctgcctagtcccgacgccccctgcctgcccgtgaagcgggggtctccagcttccccaacttctccatcagactgcccaccggcactggcccccagacccctgtccggccaggcccccggttccccaccctctacccgaccgcccccatggctcagcgagttgccagagaacacgtcactgcaggagcacggagtgaagctagggcccgcgctgacacgcaaggtgagctgcgccaggggggtggacttggaaactctgaccgagaataagctccatgctgaagggatcgatttgaccgaagaaccttactccgacaagcatggccgctgtggaattcctgaagccctcgtgcaacgctacgcagaagacctcgaccagcccgagagagatgtcgctgcgaacatggaccagataagggtcaagcagctccgcaaacagcaccgcatggccattccaagtggcggcctcaccgagatttgtaggaagccggtttcacccgggtgcatcagctccgtgtccgactggctgatctccatcggccttccaatgtacgctgggactctctcaacggccggattctcaactctcagtcaagtgcccagcctgtcccacacttgtctccaggaagctggtattaccgaggagcgccacataagaaaacttctttcagcagcccgcttgtttaagttgccccccggcccagaggccatgtag

SEQ ID NO: 26255 - DNA, 255 bp, Artificial Sequence
  Description of Artificial Sequence: Synthetic coding sequence
atggaggagcaggactgccgggacggcagcctgggcaacatcgacgacctggcccagcagtacgcagactattataatacgtgtttttccgatgtgtgtgagcggatggaggagctgagaaaacgtagggttagccaggatctggaagtggaaaaacctgacgcctctcccacatccctgcagcttcgaagtcaaatcgaggaatctctcgggttctgttcagccgtgtcaactcccgaggtggagcgaaaatag

SEQ ID NO: 26256 - DNA, 249 bp, Artificial Sequence
  Description of Artificial Sequence: Synthetic coding sequence
caggcccaggacttcaaggacggcagcctgggcaacatcgacgacttggcccaacaatatgctgactattacaacacttgtttctccgacgtgtgcgagcggatggaagagctgcggaagcgcagagtctcacaggacctcgaggtggaaaagcccgatgcgtctcccacctccctccagcttaggtcacagatcgaggagtcactgggattttgcagcgctgtcagtacacccgaggttgaaaggtag

SEQ ID NO: 26257 - DNA, 2091 bp, Artificial Sequence
  Description of Artificial Sequence: Synthetic coding sequence
atgcccaagcccagccgggagcagagcgacgacgagaccgaggagagcgtgaaatttaagcgactccataagctggtgaactctacacgtcgcgtccggaagaagctgatccgcgtcgaggagatgaaaaagcccagtaccgagggaggggaggaacacgtgtttgagaactcccctgtgctggatgagagatcagctttgtatagcggagtgcataagaaacccctatttttcgatggctcgccggaaaagcctcccgaggacgactctgattcactgaccacctctcctagtagctcatcactagacacctggggcgcaggcaggaaactcgttaagaccttctcaaaaggggagtctcggggtcttatcaagccgcccaagaaaatgggcacgtttttctcttaccctgaggaagaaaaggcccagaaggtgagcagatctttaaccgagggcgagatgaaaaaggggctaggaagtctgtcccacggtcgcacctgctcatttggaggattcgacctgaccaacaggagcctacacgtcggcagtaacaatagtgaccctatgggaaaagagggggactttgtgtacaaggaagtcattaaatcccctactgcgtccaggatatctcttggcaagaaagttaaatcggtgaaggagaccatgcgcaaacggatgtccaaaaaatatagtagctccgtgtcagagcaggactcaggattggatggcatgcccggttcgcccccgccaagccagccggatcctgaacacttggataagcccaagctgaaggccggaggatccgtggagagcctccgctcaagcctctctggccagtcctccatgtccggccaaactgtgagcaccaccgactctagtacatccaatcgagaatctgtgaaaagcgaggacggagatgacgaagagcccccttacaggggtcctttttgcggaagggcccgtgttcatacagacttcacaccttcaccttatgatacagactccctgaaactgaaaaagggtgacatcatagatattatcagtaaaccccccatgggcacatggatgggcttgcttaacaacaaggttgggaccttcaaatttatctacgtagatgtcctatcggaggatgaagaaaagcccaaaagaccaaccaggcggaggcgaaagggccgccctccacaaccaaaaagtgtcgaggatctgctggatagaattaacctcaaagagcacatgcccacttttctatttaacggttatgaagacctggacaccttcaagctgctggaagaggaagatttagatgagctgaatataagagaccctgagcatagagctgtgctgctgacagctgtagagttactgcaggaatacgacagcaactccgatcagagcgggtcacaagagaagcttctggttgacagccaggggcttagcggatgctctccccgggattcaggatgttacgagtcatcagaaaacttagaaaacggcaagacacggaaggcatccctgctctccgctaaaagctcaaccgagccatctctcaagagcttcagccgaaatcagcttggaaactaccctaccctgccactgatgaagagcggcgatgcacttaagcagggccaagaggaagggagattaggcggcgggttggctcctgatacaagtaaatcctgtgatccccccggtgtcactggcctgaacaagaatcgccggtccttgcctgtttcaatctgcaggagctgtgagaccctagagggtccacagacagtcgatacctggcccaggtcacattcactggatgatctgcaggtggagccgggggccgaacaggatgtcccgacggaagtgaccgagccgcctccccagatcgtgcccgaagttcctcaaaaaacaacagcgtctagtaccaaggcacagcctctggaacaggactctgctgtggacaatgccctgctgctcacacaaagtaaacgcttctcagaacctcaaaaacttacaactaagaaactggagggttcaattgctgcatccggcaggggcctgtccccaccccaatgtctccctcgaaactacgatgcccaatag

SEQ ID NO: 26258 - DNA, 1974 bp, Artificial Sequence
  Description of Artificial Sequence: Synthetic coding sequence
atgggcacctggatgggcctgctgaacaacaaggtgggcaccttcaaattcatatatgtcgacgtgctgtcagaagacgaggagaaaccaaaaaggccgacccggaggcgacgcaagggtagacccccccagcctaaaagcgtcgaagacctcctcgacagaatcaatcttaaagagcacatgcccactttcctctttaacggatatgaagacctcgatactttcaagctgcttgaagaggaggatctcgacgagctgaacatccgggatcctgaacatcgcgccgtgctattgaccgccgttgagctgcttcaggagtacgattcaaactccgaccagtccggatctcaggaaaaacttctggtggacagtcagggcctcagcggctgcagccctagggactcagggtgctatgaaagctcagagaaccttgagaatgggaagacgcggaaagcctccctgctgtctgctaagtctagcaccgagcctagcttaaagtcttttagccgaaatcagctgggaaactaccccaccttacctctgatgaagtccggagatgctctgaaacaggggcaagaggaggggcgcctgggaggtggccttgcgcctgacacttccaagtcatgtgacccccctggagtcacagggctgaataaaaatcgccggagtctgccagtctctatctgtagaagctgcgaaactctggagggaccccagacagtagatacgtggccaaggagccacagcctcgacgatctacaggtggagccaggcgccgagcaggacgttcccacagaggtgaccgaaccgcccccccagatcgtgccagaagtgccacaaaaaaccaccgcaagtagcacaaaggcacagcccctcgaacaagattctgctgtggacaatgctcttctcctgacccaaagtaagagattctcagagccccagaagctgacaacaaaaaagctcgaaggctcaatagcagcgagcggcagaggactgagtccacctcagtgcttacccaggaattacgatgcccagccgcctggcgccaaacacggcttggcccggactccacttgaggggcataggaaaggtcacgaattcgaggggacgcatcaccccttaggtacgaaggagggagtggatgccgagcaaaggatgcaaccaaaaatcccatcgcagcctccgcccgttcccgcaaagaagtcccgcgagcgcctggccaatgggctgcaccctgtccccatggggcccagcggagcattgccgtctccggacgctccttgcctgcctgtgaagcgtgggtccccagcctctcctacttcccctagcgactgtcctcctgctctggccccacgtcccttgagcgggcaggccccaggaagccctcctagcacccggccccctccatggttgtcggagcttcccgagaacacctctctgcaggaacacggcgttaaacttggtccagcattgactaggaaagtgtcttgcgcaaggggagttgacctggagaccctcaccgagaataagctgcatgccgaaggcattgatttaaccgaggagccatactccgacaaacacggacggtgcggaatccccgaggctctggttcagcggtatgcagaggacctggatcagcctgagcgggatgtggctgctaatatggaccagattcgggtgaagcagttgcgcaagcagcacagaatggctatcccatccggagggttgacggagatctgccgtaaacccgtgagcccaggttgtatttctagtgttagtgactggctaatctctattgggctgccgatgtacgccggtacactgagcacagccggatttagtaccttatcccaggtccctagcttgtcacacacatgtctccaagaggcgggcatcacggaagagaggcacattaggaaactattgtcagctgctcggctctttaagctgccaccagggcctgaggccatgtag

SEQ ID NO: 26259 - DNA, 621 bp, Artificial Sequence
  Description of Artificial Sequence: Synthetic coding sequence
atgctgccccccgccatccacttctacctgctgcccctggcctgcattctgatgaaatcgtgtctcgcattcaaaaacgatgcgacagaaattctgtactcccatgttgtgaagcccgttcccgctcacccttctagcaactcaaccctaaatcaggcaagaaatggcggacgtcattttagcaatacgggtctggaccggaacacacgcgtacaagtagggtgcagggagctgagaagtacaaagtatatctcagacggacagtgcacttccattagtcccctgaaggaactggtgtgcgccggggagtgccttccactacctgtcctgccaaactggatcggaggcggctatggaaccaagtactggtctaggaggtcctcgcaggaatggcgatgtgtaaatgacaagacccggactcagaggattcagttgcagtgtcaggacggctccactaggacgtacaagataaccgtggtcaccgcatgcaagtgtaaacgctacactcggcaacacaacgaatcttcacataatttcgagtctatgagtcccgccaaacctgtgcagcaccacagggaaaggaagcgcgcgagtaaaagtagtaaacactccatgtcctag

SEQ ID NO: 26260 - DNA, 693 bp, Artificial Sequence
  Description of Artificial Sequence: Synthetic coding sequence
atgctgccccccgccatccacttctacctgctgcccctggcctgcattctaatgaagagctgtctggcgtttaaaaatgatgcaacggagatcctctatagccacgtcgttaagcccgttcctgcccatccatcttctaacagcaccctcaaccaggcccggaatggagggaggcactttagcaataccggcctggaccgcaatcggaccgaaagcctgactaggcaaaattatttttggttgttcccaggcgctttcctcagacagctgcaggaggccagagtacaagtaggatgtcgagagttgcgcagcaccaagtatatctcggatggacagtgtaccagcatcagtcctttgaaggagctcgtgtgtgccggggagtgcctgcctctgcctgttttgcccaactggatcggtggtggttatgggacaaagtactggagcagacggagtagccaggaatggcgttgtgtcaatgacaaaactagaacgcaaaggatacagctacaatgtcaggacggcagtaccaggacatacaaaatcaccgttgtgacagcttgtaagtgcaaaaggtatacacggcagcataacgagagtagtcataactttgagtctatgtccccagctaagcctgtccagcaccatcgcgagcgtaaaagggcatctaagagtagcaaacattcgatgagctag

SEQ ID NO: 26261 - DNA, 2229 bp, Artificial Sequence
  Description of Artificial Sequence: Synthetic coding sequence
atgggcagcgagaacagcgccctgaagagctacaccctgcgggagccgcctttcaccctacccagcggtctggccgtctatcccgctgttctgcaggacggcaagttcgcctctgttttcgtgtacaagcgcgaaaatgaggataaggtcaataaagcggccaagcatctgaaaacgttgcgacacccctgcctcctgagattcctgagctgcaccgtcgaggcggatggcatccatctggtaacggaaagggttcaacccctggaggtggcactagagactctctcaagtgctgaggtgtgtgcagggatctacgacattctcttagccctgatctttctgcacgatcgaggccatctgacgcacaataacgtatgcctcagctctgtcttcgtcagtgaagatggccactggaagctgggcggaatggagaccgtgtgtaaggtgtctcaggcaacgcccgagttccttcgctctatccagtctattcgggatccggcctctatcccccctgaagagatgagcccagagttcacgacgctgcctgagtgtcatgggcacgcgcgcgacgccttctccttcgggacgctcgtcgaaagcctcctgacaatccttaacgaacaagtttctgcggacgtgctttctagtttccaacagactttgcattctaccctcctgaatcccatcccgaaatgccgacctgccctttgcacccttctgtcccatgacttcttccgcaacgatttcctggaggtggtgaacttcctgaagtcattgacactgaaaagtgaggaggaaaaaaccgagttttttaagttcctgctggatcgggtatcttgtctttctgaagaactgattgcgtcccggctggttcccctcttgttgaaccaattagtctttgccgagcctgtggccgtgaagagttttttgccttacctgctcggccctaagaaggaccacgctcaaggcgagacaccctgtctgctgagccccgccctatttcagtcaagagtgattccagtcttacttcagctgttcgaagtccacgaagaacatgttcgcatggtcctcctctctcacatcgaagcctatgtcgaacatttcacccaggagcaactcaagaaggttatcttgccccaggttcttctgggactgagggacaccagcgactccatcgtggcaatcaccctgcatagcctagctgttctggtttcattgttaggaccagaggtggttgtggggggggagcggaccaagatcttcaagcggaccgcaccctcctttactaagaatactgatttgtcattggaggactccccaatgtgtgtcgtgtgcagtcaccattcccagatcagtccgatactcgagaacccattttctagcatctttcccaagtgcttctttagcggttctacacccatcaacagcaaaaaacacatccagagggactactataatactttactgcagacgggagaccctttctcccagcccatcaagtttcctatcaatggactctccgatgttaaaaacacctcagaagacagcgaaaactttccatcctcctctaaaaaaagcgaggaatggcctgactggtccgagccggaagaacctgaaaaccagactgtgaatattcagatttggccgagagaaccatgcgatgacgtgaaatcccagtgtacaacattggatgtagaggaaagctcctgggacgactgtgaaccttccagtttggacacgaaggtcaaccctggcggcgggatcactgccacaaagcctgtcaccagtggagaacagaagccgatacctgcactcctaagcttaacggaagaatcaatgccctggaaatcgtccctgccgcagaaaatttcgctggttcagcgtggcgatgatgcagatcaaattgagccgcccaaagtaagctcgcaggagcgccctctgaaggtgccaagtgagcttggactgggtgaagagttcaccattcaggttaagaagaagcctgtcaaggaccccgagatggactggtttgccgacatgatccccgaaatcaagccaagcgctgccttcctgattcttcctgaattgaggaccgaaatggttccaaagaaggatgacgtttccccggtgatgcaattcagttccaaatttgctgctgccgaaatcactgagggtgaggccgaaggatgggaggaagagggcgaactgaattgggaagataataattggtag

SEQ ID NO: 26262 - DNA, 2067 bp, Artificial Sequence
  Description of Artificial Sequence: Synthetic coding sequence
atgggcagcgagaacagcgccctgaagagctacaccctgcgggagcccccatttacgctccccagcgggctagctgtgtaccctgcagtgctgcaggatggaaaatttgccagtgtctttgtttataagcgggagaacgaagacaaggtcaacaaagcagcaaaacatttaaaaaccctgagacacccatgcctgttacgctttttgagctgtacagtggaagcagacgggattcacctggttacggaaagggtccaacccctcgaggtggcacttgagacactttcttctgcagaagtttgcgccggaatttacgatatccttctagctctgatttttctgcatgaccgcgggcacctgacacataacaatgtgtgtttgtccagcgtgtttgtgagtgaagacgggcactggaagctgggagggatggaaactgtctgcaaggttagtcaggctacgcccgagtttttgagatctatccagagcatcagagacccagcgagtataccaccggaggaaatgagcccggagttcactacactacccgaatgtcatggacatgctagggacgcattctcctttggaaccctcgtcgaaagcttgttaactattctgaatgagcaggtatctgccgacgttctgtcctccttccagcaaactttgcactccactcttctgaatcctattcctaaatgtcgccctgccttgtgcactttattgagccacgattttttccggaatgacttcttagaagtggtgaacttcctcaagtctctgacactcaagtccgaagaggagaagacagaattctttaagtttcttctcgaccgtgtaagttgcttgagcgaggagctgatcgcttcaagattggtacctctgctgctgaaccagctggtgttcgcggagcccgttgcggtcaaatctttcctgccgtacttgctcggccccaaaaaagatcatgcccaaggagagactccttgtctgttgagccccgccctcttccagtcacgggtgattcccgttcttctgcagctgtttgaggttcacgaagagcacgtacgcatggtgttgctgagtcacatcgaagcctatgtggagcacttcactcaagaacagctcaaaaaagtcatcctgcctcaggtgcttcttgggctgcgcgatacaagtgactctattgtggcaattacactccacagcctagctgtgttagtgtccctgctgggccctgaagtggtcgtgggaggcgaaagaaccaagatctttaagaggactgccccctccttcacaaagaacaccgacctgagcctggaaggcgacccctttagccaacctatcaagtttcccatcaacggtctgtctgatgtcaagaatacaagtgaggacagcgaaaacttcccatcgtcatccaagaagtctgaggagtggccagattggagcgagcctgaggaacccgagaaccagacagttaacatccagatatggccgagggaaccctgcgatgatgtgaaatcacagtgtaccacactggacgtggaagagagtagttgggacgactgcgagccttcatcccttgatacaaaggtaaacccaggaggagggatcactgccactaagcccgtcacctctggggagcaaaaacccatcccggctctcctgagtctaacggaggagagtatgccttggaaatcaagtctccctcaaaagattagcctggtgcagcggggcgacgacgcagaccagatcgagccccccaaagtttctagtcaggaacgcccactcaaagtgcctagcgagctcggccttggagaggagtttacaatacaggttaagaagaagcctgtcaaggatccggagatggattggttcgccgacatgatccctgaaatcaaaccaagtgccgcgttcctcatcttgcccgaactcaggacggaaatggtgcccaagaaggatgacgtgagtcccgtgatgcagttctcctcaaaatttgccgccgcagaaatcaccgagggggaggcagagggctgggaggaagaaggggaattgaactgggaagacaacaattggtag

SEQ ID NO: 26263 - DNA, 2229 bp, Artificial Sequence
  Description of Artificial Sequence: Synthetic coding sequence
atgggcagcgagaacagcgccctgaagagctacaccctgcgggagcctcctttcaccctccccagtgggttggccgtgtatcctgcggttttgcaggacggcaaatttgcctctgtctttgtgtataagagggagaatgaagataaggtgaataaggcagccaagcatcttaaaacgctgaggcatccctgtttattgcgtttcctttcctgcactgtcgaagcagatggtattcatctggtgactgaacgggtgcaacccctggaggtagctctggagaccctaagtagcgctgaagtgtgcgctgggatctatgatattctgctggccttgatctttttgcacgacagaggtcacctcacacacaacaatgtgtgcctctctagtgtcttcgtgtctgaggacggtcactggaaactcggaggcatggaaacagtgtgtaaagtgtcacaggctactcccgaattcctgaggagtattcagtcaattcgcgatcccgcttcgattccacctgaggaaatgtcccctgagttcacgaccctgcccgaatgtcacggacacgccagggatgcatttagttttggcacattggttgaatccttgttgactatcctgaacgaacaggtgtccgcagacgtgcttagcagtttccaacaaactctacattctacactccttaacccaattccaaaatgccggccggcgctctgtaccttactgtcgcacgatttttttcgcaacgatttcttagaagttgtcaacttcctgaaatccctgacgttgaagtccgaagaagagaaaaccgagttcttcaaatttctgctggatcgagttagctgccttagtgaagagctcatcgcttctcggctggtgcccctcctgctcaatcagcttgtgttcgccgaaccagtagcagtgaaatcttttctgccgtatctactcggccctaaaaaggaccacgcgcagggggagacgccctgtctgttgagcccagccctatttcagtcacgtgtgatccctgtactcctgcagctgttcgaggttcacgaagaacatgtacggatggtattgctttcacacattgaggcttatgtcgaacattttactcaggaacaactcaaaaaggtcatcctgccccaagtcctgctcggcctccgcgacacatcagacagcatcgttgccatcaccttgcactctttagccgttttggttagcttgcttggacctgaggtagtggtgggcggcgaacgcacaaaaattttcaagcggaccgcacctagcttcaccaaaaacaccgatttatcccttgaagattcgcctatgtgtgtggtctgtagccaccattcccaaatttctccgatcttggaaaacccgtttagcagtatattccccaaatgtttttttagtggaagtacacccatcaactccaagaagcatatccaaagagactattataacaccctgctgcagacaggagacccgttcagtcaaccaataaagttccctatcaacggtctttccgatgtgaaaaatactagcgaagattccgagaacttccccagctcctcgaagaagagcgaggaatggccagactggtcggaaccagaggaacctgaaaaccagaccgtgaatatccagatttggcccagggaaccttgcgatgatgttaaatcccagtgtaccactctagacgtagaggagtcctcctgggatgactgcgagccctccagcttagacacgaaagttaatcccggaggcggaatcacggcgacgaaaccggtcacttctggagaacaaaaacctattcccgctctcctcagtctcaccgaagagagtatgccttggaagagctcgctgcctcagaagataagtctggtgcagagaggggatgacgctgatcagatcgaaccgcctaaggtgtcatcacaggagaggcccttgaaggtccctagcgaacttgggctgggtgaggaattcaccatacaagtgaagaagaagccggtcaaagacccagaaatggactggttcgccgatatgatccccgaaatcaagccaagtgcggcttttcttatcctgccagagctaaggactgagatggtacctaagaaagatgacgtaagcccggtgatgcaattttccagcaagttcgcagctgccgagattaccgaaggagaggccgaaggatgggaggaggaaggcgagctcaattgggaggataacaactggtag

SEQ ID NO: 26264 - DNA, 1767 bp, Artificial Sequence
  Description of Artificial Sequence: Synthetic coding sequence
atgggcagcgagaacagcgccctgaagagctacaccctgcgggagccgccattcaccctgcctagcggtctcgctgtgtatcctgccgtcttacaagacggaaagtttgcctcagtatttgtttataaaagggagaatgaggacaaagttaacaaagcagcaaagcacctaaaaacactgcgccacccgtgcctcctgcggtttctctcctgcacggtcgaggccgatggcatacatctggtaaccgagcgcgtgcagcctcttgaagtggctttggagactttatcatctgcggaagtgtgcgctgggatctacgatatacttctggctctcatatttcttcacgatagaggccatttaacgcacaataacgtttgcctgtccagtgtgtttgtctcggaggacgggcattggaaattgggcggtatggagaccgtgtgcaaggtgagccaggccacccccgaattcctgcggagtattcagagcatccgagatccggccagtatccctcctgaggaaatgtcacctgaattcactacactgcctgagtgccacggccacgcaagagacgcgttctctttcggaacgctggtggagtccctgctgactatcctaaacgagcaagtctccgctgacgtgttgagctcttttcagcagaccttgcattcaactctgctaaatccgattccaaaatgtaggcctgccctctgcacactgctgtctcacgattttttccgtaacgatttcctagaagttgtgaattttctgaagagtctaactctgaagtcagaggaggaaaaaaccgagtttttcaagttcctgctagatagagtgagttgtctatctgaagagcttatcgcctcaagactggtgcctctcctattgaaccaactggtctttgccgagcccgtggctgttaagtcttttctgccgtacctcttggggcctaagaaagatcacgcccaaggtgagacaccctgtctgctgtctccagccctgtttcagtctcgggtaattcccgtgctcctgcagttgtttgaagtgcatgaagagcatgttcggatggttctgctgtcacacatcgaggcctatgtggaacacttcacacaagaacagttaaagaaggttatcctgccacaagttctgctgggcttgcgggatacctcggactcgattgttgccataaccctacacagtcttgcagtcctagtttccctcctgggtcccgaggtcgttgtgggtggcgaaagaacaaaaatctttaaacggaccgccccatccttcactaagaatacagatctgtcattggaaggcgacccattctctcaacctattaaattccccattaacggcctgagcgacgtaaagaacacttccgaggactcggaaaatttccctagttcctccaagaagagcgaagagtggccagactggtcagaaccagaagaaccagagaatcagaccgttaacatacagatctggccaagagagccatgcgatgacgtgaagtctcagtgcaccacgctcgatgtcgaggagtcctcttgggacgactgcgaacctagcagcttagacaccaaggtgaaccccggtggtggcattactgccacaaagccagtgacctccggcgaacaaaagcccatccccgcgctcttgtcacttaccgaagagtcaatgccctggaaaagctcccttccacagaagatctccctggtgcagcgcggagacgatgcagatcagatcgagccacctaaagtgtctagctag

SEQ ID NO: 26265 - DNA, 1008 bp, Artificial Sequence
  Description of Artificial Sequence: Synthetic coding sequence
atgaagctgcccgcccgggtgttcttcaccctgggcagccggctgccgtgcgggctggcacctagaaggtttttttcttacgggacgaaaatcctgtaccaaaacaccgaagccctgcaatctaagttcttctcccctctccagaaggccatgctgccaccgaactcttttcagggcaaagtggcattcatcactggaggcgggactggccttggcaagggcatgaccactctgctctcttctctgggggctcagtgtgtgatcgcctcacgcaaaatggatgttctaaaggccaccgctgaacaaatttcatcccaaacaggaaacaaggtgcatgctatccagtgcgatgtgcgcgaccccgatatggtgcagaacaccgtgagcgagctgatcaaagtggctggacatccaaacattgtcatcaacaacgctgccggtaatttcatcagtcctaccgagcgtctgtctcctaatgcttggaaaaccattacggatattgtgttgaatggcaccgcctttgtaactcttgagattggcaagcagctcattaaggctcagaaaggtgctgctttcctgtcgatcacgactatctacgccgagaccgggagtggctttgttgtgccttctgcatccgctaaggcaggggtcgaggccatgtccaagagtctggccgccgagtggggcaaatacggcatgcgattcaatgtcattcagccgggaccgattaaaaccaagggggcgttctcccgcttggatcctacgggaacattcgaaaaggagatgattggcaggattccctgtgggcgcctcgggacagtggaagagttagctaacctggctgccttcctctgctccgactatgcatcttggataaacggagcggtgatcaaattcgatggaggggaggaagttctgatctctggggaatttaatgacttgagaaaagtgactaaagaacaatgggacacgattgaggaattgatccgtaagaccaaaggcagttag

SEQ ID NO: 26266 - DNA, 945 bp, Artificial Sequence
  Description of Artificial Sequence: Synthetic coding sequence
atgggcatcggccggagcgagggcggccggcggggcgccgccctgggggtgcttctcgccctaggggccgctctcctcgctgttggctccgccagtgaatatgattacgtttcttttcaatcagatattggcccttaccagagtggtagattttataccaaaccaccacagtgtgttgacatccccgcagacctgaggttatgccacaatgtcgggtataaaaagatggttcttcccaacttactagagcacgagacaatggcagaggtaaagcaacaggcctctagctgggtacctctgttaaacaagaactgccacgccggaacccaggtgttcctgtgctccctgtttgcaccagtctgtctggacagaccaatttatccctgcagatggttatgcgaagctgtgcgcgactcctgtgagcccgtgatgcaatttttcggattctactggcctgagatgttgaaatgcgacaaatttcccgaaggcgatgtatgtatagcaatgacccctcctaatgcaacggaagcatcaaagcctcaggggaccacagtttgccctccctgtgataacgagttgaagagcgaagccatcatcgagcacctctgtgctagcgagttcgcacttagaatgaagatcaaagaagtaaagaaagaaaatggtgataagaaaattgtgcccaaaaaaaagaaacctctgaaactgggtcccatcaagaaaaaagatttgaaaaagcttgttctgtacttgaaaaacggcgctgactgcccatgccatcaactcgataacttatctcaccattttctcatcatgggtcgcaaggtgaagtctcagtacctgctgacggccatccacaagtgggacaagaagaacaaggagttcaagaatttcatgaagaagatgaagaatcacgaatgccccacttttcagagcgtgttcaagtag

SEQ ID NO: 26267 - DNA, 1041 bp, Artificial Sequence
  Description of Artificial Sequence: Synthetic coding sequence
atgttcctgagcatcctggtggccctgtgcctgtggctgcacctggccctcggagtgcgaggtgcgccctgtgaggcagtcagaataccaatgtgcaggcacatgccctggaatatcacccggatgcctaaccacttacaccacagtactcaggaaaacgccatcctggcaatcgagcaatatgaggaacttgtagacgtgaactgtagtgcagtcttgcgattttttttatgcgccatgtatgcaccaatatgtactctggaatttttgcacgatccaattaagccatgcaagagtgtgtgccaaagagccagggatgattgtgaaccactgatgaaaatgtataaccacagctggcccgaaagcttggcgtgcgacgagctgcccgtgtatgaccgcggcgtgtgtatttcaccggaggccatagtgactgacctgccagaagatgtgaagtggattgacataacccctgacatgatggtgcaggagagacccctggatgttgactgcaaacggctctcacccgaccggtgcaaatgtaagaaagttaagccaacattagcaacctacctatccaagaactatagttatgtcatccacgctaaaatcaaggccgtgcagcgaagcgggtgcaacgaagtgaccaccgtagtagacgtcaaggaaatcttcaagtccagcagcccaatcccccgcacacaggtgccgctgattaccaactcttcctgtcagtgcccacacatcctgcctcatcaggacgtgctgatcatgtgttacgagtggcgctcccgcatgatgctgctcgagaattgcctggtggagaagtggagagaccagctgtccaagcgctccatccagtgggaggagcgtttgcaggagcagcgtagaacagtacaggacaaaaagaaaaccgctggccggacttctagaagcaatccaccaaaacctaagggaaagcctcccgcacccaaaccagcgagcccaaagaagaacataaaaacgcggtccgctcaaaagcgcacaaaccccaagcgggtgtag

SEQ ID NO: 26268 - DNA, 1032 bp, Artificial Sequence
  Description of Artificial Sequence: Synthetic coding sequence
atgcgggtggccggccgggagggccggttcctgagcgccggcgtggcagccagggagggaagtgcaatgtttctctcaattctggtggccctgtgcctgtggcttcacttggccctgggcgttcggggggccccctgtgaggctgtgcggatcccgatgtgcagacatatgccatggaatatcacgcggatgcccaaccatctccatcactccacccaggaaaatgcaatgtacgccccaatctgtacactggagttcctgcatgaccccataaagccttgtaaaagtgtctgtcaaagagcacgggatgactgcgagcccttaatgaagatgtataaccatagttggcctgagagccttgcctgtgacgaactgccagtctatgaccgcggtgtttgcatctcaccggaggccatcgtgacagacctccctgaggatgtgaagtggatagatattacgccagacatgatggtgcaggagagaccattagatgtggactgcaagcgactctctccggatcggtgtaaatgtaagaaggtgaaacccaccctggctacatatctctcgaagaattattcatacgtgatccatgctaagatcaaggccgtgcagcggtccggctgcaacgaggtcactactgttgtcgacgtgaaagagatctttaaatctagttcacccatacctcggactcaggtcccccttatcaccaatagttcctgccagtgtccgcacattctcccccaccaagatgtcttgatcatgtgctacgaatggcgctcacgcatgatgctgttagagaactgcctagtcgaaaagtggagggatcagttaagtaagcggtctatacaatgggaggagaggctgcaggagcagcgccgaaccgtacaggataagaagaagaccgctgggaggacttcccggtcgaacccacccaaacccaaaggaaaaccccccgcccccaaacccgccagtcctaagaagaacattaaaactaggagcgcccaaaagcgtaccaaccctaaacgtgtgtag

SEQ ID NO: 26269 - DNA, 954 bp, Artificial Sequence
  Description of Artificial Sequence: Synthetic coding sequence
atgcgggccgccgccgccggcggcggcgtgcggaccgccgccctggcattactccttggtgccctccactgggctcccgcaagatgcgaagagtacgactactatgggtggcaggcggagccgctgcatggaagatcctattcgaagccgccccagtgtctagacatcccagcggatctgcccctgtgccacaccgttggctataaacgaatgagactgccaaatctactagagcacgagagtctggccgaagtaaagcaacaggcctcttcttggcttccactgctagccaagaggtgccacagcgacacacaggtattcttgtgctccctctttgctcctgtatgtttggacaggcctatctatccctgcaggtctctctgtgaagcggtgagggccggatgcgctcctttaatggaagcttacggctttccatggccagagatgttgcactgtcacaaattcccacttgataacgacctctgcattgccgtccagttcggacacctaccagctactgctcccccagtcacgaaaatctgtgcccaatgtgaaatggagcacagcgccgacgggttgatggagcagatgtgctcctccgacttcgttgttaagatgagaattaaggagatcaagattgaaaacggagaccgtaaactgattggggcccagaagaaaaagaagttgctgaagccggggcctctaaaacggaaagacacaaagcggctggtgctgcacatgaagaacggagcaggatgtccatgtccccagcttgactcccttgcggggagtttcctggtgatgggccgtaaagtggacggtcagcttctcttgatggctgtctatcgatgggataagaagaacaaagaaatgaagttcgccgtgaaattcatgttctcttatccctgttccctgtactaccctttcttttacggcgcggctgagcctcactag

SEQ ID NO: 26270 - DNA, 903 bp, Artificial Sequence
  Description of Artificial Sequence: Synthetic coding sequence
atgcggatcgccgtgatctgcttctgcctgctgggcatcacctgcgcgatccccgtgaaacaggcggactcaggttccagtgaggaaaagcagctgtacaataaatatccagatgcagtcgctacatggctgaatccagaccctagccaaaagcaaaatctgcttgcaccccaaactctgccctctaagtccaatgagagccatgaccacatggatgatatggacgacgaagatgatgacgatcatgtcgattcccaggacagcattgactctaatgattccgacgacgtggatgataccgatgactcacaccagtcggatgaatctcatcactctgatgaaagtgatgaattagtcacagatttccccacagaccttcctgcaacagaggtcttcaccccagtagtgcccactgttgatacgtacgatgggaggggtgattcggtggtgtatggcctgaggagcaaatccaaaaagttccgccggcctgacattcagtaccccgacgctactgatgaggatattacttcgcacatggaatctgaggaactgaatggagcgtacaaggctataccagtggcccaggatctcaatgcccctagcgactgggatagcagaggcaaagatagttacgagacgtctcagcttgatgatcagtcagcagagactcactcccacaagcagtcccgcctgtataagcggaaggcaaatgacgagtccaacgagcacagcgacgttattgactcacaggagctgtctaaggtctccagggaatttcactcccacgaattccactcacacgaggacatgttagtggtcgacccaaagtcgaaggaggaagacaagcatctgaagtttcgaatcagtcatgagttggattcagcaagctctgaggtgaactag

SEQ ID NO: 26271 - DNA, 879 bp, Artificial Sequence
  Description of Artificial Sequence: Synthetic coding sequence
atgcggatcgccgtgatctgcttctgcctgctgggcatcacctgcgccatccccgttaaacaggccgattccggcagtagtgaagaaaaacagctgtacaataagtatcccgacgcagtggcaacatggctaaatcccgatccctcacaaaaacagaacctccttgcaccccagaatgcggtttcatcagaagagaccaatgattttaagcaggagaccttaccaagcaaatctaacgaatcacatgaccacatggacgacatggacgatgaggacgatgacgatcatcagtccgacgagtcccatcactcagatgagtccgacgagctggtgaccgatttcccaacagatctcccagccacagaggttttcaccccggtggtccccactgttgatacatacgatggccgaggagactctgtggtctatggccttagatctaagagcaagaagttccgacggcccgacatccagtaccccgatgcaaccgacgaggatatcacctcccacatggagtcagaggaactcaatggcgcatacaaggcgattccagtggctcaggatttgaacgcgccaagtgattgggacagtcgagggaaagacagctacgaaacatcccaacttgatgatcagagcgcggaaacgcatagccataaacaatccagactgtataaaaggaaggccaacgatgagagcaacgaacacagtgacgtgatcgattcccaggagctgtctaaagtgagccgggagtttcactcccacgaatttcattcccacgaggacatgttagttgtcgacccaaagtctaaagaggaggataaacatctgaaattcagaatctcgcatgaattggattcagcttcatccgaggtcaactag

SEQ ID NO: 26272 - DNA, 864 bp, Artificial Sequence
  Description of Artificial Sequence: Synthetic coding sequence
atgcggatcgccgtgatctgcttctgcctgctgggcatcacctgcgcaataccagtcaaacaggcagactctggcagcagcgaagaaaagcagaatgcggtgtcatccgaagaaacaaacgatttcaaacaggaaacacttccttctaaatcgaacgagagccacgaccacatggacgacatggatgatgaggatgacgacgatcacgtggatagccaggatagcattgactcaaatgatagcgatgatgtcgatgatactgatgactcgcaccagtcagacgagagccaccactctgacgaaagtgacgagttggttactgatttcccgactgatttaccagcaactgaagtcttcacccctgttgtgcccaccgtggatacctatgacgggcgcggtgactctgtcgtgtacggcctaagatccaaatccaaaaagttcagaagaccggacattcagtacccggacgccacagatgaggatataacgtctcacatggagagcgaagaactgaacggcgcctacaaagccattcccgtggctcaggatctaaacgctcctagcgattgggactctaggggcaaggactcttacgagacgtcacaattggacgatcagtccgccgagactcattcacacaagcagagcaggctgtataagagaaaagccaatgatgagagcaatgagcattcagacgttatcgatagccaagaactctctaaagtaagtcgcgagtttcattcccatgaattccactcacatgaggatatgctggtcgtggatcctaaaagcaaggaggaagacaagcatttgaagttccggatcagccacgaactggacagcgcgagtagcgaagtcaactag

SEQ ID NO: 26273 - DNA, 945 bp, Artificial Sequence
  Description of Artificial Sequence: Synthetic coding sequence
atgcggatcgccgtgatctgcttctgcctgctgggcatcacctgcgccatcccagtcaagcaggccgactccgggagttcagaagagaaacagctgtataataagtaccccgacgctgtggcaacatggctgaatcccgacccttcacaaaaacagaatctgttagcaccccaaaatgctgtatctagcgaagagacaaacgacttcaaacaggagactctgccaagcaagagcaacgagtcacatgaccatatggatgatatggacgacgaggacgacgacgatcacgtggacagccaagactctattgactccaacgatagtgacgatgttgatgataccgatgacagtcaccagagcgatgaatcccatcattctgacgagtccgacgaacttgtgaccgactttcccaccgatcttccggcaaccgaggtctttacaccggtcgtacctacagtggacacctacgacgggagaggagattctgtggtgtacgggctgcgatctaaatctaagaagtttcgccgaccagacattcagtaccctgacgccacagatgaggacatcacctcccacatggagtccgaagaacttaatggtgcctataaagccatacccgtagcccaggaccttaatgcaccaagtgactgggacagccggggcaaggacagttacgaaacgagtcagcttgacgaccagagtgcggaaacccatagtcacaagcagtctcgattgtataagcggaaagcgaatgacgaatctaacgagcacagtgacgtgattgatagccaggagctttccaaggtcagccgggagttccacagccacgaatttcattcccatgaagatatgttggtggttgacccaaagtcaaaggaagaagataagcacctcaagttcagaatctctcatgagcttgatagtgccagcagtgaggttaactag

SEQ ID NO: 26274 - DNA, 822 bp, Artificial Sequence
  Description of Artificial Sequence: Synthetic coding sequence
atgcggatcgccgtgatctgcttctgcctgctgggcatcacctgcgccatacccgtgaaacaggctgactccggcagctctgaagaaaaacagaccttgccttcaaagtctaatgagtcccatgaccacatggacgatatggacgatgaagatgacgatgatcacgtcgattcccaagactcgatcgatagtaatgacagcgacgatgtggatgatactgacgacagccatcagagcgacgaatcacatcactcagacgagtcagatgagctggttacagactttccaaccgacctgcctgccaccgaagtgttcacacctgtagtccctaccgtcgatacctatgatggccggggagactctgtggtctatggcctgaggtcgaagagtaagaagttccggcgacctgacatacaatacccagatgcaaccgacgaggacataacgtcgcacatggagagtgaggaactgaacggagcctataaagcaattccagttgctcaggacctaaacgccccatccgactgggacagcagaggcaaagatagctatgaaacctcccagttagatgatcagagcgccgaaactcattcacacaagcagtctcgcctgtataaacggaaagctaatgacgaatcaaatgagcacagcgacgtgatcgattcccaggaattgagcaaggtctccagggaattccacagtcatgagtttcattcccacgaagatatgctggtggttgatcccaagtccaaagaagaagacaagcatttgaagtttcgtatttcccacgagctggatagcgcaagcagtgaagtcaattag

SEQ ID NO: 26275 - DNA, 2370 bp, Artificial Sequence
  Description of Artificial Sequence: Synthetic coding sequence
atgcggacctaccactacatccccctgttcatctggacctacatgttccacacagttgacacgattttactccaagagaaacccaacagctacctgagctctaaaaagattgcaggtctgaccaaggacgacgggaagatgcttcgtagaacaaagcggggttggatgtggaatcaatttttcctgttggaggagtacaccgggacggacacccagtacgtagggaagctccatacagaccaggacaagggggacgggaatctgaaatacattttaacgggagatggagcaggcagcctgttcgtaattgatgaaaatactggcgatatccacgctgctaaaaaactggacagggaggaaaagtccctctacatactacgcgccaaagcaatcgataggaaaaccgggcgacaagttgaacccgaaagtgagtttataatcaaaattcacgacataaacgataacgagccgaaattcaccaaggacctgtatacagcttccgtcccagaaatgtccggcgtaggaacgtccgtgatccaagtaaccgcaacagatgccgatgatgcgaattacggaaattctgccaaggtcgtttattctattctgcagggacagccttacttctccgtggaccctgaatctggcatcattaaaaccgccttgccagatatgagccgcgagaaccgggagcagtaccaggtcgtcatccaggctaaagatatgggaggacaaatgggcggactttctggcacaaccaccgtcaatattacacttacagatgtaaacaataaccctccccgatttcctcagtcgacgtatcaattcaactcacccgaaagcgttccactgggtacacatctgggaagaataaaggcaaacgatcctgacgtgggcgaaaacgccgagatggagtactctattgcggagggtgatggcgccgacatgtttgacgttatcaccgacaaggatactcaagagggaattataacggtgaagcagaacttggactttgaaaatcagatgctctacacactgcgtgtagacgcttccaatactcaccccgaccctcggttcctccacctggggcccttcaaagacactgctgtcgtgaaaatcagtgtagaagatattgacgagcctccagttttcacaaaagtgagttaccttatagaggttgacgaggacgtgaaagaaggttccatcatcggccaggttacagcatatgacccagatgctcggaataacctcattaaatattctgtagaccggcacacggacatggatcgtatctttggcattcattccgagaacgggagcatttttaccctgaaggcattagatagggaaagttctccttggcataatatcaccgtgactgcaacagaaatcaataaccctaagcagagctctcatatcccggttttcatccgcattctggacatcaacgaccatgcccccgaatttgccatgtattatgaaacatttgtttgcgaaaacgcaaagcccggtcaattgatccagacagtgagtgtgatggacaaggacgaccctcctaggggtcacaaattctttttcgagcccgtccccgagttcacgctgaatccaaactttacaattgtggataacaaagacaacacggctggaattatgactagaaaggacggctattctaggaacaaaatgtccacctacctgttacccattctgatcttcgataatgattatccgatccagtcaagcacgggtacactaaccatccgcgtgtgcgcttgcgacaatcagggaaacatgcagtcatgcaccgctgaggcccttatcctgagtgctggactcagcaccggcgcccttgttgcaatcctgctgtgcgtactgatcctactcattctcgtagtgctctttgctgcactgaagcgccagcgcaagaaagagccgcttatcatctctaaggatgatgtgagagacaacatcgtcacttataacgacgaggggggaggcgaggaggatacacaagccttcgatattgggacacttaggaacccagaagcaagggaggactccaagctgcgccgggacgtcatgccagagaccatcttccagatacgccggaccgtgccactttgggagaacatagatgtacaggatttcattcacaggcggttgaaggaaaatgacgcggaccctagcgcccccccgtatgactcactcgccacttatgcttacgaagggaacgacagcattgcggattcgctttccagcctcgagagtttgacagcggattgcaatcaagactatgattatctctccgattggggcccccgatttaagaagctcgccgacatgtacggcggagacgatagcgatcgagactag

SEQ ID NO: 26276 - DNA, 162 bp, Artificial Sequence
  Description of Artificial Sequence: Synthetic coding sequence
atgcgggcctggatcttcttcctgctgtgcctggccggccgggccctcgctgctccccagcaagaggctctcccagacgaaacagaggtcgtggaggagacagtggcagaagtcacagaggtgtccgtgggcgcgaatccagtgcaagtcgaggtgggatag

SEQ ID NO: 26277 - DNA, 336 bp, Artificial Sequence
  Description of Artificial Sequence: Synthetic coding sequence
atgcgggcctggatcttcttcctgctgtgcctggccggccgggccctggcagcaccccagcaggaggccctcccggatgaaactgaagtcgtggaggagacggtggcagaggtgactgaggtcagcgttggtgccaacccggtgcaagtagaagttggggaattcgacgacggcgctgaggagaccgaagaagaggtggttgccgaaaatccgtgccagaatcaccactgtaaacacggcaaggtctgtgagctcgatgaaaacaacacccccatgtgcgtgtgccaggatcctacaagttgtccagctcccatcggcgaatttgagaaagtgtag

SEQ ID NO: 26278 - DNA, 276 bp, Artificial Sequence
  Description of Artificial Sequence: Synthetic coding sequence
atgaagctggccgtgaccctgaccctggtgaccctggccctgtgctgtagcagcgcaagcgcagagatatgcccttcctttcagagggtgatcgaaactctgcttatggatactccatcctcatacgaggctgccatggagctgttctctcctgatcaggacatgagggaggccggcgcacaattgaaaaagctggtcgatactcttccccagaagcccagagagagcataatcaaactgatggaaaaaatcgctcaatctagtctttgcaactag

SEQ ID NO: 26279 - DNA, 1380 bp, Artificial Sequence
  Description of Artificial Sequence: Synthetic coding sequence
atgatcaagcggttcctggaggacaccaccgacgacggcgagctgtccaaatttgttaaggattttagcggcaatgcgtcctgtcaccccccagaagccaagacttgggcctcccgaccacaagtacctgaaccccgtccccaggcgccagacctgtatgatgacgatttggaattccggcccccatctcggccacaaagctctgacaatcagcagtatttttgcgccccagccccactctcacccagcgcgagacccagatctccgtgggggaagctagacccatatgacagctcggaggacgataaggaatacgtagggtttgcgacattgccaaatcaggtacaccgcaaatccgtaaagaagggttttgacttcacattgatggtcgccggcgagagcggtctggggaaatcgaccctggtcaattccctttttctgacggacctatacagagacagaaagttgctcggggccgaggaacggattatgcagacagttgagatcacaaagcacgccgtggacatcgaggaaaaaggcgtgcgtctgcggctgaccatcgtggatacccctggctttggtgacgccgtgaacaacaccgagtgctggaaaccagtcgctgaatacatagaccagcagttcgagcaatattttagagacgaaagcggactgaatcgaaaaaacattcaggacaaccgggtacactgctgcctgtatttcattagcccgtttggacacggcttgaggccactggacgttgagtttatgaaagcgctacaccaacgcgtaaacatcgtcccaatcttggcaaaggccgatacgttgacacctcctgaggttgatcataagaagagaaaaatcagagaggagatcgaacatttcgggatcaagatctaccaatttcctgattgcgattccgatgaagatgaagacttcaagctccaggatcaagcattaaaggaaagcattccatttgcagtcatcggctccaacacggtggtcgaggccagaggaagacgcgtgcgcggccgtctgtatccctggggcattgttgaagttgaaaacccaggacactgcgattttgtgaaactgcgtacaatgctcgtaaggacacacatgcaggatttgaaagacgtgaccagggaaacacattacgagaactaccgagcccagtgcatccaatccatgacccgattagttgtgaaagagcgcaatagaaacaagttaacccgtgagtccggcaccgacttccccatacccgcggttcccccgggcacggacccagagaccgaaaagctcatccgggagaaagacgaagaactgagacggatgcaggagatgctgcacaaaattcagaaacagatgaaggagaattattag

SEQ ID NO: 26280 - DNA, 1437 bp, Artificial Sequence
  Description of Artificial Sequence: Synthetic coding sequence
atggaccggagcctgggctggcagggcaacagcgtgcccgaggacagaaccgaagctgggataaaacggtttctggaggatacaaccgacgacggcgagttgtcgaagtttgtcaaggacttcagcggcaatgcatcctgtcatccccctgaggcaaaaacctgggcctcgagacctcaagtgcccgaacctcgaccccaagcccctgacctatatgatgacgatctagaatttcgtccgccgagcagaccacaatcaagcgataatcagcagtacttttgtgctcctgctccactgtccccgtccgctcgcccgcgaagtccttggggtaaactcgacccctatgactcatcggaagatgacaaggaatacgtgggatttgcaacacttcctaaccaagtccaccgaaagtctgttaagaaaggctttgattttaccctcatggtggccggggaatccggcttgggcaagtcaacactcgtgaacagcctgttcctgaccgacctctacagggacagaaagctattaggcgctgaagaacggataatgcagactgtggaaattacaaagcatgccgttgacattgaagaaaagggtgtccggctgcgtctgaccattgttgataccccaggctttggcgacgcggtaaacaacactgagtgctggaagcctgttgcggaatatattgaccagcagtttgaacaatatttccgcgatgaaagtggcctgaaccgcaagaatattcaggataaccgcgtccactgctgcctgtactttattagtcccttcggtcacgggctcaggcccctagacgttgagttcatgaaggccttgcaccagcgggtgaacatagtgcccattctggccaaggccgataccctcacaccaccagaggtagaccacaagaagagaaaaatcagggaagagatagagcactttgggattaagatctatcagtttccggattgtgatagtgatgaggacgaggactttaaacttcaagaccaagctctgaaagagtctattccattcgcagtgattggctccaataccgtggtcgaggctcgaggccggagagttcgggggaggctgtacccttggggcatcgtcgaggtcgaaaatcctggacactgcgattttgtcaagttgaggacgatgctcgttcggacccacatgcaggacctgaaggatgtcaccagagaaacacactatgaaaattaccgggcccagtgcatacagtctatgacccgactggtggtgaaagagcggaatcgcaacaagctgacccgagagtcaggcaccgacttccctataccagctgtcccacctggcactgatccggaaaccgaaaaattgattcgcgagaaggacgaggagctgagaaggatgcaggagatgctgcataaaatccaaaagcagatgaaggagaactattag

SEQ ID NO: 26281 - DNA, 1380 bp, Artificial Sequence
  Description of Artificial Sequence: Synthetic coding sequence
atgatcaagcggttcctggaggacaccaccgacgacggcgagctgagcaagttcgtaaaggatttctccgggaacgcatcatgtcaccccccggaagcaaaaacttgggcctcccgcccacaggtacccgaacctaggcctcaggctccagatctgtacgacgacgacctggagttcagacctcccagccgcccccagtctagcgacaaccagcagtatttttgcgcgcccgccccactctctcccagcgctcgacccagaagtccttggggcaaattggacccttatgactcttcagaagatgacaaggaatacgtaggtttcgctactttacctaatcaagtgcatagaaaaagtgtcaagaaaggattcgacttcacgctcatggtggctggcgagagtgggctggggaagagcactctggtgaatagtctgttcctcactgatttgtatcgcgacagaaaactcctgggagcagaggagaggattatgcagactgtcgaaataaccaagcatgccgtggacatcgaagagaagggggtcagactgcgactaacaatagttgacacacccggtttcggagacgcggtaaataatacagaatgctggaagcccgtggcagaatacattgaccagcagttcgaacagtatttccgcgatgagtcaggcctgaaccgcaagaacatccaggacaatcgcgtgcactgttgcctgtatttcatctctccatttggtcacggcctccggcccctggacgtagagttcatgaaagccctgcatcaacgcgtgaacattgtcccaatattggcgaaggctgatactctgacaccacctgaggtggaccacaagaaaagaaaaatcagggaagaaatcgaacactttggcattaaaatttaccagttcccggattgtgactccgatgaagacgaagatttcaaactccaagaccaagcacttaaagaaagtattccctttgccgtgatcggcagcaataccgtcgtagaagcacggggacgacgagttaggggtagactttacccttggggcatcgtggaggtggagaacccaggtcactgcgatttcgtcaaactgagaactatgcttgttcgcacgcacatgcaggatctcaaagacgtcacaagggagacacactacgaaaactatcgagcccagtgtattcagtccatgactcggcttgtggtgaaagagaggaacagaaataagctgacacgcgagtctggcaccgactttcctatcccagccgtgcctcccggcactgacccggagaccgagaaactgatcagggagaaggacgaggaactgaggagaatgcaagaaatgcttcataaaatccagaaacagatgaaggaaaattactag

SEQ ID NO: 26282 - DNA, 1413 bp, Artificial Sequence
  Description of Artificial Sequence: Synthetic coding sequence
atgcccggcttctacagcgtgatgaccgacgaggagatcaagcggttcttagaagataccaccgacgatggggagctgtcaaaattcgtgaaagacttttcggggaacgcgagttgccaccccccggaggcaaaaacctgggcttcacgaccccaggtgcccgaacctagaccccaggcccccgatttgtatgatgatgatttagagtttagaccgccatcccgcccccaatcttctgataatcagcagtacttttgcgccccagcacctttatctccaagcgctcgcccccggtccccttggggaaaactcgatccttacgactcgagcgaagacgacaaagagtacgttggattcgcaaccctgccaaaccaggtacacagaaagtcagtcaagaagggattcgacttcacactcatggtagccggcgaaagtgggttaggaaagtccaccctagtgaacagtttattcctcaccgacctctaccgggaccgtaaactgctcggggccgaagaacgaatcatgcagacagttgagattacaaagcacgccgttgacattgaggagaagggagtgcggctgcgtcttaccattgtcgatacgcccggattcggagacgctgtgaacaatacagaatgttggaagccggtggcagaatatatcgatcagcaatttgaacagtacttcagggatgagtccggacttaaccgcaagaacatacaagacaatagggtgcattgttgtctgtactttattagcccttttgggcatggtctgagacccctcgatgtcgagttcatgaaagcgctccaccagcgcgtgaacattgtccccatcctcgctaaggccgataccttgacccctcccgaagtggatcacaaaaaacggaagattcgcgaggagatcgagcactttggcattaaaatataccagtttcccgactgcgactcagacgaagatgaagacttcaaactccaggaccaggctctcaaagagagcatccccttcgcagttatcgggagcaatacagttgtagaagccagagggagaagagtccgaggccgcttgtacccctggggaattgtggaggttgaaaaccctggacactgcgattttgtgaaactgaggaccatgcttgttcggacccatatgcaggatctgaaggatgtcacccgggagacacattacgagaactatcgcgcacagtgcattcagagcatgacacgcctcgtcgtaaaggaacgcaatcggaataagttgacccgcgaaagtggcaccgacttccctatccccgcggtgcccccggggacagaccccgaaaccgagaagctgatcagagaaaaggacgaggaacttcgacggatgcaggaaatgttacacaaaatccagaagcagatgaaagagaattattag

SEQ ID NO: 26283 - DNA, 825 bp, Artificial Sequence
  Description of Artificial Sequence: Synthetic coding sequence
atgatcaagcggttcctggaggacaccaccgacgacggcgagctgagtaagttcgtgaaggattttagcggtaatgcctcatgccaccctccggaggcaaaaacctgggctagccgtcctcaggtgccagaaccacgaccccaggcccccgatctgtatgatgacgacctggaatttagacccccatcccgcccacaatcatccgacaaccagcagtacttttgtgcccctgcacctctgtccccctctgctcggccgagaagcccatggggaaagctggacccttacgacagcagcgaggatgataaagagtatgttggctttgcaacactcccgaaccaggtccacaggaagagcgtaaagaaaggatttgatttcacactcatggtggccggggaaagcggattgggaaagtccacactggtgaactcactattcttaacagacctttaccgtgatagaaagcttctgggtgcagaggagcgcattatgcaaaccgtcgaaatcactaaacacgctgtggacatcgaggaaaaaggggtgcgacttcgactcactatcgtcgatactcccggttttggggacgccgtgaacaataccgaatgctggaaacctgtggccgaatacatcgatcaacaattcgaacaatactttcgggatgaaagcggactcaatagaaaaaatatacaggacaacagagtccattgttgtttatactttatcagccctttcgggcacggatatggtccgagcctgcgcctgctcgcacctcccggcgccgtgaaggggaccggccaggagcaccaggggcagggatgccactag

SEQ ID NO: 26284 - DNA, 1479 bp, Artificial Sequence
  Description of Artificial Sequence: Synthetic coding sequence
tacagcagccccgccctgttcagcagccgggccgccccccagaagccgaggaaagaaggcagccaggcggccggactgttggttttttctgactctctggagattaagaggttcctcgaagacaccaccgacgatggagagctgtctaagttcgtgaaggatttttcaggcaatgcctcttgccatccacccgaagcaaaaacctgggcctcccgcccccaggttcccgaaccccgcccacaggctccagacttgtacgatgatgatctggagttcagaccaccatcacgaccccagtcttctgataaccagcaatacttttgcgctcccgccccactgagtccgtccgctagaccccgcagcccctggggcaagttagacccctatgattcttctgaagacgacaaagaatatgtcggtttcgctaccctacccaatcaggttcatcgcaagtctgttaagaagggcttcgacttcacgctcatggtcgctggcgaatccgggctaggcaagagtactctggtaaacagcctgtttctcactgacctgtaccgagaccggaagttgttaggggcggaagaacggattatgcagacggtggaaatcaccaaacacgccgtcgacattgaagagaaaggggtgaggctgcgccttaccatcgtcgacacgccaggttttggagacgccgtgaataacacagaatgttggaagccagtggccgagtatatagaccaacagtttgagcaatattttagggacgagagtggactgaaccgcaagaatattcaggataaccgcgttcactgttgtctctatttcataagtccttttgggcatggcttgcgaccgctcgatgtggagtttatgaaagctttacatcagcgcgtgaacattgttcccatcttggccaaagccgataccctgacacctcctgaggtggatcacaagaaaaggaagatccgtgaggaaatcgagcatttcggcattaaaatatatcagtttccagactgtgactcagacgaggatgaagactttaagctgcaagaccaggctctgaaggaaagcatcccctttgcagttattgggtctaatacagttgtggaggctagagggaggcgcgtgcgggggagactgtatccgtggggaatcgtcgaagtggaaaacccaggacattgtgattttgtcaaactgcgtacaatgctcgtgaggacgcatatgcaggacttgaaggacgtgacgagggaaactcactacgaaaattatcgtgctcagtgcatccagagcatgacacggcttgtagtgaaggaaagaaatagaaacaagctaaccagggagagcggcacggatttcccaatccctgctgttccgcctggcactgaccccgaaactgaaaagctgatccgcgaaaaagacgaagaactgcgccgtatgcaggagatgctgcacaagattcagaagcagatgaaggagaactattag

SEQ ID NO: 26285 - DNA, 996 bp, Artificial Sequence
  Description of Artificial Sequence: Synthetic coding sequence
atggtggccggcgagagcggcctgggcaagagcaccctggtgaactcactctttctgaccgacctatatcgagaccgcaagctgttgggtgctgaagaaaggataatgcagacagtagagattacaaaacacgcggtggacatcgaagagaaaggggttaggctccgcttgaccattgtggacacacctggatttggggatgcagttaacaatactgagtgctggaaaccggtggccgagtacatcgaccaacaattcgagcagtatttccgagacgaaagcggacttaaccggaagaacattcaagataatcgcgtgcactgttgtttgtatttcatttctcctttcggtcatgggttgagaccgctcgacgtcgagttcatgaaggcccttcaccaaagggtcaatatcgttcccattctggctaaagccgacaccctcaccccccccgaagtcgaccataaaaaacggaagatcagggaagagatcgaacactttggaataaagatatatcaattccccgactgcgacagtgatgaggacgaggattttaagctgcaagatcaggctttaaaggagtccatcccctttgccgtcatcggcagtaatactgtggtggaagcaagaggccggagggtgaggggccgactatatccatggggaattgtggaggtggaaaatcccggccattgcgatttcgttaaactgcgaactatgcttgttcggacgcacatgcaggacctaaaagatgtcacccgggagactcactatgagaactaccgcgcacagtgtatccaatctatgacccgcctggtggttaaagagcgaaacaggaataagttaacacgtgaatcgggcactgacttccccattcccgctgtgccgcccgggacagaccccgagacggaaaagctgataagagaaaaggatgaggagctgaggcgcatgcaggagatgctccacaagatacagaaacagatgaaggaaaattactag

SEQ ID NO: 26286 - DNA, 1311 bp, Artificial Sequence
  Description of Artificial Sequence: Synthetic coding sequence
atgagcgtgagcgcccggagcgccgccgccgaggagcggagcgtgaacagtagcacgatggggcaacaaaaaaacctcgagggttatgtgggatttgctaatttacctaatcaggtttatagaaaatctgtaaaaagggggttcgaattcaccctaatggtggttggcgaaagcgggttgggcaagtcaacgctcattaattccctatttttgaccgacctttattcaccagagtatcctgggccatcacaccgaatcaagaagaccgttcaggtggagcagagcaaggtgctgatcaaggagggcggcgtgcagcttctcctgacgatcgtggacacacccgggtttggggacgctgtcgataattcaaattgctggcagcccgtgatcgactacattgacagcaagtttgaggactacctcaacgccgaaagcagagtgaatagacgacagatgcctgataatcgggtgcagtgttgtttgtacttcatcgcgccctccggtcatggcctgaaaccacttgacatcgaatttatgaagcgtcttcacgagaaagtaaacattatcccgctgatagccaaggccgataccctaacccctgaggaatgtcaacagtttaagaagcagattatgaaagagattcaggagcacaaaattaaaatctacgaatttcccgagacagacgatgaggaagagaacaagcttgttaagaaaatcaaggacaggcttcctctggccgttgtagggagcaacaccatcatcgaagtgaatggtaagagagtccgtgggaggcaatatccgtggggagtagccgaggtcgaaaacggcgaacactgtgacttcacaatccttcggaacatgctgatcaggactcacatgcaggatttgaaggatgttacaaataacgtgcactacgagaactataggtctcgcaaattggcagcggtgacctacaatggtgtggataacaacaagaacaaggggcaacttactaaatccccgctagcccagatggaggaggaacgtagagagcatgtagcgaagatgaaaaagatggagatggagatggagcaggttttcgagatgaaggtgaaggagaaggtccaaaaattgaaagactctgaagccgagctgcaacgcagacatgagcagatgaagaaaaacttggaggcacaacataaagaactcgaggaaaagagacgccagttcgaggacgagaaagcgaactgggaagctcagcagcggatactggagcagcagaactctagtcggactctggagaagaacaagaagaagggaaaaatcttctag

SEQ ID NO: 26287 - DNA, 1317 bp, Artificial Sequence
  Description of Artificial Sequence: Synthetic coding sequence
atgagcgtgagcgcccggagcgccgccgccgaggagcggagcgtgaacagctctacaatggaggtggcccaacagaagaatctggagggttacgttggtttcgcaaatctgccaaatcaagtgtacaggaagtccgtcaagagaggcttcgagttcacattgatggtcgtaggggaatccggtctcgggaagagcaccctgattaatagcctgtttctcactgacctttactccccagaataccccggcccaagccaccgaatcaagaagactgtgcaggtggagcagtcaaaggtattaatcaaggaagggggagtacagctgcttctgaccattgtggatacccccggctttggggacgctgtagacaactccaattgttggcaaccagtgatcgactacatagatagcaaattcgaggattacctcaatgcagagtcacgggttaatcgacgtcaaatgccagataaccgggtccagtgttgcctgtactttatcgccccaagcgggcacggactcaagcccctcgacattgaattcatgaagcggctgcatgagaaggtgaacatcatcccactcatcgccaaagctgatactctgactccagaagaatgtcagcaattcaagaaacagatcatgaaggagatccaagagcacaagatcaaaatatatgagttccccgaaactgatgacgaagaagaaaacaaacttgtgaagaagataaaggatcgacttcccctagcagtggttggaagcaacaccataattgaagtcaatgggaaacgggtgcgcgggcgacagtatccttggggcgtagccgaagtcgagaacggagagcactgtgatttcaccatccttagaaacatgctaataaggacacacatgcaagaccttaaggatgttacgaacaacgttcactatgaaaactataggtcaagaaagctggcagcagtaacttacaacggcgtcgacaacaacaaaaacaagggacagctgaccaaatcacctctggcccagatggaggaagaacggcgggaacacgtggccaagatgaaaaaaatggaaatggaaatggaacaagtgttcgagatgaaggtgaaggaaaaagttcagaagcttaaggattcagaggcggaattacagcgccgccatgaacagatgaagaagaacctcgaggcccagcataaagagctcgaagaaaaacgccggcagtttgaggatgaaaaagcaaattgggaagcgcaacagagaatattggaacagcagaattcctcaaggaccctagaaaagaataagaaaaaagggaagatcttctag

SEQ ID NO: 26288 - DNA, 1311 bp, Artificial Sequence
  Description of Artificial Sequence: Synthetic coding sequence
atgagcgtgagcgcccggagcgccgccgccgaggagcggagcgtgaattcatccaccatggtacagcaaaaaaacctagaaggctacgttggttttgcaaacctgcctaaccaggtttacaggaaatcagtgaagaggggatttgaattcaccttgatggtagtgggagagtccgggttggggaagtccaccctgataaatagtctattcctcaccgatctgtattcacctgagtacccagggccctcccaccggataaagaaaactgtgcaggttgagcagagcaaggttttgattaaagagggaggggtgcagctgttacttaccatagtcgataccccaggcttcggcgatgcagtggataatagtaactgttggcagcctgtgatagactatattgactctaagtttgaagattacctgaacgcagaaagtagagtgaaccgcagacagatgccggacaacagggtccagtgctgtctgtattttatagctccatcagggcacgggttgaaacccctggatatcgagttcatgaagcgattgcatgagaaagttaacatcattccccttattgccaaagcggatacgttgacaccagaggagtgccaacagtttaaaaaacaaattatgaaagaaatccaggaacataaaatcaagatttatgagttccctgagacggatgatgaagaggagaacaaactcgtgaagaaaattaaagacagactgccgcttgcagtggtggggtcaaacaccatcatcgaagttaatggaaagcgcgtgcgcggcagacaatacccgtggggagtcgccgaagtggaaaatggggagcactgtgacttcactattcttagaaatatgttgatacggactcacatgcaggatttaaaagacgttactaataacgtgcattacgaaaattacaggtcccgcaagctggccgccgtgacgtacaacggcgttgacaataataaaaataaaggtcagctgacaaagtcacccctggcccagatggaggaagagaggagggagcacgtggccaaaatgaaaaagatggagatggaaatggagcaggttttcgaaatgaaggtcaaggaaaaggtccagaaactcaaggattccgaggcagaactccagcgtagacatgagcaaatgaaaaaaaatctcgaggcgcagcataaagagttagaggagaagaggaggcaatttgaggatgaaaaggctaactgggaggcccagcaacgtattctcgagcagcagaattcaagtcggaccttagaaaagaataagaagaaagggaaaattttctag

SEQ ID NO: 26289 - DNA, 267 bp, Artificial Sequence
  Description of Artificial Sequence: Synthetic coding sequence
atgaagaagatggagatggagatggagcaggtgttcgagatgaaggtaaaggaaaaggtgcaaaagctcaaagactctgaagcagagctgcagaggaggcatgagcagatgaaaaagaatctagaggctcagcataaagaactggaagaaaagaggcgccaattcgaggatgaaaaggcaaattgggaggcccagcagaggattctggaacaacagaactcctctaggacccttgagaagaacaaaaaaaaagggaaaattttttag

SEQ ID NO: 26290 - DNA, 1155 bp, Artificial Sequence
  Description of Artificial Sequence: Synthetic coding sequence
atggtggtgggcgagagcggcctgggcaagagcaccctgatcaactcactctttctgaccgacctctacagtcccgagtatcctggtccctcccaccgcatcaagaagacagtgcaggtggagcaaagtaaggtgctgatcaaagaaggaggggtccaacttctgcttaccattgtggatacccctggatttggtgacgcggtggacaactccaactgctggcagcctgttattgattacattgattctaagttcgaggactatctcaacgcagagtccagggtaaataggagacaaatgccagacaaccgggtacaatgctgtctgtactttatcgctcccagcgggcatggcctaaagccgttagatatcgagttcatgaagaggttgcacgagaaggtaaacattattcctttgatcgcaaaagctgacactttaacccccgaggagtgccagcaatttaagaagcagatcatgaaggagatccaggagcacaaaattaaaatctatgagttcccagagaccgacgatgaggaggagaacaagctcgttaagaagatcaaggaccgattgcccctggcagtcgttggatccaatactattatcgaggtaaacgggaagcgtgttcggggcaggcagtacccttggggggtggctgaagtcgaaaatggcgagcattgtgacttcaccatcttgcgcaatatgttgattaggactcatatgcaggatcttaaggacgtgaccaacaacgtgcattacgagaattacagatctcggaagctggctgcagtgacatataacggagtggacaataacaaaaataaagggcaattgaccaagagtccactggcccagatggaggaggagagacgagaacacgtcgccaaaatgaagaaaatggagatggagatggagcaagtgtttgagatgaaggtgaaagagaaggtgcagaagctgaaagatagcgaggccgaacttcaacgccggcatgagcaaatgaaaaagaacctcgaagctcagcataaagaactcgaagagaagaggcggcagttcgaggatgagaaggccaactgggaggcccagcaacgcatcctcgaacagcagaactcctctcggacactcgaaaaaaacaaaaagaaggggaaaattttttag

SEQ ID NO: 26291 - DNA, 708 bp, Artificial Sequence
  Description of Artificial Sequence: Synthetic coding sequence
atgagcgtgagcgcccggagcgccgccgccgaggagcggagcgtgaactcaagcacaatgggccagcagaagaatcttgagggatacgtcggttttgcaaacctcccaaatcaggtttacagaaaatcggtgaaacggggatttgagtttactcttatggttgtcggagaaagtggactcggaaagtccaccctgatcaactccctctttctgacggacctgtattcacctgagtaccccggtcccagtcaccggattaagaagaccgttcaggttgaacagtccaaggtgctgattaaggagggcggcgtgcagctgttgctgactatcgtagatacgccagggttcggcgatgcggttgacaactcaaactgttggcaaccagttattgattatattgactccaagtttgaggattacctgaatgcggaaagtcgcgtgaatcggagacaaatgcctgacaatcgtgtccagtgctgtttgtacttcattgcacccagcgggcacggcctgaaaccactcgatatcgagtttatgaagcgcctgcacgagaaggtgaacatcatccctctaattgcaaaagcagacacgctcacccccgaagagtgccagcaatttaagaagcagataatgaaagaaatccaagaacacaaaatcaaaatttacgaatttcccgagaccgcaaaaaaaaagaagaagaagaagtag

SEQ ID NO: 26292 - DNA, 1155 bp, Artificial Sequence
  Description of Artificial Sequence: Synthetic coding sequence
atggtggtgggcgagagcggcctgggcaagagcaccctgatcaactctctgtttctcactgacctgtacagcccagaataccctggccctagccacagaatcaaaaagaccgtgcaggtcgaacagtctaaggtgcttataaaggagggcggagtgcaactcctgctcaccattgtcgatactcccggattcggagacgctgtggacaacagcaactgctggcagcctgtgattgattacattgactcaaaattcgaggactacttgaacgctgaatctcgagtgaataggaggcagatgcctgacaatagggtccagtgttgtctgtacttcattgcaccgagcggtcatggcctgaagcccttagatattgaatttatgaagcgtttgcatgagaaggtgaatatcatccctctgattgcgaaagctgataccctgaccccagaggaatgccagcagtttaagaagcaaatcatgaaagagattcaggaacataaaatcaaaatttatgaatttcctgaaactgacgacgaggaggagaataaactcgtgaagaagatcaaggaccggcttccgctggcggtcgtaggatcaaacacaatcatagaagtgaacggcaaacgtgtgcgggggagacaatacccttggggagttgcagaggtcgaaaacggcgaacattgcgacttcacaattctgcgcaacatgctcatacggacacacatgcaggacttaaaagatgtgactaacaacgtccattacgagaactaccggtctcgtaaactggcggcagtgacttacaacggtgtcgacaacaacaagaataagggtcagctgaccaaatcaccactggcacaaatggaggaggagcgccgcgagcatgtagcaaagatgaagaagatggagatggagatggaacaggtgtttgaaatgaaggtgaaggagaaagtacaaaagctgaaggacagcgaggctgaattgcagagaagacatgagcagatgaagaaaaacttagaagcgcagcacaaggagttggaggagaagcgccgccagtttgaagatgaaaaggcgaattgggaagctcagcagagaatactggaacaacagaattcaagtcgcacccttgaaaaaaacaaaaaaaaagggaagattttctag

SEQ ID NO: 26293 - DNA, 1146 bp, Artificial Sequence
  Description of Artificial Sequence: Synthetic coding sequence
gtgacccacgagaccatcgtggagcagcagaagaacctggagggctacgtgggcttcgcgaacctgcccaatcaagtctacaggaaaagtgttaagcgcggcttcgaatttacattaatggtggtgggcgagagtggtctcggcaaaagtaccctgatcaacagtctttttttgactgacctttacagtcctgaatatcctgggcctagtcatcgaataaagaagactgttcaagtggaacagtcaaaggtgctcattaaagaaggaggtgtgcaactactgcttactatcgtcgacacaccaggcttcggagacgccgtggataattctaactgctggcaacctgtgatcgactacattgatagcaagtttgaggactacttaaatgccgaatctagggttaatcgccggcaaatgccggacaatcgagtccaatgctgcttgtactttattgccccctcggggcatggactgaagccattggatattgaattcatgaaacgactgcacgagaaagtgaatatcattcctctcattgcaaaggctgatacactgacacctgaggaatgccagcagtttaaaaagcagatcatgaaggagattcaggaacacaaaatcaaaatttacgaattccctgagactgacgatgaggaagagaacaaactcgtcaaaaaaataaaagacaggctaccgctcgccgtggttgggtcaaatactataatcgaagtaaatggcaagagagtgagaggacgtcagtacccttggggtgttgctgaggttgaaaacggcgagcattgcgatttcaccatcctgaggaacatgctgatcagaacccacatgcaggatcttaaagacgtcaccaacaatgtccactatgagaactatcgctctcgtaaactggcggctgtcacgtacaacggcgtcgataataataagaacaagggccagcttactaaatccccattggcccagatggaagaggagcgccgcgagcatgtcgccaagatgaaaaagatggaaatggagatggagcaggtattcgaaatgaaggtgaaggaaaaggttcagaagctgaaggactccgaagctgaagtcatctctttgatttcccatttgctagcagatattgtgttcctgttcaagtag

SEQ ID NO: 26294 - DNA, 1149 bp, Artificial Sequence
  Description of Artificial Sequence: Synthetic coding sequence
atgggcgagagcggcctgggcaagagcaccctgatcaacagcctgttcctgaccgacttgtactcaccggaatatccagggccttcacatcggattaaaaagacagtgcaggtggagcaatccaaagtcctgattaaagaggggggagttcagctgctgcttacaatcgttgacacacccggctttggagacgcagtcgacaattcaaattgctggcagcctgtcattgattatattgatagcaaattcgaggactatctgaacgccgagtctcgcgtgaataggagacagatgcctgacaatagagttcagtgttgcctctattttatcgccccctccggccacggcctgaaaccactcgacattgaattcatgaaacgtctccacgaaaaggtgaatattatccccctgatagccaaggccgatactttgactcctgaggagtgtcagcagtttaagaaacagatcatgaaggaaattcaggagcataagatcaagatctatgagttcccggagaccgatgatgaagaagagaataagcttgtcaagaaaattaaagatcggctccctttggcagtggtaggctcaaatacaatcatcgaggttaatggtaagagagtgcgcggcagacaatacccatggggggtcgctgaagtggaaaatggggaacactgtgatttcaccatcttgcggaatatgcttattcgaacacacatgcaggatcttaaggatgtcactaacaacgtccactacgagaattatcggagtcggaagctagccgccgtcacttataatggtgttgacaataacaagaacaagggacagctgaccaagtcacctctggcacaaatggaggaagagcggagagagcatgttgcaaaaatgaaaaagatggaaatggaaatggagcaggttttcgagatgaaagtcaaggaaaaggttcaaaaattgaaagactccgaagcagagctgcagcgtcgccatgagcagatgaaaaagaatctggaagcccaacacaaagagcttgaggaaaaacgaaggcagtttgaggacgagaaagctaactgggaagctcagcagcgaatactggagcagcagaacagtagtaggaccctggaaaagaacaagaagaaagggaaaatcttctag

SEQ ID NO: 26295 - DNA, 1302 bp, Artificial Sequence
  Description of Artificial Sequence: Synthetic coding sequence
atggaggtggtggacccccagcagctgggcatgttcaccgagggcgagttgatgagcgttggtatggacacattcatccaccgtatagatagcactgaggttatctaccaacctcgcagaaaacgcgctaaactgatcggcaaatatctcatgggcgaccttctgggggaggggagttatggcaaggtgaaagaagttctggactctgaaacactctgtaggcgtgcagtgaagattcttaaaaagaagaagctgagacgcattccgaacggcgaggccaacgtgaagaaggaaatccaattactgcgcagactgcgtcacaaaaatgttattcagttggtggatgtgctgtacaatgaggagaaacagaagatgtacatggtcatggagtattgcgtgtgcggaatgcaagagatgttggattcggttccagagaaaaggttccccgtttgccaggcccatggatacttttgtcaactgatagatggtctcgagtatctccacagccaggggattgtccacaaggatatcaagcctgggaatctgttactcacgacaggaggaacactgaagatatctgacctgggggtggccgaagctttgcatccattcgccgccgacgatacctgtcggacctcacagggcagcccggcatttcagcctcctgaaattgctaacggactagacaccttttctggcttcaaggtcgacatatggtcagccggggtcacactgtacaatattactactgggctgtatcccttcgagggcgacaacatctacaaactcttcgagaacataggaaagggtagttatgccatacccggagattgcggtccacccctgtccgatttgttgaaaggtatgcttgaatatgagcctgcaaaaaggttttccattcggcagatccggcaacacagctggttccgaaaaaagcacccaccagctgaggccccggttcctatacccccgagtcccgacactaaggataggtggagatctatgacggtggtcccatatctcgaggacctacatggagcagacgaggatgaagacctcttcgatatcgaagacgacatcatctacacacaagactttacggtgcctggacaagtgcctgaggaggaagcatctcataatggccagcggcgcgggcttccaaaggccgtgtgtatgaacggaacagaagctgctcagctgagtaccaagagccgggccgagggtcgagctcctaatcctgctagaaaagcatgctctgcttccagcaaaattcgcaggctgtcagcctgtaagcagcagtag

SEQ ID NO: 26296 - DNA, 1299 bp, Artificial Sequence
  Description of Artificial Sequence: Synthetic coding sequence
atggaggtggtggacccccagcagctgggcatgttcaccgagggcgaattgatgtccgtggggatggacacattcattcaccgcatcgactcaacggaagtgatctaccaaccccgacggaagcgcgctaagctgataggaaaatatcttatgggcgatctgctcggtgaaggcagttatggaaaagtgaaggaggtcctcgatagcgaaacactctgccgccgggcagtgaaaatactaaagaaaaaaaaattgagaagaatccctaacggagaggccaatgtgaagaaggagattcaacttctgcgcagactcaggcataaaaacgtcattcaactagtcgacgttctgtataatgaagaaaaacagaaaatgtatatggtgatggagtattgcgtgtgcggtatgcaggagatgctcgattcagtgcctgagaaacgtttccctgtgtgtcaagcacatggttacttctgtcagctcatcgacgggctggagtacctccactcacaggggatcgttcacaaagacataaaaccgggaaacctgctccttaccacaggagggactttgaaaattagtgatctaggagtggccgaggcacttcacccattcgcggccgacgatacgtgtcgcaccagccagggtagccctgcttttcaaccccctgagatcgctaacgggttagatacctttagcggctttaaggttgacatctggagcgccggtgtgacactatacaatataactaccggtctgtatcccttcgaaggggacaacatttacaagctgttcgagaacattgggaaagggagctatgccattccaggcgattgcgggccccctctgtctgatctactaaaggggatgttggagtacgagcccgctaagagattctccattcgacagatacggcagcacagctggtttcggaagaaacacccccctgcagaggcgccagtcccaattccccccagcccggacactaaagatagatggcgcagcatgactgtcgttccttacttggaagatttgcatggagcagatgaggacgaagacctctttgacattgaggatgacattatctacacacaggactttacagtgcctggtcaggtccccgaagaggaggcatcgcacaacggccagcggcgagggctcccaaaggctgtctgcatgaacggcacagaggccgctcaacttagcactaaaagccgtgccgaggccggacctcccactctgcctgcacggcccgccgcgagttctaaaatccggcggctgagtgcctgcaaacagcagtag

SEQ ID NO: 26297 - DNA, 1248 bp, Artificial Sequence
  Description of Artificial Sequence: Synthetic coding sequence
atggaggacctgtgcgtggccaacaccctgttcgccctgaacctgttcaaacaccttgcaaaggccagccccacccaaaacctgtttctgtctccatggtccattagctccactatggcaatggtctatatgggcagtaggggcagtaccgaggaccagatggctaaagtgctgcaatttaacgaggtgggtgctaacgccgtcacccccatgactcccgaaaactttacaagttgcggctttatgcagcagatccagaaagggtcataccctgacgctatcctccaggcacaagctgcagacaagattcactcatcatttagaagtctttcaagcgccatcaatgcatccaccggcaattacttactggaaagcgttaacaagttgtttggggaaaagtccgcatcgttccgcgaagaatacatccggctatgccagaagtactactcgtccgaacctcaggctgtggacttcctcgaatgtgccgaggaagcccgaaagaagatcaattcatgggttaagacacagaccaaggggaagatccccaacctcctccccgagggctccgtggacggtgatacaaggatggtcctggttaacgcggtgtattttaagggaaagtggaagaccccttttgagaagaagctcaacggcctctacccctttcgagttaactcggctcagaggacccccgtgcagatgatgtatttacgggaaaagctcaacatcggctatatagaggatctgaaagcacagatcttggagctgccttacgccggcgacgtaagcatgttcctgctactcccggacgaaatagccgacgtgagcaccggccttgaactcctggaatccgaaattacctacgataaactcaataaatggacatccaaggataaaatggccgaagatgaagtggaggtctacattccgcagttcaaactggaggagcattatgagctccgaagtattttgcggtccatgggtatggaggacgccttcaacaaaggtcgggccaactttagcggaatgtctgagagaaacgatctatttctgtctgaggtcttccaccaggctatggtcgacgtgaatgaagaaggcacagaggccgccgcgggtaccggaggagtgatgaccggcagaacgggccacggcggacctcagttcgtcgccgatcatccattcctgttccttatcatgcataagatcactaattgcatcctattctttggaaggttctcatcaccttag

SEQ ID NO: 26298 - DNA, 342 bp, Artificial Sequence
  Description of Artificial Sequence: Synthetic coding sequence
atggaggacctgtgcgtggccaacaccctgttcgccctgaacctgtttaaacaccttgctaaagcctcacccacacagaacctgttcttatccccatggagcatctccagtacaatggcaatggtctatatgggatcaagaggcagtactgaggatcagatggccaaggtcctgcaatttaatgaagtaggggcgaatgcagtgacccctatgactcctgaaaactttacgagttgtgggtttatgcagcagatccaaaaggggtcctaccccgatgcgatccttcaagcgcaggctgccgacaagatccatagctctttccggtccctgtcctctgcctag

SEQ ID NO: 26299 - DNA, 486 bp, Artificial Sequence
  Description of Artificial Sequence: Synthetic coding sequence
atggaggacctgtgcgtggccaacaccctgttcgccctgaacctgttcaagcacctggccaaggcctcccctacacaaaatctcttcctgagcccttggtctatctccagtactatggcaatggtgtacatgggttctcggggctccactgaagatcagatggccaaagtgcttcaatttaacgaagtcggcgccaatgccgtgacccccatgacgccagagaacttcacctcctgcggattcatgcagcaaattcagaaaggctcgtatcccgacgctattctccaggcgcaagctgcagataaaatccactcctccttcaggtctctctcttcagccattaacgcatccactgggaactacctgctagagagcgtcaataaactttttggcgagaaatctgcaagcttcagggaggaatacatacgtctgtgtcagaaatactattcctccgagcctcaggccgtggactttcttgaatgttag

SEQ ID NO: 26300 - DNA, 399 bp, Artificial Sequence
  Description of Artificial Sequence: Synthetic coding sequence
atggaggacctgtgcgtggccaacaccctgttcgccctgaacctgttcaagcaccttgcgaaggccagccccacacagaatttgtttctgtctccctggtctataagttcaactatggctatggtgtacatgggctctcgcggatcaaccgaggatcagatggccaaggtgctgcagttcaacgaggtaggggcgaatgcagtcaccccaatgacccccgaaaatttcacatcctgcggattcatgcagcagattcagaagggctcttacccggatgccatcttacaagctcaggccgctgacaagatccattcctctttcaggagcctctctagtgcgatcaacgcatccactggaaactaccttctggaaagcgtgaacaaacttttcggtgaatag

SEQ ID NO: 26301 - DNA, 1248 bp, Artificial Sequence
  Description of Artificial Sequence: Synthetic coding sequence
atggaggacctgtgcgtggccaacaccctgttcgccctgaacctgttcaagcatcttgccaaagcatctccgacacagaatctatttttatcaccgtggtcaatctcttccacaatggccatggtgtatatgggtagtcggggcagcacagaggaccagatggctaaggtgcttcagttcaatgaggtgggggccaacgccgttactcccatgacacccgagaatttcaccagctgtgggtttatgcagcaaattcagaagggaagctatccagatgcgatcttgcaggcacaggcagcggacaaaattcattcatcatttcggtccctgagctccgcaatcaacgcttccacaggaaattacttattggagtcagtcaacaagctgttcggggaaaagtctgcgtcattcagagaggaatacattcgactctgccaaaagtattattcttctgaacctcaggctgttgactttctggagtgtgctgaggaggcgcggaagaagattaactcttgggttaagacgcagaccaaggggaaaatcccaaatctgttacctgaaggatctgtggatggggacacacgaatggtgttagtcaatgcagtctatttcaaaggtaaatggaaaaccccttttgagaagaaactcaatggcctgtacccatttcgcgtgaattcagctcaaagaacacctgtgcagatgatgtacctgagggaaaagctgaacattggttacatcgaggatctcaaagctcaaatcctcgaactaccttatgctggagatgtttctatgtttttgcttctgcctgacgaaatcgccgacgtttctacaggattggagctactagaatctgagatcacctatgataagcttaacaaatggacgtcaaaagataagatggcagaggacgaggttgaagtatacattccccagttcaagctggaagaacactatgagctaaggtcaattttgcgatctatgggtatggaagatgcctttaataaaggcagagccaacttttccggtatgagtgagaggaatgatctttttctctcggaagttttccatcaggccatggttgacgtaaatgaggaggggactgaagcggccgcaggaactggcggggtgatgacgggcaggacaggccacggggggccccagttcgtggctgatcatccctttttgtttctgatcatgcataaaattactaactgtatcctcttcttcggtcggtttagtagcccatag

SEQ ID NO: 26302 - DNA, 2280 bp, Artificial Sequence
  Description of Artificial Sequence: Synthetic coding sequence
atggccggcctgaccctgttcgtgggccggctgccccccagcgcccggtcagagcagcttgaagagttgttttcccaagtcggacctgtcaagcagtgctttgtggtgacggaaaaggggagtaaggcgtgtagaggattcgggtatgtgaccttttctatgcttgaggatgttcagcgggcgctgaaagagatcactacctttgagggatgcaagatcaatgtaacagtcgctaaaaaaaaactccgtaacaaaactaaagagaagggcaagaacgaaaattcagaatgtcctaaaaaagagccaaaagccaagaaggctaaggttgccgacaagaaggcccgactgatcatcaggaacctaagcttcaagtgctcggaagacgatctaaaaactgtgttcgcacagttcggggcagtgctggaggttaatattccacgtaaacccgacggcaagatgcgtggattcgggtttgtgcagtttaagaatctattagaagccggcaaagctctgaaaggtatgaatatgaaggagatcaaagggagaacagttgccgtcgactgggcggtcgctaaagataaatataaagatacccagtccgttagcgctattggtgaagaaaagagccacgagtcgaaacaccaggaaagcgtcaaaaagaagggaagagaggaggaggacatggaagaggaggaaaacgacgacgatgacgatgacgacgatgaggaagatggagtcttcgatgatgaagacgaggaagaggagaatattgagagcaaagtcacaaagcctgtacagattcagaaacgcgccgtaaaacggcctgcacctgctaagtcgtctgaccattccgaggaggacagcgacttagaagaaagtgacagtattgacgatggtgaggagctagcacagtctgacacgagcacggaagaacaggaagacaaggctgtccaggtgagcaacaaaaaaaagcgaaagctgcccagtgacgtcaatgagggcaagacagtgtttattcgcaatctgtcatttgactcagaggaagaagagcttggagaactgctgcagcagttcggggaactgaagtacgtgcgaattgtcctccatcccgacaccgaacattctaaaggctgtgctttcgctcagttcatgacacaggaggccgctcagaaatgcctgctcgccgctagtcctgagaatgaggcaggtggactgaagttagatgggagacagcttaaagttgatctagcggtcacacgtgacgaagcagcaaagcttcagacgacgaaggtcaagaagccgacaggcacccggaacctataccttgctcgcgaaggattgatccgggcgggcacaaaggcagctgagggcgtgtcagccgctgacatggcaaagcgagagcgctttgagctcctcaaacatcaaaagctgaaggatcaaaacatctttgtctcccgcacccgcttgtgcttgcataatctgcccaaggccgtcgatgacaagcaactcagaaagctgctattaagcgcaacaagcggcgagaagggggtgaggatcaaagaatgcagagttatgagagacctgaaaggagttcacggtaatatgaaggggcaatctctcggatacgcctttgccgaattccaagaacatgagcacgcactgaaggctctccgtctaatcaataacaacccagagatatttggtcccctcaagagacccatcgtggaattttccctcgaagatcggaggaaactcaaaatgaaagagctcaggatccagaggtcgttgcagaagatgcgctctaaacccgcgaccggggaaccgcaaaaagggcagcctgagccagctaaggaccagcagcaaaaagccgcccagcaccacacagaagaacagtccaaagtccctccggagcagaaacggaaagccggctcaactagctggaccgggtttcaaacaaaagccgaagtcgagcaggtcgaactgcctgatggcaagaagaggaggaaagttctagccctcccctctcaccgggggccgaaaattcggttgagagataaggggaaggttaaacccgtccacccaaaaaaaccaaaaccccagattaaccagtggaaacaagagaagcagcagttgtcatcggaacaggtgagtcggaaaaaggcaaaagggaacaagaccgagactcgttttaaccagcttgtggaacaatacaagcagaagctactgggaccctccaagggagccccgctagccaagaggagtaaatggttcgattcatag

SEQ ID NO: 26303 - DNA, 1164 bp, Artificial Sequence
  Description of Artificial Sequence: Synthetic coding sequence
atgcagatgagccccgccctgacctgcctggtgctgggcctggccctggtgttcggtgagggaagcgccgtgcaccacccaccctcttatgtggcacaggcaagcaaggaccggaacgttgtattttccccatacggagtggcatccgtcctggcgatgctgcagctgaccaccggtggagaaacccagcaacagatccaggccgccatgggctttaaaatagatgacaaagggatggccccggcccttcgacacctgtataaggagcttatgggcccatggaataaggatgaaatctccaccacggacgcgatttttgttcagcgagaccttaagctagtacaaggtttcatgccccatttctttagactgtttagatcaaccgtgaagcaagtggacttttctgaggtggaacgggcgagattcatcataaacgactgggtcaagacccacactaaagggatgatatccaatctgctcggcaaaggagcagtggatcaattgaccaggttggttttagtgaacgccttgtacttcaatggacagtggaagacacccttccccgacagtagcacccatcgcaggctgttccacaaaagcgacggttccacggtgagcgttccgatgatggcacagactaataagttcaactatacagagtttaccactccagacggccattattatgacatcttggaactcccataccatggggacacactaagcatgttcatcgctgccccatatgagaaagaggtccccctatctgccttaactaacatcctttccgcacagttaatttcacactggaagggcaacatgactagactacctcggctgctggtactcccaaagttttcccttgaaactgaagtcgatttacggaagccacttgaaaacttggggatgacagatatgttccggcagtttcaggcagattttacatcgctgtccgatcaagagccactgcacgtcgcccaggcccttcagaaagtgaagatcgaagttaatgagtcgggcacagtggcaagttcttccaccgccgtaattgtctcagctaggatggctccagaagaaatcatcatggacagaccctttcttttcgtcgtgcggcataaccctaccggtaccgtactgttcatggggcaagttatggagccatag

SEQ ID NO: 26304 - DNA, 540 bp, Artificial Sequence
  Description of Artificial Sequence: Synthetic coding sequence
atgatggcccagaccaacaagttcaactacaccgagttcaccacccccgatgggcattattacgacattctggagctgccctatcacggcgataccctgtccatgtttatcgctgcaccatacgagaaagaggtgccgctctctgccttaaccaacattctgtccgcacagctgatatcacattggaagggcaacatgactcgtttacctaggctgctggtgctaccaaagttttcacttgaaactgaagtcgatctgcggaagcctcttgaaaacctgggcatgactgatatgtttcgacagtttcaggcagactttacgagcttgtcagaccaggagcctctgcacgtggcccaggctcttcaaaaagtgaaaatcgaggtaaatgagtcgggtacagttgcatcgagttccacagcagtaattgtgtcagcccggatggcgccagaggagattattatggaccgcccattccttttcgtcgttcgccacaacccaaccgggaccgtgctttttatggggcaggtgatggagccctag

SEQ ID NO: 26305 - DNA, 711 bp, Artificial Sequence
  Description of Artificial Sequence: Synthetic coding sequence
atgctgagcaagggcctgaagcggaagcgggaggaggaggaggagaaagaaccactggctgtggattcttggtggctagatccagggcatactgcagtcgcacaggcgcctccagcagtggcaagtagttcactgtttgatctgtcagtgcttaaattgcaccactctctgcagcagtctgaacctgacctcagacatctggtgctggtcgtgaacaccttgcgccgaatccaggctagcatggcccctgctgcagccctgccgcccgtcccatcaccacccgctgccccatcagtggccgacaaccttctcgctagctccgacgctgccctgagtgcaagcatggccagcctgttggaagacttgagccacatcgaaggattgtctcaggccccccagccccttgcagatgaaggcccccccgggcggtctataggtggcgccgccccaagcctgggagccttagacctgctggggcccgccaccggttgtttacttgacgacggcctggagggcctttttgaagatatagataccagcatgtacgataacgaattatgggcacccgctagtgaagggcttaagcccggccccgaagatgggcccggcaaggaggaggctcctgagcttgacgaggccgaacttgattacctcatggatgtcctcgtgggcacacaggccctggagcgccccccagggccaggccgctag

SEQ ID NO: 26306 - DNA, 1527 bp, Artificial Sequence
  Description of Artificial Sequence: Synthetic coding sequence
atgctgcccacccaggccggcgccgccgccgccctgggccggggcagcgcactcggcggtagccttaatcgtactcctaccggacgcccaggcggaggtggagggacgcgaggtgcaaatgggggtagagtgcctggtaacggtgcaggcctcggccctgggcgcctggagcgtgaggccgcagccgctgctgcaacaactccggctcccaccgcaggcgctctgtactccggtagcgaaggtgactccgagtcaggagaagaggaggaactgggtgctgagagaaggggcctgaagcgaagtctctccgagatggagattggcatggtcgtgggtggtcccgaagccagtgcagctgccaccgggggttatgggccagttagtggcgctgtatcgggggccaaaccgggaaagaagactcgtgggcgtgtcaaaattaagatggagttcatcgacaacaaactgagacggtataccacctttagcaagcgaaagactgggatcatgaaaaaagcctatgagcttagtactctgacagggacacaggtgcttctgctagtcgctagcgagacaggccacgtatacacttttgccactcggaaactgcagccaatgataacttccgaaaccgggaaagccctcatccaaacctgcctgaacagccccgattcaccgcctcgatcagatcccaccactgatcaaaggatgtccgcaactggattcgaggaaacagacttaacataccaggtatccgagtcagactctagtggcgaaaccaaggacacactcaagcctgcattcacagtgacaaatttaccagggactacaagcacgatccagacagccccctctacctcaacaaccatgcaggtgtcctcaggtccttcatttcccatcaccaactatctcgctcctgtctccgcttcagtgagccccagtgcggtatcttccgcaaacggaactgtccttaaatcaaccggctcgggacccgtgtccagcggtggattaatgcagctcccaacttcttttacactgatgcccgggggtgctgtggcacaacaagtgccggtccaagctatacaggtacaccaagccccacagcaagcgagcccctctagggactcatctactgacctgacacaaacttcctcaagcggaacggtgaccctacccgctactatcatgacatcgagcgttcccacgactgtcgggggtcacatgatgtatccatccccacacgcggtcatgtatgcgcctacctcaggtttgggagacggatcactgacagttctcaatgcgtttagtcaggctccttctacaatgcaagtgtcacactcccaagttcaggagccggggggggttcctcaggtgtttctcacagcttcatctggcacagttcagatacccgtctccgccgtgcaattacatcaaatggcagtcataggccaacaggcgggcagcagcagtaacttgaccgagctgcaggtggttaacctggatacagcacattctacaaaaagtgagtag

SEQ ID NO: 26307 - DNA, 915 bp, Artificial Sequence
  Description of Artificial Sequence: Synthetic coding sequence
atgatcaccagcgagaccggcaaggccctgatccagacctgcctgaactcacccgactcaccgccacgctccgacccaaccactgaccagcgaatgtcagccacagggtttgaggaaacagacctaacctatcaggtgagcgagagtgatagttctggcgaaacaaaggataccctgaagccagcctttactgtcaccaacttaccgggaactacatctaccattcaaacagccccaagcacatctaccacaatgcaggtttcctcgggtccaagcttccccattaccaactacctggcgccggtgtccgctagtgtcagtccctccgctgtgtctagcgccaacggaaccgtcctcaaaagcacgggtagcggacctgtgtcttccggaggtcttatgcagttgcctacctcattcacgctcatgccagggggcgcagtggcacagcaggtgccagtccaggctatccaggtccaccaggccccacagcaagcttcgcccagtagagatagttcaacagacctaacacagacgtcttcatcaggaactgtcacactccccgcaaccattatgacctcttcagtgcctactaccgtgggtgggcacatgatgtacccctctccccatgctgtgatgtatgctccaacctcagggttaggggacggtagtctaaccgttcttaatgccttctcccaagccccttccaccatgcaggtttcccactcccaggtgcaagagcccggaggcgtcccccaagtttttctcaccgcatcctccggtaccgtgcagattccagtgtccgcagtccagttacaccagatggccgtgatcgggcaacaggcaggatcctcaagcaatctaactgagctccaggtggtcaacttagataccgctcattcaacaaagtctgagtag

SEQ ID NO: 26308 - DNA, 834 bp, Artificial Sequence
  Description of Artificial Sequence: Synthetic coding sequence
atgagcgcccccgccgccaaggtgagcaagaaggagctgaacagcaatcatgacggagctgacgaaaccagcgaaaaggagcagcaagaggccattgagcacattgacgaggtccaaaatgaaatagacagacttaacgaacaagctagcgaggaaatacttaaagttgaacaaaagtacaataagttgcggcagcccttctttcagaagaggagtgagctgatagcaaagattccaaatttctgggtgaccacctttgtgaatcaccctcaagtgagcgcactcttaggcgaggaagacgaagaggcactgcactacctaaccagagtggaagtcactgagtttgaggatatcaagagtggctatagaatcgatttctacttcgatgaaaacccctatttcgaaaataaggtcctgtcaaaggagtttcatctgaatgagtccggcgatccatcatccaaaagcaccgaaataaaatggaagtcaggcaaagaccttaccaaacggtcaagtcaaacccagaacaaggcctctaggaaaagacagcacgaggaacctgagtccttcttcacatggttcaccgaccactccgatgccggagccgacgaactcggtgaagtcattaaggatgacatctggccgaacccgctccagtattatctggtccctgatatggatgatgaggagggggaaggggaagaagatgacgatgacgacgaggaagaagagggtctggaagacatcgacgaggagggcgatgaagatgagggtgaagaagatgaggatgatgatgagggagaagagggagaggaggatgaaggggaagatgattag

SEQ ID NO: 26309 - DNA, 798 bp, Artificial Sequence
  Description of Artificial Sequence: Synthetic coding sequence
atgccccggagccaccagccccccccccccccccacgagaaggagcagcaggaagctattgaacatatcgacgaagtacagaatgaaatcgacaggttgaacgagcaagccagtgaagagatcctaaaagttgagcagaagtacaacaaactccgccaaccatttttccagaagcggagcgagttaatcgccaaaatacccaacttctgggtgacaacattcgtgaatcatccccaggtctcagcgctcttgggtgaggaagatgaagaggcactacattacctgacgcgagtcgaagttaccgaattcgaagacataaaaagcggataccgcattgacttctactttgatgagaatccctattttgagaataaggtcctcagtaaagagtttcatctcaacgaatcaggggatccgagttccaaaagcactgagataaagtggaagtcaggaaaggatctgacaaaaagatcctcccaaacacagaacaaggcaagccggaagagacaacacgaagagcccgaaagcttcttcacctggtttacagaccactctgacgcgggcgcagatgaactgggagaagtgatcaaggatgatatctggcctaatccactccagtattacctggtgccggacatggatgacgaggagggcgaaggagaggaggatgatgacgacgacgaggaggaagaaggtctcgaggatatcgatgaggaaggagatgaggatgaaggggaggaagacgaagatgatgacgaaggggaggagggcgaggaggatgagggagaagacgactag

SEQ ID NO: 26310 - DNA, 801 bp, Artificial Sequence
  Description of Artificial Sequence: Synthetic coding sequence
atgatgccccggagccaccagccccccccccccccccacgagaaggaacagcaggaggctatagagcatattgatgaggttcaaaacgagattgatcgactaaatgaacaggctagcgaggagatcctgaaggtggaacagaagtataacaagctgcggcagccgtttttccagaaacggtccgaactgatcgccaagatacctaacttttgggtaacaaccttcgtgaatcatccccaggtcagcgcactgttgggcgaggaggatgaagaagccctgcactacctgactagagttgaggttactgagttcgaggatatcaaatctggatataggatcgacttttatttcgatgaaaatccgtactttgaaaacaaggtgctttccaaagagtttcacctgaacgagtccggagatcccagtagtaagtcaacagagataaaatggaaatcaggaaaggatctgacaaaaagatcctcacagactcagaacaaagcgtcaagaaagcgtcagcacgaagaaccagagtccttttttacttggtttacagaccatagcgacgctggtgctgacgagcttggcgaagtaattaaggatgatatctggcctaacccgttgcagtactacctggtgcctgatatggacgacgaggagggggaaggggaggaagacgacgacgatgacgaggaggaagaggggctggaagatattgacgaagaaggcgatgaggacgagggagaggaggacgaggatgacgatgaaggcgaggaaggggaagaagatgaaggcgaggatgactag

SEQ ID NO: 26311 - DNA, 873 bp, Artificial Sequence
  Description of Artificial Sequence: Synthetic coding sequence
atggcccccaagcggcagagccccctgcccccccagaagaagaagcctcgcccgcctccagcactcggccccgaggagacctcagcaagcgccggcctcccgaagaaaggcgagaaagagcagcaggaggcgattgagcatatcgacgaagtccaaaatgaaatcgaccggctcaacgagcaagcttcggaggaaatcctcaaggtcgagcagaagtataacaaattaaggcagcctttttttcagaagcggagcgagctgatcgccaagatcccaaatttttgggtaactaccttcgtaaaccacccacaggtgagcgcactgcttggagaggaggatgaggaagccctgcactacctaactcgagtggaggtcacggagttcgaggacataaagtccggctacaggatcgacttctatttcgacgaaaatccatatttcgagaacaaagtactttctaaggagttccatcttaatgaaagtggtgacccctcctctaaatcaaccgaaattaaatggaagtccgggaaggacctgacgaagcgttcctctcaaacacagaataaggcttcaagaaaaagacaacatgaagagcccgagtccttctttacttggtttacagaccatagcgatgcaggggctgatgagctcggcgaagttataaaggacgacatctggcctaacccccttcaatactacttggtgccagacatggacgatgaagagggagaaggagaagaagacgacgatgatgacgaagaggaagagggtctagaggatattgatgaggagggcgacgaggacgagggagaggaggacgaggatgatgacgagggagaggagggtgaagaggatgaaggtgaggacgactag

SEQ ID NO: 26312 - DNA, 807 bp, Artificial Sequence
  Description of Artificial Sequence: Synthetic coding sequence
atgggctgccgggacctgctgcccagcctgaagcccaccctgctggaaaaggagcagcaggaagccatcgaacacatcgacgaggtccagaatgagatcgatagactgaatgaacaggctagcgaggagatcctgaaagtggagcaaaaatataataaactgcgccagcctttcttccagaaaagatcggaactgatcgccaagatcccgaacttctgggtaactaccttcgttaaccaccctcaggtgagtgcactattaggtgaagaagatgaggaggcgctgcactatcttactcgcgttgaggttaccgaattcgaggacatcaagtctgggtatcgcattgacttttattttgatgaaaacccatatttcgagaacaaggtcctgagcaaggagttccatttgaacgagtccggagacccatctagtaagtcaactgagattaaatggaaatcagggaaagatctgacgaaacggtccagccagactcaaaataaggcaagcagaaaacgccaacacgaggaaccagagtctttctttacgtggttcaccgaccatagcgacgccggggccgacgagctgggcgaagtgatcaaagacgacatatggcccaatccactgcagtattacctggtgcctgacatggatgacgaggaaggggagggggaagaagatgacgatgacgacgaggaggaggagggcttggaggacatcgatgaggagggcgatgaggatgaaggggaggaggacgaggatgatgatgaaggtgaggaaggagaagaggacgagggggaagatgattag

SEQ ID NO: 26313 - DNA, 99 bp, Artificial Sequence
  Description of Artificial Sequence: Synthetic coding sequence
atggcccccaagcggcagagccccctgcccccccagaagaagaagcctaggccaccaccagccctaggtccagaagaaactagcgcaagtgccggatag

SEQ ID NO: 26314 - DNA, 942 bp, Artificial Sequence
  Description of Artificial Sequence: Synthetic coding sequence
atgaccggcaaggccaccccccccagcctgtacagctggcggggcgtgcttttcacatgtctacctgcagctagaacccgcaaaaggaaggagatgtcccgtcaaactgctacagcattgccaacaggtacttcaaaatgcccaccaagccagagggtccccgctctgacgggaacaaccgcatccaataacgacttggcgagccttttcgaatgcccggtgtgttttgactatgttctgccgcctatcttgcagtgccagtctggacatctagtttgttcaaattgccgacccaagctaacctgctgtccaacctgcagaggcccactgggatctatcaggaatctggcaatggagaaagtggctaacagtgtcctgtttccctgcaaatatgcctctagcggatgcgaaatcactctgccacacaccgaaaaagcagaccacgaggagctgtgtgagttccgcccttattcttgcccatgtccaggggcatcttgtaagtggcagggatccctggacgctgtcatgccccacctgatgcatcagcataaaagcatcaccaccttgcaaggggaggacatagtgtttctcgccacggacatcaatctccccggcgctgtggactgggtgatgatgcagtcttgtttcgggtttcactttatgctcgtgctggaaaaacaggagaagtacgatggccaccagcagtttttcgcaatagtgcagctaatcgggacaagaaaacaggcagaaaattttgcctacagactggagctcaacggacatcggcgaagacttacctgggaggctacgccccggtctattcatgaaggcatcgcaactgctatcatgaattctgattgcctagtattcgacacttccattgcccagctgttcgccgagaacgggaatctgggtatcaatgtcaccatatctatgtgctag

SEQ ID NO: 26315 - DNA, 897 bp, Artificial Sequence
  Description of Artificial Sequence: Synthetic coding sequence
atggtgatcatcatcttcctgctgcccccctacgtgttcatcagcgagatgtctagacaaacggccaccgcgcttcctacgggtacctccaaatgtcctccatcccagcgcgtgcctgcactcaccgggaccacagcaagtaacaatgatctggctagtctgtttgaatgtccagtctgcttcgattatgtcctcccaccaatcctgcagtgccagtccggccacctcgtttgctccaattgccgacccaaactaacctgttgtccaacttgtcgcgggccattaggttcgatccgaaaccttgccatggaaaaggtggccaactccgtgttgtttccatgcaaatatgcctctagcggttgtgaaatcactcttccccatacggagaaggcagatcacgaggaattgtgtgaattccggccctactcttgcccgtgtccaggtgcatcatgcaaatggcaagggagcctcgacgctgtgatgccgcacctcatgcaccagcataaatcaatcacaaccctgcagggggaggatatcgtgtttctagctaccgatattaacctgcctggggccgtggactgggtgatgatgcagtcctgttttggctttcacttcatgcttgtgcttgaaaaacaagagaagtacgacggccatcagcagttctttgccattgtgcagttgatcggcactcgcaaacaggccgagaatttcgcatacaggctggaattgaatgggcatcgccggcgactcacttgggaagccacaccgcgcagtatccatgaggggatcgctactgccatcatgaattccgattgcctagtgtttgatacatctatcgcccagttgtttgcagagaatggtaatctgggtataaatgtgactataagtatgtgctag

SEQ ID NO: 26316 - DNA, 849 bp, Artificial Sequence
  Description of Artificial Sequence: Synthetic coding sequence
atgagccggcagaccgccaccgccctgcccaccggcaccagcaagtgccctcctagccagagggtcccggccttgacagggactaccgcaagcaataatgacttggcctcgctttttgagtgtcctgtatgcttcgattacgtcttgcccccgatcctgcaatgccagagcggtcatcttgtgtgttccaactgtcggccaaagctgacttgctgccccacatgtaggggacctttgggcagtatccggaaccttgctatggaaaaggtagcaaattctgttctctttccgtgcaagtatgcaagctccggctgcgaaataaccctaccccatactgagaaagcagatcacgaagagttgtgcgaatttaggccttactcttgtccatgtcctggagccagctgcaaatggcaaggtagccttgatgccgtcatgccacatctgatgcaccagcataaaagcataaccaccttacaaggcgaggatatagtgttcctagcgacagacattaacctgccgggggctgtggattgggtgatgatgcagtcctgtttcgggttccacttcatgctggtgttagaaaagcaggaaaagtacgacggacatcaacagtttttcgccatagtccaacttatcggaacccgaaaacaagcggagaacttcgcctaccgacttgagctaaacggtcacaggcggcgcctgacttgggaggcaacaccacgatctattcacgaaggcatcgctaccgcaatcatgaatagtgattgtttagtgtttgacacttccatagctcagttgttcgcggaaaacggcaacctgggaataaatgtcactatctccatgtgttag

SEQ ID NO: 26317 - DNA, 708 bp, Artificial Sequence
  Description of Artificial Sequence: Synthetic coding sequence
atgaccttcgacctgaccaagatcaccaagaccagcagcagcttcgaagtaaggacatgggacccagagggcgtgatcttctacggggataccaatccaaaggatgactggttcatgctgggactgcgggacgggagaccagagattcagctgcataaccattgggcccagctcacagtgggcgccggtcctcgcctggatgatggtcggtggcatcaggttgaggtgaaaatggaaggggactcagtattactggaggtggacggtgaggaggtcctaagactgagacaggtctctggcccgctgacctccaagaggcatcctataatgcgcatcgcactcggcggtctcctgtttcctgcatctaacctcagactgcctttagttccagctctggatggctgcctgaggcgtgactcctggctggacaaacaggcagaaataagcgcatcggcgcccacctcgttacgcagctgcgatgtcgagtctaatccaggaatctttctaccgcctggcacccaggcggaatttaatctacgggatattccccagccacacgctgagccctgggccttttcattggacctgggactgaaacaggctgccgggagcggccatctgctcgcgctgggcacacccgagaaccccagctggctgagtctgcacctgcaggatcaggagaagacactacccccactctttgcctag

SEQ ID NO: 26318 - DNA, 1209 bp, Artificial Sequence
  Description of Artificial Sequence: Synthetic coding sequence
atggagagccggggccccctggccaccagccggctgctgctgctgctgctcttgcttctcctgcgtcatacccgtcaagggtgggcattgagacccgtgttgcccacacaatcagctcacgaccctccggcggtgcacctcagtaatggccccggccaggaacctatagccgtcatgactttcgatctaactaagatcaccaaaacctcatcctcattcgaagttagaacgtgggaccccgaaggggttatattctatggggacaccaatccgaaggacgattggtttatgcttgggctgagggatgggcgccccgagatccagcttcataatcactgggcccaattaactgtgggagcaggacctcgtcttgatgatggcaggtggcatcaagtggaagtgaaaatggaaggcgatagtgtgcttctggaggtcgatggagaggaagtgcttagacttcgccaggtgagcggccctctcacaagtaagaggcaccctatcatgcgaattgcactaggtggattactgttccctgcaagcaatctccgtctcccacttgtccccgcacttgacggttgtctgagacgggactcttggcttgataaacaggccgaaattagcgcttcagcacccacaagtctgagatcctgcgatgtcgagtctaatcccggtatctttttgccccctggaactcaagctgagttcaacctccgggatattccccaaccacacgcagagccttgggcattctctctggacctcgggctgaagcaggccgcaggctcaggccatcttctcgcgctgggcaccccagagaatccatcttggctgagcctccatcttcaagatcaaaaggttgtgctgtctagcgggtctggccccggcctggacctgcctctggtgttaggcctccctttacagctgaagctcagcatgtctagagtcgtcctatcacaaggtagcaaaatgaaggcactggccctgccacccctagggctcgcgccgttgctaaatctgtgggcaaagccacaaggacggctgtttttaggggcactgcctggtgaagatagttccacttccttttgcctcaatggtctctgggcacagggccaacgcttagacgtcgaccaggctctgaacaggagccatgaaatctggacccattcatgtccacagtcaccggggaacggaactgacgccagccactag

SEQ ID NO: 26319 - DNA, 882 bp, Artificial Sequence
  Description of Artificial Sequence: Synthetic coding sequence
atggagagccggggccccctggccaccagccggctgctgctgctgctgctgctactccttctgcgccacaccaggcagggctgggccctgcggccagtgctgcccacacaatccgcccacgacccacctgctgtccatctcagcaacggacctggccaggagcctatcgcggtcatgacatttgacttgactaagattactaagacaagctcgtcctttgaggtacgtacatgggatcccgagggcgttatcttctacggagatactaatcctaaggacgattggttcatgctcggcctgcgggacggtcgccctgaaatccagttacataatcattgggcgcaactcacagttggagccggcccgaggctcgacgatgggcgctggcaccaagtcgaggtgaagatggagggagactctgtgctgctggaggttgacggcgaggaggtgctccgcctcagacaggtaagtggcccactcacatccaagaggcatcctatcatgaggattgcactgggcggtctgttgttccccgcctcgaacctgaggttaccgctggtgccggcgcttgatggctgccttcgcagggattcctggctggacaagcaagccgaaattagtgcgagcgctcctacttcactgaggtcttgtgatgtagagtcgaaccccggcatatttttgccacccggcacacaagcggaatttaacttgcgagatatcccacagcctcacgccgagccatgggctttctcactggacctcgggctgaagcaggcggcaggctcagggcatctcttggctctcgggaccccagaaaacccaagctggttgagtctgcacctgcaggaccaggagaagactctgcctcccctcttcgcctag

SEQ ID NO: 26320 - DNA, 720 bp, Artificial Sequence
  Description of Artificial Sequence: Synthetic coding sequence
atggagagccggggccccctggccaccagccggctgctgctgctgctgctgctcctgctgctccggcataccagacaggggtgggccctgagaccagtattgcccactcaaagcgcacatgatcccccagctgtccatctgagcaacggccctgggcaggaaccaatcgccgtgatgacttttgacctgaccaagattacgaagacctcctccagtttcgaggtccgcacatgggacccagagggcgtcatcttttatggtgatacaaatcccaaggacgattggttcatgctaggtctgagggatggacgcccagaaatccagttgcacaaccattgggcacagctgaccgtgggcgcaggacctcgcttagatgatggacgctggcaccaacttgtgcctgcactggacggatgcctgcgcagggatagctggctggacaagcaggccgagatctctgcgtccgctccgacttcacttaggtcatgcgatgtcgaaagtaaccccggaatctttctcccccccgggacacaggctgaattcaacttgcgcgatatcccacagccccacgcggagccgtgggcattttcactggacctgggcttgaagcaggcggcaggctctggccatctgctcgctctcgggactccagagaatcccagttggctgagcctccacctccaagatcaagagaagaccctgcctcccctgttcgcatag

SEQ ID NO: 26321 - DNA, 864 bp, Artificial Sequence
  Description of Artificial Sequence: Synthetic coding sequence
atggagagccggggccccctggccaccagccggctgctgctgctgctcttgctgttgttgcttcgccacactcgacagggctgggccctccgccccgtgttgccaactcagagcgcccacgacccacccgcagtccacctgagcaatggcccaggccaggagcctatagcagtcatgacattcgaccttaccaaaattactaagactagtagttcttttgaggtcagaacgtgggaccccgagggagtcattttttacggggacacaaaccctaaggacgattggtttatgctcggactgcgggatggccgtcccgagattcagctgcataatcactgggctcagctgactgtgggtgccgggccgaggttggatgatggcagatggcaccaggttgaagttaaaatggagggcgatagtgtactccttgaggtggatggggaagaagtactccggttaagacaggtgtcggggcccctgacttcaaagcgccacccaatcatgagaattgcactaggcggactcctcttccctgccagcaacctgcgtttgcctctggtccctgccttggacggatgtttgaggcgagactcctggctggataagcaggcagagataagcgcgtctgcccctacaagcctgagatcatgtgacgttgagtctaatccaggcatattcttgcctccgggaactcaagcagaattcaatctgagaggtgaggacagtagtacctcattctgtctgaacggattatgggcccaggggcagagactggatgtggaccaggcactaaatagatcccacgaaatctggactcactcatgcccccagagtcccggcaacgggaccgacgcctcccattag

SEQ ID NO: 26322 - DNA, 423 bp, Artificial Sequence
  Description of Artificial Sequence: Synthetic coding sequence
atggagagccggggccccctggccaccagccggctgctgctgctgctcttattgctccttctgcgccatacgcggcagggatgggctctccgacccgtgctgcccacccagtctgcccacgacccccccgcggtgcacctgagcaacggacctggccaggagcccatcgccgtcatgacgttcgacctgactaagattacaaagacgtcctcctccttcgaggtccgcacctgggatcctgaaggtgttatcttttatggtgacaccaacccaaaagatgactggtttatgcttggtttgcgtgacgggagacccgagatccaactccataatcactgggctcagctgaccgtaggggccggacctagactggacgatggacggtggcaccaggagaaaaccttaccgcccctgtttgcctag

SEQ ID NO: 26323 - DNA, 1155 bp, Artificial Sequence
  Description of Artificial Sequence: Synthetic coding sequence
atggagagccggggccccctggccaccagccggctgctgctgctgcttctgctccttctgttgcgacacactaggcagggatgggctctgcgccctgtgctaccaacacagtccgcccacgatcctccagcagtacacctgagtaatggccccggtcaggagccgatagccgtgatgactttcgatttgactaagattaccaagacctcatcttccttcgaggtccgcacttgggatcctgagggcgttatcttttacggggatacaaaccctaaggacgattggttcatgttaggactgagagatggcagacccgaaatccagctacataaccactgggcccaattgacagtgggcgctggcccgcgacttgacgatggacggtggcaccaggtggaagtgaagatggagggggatagtgtcctgctggaggtggatggggaagaagtgctccgactcaggcaggtgagcggtccactcacctcaaagaggcaccccatcatgcgaattgcgctcggcggcctgctcttcccagcgtctaatcttaggctgcctgctgaaatatcagcatccgctccaaccagtttaagaagttgtgacgttgagtctaatccgggaatcttcctccctcctgggacacaggctgagttcaaccttcgcgatattcctcaaccccatgctgaaccgtgggcgttttctctggacttgggccttaaacaagcagccggatcaggtcatcttttggcgctcggcacccccgagaatccctcttggctctcgttgcatttacaagatcagaaggtcgtcctgtcaagtggctccggcccaggcctggacctgcctttagtgctgggcttgcctctccagctcaagctgagcatgtctcgggtggtcctgtcacaggggtcaaagatgaaggctctggcccttcctcccttgggccttgcgcctctcctcaacctttgggctaaaccacagggccggctgtttctaggggcacttcctggcgaggatagttctaccagcttctgtttaaacggactgtgggcacaaggtcagagactggacgtggaccaagctctcaacaggagccacgagatctggactcactcgtgccctcaatctcctggcaatggaaccgatgcctctcactag

SEQ ID NO: 26324 - DNA, 1116 bp, Artificial Sequence
  Description of Artificial Sequence: Synthetic coding sequence
atgagccccagcaccttccagatcaccgacatgacccggcggagctgccagaatttgggttacacagcagcttcgcctcaggcgcccgaggcagcatccaataccggtaacgctgagcgggcggaggaggtgccgggagaagggtcgctcttcttacaggctgaaacaagagcttggtttcagaagacccaagcccattggttgctgcagcatggcgcagcccctgcctggttccacggattcataacgaggcgcgaagccgagagattgctggaaccaaaacctcagggctgctaccttgttagattttcagagtctgctgttacttttgtgctgacatatcggagcagaacatgctgcaggcacttcctgttggcccagcttagggatggccgccatgtggttctgggagaggatagcgcacacgcacgcctgcaggacctactgctccactacacagcgcaccccctctctccatacggcgaaaccttgacagaacctctggcacgacagacgcctgagccagccgggcttagtttacgcacagaggaaagtaattttggaagcaagagccaggaccctaatccacagtattctcccattatcaaacagggccaagcccctgtccctatgcagaaggagggcgccggcgaaaaggaacccagccagctactccgccctaaaccacctatccctgcaaagcctcaacttcctcctgaagtgtacaccatacccgtgccaaggcataggccagcccccagaccaaaaccaagcaatccgatttataacgagcctgacgaaccaattgcgttctatgcaatgggcagaggctctccaggtgaggcaccctctaacatctacgtcgaagtagaagacgaaggactgccagccaccctgggccatccagtgttaaggaaatcctggagccgtcccgttccaggtggccaaaatacggggggctctcagctgcattctgaaaattccgtgatcggacagggccctcccctgccccatcaacctcctcccgcttggcgacacacgctgccccacaacttgtcaagacaggtgctccaggatcggggacaggcctggcttccactggggccacctcagtag

SEQ ID NO: 26325 - DNA, 1170 bp, Artificial Sequence
  Description of Artificial Sequence: Synthetic coding sequence
atggagttccccctggcccagatctgcccccagggcagccacgaggcaccaattccaacgttcagcacgtttcagattacagacatgacccggcggagctgtcagaatctaggttataccgcagctagccctcaagcccccgaagctgcatctaacaccggcaatgctgagcgcgccgaagaggtacctggagagggaagcttattcctccaagccgaaacgcgcgcgtggtttcagaagactcaggcacactggctcctgcagcatggcgcagctccagcttggtttcacggtttcattaccaggagggaggcagaaagattgctggaacctaaaccacagggctgctacttagtgaggttcagcgagtctgccgttaccttcgtcctcacttaccggtctaggacatgctgcagacattttttgttggctcagctcagagatgggcgtcatgttgtgcttggggaagattctgcacacgctcgtcttcaggatctgcttctgcattacactgcccatccattatcgccctacggcgaaaccctgacagaacccctggcgcgccaaactcctgaacctgcaggcctatcgctgcgcacagaggagtctaatttcggcagcaagagccaagacccaaatcctcaatatagtcctatcatcaagcagggtcaagctcctgtcccgatgcaaaaggaaggtgccggcgaaaaagagccctcacagttgctccggcctaaaccccccatcccagcaaagcctcagctgcccccagaagtgtacaccatccccgtcccccgacatagacctgctcctcgtccaaaacccagcaatccaatctataacgaacctgacgaacctattgccttttacgctatgggtagggggtcccccggcgaggccccaagcaacatatatgtggaagtcgaggacgaaggcctgcccgccacactggggcatccggtgttacggaagtcgtggagcaggccagttccaggaggtcagaatactggggggtctcagctgcattccgagaacagcgtgatcggtcaggggcccccgcttccacatcagccaccacccgcttggaggcacaccttacctcataacttgagtcgccaggtactgcaggaccgcggtcaggcctggcttcctctggggccccctcagtag

SEQ ID NO: 26326 - DNA, 1200 bp, Artificial Sequence
  Description of Artificial Sequence: Synthetic coding sequence
atggagttccccctggcccagatctgcccccagggcagccacgaggctcccattcctaccttcagtaccttccaaattacggacatgacgcgccggagttgtcaaaacctcggatacaccgctgcatccccccaagcccccgaggcagcaagcaatacaggtaatgcagagcgagcggaagaggtacccggagaaggcagcctttttttgcaagccgagactcgcgcatggttccagaaaacccaggcccactggctgctgcagcatggggctgcgcccgcctggtttcacggcttcatcacaaggagagttcgaccacccctctctgtgacacaccgagaggccgagcggctgcttgagcccaaaccccagggatgctatctggtccgtttcagtgagtctgctgtcaccttcgtgctgacctacagaagtcgaacatgctgcagacactttctcctcgcccaactgagggatggcagacatgtggtgttaggtgaggattccgcacacgcacgcctgcaagatcttttactgcattacacagctcaccctttgagtccctatggtgagaccctgactgaaccactggcccgacaaacaccagagccggcaggtctgtccttgcggaccgaagagtctaattttgggtcaaagtcccaagaccctaacccccaatactcacctatcatcaaacagggccaggcccctgtccctatgcagaaagagggtgcaggcgagaaggagccgtcgcagctgctgcggcccaaaccaccaattccggctaagccacaattgcctcctgaagtttacaccattcccgtccctcgacatagaccagcgccccggccaaagccttctaatcccatatataatgagcctgacgagcctattgctttttatgctatggggcgaggttcaccgggcgaagccccaagcaacatttacgtggaggtagaggatgaggggctgccagccactctcgggcaccccgtgcttcggaagagttggtctagaccggtccctggggggcagaacacaggcggctctcagctccacagcgagaatagcgtcattgggcagggcccccccctaccgcatcaaccccctcccgcttggaggcacaccttgccacacaacttaagccgccaggtcctgcaagatagaggacaggcgtggcttcccctgggacccccacaatag

SEQ ID NO: 26327 - DNA, 2823 bp, Artificial Sequence
  Description of Artificial Sequence: Synthetic coding sequence
atgatcctggagcagtacgtggtggtgagcaactacaagaagcaggagaatagtgagctgtcactgcaggcaggggaagttgtcgatgtgattgaaaagaatgagagtggctggtggttcgttagcacgagcgaggagcagggatgggtgcccgctacctaccttgaggcgcagaatgggacgagggatgacagtgatatcaacacctcgaagacaggcgaagaagagaaatatgttactgtgcagccctataccagtcagtccaaagacgagatcggttttgagaagggtgtgacagtggaggttatcaggaagaatctcgaggggtggtggtacattcgatatcttgggaaggaggggtgggcgcccgccagctacctgaagaaggccaaagacgatcttcccacacggaaaaagaacctggctgggcccgtggaaattataggaaatatcatggagattagcaatctgctgaacaagaaggcaagtggagacaaagagacccctcccgccgaaggggaaggacacgaagcccccatagcgaaaaaagaaattagcctcccgatcctgtgtaatgcctccaacggttccgcagttggcgtaccagaccggactgtaagccggctcgcacagggttctcctgccgtggcacggatcgcaccccagcgggctcagatctcaagtccaaatctaaggacacgcccaccaccgagaagagagtcttctcttgggtttcaactgcctaaaccccccgagccgcccagcgtggaggtggaatattacactattgccgaattccagtcctgtatttctgatgggatctctttccggggaggacaaaaagctgaagtgatcgacaaaaatagcggagggtggtggtatgtgcagatcggcgagaaggagggttgggcaccagccagctacatagacaagcgaaaaaagcctaatcttagccgccggacctccacccttactcgacccaaagtgcccccaccagctccaccatctaagccaaaggaggcagaagaaggacctacgggagccagcgaatcccaggacagtccaagaaagctgaaatacgaggaacccgagtatgatatccccgcgtttggattcgactccgagcccgaactatccgaagagcctgtggaagacagggcttcaggggagcggaggcccgctcagcctcacaggcccagccccgcctcctccctccaaagggcccgctttaaggtcggcgaatctagcgaagacgttgcgctcgaagaggagactatctatgagaacgaaggatttaggccatacgctgaggacactctctccgctcgtgggtcgtctggggactctgactccccagggtcctccagcctgagcctgacaagaaaaaatagtcccaaatctggctctcccaagagttcaagcctcctgaagcttaaagccgaaaagaacgctcaggccgaaatggggaaaaaccactcctctgcctcattctcaagttctatcacaattaacacaacctgctgtagttcctcatcgtctagttctagcagtctgtctaaaacatccggtgaccttaagccccgctcagcctcagatgccgggattagagggactcccaaagtacgagccaagaaggatgcagacgctaacgctgggttgactagttgcccccgggcaaagccctccgtgcggccgaagccctttctgaatagagccgagtcgcagtcccaggaaaagatggatatttccaccctgagacggcagctgaggccgacaggccaactgagaggcggcttgaagggctctaaaagtgaagacagcgagctccctccacaaacggctagcgaggctccctctgaaggctcacgcagaagcagtagcgacctgattaccttacctgcaactaccccaccctgtccaaccaaaaaggaatgggaagggcctgcaacgtcctatatgacctgctccgcttatcagaaagttcaagactcagaaatctctttccccgcaggggtggaggtccaggtgctggagaagcaggagtcagggtggtggtatgtgcgctttggggagcttgaagggtgggcccccagccattacctggtgctcgatgaaaacgaacaaccagatccctctgggaaggaattagacaccgtccccgctaagggaagacaaaatgagggcaagtctgatagtcttgagaaaatcgaacgccgcgtccaagcgctgaacacagtaaatcaatccaagaaggcaactccccccattccaagcaaaccaccaggcgggttcgggaagacctctggaactcctgcagtgaagatgcgcaatggcgttcggcaggtagcagttaggccccagagcgtgtttgtatcgcctccccctaaggacaataatctcagttgtgcactgcgtagaaatgaatcactgaccgcaaccgacggcctaaggggcgtccgtaggaactcttcattctccaccgctaggtcagcagctgccgaagcgaagggcagattagcggagcgagcagcctctcagggctctgactctccccttcttccggctcagaggaattccattcccgtctctccagtgaggcctaaaccaatcgagaagagccagtttattcataataacctcaaagatgtctatgtgagcattgccgattacgaaggcgatgaggagaccgccggattccaggagggggtatccatggaggtattggagcggaatccaaacggctggtggtactgtcagatcctcgatggcgtgaaacccttcaaaggctgggtccccagcaattacctggagaaaaagaactag

SEQ ID NO: 26328 - DNA, 3318 bp, Artificial Sequence
  Description of Artificial Sequence: Synthetic coding sequence
atgctggcctactgcgtgcaggacgccaccgtggtggacgtggagaagcgacggaacccatctaaacactacgtgtacatcataaacgttacttggagcgactccaccagtcagacgatttatcgcaggtacagcaaattcttcgacctgcaaatgcagttgcttgataagtttccaatcgagggggggcagaaagatccgaaacaaagaattataccttttctgccagggaagattttattcagacggagtcatatcagagacgtcgctgtcaaacgactcaagcccattgatgagtactgtcgcgcattagtgcggctacctccgcatattagccagtgcgatgaggtgtttagattttttgaggcccgaccagaagatgtgaatcccccaaaagaggactacggatccagcaagagaaagagcgtctggctctcaagttgggccgagtcacctaaaaaggacgtcacgggagccgacgcaaccgcagagccaatgatcctggagcaatacgtcgtggtgtcgaactacaagaagcaggaaaactctgagctgtcgttgcaggccggcgaggtggtggatgtaattgagaagaatgagagtggctggtggtttgtgtcaacctccgaagagcagggctgggttcctgccacatacttagaagcccagaacgggactcgcgacgatagcgatatcaacacgagtaaaacaggggaggaggagaagtacgtgactgttcagccctacaccagccagtctaaggatgaaatcggtttcgagaagggcgttaccgtagaagttattaggaagaatctggaggggtggtggtacatacgctaccttggcaaagaaggctgggcccccgctagctacctgaaaaaagcgaaggacgacttgccaacccggaagaaaaacctcgctgggcctgtggaaattattggcaatattatggaaattagtaatttgctgaataaaaaggcgagtggtgacaaggagacgccccctgccgagggcgagggtcacgaggctcctattgccaaaaaggaaatctcgctgcccattctgtgcaacgcttcgaatggctctgccgtgggagtccctgatcggacagtgagcagactagctcagggcagtccggcagtggccaggatcgcgccgcagcgggctcaaattagtagccctaatctgcgcaccaggcctccaccccgccgggaaagttcactcggcttccagctgcctaagcccccggaaccccccagcgtggaggtagaatattacaccattgctgagtttcaaagttgtatttcagacggaatctctttccggggagggcagaaagcggaggtgatagataaaaattccggaggctggtggtatgtgcagatcggcgagaaggaaggatgggcccccgcctcttacatcgataagagaaagaagcctaacctcagcaggagaaccagcacactcacgaggcccaaggtccccccccccgcgccccctagcaaacccaaagaggctgaggagggccccacgggagcgtcagaaagtcaggactctccccgcaagttaaagtatgaagaacccgagtatgatatccctgcctttgggttcgacagcgaaccagaactctccgaggagcctgttgaggatagagcctctggagaaaggaggccagcacaaccccaccggccctctcccgcatcttcattgcagcgagcccgttttaaggtgggagaaagttccgaggacgtggcactcgaggaagagaccatttacgaaaacgagggcttcaggccttatgccgaggacaccctgtcagccaggggctcgtcaggggactccgattcccctggctcctcttcactgtccctgactcgaaagaattcccctaaatcaggctcccccaaatcttcttctttacttaaactgaaagccgaaaagaatgctcaggccgagatgggcaagaatcatagcagcgcatcatttagcagttctataaccattaatacgacctgttgttcaagcagtagcagctcaagttcgagcttatcgaaaacaagcggggatctgaaacctagaagcgcttcagatgctggtatccgcggaacacctaaggtcagggccaagaaggatgcggatgccaacgcgggactgacgagctgtccccgtgccaaaccaagcgtaagacctaagcctttcctcaatagggcagagagtcagtctcaagaaaaaatggacatcagcactttgagaagacagttaagaccaaccggccagctccgcgggggtctgaaaggctcaaagtccgaggacagtgagttacccccccagactgcatcagaagcaccttccgaaggaagtagacgttcttcaagcgacctgatcacattgcctgcgacaacaccgccatgccccaccaaaaaggagtgggagggcccggccactagctacatgacatgcagcgcataccagaaggtccaagatagtgagatttctttccccgccggtgtcgaagtgcaagtactcgagaaacaggagagtggttggtggtatgtgcgatttggagagctggaagggtgggccccgtcacactatctggtgttggatgaaaatgaacagcctgatccctccggaaaggaactcgatactgtccctgcgaaggggcggcagaacgaaggaaagagtgatagccttgagaaaatcgagcgcagggtacaggccctcaacactgtcaaccagtctaagaaagccacacctccaattccctctaaacccccagggggcttcggcaaaactagtgggacgcctgctgtcaaaatgcggaatggagttcgtcaagtggccgtcagaccacagagtgtgtttgttagtccaccacccaaagataataacctatcatgtgccctacggaggaacgaatctctgaccgccacggacgggttgagaggcgtgaggcgaaatagcagttttagcacagcgagatccgccgctgcagaggccaaaggacgcctagccgaacgggctgcatcacagggatcagattcaccactgttgccagcccaaagaaatagtattcccgtatctccagtgaggcccaagccaattgagaagtctcagtttatccacaacaatctcaaggacgtgtatgtttccatagccgactatgaaggtgacgaagagacggccgggttccaggaaggcgtaagtatggaggtcctcgagcggaatcccaacggatggtggtactgtcaaatcttagatggtgtaaagcctttcaagggctgggtcccatctaactacctggaaaaaaagaactag

SEQ ID NO: 26329 - DNA, 3402 bp, Artificial Sequence
  Description of Artificial Sequence: Synthetic coding sequence
atgctggcctactgcgtgcaggacgccaccgtggtggacgtggagaagaggcgcaatcccagtaagcactatgtttacatcatcaatgtgacctggagcgacagcacgtctcagacaatttatagaaggtatagcaaattttttgatttacagatgcagctgctcgataaatttcctatcgaaggggggcaaaaggatcccaaacagagaataattcccttcctcccaggtaagatcctattccggcggtcccatatcagggacgtcgcagtgaagcgtctcaagcccatagacgagtactgtcgcgccctcgtacgtctaccccctcatatctcccaatgcgatgaagtgttccgcttctttgaggccagaccagaggacgtcaaccctcccaaggaggattacggttcatctaaaagaaagagcgtttggctgagttcctgggccgaatctccaaagaaggatgtgaccggggctgacgccacagctgagcccatgattctcgagcaatacgtagtggtctcaaactacaagaagcaagagaattctgaactgagcctccaagcaggtgaggttgtggatgtcattgagaagaatgaaagtgggtggtggtttgtttcaacatccgaggagcaagggtgggtgcctgccacatacctggaagcgcaaaatggaactagggacgacagcgatatcaatacgtccaaaaccggggaagtttccaaaagaagaaaagctcacctgcgaagactggatagacgatggacactggggggtatggtgaaccgccaacatagcagagaagaaaagtacgtcacagtccaaccatacacttcacagtcaaaagacgagatcgggtttgaaaaaggggttaccgtagaggtcattagaaagaacctggagggttggtggtatataagataccttggaaaagagggctgggcacctgcgagttatctgaaaaaagcaaaggatgacttaccgacccgtaagaaaaatctagccggtcccgtggagattatcggtaatatcatggaaatctctaacttgctgaacaagaaagcatcaggggataaggaaacacctcccgccgagggcgaggggcacgaggcacccattgcgaaaaaggaaatcagtctgcccatcttgtgtaacgcctcgaatggttcggcagtcggggtccctgatagaaccgtgtcacgactggcccagggaagccccgctgttgcacgcatcgctcctcagcgagctcagatttcctctccgaacctacgcacccgcccacctcctcgtcgtgagtcttcattggggtttcagctgcctaaaccacccgaacctccaagcgtcgaagtggaatactatacaattgccgagtttcagtcctgcatatctgatggcatatcgttcaggggcggtcagaaggcagaagtgatcgacaagaactctgggggatggtggtacgtacaaataggtgaaaaagagggctgggcccctgcctcttacatcgataagcggaagaagccaaacctcagccgacggacaagtactctaacacggccgaaggtgccgcctcctgctccaccctccaagcccaaagaggctgaggagggacccacgggagcctcagagtctcaagattcgccccgaaaacttaaatatgaggaaccggaatacgacatcccagcctttggtttcgacagcgaaccagagttgtctgaggagccagtggaggacagggcctccggcgagaggaggcctgcccaacctcaccggccttccccagctagctcactgcagcgggctagattcaaggtaggcgaatctagtgaggacgtcgccctcgaagaagaaaccatctacgaaaacgaggggttccgcccctacgctgaagacactttgagcgctcggggcagttctggagattccgacagtcctggcagtagcagcctatctttaactagaaaaaattccccgaagagcggatcacctaagagttccagcctgctcaaactcaaagctgaaaagaatgctcaggcagagatgggtaagaatcacagctccgccagttttagctcttctatcactattaatacaacttgctgctcatcttcttcgtctagcagctcatctttgtcaaaaacttcgggtgacctaaagcctcgcagcgccagcgatgccggcatccgcggtacccccaaggtgcgggccaagaaagacgccgatgccaatgctggactgacttcctgcccccgtgctaaaccgtctgtgaggccaaagccattccttaatagggctgaatctcagtctcaggaaaaaatggacattagcacgctgcgtaggcagcttcgccctactgggcaactgcgcggcggactgaaaggctccaaatccgaagatagtgaattacctcctcagacggcctccgaggcaccctcagagggcagcagacggtcaagtagtgacctaattacactgccagccactacaccaccctgtcctactaaaaaagaatgggagggacctgccacatcttacatgacctgtagtgcatatcagaaagtgcaggatagcgagatttcttttccagctggcgtcgaagttcaggtgctcgaaaaacaggaaagtggatggtggtacgtgaggttcggggaactggagggctgggccccaagccactatctggtgctggatgaaaatgaacagcccgacccttccggaaaggaactggacacggtgcccgcgaaaggacgccagaatgagggcaaaagtgattcactggaaaaaatcgagaggagggtacaggcacttaacacggtgaaccagagtaaaaaggccaccccaccaataccctccaaaccccctggggggttcggcaagacctccggcacgcccgccgtgaaaatgagaaatggggttaggcaggtggccgtccggccccagtctgttttcgttagccctccaccaaaggacaataacctcagctgtgccctgcgacgtaacgagtccctcacagccaccgacggcctgcgaggagtgaggaggaattcaagctttagcacagctcgtagcgcggctgcagaggctaagggtagactggctgaacgggccgcatctcagggttctgactcaccactgctgcctgcacagcgaaacagcattcctgtctcaccagtaagacccaaacccatcgaaaagtcccagtttatccataacaacctgaaagacgtatacgtgagcatcgctgattacgagggcgatgaggagactgctggattccaggagggggtgagcatggaagtgcttgagcgcaacccaaacggttggtggtattgtcagattctggatggcgtgaaaccatttaaaggctgggtcccctccaactacctagaaaaaaaaaattag

SEQ ID NO: 26330 - DNA, 3183 bp, Artificial Sequence
  Description of Artificial Sequence: Synthetic coding sequence
tgattcttcgacctgcagatgcagctgctggacaagttccccatcgaaggcggccaaaaagatcctaagcagcgaatcattccctttttgcccggcaaaattctcttcagaaggtcccacattagagatgtagcagtgaagaggctgaagccaattgacgaatattgtcgggccctagtgagactgccacctcacatctcccagtgtgacgaagtgttccggttcttcgaagcaaggcctgaggatgtgaaccctcctaaggaagactacggttcgtccaagagaaaaagcgtgtggctcagctcttgggcggaatcacccaaaaaagatgttaccggagcagatgccacagccgagcccatgatcctcgagcagtacgtcgtggtttcaaattataagaagcaggagaacagcgaactctccttacaggctggcgaggtggtcgatgtcatcgaaaagaatgaaagcggatggtggttcgtctctacaagtgaagagcaaggctgggtacccgccacttatttagaagctcagaatgggacccgagatgattctgacattaacactagcaaaactggtgaggaagagaagtatgtgaccgtccagccttacacttcacaatcaaaagacgaaatcggattcgaaaaaggagtgaccgtagaggtcattaggaagaacctggagggatggtggtacattcgatacctcggcaaagaaggctgggcccccgctagttacctgaaaaaggcaaaagacgacctgccgacacggaaaaaaaatttggccggccccgtcgagataatcggcaatataatggagatcagcaatctcctgaacaagaaagcttcaggagataaagaaacacctcctgcagaaggagaaggccatgaagcgccaattgcaaagaaggagatctcacttccaatcctgtgcaatgccagtaacgggtctgccgtcggcgtccctgaccgcaccgtttcccgtctggcacaggggtcacccgcggtcgctagaattgccccacagcgggcccagatttcaagtcccaatcttaggacgagaccacctcctcgccgggagtccagcctgggttttcagctcccaaaacccccagagccacccagcgtggaagttgagtattacacgattgccgaatttcagtcatgtatttccgatggaatctctttcagaggtggtcaaaaagcagaggtgatcgataaaaatagtggtggttggtggtatgtacagatcggggaaaaagaagggtgggccccagctagctatatcgataagaggaagaaacctaacctcagcagaaggacatctactcttactcgtccaaaagtgccccctcctgcccctccgtcaaaaccaaaggaggccgaggagggccccactggtgcgtccgaaagtcaggactccccgcgcaagcttaagtacgaggaacccgagtacgatatccccgcttttggctttgactcagaaccggagctcagtgaggagcctgtggaagatagggcctccggagaacgtcggccggcccagccacaccgcccaagccctgctagctcccttcagcgtgcgcgattcaaggtgggagagtccagcgaggacgtggctttagaggaagaaacaatctacgaaaatgaagggtttagaccttacgcagaagacaccctctctgcccgcggctccagtggagacagcgattcacctggtagttcttctctgtcactgacccgcaagaactcaccaaagagcggatcacctaagagcagcagccttcttaagctgaaagccgaaaaaaatgcccaggctgagatgggtaaaaaccatagctccgcgtcattcagcagcagcattaccattaataccacgtgctgctcaagcagctcctccagctcatcgagcctttctaagacctccggggacctgaagccacgttctgccagtgacgcgggcattagaggaactcctaaggtcagagctaaaaaagatgccgacgcaaacgccggactcacgtcttgcccccgtgcaaagccttcagtgcggcctaagccctttctgaatcgggccgagtcgcaatcacaagagaagatggatatctcgaccctgcgccggcagttacgccccacaggtcaacttaggggcggtctaaagggatccaaatcagaagacagcgagcttcccccccaaaccgcttcagaagctccctcagagggatcgcgaaggtccagcagcgacttgattactctacccgccacaaccccgccttgtcccaccaaaaaggaatgggaagggccagctacatcctatatgacctgcagcgcctaccagaaggtgcaagactccgagatcagttttcctgccggtgttgaagtccaagtactggaaaagcaggaaagtggctggtggtatgtgagattcggcgagctagaaggatgggccccaagtcactacctggtgctggacgagaacgagcagcccgatccatctggcaaggaactggacacagtgcctgctaaaggtcgccagaatgaggggaagagcgactcactggagaaaattgagcggcgcgtgcaggcactgaacacagttaatcaaagcaaaaaagcaactcctcccattccaagcaaacctccaggaggatttggcaaaacatccgggacgcccgctgtgaagatgcgcaacggcgtgcggcaggtagctgtgcgtccacagtcggtgtttgtatcccctccaccaaaggacaataacctgtcttgcgcccttcgccgtaatgaatcactgactgccaccgacgggctgaggggagtgcgcagaaactcatctttctccaccgcacggtccgccgcggccgaagccaaaggccgcctcgccgaacgggccgcttctcaggggagtgactcgccacttttgcctgcccagcggaacagcattcctgtgagccccgttcggcccaaaccaatcgaaaagagtcaatttatacataacaacctgaaagacgtttacgttagtattgcagattacgaaggggacgaagagacggctgggttccaggaaggggtgtccatggaagtactggagagaaatcctaatggttggtggtattgccagattctcgatggagtgaagccatttaaaggctgggtacccagcaactacctcgaaaaaaaaaactag

SEQ ID NO: 26331 - DNA, 1110 bp, Artificial Sequence
  Description of Artificial Sequence: Synthetic coding sequence
atgagcatctgctgctgcttcttcttccgggactacggcagcagcaaaaggaaatccggggccgatgccactgctgagccaatgatcttagagcagtacgtggttgtgagtaactataaaaagcaggaaaattctgaactctccctgcaggccggcgaagtggtagacgtgatcgagaagaatgagagtgggtggtggtttgtctctacatccgaagagcagggatgggtaccagcaacctatttagaggcccaaaacggcaccagggatgatagcgacatcaacacctctaaaacaggcgaggtgtccaaacggcgaaaggcccacctgcgcagactggatagacgctggacactaggggggatggtgaatcggcaacactccagagaagaaaagtacgttactgtccagccatatacctctcagtctaaggacgaaattgggtttgagaaaggtgtgaccgtcgaggtcatcagaaagaatctcgagggctggtggtatatcaggtacctgggaaaagaaggttgggccccggcttcatatctgaagaaggccaaggacgacctcccaacaagaaaaaagaacctcgccggcccggtggagatcattggaaacattatggagatcagcaatctgctgaataagaaggcaagcggggacaaggagacaccccccgctgagggagagggccatgaagctccaatcgctaagaaagagatttcattaccaatcctttgtaacgcatccaatggctctgctgttggagtaccagacaggacagtgtcacggcttgcccaggggtccccagccgtggctaggattgcccctcagagagcccagattagctctccaaatctccgaacacgccctccaccgcggcgcgaatcctccctcacggagtccagatgccggcaggcgggggtgcagtggcatgacttgggctctcttcagtctccacatcctcgattcaaaagatttagctgtctatccctcctgtcttcctgggatcaccgccacatgccaccgcacccagccaactttctgatttttttgattgaaaccggctttcaccacgtagggcaggacgggctgcatttgctgacctcttag

SEQ ID NO: 26332 - DNA, 2898 bp, Artificial Sequence
  Description of Artificial Sequence: Synthetic coding sequence
atgcccgtgaccgccaccggcaagatcctgttccggcggagccacatccgagacgtggccgtcaagaggctgaagcccatagacgaatattgccgggcactggtccggctccccccccatataagccagtgcgatgaggtgttcaggttcttcgaggctcgccctgaagacgtcaacccccccaaagaggattacgggagttccaagcggaaaagcggagctgatgcaaccgcggagccgatgatcctggagcagtacgtggtggtctccaactataaaaagcaggagaactccgaactttcgctccaggccggggaggtggtggatgtgattgagaaaaatgagagcggctggtggtttgtctccacatccgaggaacagggatgggtcccagccacgtatctggaagcccaaaacggtacacgagacgattctgatataaacacttccaaaacaggtgaagtctcaaagcggaggaaggcccaccttagacgacttgatcgacgctggaccctcggagggatggtgaacagacagcacagcagagaggaaaaatatgtcaccgtgcagccgtatacttcacagagcaaggacgaaatcgggtttgagaagggagttaccgtggaggtcattcgtaagaaccttgaggggtggtggtacatccggtacttggggaaagagggatgggctcctgcctcttatctgaaaaaggccaaggacgacctgcccacacgaaagaagaacttggcaggccccgttgaaattatcggcaacattatggagatcagtaatctgttgaacaaaaaggcgtcaggcgataaggagacaccccctgctgaaggggaaggtcacgaagctcccatcgccaaaaaggaaatctccctgcccattctctgtaacgctagcaacggatcagccgtgggtgtgccagacagaactgtctcacgactggcccagggtagccccgcagttgcacggatagcgccgcagcgggcccagatctctagtcccaatttacggacccgaccgccgcctcggcgagaatcgtctttaggattccagctgcccaaacctcctgagccaccatctgtcgaagtcgagtactacactatcgccgagttccaatcttgcattagcgatggaatctcatttaggggcggacagaaggccgaggtgatcgacaagaacagcgggggctggtggtatgtgcagatcggtgagaaagagggctgggcccctgctagttatatagacaagcgcaagaaacccaacctttcgcgccggacctcaacactgactcggccaaaagtgccaccacccgcccctcccagtaaaccaaaagaggccgaagaggggccaaccggggcgtccgaatctcaggactcccccaggaaactcaaatatgaagaacccgagtacgatattcccgcttttggattcgattcagaacccgagctcagcgaagagcccgttgaggatcgcgctagtggagagcgaagacccgcccagccacatagaccaagtcccgcgtcatcactacagcgagcacggtttaaggtgggcgaatcttccgaggatgtggccctggaagaagaaactatttatgaaaatgaggggtttaggccctatgccgaggacaccctatccgcgcgtggaagctctggagatagcgattccccagggagctcttctctctcgctaactcggaagaattccccaaaaagtggctctcccaagtcatccagtctgttaaagttaaaagcagagaagaacgcccaggccgagatgggtaagaaccacagctcggcatctttttcatctagtatcaccataaatacaacatgctgtagcagcagctcaagctccagtagctccctgtctaagacaagcggcgatctaaagcccaggtctgcgagcgacgctggaatccggggaaccccaaaagtcagagctaagaaggatgctgatgctaacgctggcctgacttcctgccccagggcgaaaccaagcgtcagacccaagccgttcctgaaccgagccgagagtcagagccaggaaaaaatggacattagcacgctgagacgccagctcaggcccaccgggcagctcaggggcggcttaaagggtagtaaaagcgaagattccgagctcccaccccagactgcgtccgaagctccgtcagaaggctcaagacgcagcagttccgatttgattacccttcctgcgaccacccccccctgtcctaccaaaaaagaatgggagggcccagcaacctcatacatgacatgcagcgcatatcaaaaggtgcaggactctgaaatcagctttcccgcaggtgtggaagtgcaagttctggaaaagcaggaaagcgggtggtggtatgtgaggtttggcgaacttgagggttgggccccaagccactatctggtacttgatgaaaatgagcagcccgacccgtctgggaaagagcttgacaccgtgcctgctaaagggcggcagaatgaggggaaatctgattcactggagaaaattgaaagacgggtccaggctttgaacactgtgaaccaatccaagaaggctacgcccccaattccatctaagcctcccggaggtttcggtaaaacgtccgggaccccagccgttaaaatgcgcaatggggttcgtcaggtggcggttaggcccatcgaaaaatcccagttcatccacaataatcttaaggacgtctacgtgtccatcgctgactacgagggcgatgaagaaacggccgggtttcaagagggagtttctatggaagtgctggagcggaatcccaatgggtggtggtattgccagattctggatggagtgaagccgttcaagggatgggttccaagtaactatctggagaagaagaactag

SEQ ID NO: 26333 - DNA, 2907 bp, Artificial Sequence
  Description of Artificial Sequence: Synthetic coding sequence
atgatcctggagcagtacgtggtggtgagcaactacaagaagcaggagaactccgaattgagtctgcaggccggcgaagtggtagatgttatcgagaagaacgaatccggatggtggtttgtgagtacatcagaggagcaggggtgggtgccagctacctaccttgaagctcagaacggcaccagggacgatagcgacattaatacaagtaaaacaggggaagtgagcaaacggcgaaaagcgcatcttagacgtctggacagacggtggacgctcggaggaatggtgaataggcagcacagcagggaagaaaaatacgtcaccgttcagccctacactagccaaagtaaggacgagattggatttgagaaaggcgtaacagtggaggtgattcgaaaaaatctggaagggtggtggtacattagatacctcgggaaggagggatgggcccccgcctcttacctaaaaaaggcaaaagacgacctccccacacgcaagaaaaacctcgcgggcccggtggaaattatcgggaacatcatggaaattagcaaccttttgaataaaaaggcttctggggacaaagaaacgcccccagcagaaggcgaaggtcatgaggctcccatagccaaaaaagagatttccttgccgatcctctgtaatgcatcaaatggctcagccgtcggggtgccggaccgcacggtgagccgtttagctcaggggagtcctgccgtggctcgcatagcacctcagcgcgctcagatctcttctcctaacctgaggactcgccccccaccaagacgtgaaagttctcttggtttccaactgcctaagcccccggaaccacctagcgtagaagtggaatattataccatcgctgagtttcagagctgtatttctgatggaatcagctttaggggagggcagaaggcagaggtaatcgataagaattctggaggctggtggtatgtccaaattggagaaaaggagggatgggcccccgcaagttatattgataaacgcaaaaagccaaacctgtctcgccgtacttcgaccttaacccgccctaaggtgcctcctcccgcccccccctcgaagcctaaagaggcggaggaagggccaactggagcttcggagagccaggatagcccacggaaacttaagtacgaggagccagaatatgacattccagcctttggatttgattcagaaccggagttgtctgaagaaccagtagaagatcgcgcttccggagagcgccggccagcacagccgcaccgcccatctccagcgtcttccctccagagagctagattcaaggtgggcgagtcgtccgaggacgtcgctcttgaggaggaaactatctacgagaacgagggatttcgaccttatgctgaagatactttaagcgcgcgggggagcagcggtgatagcgattcacctgggagttcttctctgagcctgacccgaaaaaattcccccaagtctggatccccaaagagcagctctttgctcaagcttaaggcagaaaagaacgcacaggccgaaatgggcaaaaatcattcttctgcatcattctcatcttctattacaataaacacaacttgttgctcgagcagctcctcctcatctagcagcctctctaaaacatctggagatcttaaaccaagatccgccagcgacgccggcatccgtgggacacctaaggttagggcgaaaaaggacgccgatgctaacgcggggcttactagttgcccacgggcgaagccatccgtccggcctaaaccctttctaaatagagcagaatcgcagtctcaggaaaaaatggatatcagcactctacgccggcagttgcgcccgaccggacagctcaggggtggtctcaaggggtctaagtccgaggactccgagctaccacctcagactgcctcagaagctccctccgaggggtctcgtcgaagctcatctgatctgattacgcttccagctacaactccaccctgtccgaccaaaaaggaatgggagggccccgccacaagctatatgacgtgtagtgcctaccagaaggtgcaggatagcgaaatcagtttcccagctggtgtggaagtgcaggtgctggagaagcaggaaagtggctggtggtacgttcgctttggcgaactagaaggatgggccccctctcactacctggttctggatgagaatgaacagccagatcccagtggaaaggagctcgacaccgtgccagcaaagggacgacagaatgaaggcaagtccgattctctcgagaagattgagagacgggtacaagctctgaacacggtgaatcagagcaaaaaagctacgcctcccatcccttcaaaaccacccggggggtttggtaaaacatccggcaccccagcggtcaaaatgagaaacggagtacgtcaggtcgctgtgcggccacagtcagtgttcgtcagtcccccacccaaagacaacaacctgtcttgtgcgctacgaaggaacgagagcttgactgctactgatggcctccgcggggtccgccgcaattcgagcttcagtactgcccgctccgccgcagctgaagccaaggggcggctcgccgagagagctgcctctcagggcagcgatagccccctgctgcccgctcaacgaaatagtattccggtttcccctgttagacccaaaccgatcgagaagagccagtttatccacaacaatctcaaggacgtctatgtatcaatcgcggactacgagggagatgaggagacggccggattccaggaaggcgtttcgatggaggttcttgaaagaaatccaaacggctggtggtactgccagatcttggacggtgtcaagccctttaaaggatgggtgccatccaactacctcgagaagaagaactag

SEQ ID NO: 26334 - DNA, 3003 bp, Artificial Sequence
  Description of Artificial Sequence: Synthetic coding sequence
atgaacggcagcttcctgctgcggctgctgttccccgtggccagcatcttgcctgaaacggtgttgctacgcggcgccgacgccactgcagagccaatgattttggagcagtatgtggtcgtgagcaactataagaagcaggaaaattctgaactgtccctgcaggcgggagaagttgtggatgtaattgaaaaaaatgagagtgggtggtggttcgtgtctacaagcgaagaacaaggctgggtccccgctacctatttagaggctcagaatgggactcgggatgactcagatatcaatacatcaaagactggcgaagtctcgaagcgcaggaaagcccaccttagaagactggatcggaggtggaccctcggcggtatggtcaatcgccagcatagtagggaagaaaagtacgtgactgtgcaaccttacacctcccagagcaaagatgaaataggcttcgagaagggcgttacagttgaagtgataagaaagaatctggaaggatggtggtacatccgttatctgggcaaagaaggctgggctcccgcctcatacttgaagaaagctaaggatgaccttcctacccggaagaagaatctcgccggcccggtcgagatcatcggtaacatcatggaaatcagcaatctgctgaataagaaggcaagtggcgacaaggaaactccgcccgctgaaggagaaggccacgaagcccccatagccaaaaaggaaattagcttaccgatcctatgcaacgcttccaacgggagcgccgtcggtgtcccggataggactgtctcaaggctcgcccagggaagtccggccgtggctagaatcgcgccccaaagagctcagatctcctccccaaacctgcgcacacggcccccaccaagacgggagagttctctcggtttccagctgccgaagccaccagagcccccttcagtggaagtagagtactatactatagccgaattccaaagttgcatctccgatgggatcagtttcaggggcggccagaaggccgaggtgattgacaaaaattccggaggctggtggtacgtgcaaattggcgaaaaagagggatgggcgccagctagctatatagacaagagaaagaaaccaaacttatcacgccgcaccagcacccttacaagaccaaaggtgcctccgcctgcccccccatcaaagccaaaagaagccgaagaaggtccaacaggagcttccgagagccaggactcccccagaaagttgaagtacgaagagccagagtacgacattcccgcctttggattcgatagcgaacccgaactctctgaggagcctgtggaggacagagccagtggcgaacggagaccagcccagcctcacagacctagcccagcaagctccctccagcgcgcccggtttaaggtgggagagagttcggaggatgtggctctggaagaagagacgatttacgagaatgaagggtttaggccctacgctgaggacaccctgagtgcccgggggtctagcggggattctgattcgcctggatcatcttctttgtcgctgacccggaagaacagcccaaaaagtggctctccaaagagcagcagccttttgaaactgaaagcagaaaagaacgcccaggccgagatggggaagaaccatagcagcgcttccttctcttctagcattaccattaacactacctgctgcagtagtagctccagctcgtcttcctcactttccaaaacctccggcgacctgaaaccaaggagcgcatcagatgccggcattagaggcactccaaaagttcgcgccaagaaagatgccgacgctaatgcaggattaactagctgtccacgcgccaagccttctgtgcggcctaaacccttcctcaaccgagccgagagccaatcacaagaaaagatggatatttctactctgcggaggcagctcaggcccacaggccagctgcgcgggggtctgaagggttcaaaaagcgaagactcagagcttcctccacagacagcctccgaggcaccgagtgagggaagccggcggagtagctccgacctgataactctgccagctacgactcctccttgccctacaaagaaggaatgggaagggccagctactagttatatgacttgtagcgcatatcagaaagtacaggacagcgaaataagttttccggccggtgtggaagtccaggtactcgagaagcaggaatccggttggtggtacgtccggtttggtgaattagaggggtgggcccctagtcattatctcgtgctggacgagaacgagcagccagatccgagcggcaaggagctggacaccgtgccagctaaaggccggcagaacgagggtaaaagcgattctcttgaaaagatcgagagaagagtccaggcgcttaatactgttaatcagtccaaaaaggctaccccccccatcccttccaagccgcccggcggcttcgggaagaccagcggcacaccagccgtgaaaatgagaaacggtgtgcggcaggtagctgtccggccccagtccgtgtttgtgagccctccgcctaaggataataatctgtcctgtgcactacgccgcaatgagtccttgacagccactgatgggctccgcggagtgcggcgcaactcctctttctctacagcacgcagcgcggcggcggaggccaaaggcagactcgcggagcgtgcggcatcccagggttcagattccccactcctgccagcccaacggaacagcattccagtgtcccccgtgcgtcccaagccgatcgagaaaagtcagttcatccataacaatctcaaggacgtctatgtgtccatcgccgactacgaaggggacgaggaaactgccggtttccaggaaggggtgtctatggaagtgctggagcgaaaccctaatggctggtggtactgtcagatactggatggcgtcaaacccttcaagggctgggtccccagcaattacctcgagaaaaagaattag

SEQ ID NO: 26335 - DNA, 414 bp, Artificial Sequence
  Description of Artificial Sequence: Synthetic coding sequence
atgaacaagctgagcggcggcggcggccggcggacccgggtggagggcgggcaactcggaggtgaagaatggacgagacacggctcttttgttaataaacctacgcgagggtggcttcacccaaacgacaaagtaatggggcccggcgtcagttatctggttagatatatgggctgtgtcgaagtgctccagtctatgcgtgccctggatttcaacactcggacacaggtgacgcgagaagctataagcctggtctgcgaagccgtgccaggggccaaaggtgccacaaggcgtcgcaaaccatgttccagacccctaagtagcattctgggtagatcgaatctgaagttcgcaggaatgcccatcaccctaactgtcagcaccagttctctgaacctaatggccgcggactag

SEQ ID NO: 26336 - DNA, 918 bp, Artificial Sequence
  Description of Artificial Sequence: Synthetic coding sequence
atggccggcttcgacggcagcgcctgggacgaggaggaggaggagcctccagaccaccagtattataatgatttcccaggcaaagaaccccccctgggtggagtggttgatatgagactcagggagggcgctgcccctggagctgccagaccaaccgctcctaacgcccagacccctagccacctgggcgccaccctccccgtgggccagcccgtcggaggagatcctgaggtgaggaagcagatgcccccaccccctccctgccccggccgcgaactgtttgatgacccatcttacgtgaacgtgcagaacctggataaagctaggcaggctgttggaggagcaggccccccaaatccagccatcaacgggagtgccccacgcgatctgttcgatatgaaacctttcgaagatgccctgcgcgttcctccaccccctcagagtgtgtcaatggcagagcagctcagaggcgagccatggtttcacgggaagctatcgcgaagagaggcagaggcactgctgcagctgaatggagacttcctggtccgagagtccacgaccacgccaggacaatacgtgctgacgggcttgcagtctggccagcctaaacaccttttgcttgtggaccccgagggggtgcgatggggcttcgccatgttacccaaactctttctgaatagccgtgcccaggtgatccgtctgcctcgtcctccaagggtgttgggcctccaggcaagaactactatgccgtctctgcacatttttttctgtactgtctatacgctgctgcgacacgctaacttcctgcaggtcaaaaagggcgtctattcaagtcaactgcacagctttcgagcagacgtagcatttgcttttagccatttcaccgatctgtccatacctacaaccgtgtctttttag

SEQ ID NO: 26337 - DNA, 1563 bp, Artificial Sequence
  Description of Artificial Sequence: Synthetic coding sequence
atgagcaacctgcggctggccaaccccgccggcggccggcccggcagtaaaggtgaaccaggcagggccgccgacgacggggaaggcatcgttggtgcggctatgcctgattctggtccactgccgctgttacaggacatgaacaagctctccggagggggtggacgacggactagggttgaaggtggtcaactgggcggagaggagtggacaaggcacggctcgtttgtaaacaaaccaactcgtgggtggttgcatcccaacgacaaggtgatgggacccggcgtgagctatcttgtgcgctacatgggctgcgtcgaggtgctgcagtccatgcgggccttggattttaatactagaactcaagtgacccgagaggcaataagtctcgtgtgtgaggccgttcccggcgcaaaaggcgccacccgccgtcggaaaccctgttcacgcccgctcagttccatcctggggcgcagtaatttgaagttcgctggcatgcctattacactgactgttagcacatcttctctcaatctgatggcagccgactgtaaacagatcattgctaatcatcacatgcagtctatttctttcgcttccgggggcgatcctgatactgctgagtacgtagcttatgttgctaaggacccagtgaaccagagggcttgtcatattcttgagtgccctgagggccttgcacaggatgtaattagcacaatcggacaagcctttgagctgcgatttaaacagtacctgaggaacccacccaaactggtgactccccacgataggatggccggattcgacggcagtgcctgggatgaggaggaggaggagccgcctgaccaccagtactacaacgattttccaggcaaggagccgccactaggcggggtggtggacatgcgtctcagggagggcgctgcccccggtgctgcacggcccacagccccaaacgctcagacaccaagccacttaggcgccacccttcctgtcggccagcctgtaggtggcgatccagaagtgcgcaagcaaatgcctccacctcctccatgtcctgctgggagagagctgttcgacgatcccagttacgtcaatgttcaaaacctggacaaggctcgacaggcggttgggggggctgggcctcccaacccagccattaatggcagtgcccctagagatctattcgatatgaaacccttcgaggacgcactgagggttcccccccctcctcaaagtgtctcaatggccgaacaattgcgcggcgagccatggttccatggcaaattgtcaagaagagaagccgaagccttactccagctgaatggtgatttcctggtgcgagagagtaccactacacccggccagtacgtgctgacaggcctgcaatcaggccagcctaaacatttactcttggtggaccccgagggcgtcgtgaggacaaaagatcaccggtttgaatcggtgagtcacctgataagctaccacatggataaccatttgccgattattagcgcaggtagcgaactttgtcttcaacagccagttgagcggaagctttag

SEQ ID NO: 26338 - DNA, 1752 bp, Artificial Sequence
  Description of Artificial Sequence: Synthetic coding sequence
atggacctgctgccccccaagcccaagtacaaccccctgcggaacgaatcgctgagctctctagaggagggtgcgtccggttctacccccccagaagagctgccttctccttctgcgagttctctcggaccaattttgcctcccttgcccggtgatgacagccctaccactctttgttcgttcttcccacgcatgagcaatctccgcttggcaaatccagcgggaggccggcccggttctaagggcgagccgggcagggcagccgatgatggtgaggggatcgttggcgccgccatgccagatagcggtcccctgccacttttgcaagatatgaataaacttagcggcggcggtgggcggaggactcgggtggagggagggcagctagggggtgaagagtggacccgtcatggttctttcgttaacaagcccacacgcggttggctgcacccaaatgataaggtgatgggccccggagtgagctacctggttaggtatatgggttgtgtggaagtactccaaagcatgagagctctcgactttaacaccaggacacaagttacccgggaggcgatctctcttgtctgtgaagccgtgcccggggccaaaggagccacccgaagaaggaagccatgtagcaggcctctctcttcaatcctggggaggagtaatctgaaatttgcgggcatgcccattacactcaccgtgagtacatcttcactgaatctgatggctgcagactgtaagcagattatagccaatcaccacatgcagtcaatctcctttgcctctgggggggaccccgataccgccgaatatgtagcctatgttgcaaaggaccctgtgaaccagcgagcctgtcacatccttgagtgtcctgaggggctggcacaagacgtgatcagcactatcggacaggcatttgagctgaggtttaagcagtatcttagaaatccgccaaagctcgtcactccccacgatagaatggccggattcgacggcagcgcctgggatgaggaggaggaggagccccccgatcaccagtattacaacgattttcccggcaaggagccccccctggggggggttgtagatatgagacttagggagggagctgctcccggcgctgcacggcccactgcccccaatgcccagaccccgagccacctcggagctacactgccagtgggccagcctgttggtggtgaccccgaagtgcgaaagcagatgccgcccccgcccccatgtcccgggcgtgagctgttcgatgatccttcttacgtgaacgtacagaacttggacaaggccaggcaggccgtgggtggggcgggtcctcctaaccctgccattaatggctccgccccgcgggacttgttcgacatgaagccatttgaggatgccctgagggtgccaccccctccgcagtcagtcagcatggcagagcagctgcgtggtgaaccatggtttcacgggaagctgagccggcgggaggctgaagcgcttcttcagctgaacggagacttcctagtgagagaatcgactactactcctgggcagtatgtgctcactggcctccagtcagggcagcctaagcacctgctactcgtggaccccgagggtgtggtgcgcactaaagatcaccggttcgaatcagtgagtcatctgatttcttaccatatggacaaccacctacccattatatccgcggggtcagaattgtgcctgcagcagcccgtggaacgaaaactatag

SEQ ID NO: 26339 - DNA, 1155 bp, Artificial Sequence
  Description of Artificial Sequence: Synthetic coding sequence
atggacctgctgccccccaagcccaagtacaaccccctgcggaacgagtcattgagcatccttgggaggtccaaccttaagttcgcaggaatgccaattactctgactgtatccacctcttcgctgaacctgatggcggccgattgtaaacagataatcgccaatcatcatatgcaatcaattagtttcgcaagtggtggcgaccccgatacagcagaatatgtagcatatgtggccaaagatccagtcaaccagagggcctgccatattctggagtgtccagaaggcctggcccaggatgttattagcaccattggacaggctttcgagctgaggtttaaacagtatctcaggaaccctcccaagctggtgaccccccatgatcgcatggcaggtttcgacggcagtgcttgggacgaggaggaggaggaaccccctgatcaccagtactataatgatttccctggcaaagagcctcctctgggaggcgtcgttgacatgaggcttcgtgaaggcgccgcccctggtgctgcccggccaacggccccaaatgctcaaacaccatcccacctgggcgcaacactacccgtggggcaacctgttggaggcgaccccgaagtgagaaagcagatgccccctccgcctccttgtcctggtcgcgagttgttcgacgaccccagctatgtcaatgtgcagaacctggataaagcccgacaagcagtgggtggagcaggcccacccaatcccgcaatcaacggatcagcccccagagacctgtttgatatgaagccctttgaggatgctctgcgagttccacctcccccccagtctgtgagcatggccgagcagctacgcggcgagccatggttccacgggaaactgagcagacgggaggccgaagcattgttacagttaaacggtgactttctcgtaagagagagcaccacaacacccggccagtacgttctcacaggccttcaaagcggccagcccaagcacctgttgctggtggaccccgaaggcgtagtgagaactaaagatcataggttcgaaagcgtgagtcacctcatttcataccatatggataatcacctacctattattagcgccggttctgagttgtgtctacagcagcctgtggaaagaaaactgtag

SEQ ID NO: 26340 - DNA, 1422 bp, Artificial Sequence
  Description of Artificial Sequence: Synthetic coding sequence
atgaacaagctgagcggcggcggcggccggcggacccgggtggaggggggccaactggggggagaagagtggacccgccatgggtcttttgttaacaagcccactagagggtggcttcatcctaatgacaaggtgatgggccctggggtcagctacctggtacggtacatgggctgcgttgaggtccttcaatccatgagggcgctcgacttcaatacgcggacccaagtgacacgggaagcaatctctctcgtttgcgaggctgtgccaggggctaagggtgccacgcggaggcgaaagccttgttccaggccacttagcagcattctagggcgttcgaacttaaaattcgccggcatgccgatcaccctgaccgtcagtacttcaagcttgaatctcatggccgcagattgtaaacaaattatcgcaaatcaccacatgcagtcaatttcgttcgctagcggtggggaccctgacaccgccgaatatgtagcatacgtggcaaaagatcccgtcaatcaaagagcatgccacattctagaatgcccagagggactcgcacaggacgtaatctccactatcggccaggcgtttgaattacgtttcaagcaatatctgcgaaaccctcctaaattggtaaccccccatgataggatggccgggtttgacgggagcgcatgggacgaagaggaggaagaaccacctgatcaccagtactataatgattttccggggaaagaacccccgctggggggcgtcgttgacatgcgactgagggaaggcgccgcccccggagctgcacgaccaacagccccgaacgctcagacgcccagtcacctcggtgccaccctccctgtgggtcaaccagtgggaggagacccagaagtacggaaacagatgcccccgccacccccttgtcctgggcgagaactgttcgatgacccctcttacgtgaatgtccaaaatctcgataaagcccgacaggctgtgggcggagccggccctcctaatcctgctataaacgggagtgcccctcgtgatctctttgatatgaagccatttgaggacgctttacgggtaccgcctcccccacagtccgtgtctatggcagaacaattacggggcgagccgtggttccacggaaagttaagtcggagggaggccgaggctctgctacagctgaacggggattttctcgtgcgagaatctaccactaccccaggacagtacgtccttactggactacagtcagggcagcccaaacatctcctgttggtggaccccgagggagtggtgcgaaccaaagatcacaggttcgaaagcgtgagccatttaatctcgtatcacatggataaccatttgccaatcatatctgccgggagcgagctgtgccttcagcagcctgtggagcgtaaactgtag

SEQ ID NO: 26341 - DNA, 1425 bp, Artificial Sequence
  Description of Artificial Sequence: Synthetic coding sequence
atgaacaagctgagcggcggcggcggccggcggacccgggtggagggaggacaactgggcggagaggagtggactcgccacggatcctttgtgaacaagcctactaggggatggttacacccgaatgataaagtgatgggaccgggcgtgagttacttggtccggtacatgggctgcgtggaggtgttacaaagcatgcgagccctggatttcaatacccggactcaggtcactcgcgaggccatcagtctcgtgtgcgaagccgttcccggggccaaaggcgccactagacgtcggaaaccatgcagccgcccactgagttcaatcctggggcgctcaaacctgaagttcgccggtatgcccatcaccctgaccgttagcacctcctccctcaacctcatggctgcggattgcaagcagataatcgcaaaccaccatatgcagtctataagcttcgctagcggaggggatccggacactgctgagtacgtggcctatgtggccaaagatccggtaaatcagcgggcatgccacatcctcgagtgtccagagggactggcacaggatgtaatttcaacaattggccaggcgtttgaactacgcttcaagcagtatctgagaaacccccccaaacttgttacacctcatgaccggatggcaggatttgacggttcggcttgggacgaagaagaagaggagccccccgaccaccagtattataatgacttccccggaaaggagccccctctgggaggcgttgttgatatgcgcttgcgagaaggtgctgctccgggcgcagctcgccctacagcccccaacgcgcagacaccaagccatctgggggccacactccccgtcggacagcccgtcgggggcgatcctgaggtacgcaaacagatgcctcctccccctccatgtcccgcgggaagggagttgttcgatgatcccagctacgtgaatgttcagaatctggacaaagcgaggcaggcggtggggggcgccggacctcctaaccccgctatcaacggctcggctccccgcgacttgtttgatatgaaacccttcgaggacgctcttcgtgtgcctcccccaccccagtctgtctctatggctgagcaactcagaggcgaaccttggtttcacgggaagcttagtaggcgcgaagctgaagccttacttcaattgaacggagatttcctcgtgagagaatctaccacaacccctggtcaatacgtcctcacgggactccagagcggacagcccaagcatctgctgctggtggaccctgagggcgtcgtgcgtaccaaggaccacaggtttgagtccgttagccacctaatttcttatcacatggataatcatctccctatcatttctgcgggcagcgaactctgtcttcagcaaccagttgagcggaaactgtag

SEQ ID NO: 26342 - DNA, 603 bp, Artificial Sequence
  Description of Artificial Sequence: Synthetic coding sequence
atgaacaagctgagcggcggcggcggccggcggacccgggtggagggaggccaactgggcggggaagagtggacacgtcatggctcttttgtaaataagcccacaagggggtggctgcacccaaacgataaggtgatgggcccaggggtctcttatctggtgcgatacatgggctgtgtggaggtattacaaagtatgcgcgcactggatttcaacacgcggactcaggtaacgcgcgaagccatcagtctggtctgcgaggccgtgcctggtgccaagggtgcaaccaggaggcgtaagccatgctcgcggcctctctcctctattttgggccggagtaatctgaaattcgccggcatgcccattacactgaccgtatccacaagctcccttaacctgatggccgcggactgcaagcaagatacagctgaatacgttgcttatgtcgcaaaggatccggtaaaccagagagcctgtcacatcttggaatgtcccgaaggtctcgctcaggacgtcatctccactattggccaagcttttgaactgcggtttaagcagtacctgcgcaacccacccaaactcgtcactccccacgacagatag

SEQ ID NO: 26343 - DNA, 603 bp, Artificial Sequence
  Description of Artificial Sequence: Synthetic coding sequence
atgcccatcaccctgaccgtgagcaccagcagcctgaacctgatggcagctgattgtaagcaggatacggctgagtacgttgcctatgtggccaaggatccggtcaatcagagggcctgtcacatactggagtgtcctgaaggacttgcacaagatgtgatctctacaatcggacaggcctttgaactgcgtttcaaacagtatctgagaaatccacccaaactggttactccgcacgaccgaatggccggcttcgatggatccgcttgggatgaagaggaggaagagccccctgatcatcaatactataacgatttccctggtaaggagcccccccttggtggtgtggtagacatgaggttacgtgagggagccgctccgggtgcagctcggcctaccgctccgaacgcacagacgccctcccatcttggagctactctgcccgtgggacaacccgtgggaggagacccagaggtacggaagcagatgcccccgccaccaccatgccccgcaggcagagagttgtttgacgaccccagttatgtgaacgttcagaacctggacaaggcacgccaagccgttggcggcgctgggcccccgtag

SEQ ID NO: 26344 - DNA, 393 bp, Artificial Sequence
  Description of Artificial Sequence: Synthetic coding sequence
atgcccatcaccctgaccgtgagcaccagcagcctgaacctgatggcggctgattgtaaacaaatcatagcaaatcatcacatgcagtcaattagcttcgcatctggcggtgatcccgacaccgctgagtatgtggcctacgtcgcaaaggatccagtgaatcagcgggcttgccatatcctggaatgccccgaaggccttgctcaggacgttattagcacaatcggccaagctttcgagcttagattcaagcagtatctgcgcaacccccctaaactcgtgacgcctcacgatagaatggcaggcttcgatggatctgcttgggatgaggaggaggaggagccccctgatcatcaatattacaacgattttccgggaaaggagcctccatag

SEQ ID NO: 26345 - DNA, 894 bp, Artificial Sequence
  Description of Artificial Sequence: Synthetic coding sequence
tgagacgaggaggaggaggagccccccgaccaccagtactacaacgacttccccggaaaagagccaccactcggcggcgtcgtggatatgcgccttcgtgaaggagctgcccctggggcagccaggcccactgctcctaacgcacagactcctagccacctgggggctacactcccggtgggtcagcccgttgggggggatcctgaagtccgcaagcagatgcctccaccacctccatgccctgggcgagaacttttcgatgacccgagctatgttaacgtgcagaacctggacaaggctaggcaggccgtggggggagcaggtccgccaaacccagctattaatgggagtgctccgcgcgatctcttcgacatgaaaccattcgaggacgcactccgcgttccccctccgcctcaatctgtaagtatggcggagcagctgcgcggggaaccatggttccatggaaagctatcccgccgcgaagctgaggccctccttcagctgaacggtgattttctagtacgggagagcaccactacaccgggccagtatgtgctcacaggactccagtctgggcagccaaagcacctgttactggtagatccagagggcgttaggtggggattcgctatgcttcctaaactctttctcaactccagggctcaagtaatccgtctaccgcgccccccccgcgtactgggactgcaggctcgtacaacgatgccttctttgcacattttcttttgcaccgtatacactctgctgaggcacgccaacttccttcaggtgaaaaaaggcgtgtatagctcacaactgcacagctttagagcggacgtcgctttcgccttcagtcactttacagacctgagcatccccacgacagtctcattttag

SEQ ID NO: 26346 - DNA, 1755 bp, Artificial Sequence
  Description of Artificial Sequence: Synthetic coding sequence
atggacctgctgccccccaagcccaagtacaaccccctgcggaacgaatctctgagtagcctcgaggaaggggcctcagggtcgacccccccagaggaactcccatcgccaagtgcgtcttccctgggcccgatattgccaccgttaccaggtgacgacagccctaccactctttgctcattcttccctaggatgtccaatctgcggctcgccaaccctgcaggggggaggccagggagcaagggtgagcccggccgtgctgccgacgacggcgaaggcatcgtcggagcagcaatgcccgattctggcccactcccactattacaggatatgaacaaattgtcaggaggagggggtcgtcggacgcgggtcgaaggcggacagctggggggggaggaatggacgagacatggctcatttgtaaacaagccgacgcgcggctggctgcaccctaacgacaaagttatgggacccggagtgagctacctggttagatacatggggtgtgtcgaagtcctgcagagtatgagggctctcgatttcaatacgcgcacccaggttacccgggaggccatatcgctggtctgtgaggcagtccctggggccaaaggggcaactcgacgtcgtaagccctgtagccggcccctgagttcaatcctcggcaggtctaacctgaaattcgccggcatgcccattactctgactgttagcactagtagtcttaatttgatggcggccgactgtaaacaaatcatagcgaaccatcacatgcagagtatatctttcgcttcagggggtgaccctgatactgcggagtatgttgcttatgtcgcgaaagaccccgtgaatcagcgggcgtgtcacatattggagtgcccagagggcctggcccaggatgtgatttccaccattggccaggcttttgagctaagatttaaacaatacctgcgaaatcctccaaaacttgtcaccccccatgaccgaatggccgggtttgacgggtccgcctgggatgaagaggaagaggaaccaccagaccatcaatattacaacgactttcctggcaaggaaccccctctgggcggagtcgttgatatgaggctgcgcgaaggggccgcccctggggcagccagaccaacagctcccaacgcccaaaccccttcccatctgggagccaccctgcctgttggtcagccggtcggaggagaccctgaggtgcgcaagcagatgcccccgccacccccttgcccggccggacgggagttattcgacgacccttcttacgttaacgtgcagaacctggataaggctcgccaggcagtcggcggtgccggaccacccaatccagcaattaatgggtctgctccccgagaccttttcgacatgaagccatttgaggacgccctccgggtgccaccacccccacagtctgtgtccatggcggagcagttgcgtggggaaccttggtttcatggaaagctgtccagaagggaggccgaagcacttctccaattaaacggtgacttcctggtccgggagagtaccaccacgcccgggcagtacgttctgacaggtctccaatctgggcagcctaagcatctactgctcgtggacccagagggggtcgtccggacaaaggatcacagatttgagtccgtgagccacttaatctcctatcacatggacaatcaccttcctatcatcagcgctggcagcgagctctgtctccagcagcctgtcgaacgaaagctgtag

SEQ ID NO: 26347 - DNA, 1749 bp, Artificial Sequence
  Description of Artificial Sequence: Synthetic coding sequence
atgacccagggccccggcggccgggccccccccgccccccccgcccctcctgaacctgaagcacccacaacgttctgcgccttactaccccgtatgccacaatggaagttcgcagcacctgggggctttctggggcgcggtcctgcagcagcacgggccgccggtgcatcgggcggagccgatcctcagcccgagcccgccgggcccggaggagtccctgccttggcagcagccgtattaggagcgtgcgaaccccgttgcgccgccccttgccccctgccagccctgtcacgttgtaggggagctgggtctaggggctctcgggggggcagaggagccgcggggtctggggacgccgcagcagcagcggagtggattagaaagggaagtttcattcacaaacctgctcacggatggttacatcccgacgcaagggtactgggacccggagtcagctacgttgtccgctatatgggatgcattgaggtgttacggtctatgaggtctctggacttcaacacgaggacacaggtcactagagaggccataaatcgtctgcatgaagcggtgccaggggtgagaggttcctggaaaaaaaaggctcctaataaggccctggcatcggtcctagggaaatccaatttgcgtttcgcgggcatgagtattagcattcatatttctaccgacggactgtccctgagcgttcctgccacgaggcaagtgatcgctaaccatcacatgccatctataagttttgcttcgggtggcgacaccgacatgactgactacgtggcgtacgtggccaaggatcctattaaccagcgggcctgccatatattagagtgctgtgaaggccttgctcagagcataatttccaccgtggggcaggcctttgaattaaggttcaagcagtatctgcattccccccctaaggttgcattgccacccgagcggctcgccggccctgaagaatctgcgtggggagatgaggaagattcactggagcacaactactacaattcgattcctggtaaagagcctcctttagggggtctcgtggactccagacttgcgcttacacagccttgtgccctgacggccctcgaccagggcccatctccttcattacgcgacgcctgctccctcccttgggatgtgggcagcaccggaacagctccacccggagacggctatgtgcaggcagacgcccgtggaccacctgatcacgaagaacacctatacgtgaacacccaaggcctcgatgcacctgaacctgaagactccccaaaaaaggacctgtttgatatgcgacctttcgaggacgcactcaaactgcacgaatgctccgttgcggccggagtcactgcggcccctctccctctggaggatcaatggccgtccccacccactaggcgggctcccgtggcccccaccgaggagcaactgcgacaggagccatggtatcacggtaggatgtctaggcgcgctgctgagagaatgttaagggcagacggagactttctggttcgagactctgttactaaccctgggcaatacgttctcaccgggatgcacgcaggccaaccaaaacacctccttctggtcgaccctgagggggtcgtacgtacaaaagacgtcttgttcgagagcatctcgcacttgattgatcaccatctgcagaatgggcaaccaatcgtagcagctgagtccgaactacatctccggggggtggtcagcagagagccttag

SEQ ID NO: 26348 - DNA, 1833 bp, Artificial Sequence
  Description of Artificial Sequence: Synthetic coding sequence
atgctggacttcttcaccatcttcagcaagggcggcctggtgctgtggtgcttccagggtgtgagcgacagctgtacaggccctgtgaatgccctgatccgaagtgtgttactccaggttgggtttcagaaaatactaactctcacctatgttgacaaactcattgatgacgtacataggctgtttcgtgataagtaccgcaccgagatccaacaacaaagtgcattaagccttctcaacggcaccttcgatttccagaatgacttcttacggctgctccgcgaggccgaggagtcaagtaaaattcgggcacccactactatgaaaaagttcgaggactccgagaaggcgaaaaaacccgtgcggtcgatgattgagacccgcggtgagaaacccaaagagaaagctaagaattctaagaagaagggcgctaaaaaagaaggcagtgatggaccgcttgccacaagcaagccagtacccgctgagaaatctggcctgcccgtcggcccggaaaacggagtggaattaagcaaagaggaattgatccggaggaagagagaggaattcatacagaaacacgggagggggatggaaaagtctaataagtcaaccaagtcggatgcgccgaaggagaaaggaaaaaaggccccccgagtatgggagctgggcggctgcgctaataaagaggtgctagattacagcacacctacgacgaatggtacacccgaagctgccctctctgaagatatcaatctgatcagaggcacaggatcaggagggcagctgcaggatctggactgttcatcatctgatgatgagggggcagcgcagaattcaaccaagcccagcgcaacaaaagggactcttggcgggatgtttggaatgctcaaaggtctggtgggcagcaagagcctgagccgcgaagatatggagtccgtgctggacaagatgagggaccatctgatcgctaagaacgttgccgccgatatcgccgtgcaactttgcgagtctgtggccaacaagttggagggaaaggtcatgggtactttctctacggttacatctacagtgaaacaggccctgcaagaatccctggtccagattctgcagccccaacgacgggttgatatgctgagagatattatggacgctcagaggagacaacggccctacgttgtaactttttgtggagtcaacggggttggaaagagcaccaatctggcaaaaatttctttttggttgcttgagaatggcttttccgtgctcattgcagcctgcgacactttcagagccggggctgttgagcagttacgtacacatactaggaggctgtccgccttgcaccctcctgagaagcacgggggcaggaccatggtccagcttttcgagaaaggatacggaaaagacgcagcaggcatcgctatggaagccatcgcgtttgcgcgaaaccagggattcgacgtcgttctagtcgacaccgccggccgcatgcaggacaatgccccactgatgacagcccttgctaaactgatcacagttaacacgcccgatttggtattgtttgtgggcgaggcactagtgggcaacgaggccgtggatcagcttgttaagttcaaccgagcattggcagaccactcaatggcccagacacccaggctcatcgacggaatcgtcctgacgaagttcgacacaatcgacgataaggttggcgccgcaatttccatgacttatatcaccagcaagcccatcgtgttcgttggaaccggacagacttattgcgacctgagaagcctgaacgcgaaggccgtcgtggctgccctcatgaaggcctag

SEQ ID NO: 26349 - DNA, 2253 bp, Artificial Sequence
  Description of Artificial Sequence: Synthetic coding sequence
atgagccagtggtacgagctgcagcagctggacagcaagttcctggagcaggtgcaccagttatacgatgactcattccccatggaaatccggcaatatctggcccaatggctcgagaaacaagattgggaacacgccgctaacgacgtttccttcgccacaatacggtttcacgatctgctcagccagcttgatgaccagtattcccgattttctctggagaacaactttttgctacagcacaacattcggaagtccaagcgcaatctgcaggacaattttcaagaggatccgatccagatgagcatgattatctactcctgtctgaaagaggaacgcaaaattttggagaatgcccagcgctttaaccaggcacagtccggcaatattcaatcaactgtaatgctggataaacagaaagagctggattctaaggtaagaaatgtaaaagacaaggttatgtgcatcgagcacgagatcaagagcctcgaagacctgcaggatgaatacgattttaagtgtaaaacgcttcagaaccgggagcacgaaaccaatggggtggccaagagtgatcaaaagcaggaacaactgctgctgaaaaaaatgtacctgatgctcgataacaagcggaaggaagtggtacataagatcatcgaacttctgaatgtcacggaactaacccagaacgccctcataaacgatgaactggttgagtggaagaggaggcagcaaagcgcctgtataggggggcctccaaacgcctgtctggaccaactgcagaactggtttactatcgtggcagaatccctccagcaggtgaggcagcagttaaaaaaactggaggagctcgagcagaaatacacgtatgagcacgatccgatcacgaaaaataagcaagtgctgtgggatcgaactttctccttatttcagcagctgatccagtctagctttgtcgtagagcgtcagccttgtatgcccacacaccctcagcgacctctggtgctaaagaccggcgtccagtttactgtaaagcttcggctcctggtgaaactgcaggagctcaattacaatctcaaagtcaaagttctgtttgacaaggacgtcaatgagagaaacactgttaaaggatttaggaaatttaacatcctggggacacacactaaggtgatgaacatggaggagtcaacaaatggatctttggcggcagagttccggcacttacagctgaaagagcagaaaaacgccggtacgagaactaacgagggacctcttattgtcacagaagagctgcacagcctgtcatttgagacccaactgtgccagccagggctggttattgacctggaaaccactagtctgcctgtggtggtgattagtaacgtttctcaattaccttcaggatgggcctctatcctctggtacaacatgctggttgccgaaccccggaatctcagtttttttctcacccccccatgcgcgagatgggcccaactgagtgaagtcctatcttggcagttcagtagcgttacaaagaggggattaaatgttgaccagttaaacatgctgggggagaagctgttgggacccaatgcaagccccgacgggctgattccctggacgcgcttctgtaaggaaaacataaatgacaagaatttccccttctggctgtggatcgagtctatcctcgaactgatcaaaaagcacctcctcccgttgtggaatgacggatgcattatgggctttatttcaaaggaaagagaacgagctttgttaaaggaccaacagcctggcacatttctgctgcgtttttcagagtcgagcagagaaggcgctataacatttacatgggtagagagatcccagaatgggggggagcctgactttcacgctgtcgagccctatactaagaaggaactcagcgccgttacctttcccgacatcatccgcaactacaaggtgatggccgccgaaaatattccggagaacccacttaaatatctgtaccctaacatcgacaaagaccatgctttcggcaagtactactctagaccaaaagaagcacccgaaccgatggagctagacggccccaaaggaaccggctacattaagaccgagctgatttcggtgtcagaggtccacccttccaggctacagacaactgacaatctccttcctatgtcaccagaagaatttgacgaggtgtcgaggatagtcggatctgttgaatttgactctatgatgaacaccgtctag

SEQ ID NO: 26350 - DNA, 2139 bp, Artificial Sequence
  Description of Artificial Sequence: Synthetic coding sequence
atgagccagtggtacgagctgcagcagctggacagcaagttcctggaacaggttcaccagctatatgacgactcattccctatggagatccgccagtacctagcacaatggttggaaaagcaagattgggagcatgccgcaaacgatgtttcctttgctacaataaggttccacgatctactgtctcagttggatgaccagtacagccggttttccctagagaacaatttcctgctgcagcacaacatccggaaatctaaaagaaatctgcaggataatttccaagaagatccaatccaaatgtcaatgattatctatagttgcctaaaggaggaacgcaaaatcctggagaacgcacagagattcaatcaggcacagtcaggaaatattcaatcgactgtaatgttggataaacagaaagagcttgactcaaaggttcgcaacgtgaaagacaaggttatgtgtatcgagcacgagattaagagcctggaagacctacaagacgagtacgattttaagtgtaaaaccctgcagaatagagaacatgagaccaatggcgtggccaagtctgaccagaagcaggagcagctgctgctcaagaaaatgtacctgatgctggacaacaaacgaaaagaagtagtacataaaatcatcgagttgctgaatgtcacggaactgactcagaacgctctaattaacgatgaactggtggaatggaagcgtaggcaacaaagcgcttgtattggcggcccgcccaacgcgtgtctggaccagttacaaaactggttcaccatcgtggccgagagtctgcagcaggtgcggcaacagcttaagaagttggaggaacttgaacagaaatatacatacgaacacgaccctatcacaaaaaacaagcaggtcttgtgggatcgcactttcagcttgtttcagcagctgattcagagctcttttgtggtggagagacaaccctgcatgcctacccacccgcagcggccactggtgctcaagactggcgtgcagtttactgtgaaactgaggcttctggtcaagctccaggagctcaactataacctgaaggtgaaagtcctttttgacaaggacgttaacgaaagaaacacggtcaagggttttcgcaaatttaacatcctgggtacccacacgaaggtcatgaatatggaggaaagcacaaacgggtctttggctgctgagtttaggcatctacagttgaaagaacagaagaacgccggcacgcgcaccaacgagggtcctctcatcgtgactgaagagctgcactctttgtcattcgaaacgcagctgtgtcagccaggcctcgttatcgacctggagaccacttctctacctgtggtggtgataagcaacgtatcccaactccctagcggttgggcaagcatcctctggtataatatgttagttgccgagcctagaaacctcagcttcttcctgacgcctccttgcgcccgttgggcccaattgtccgaagttctgtcctggcaattttcttccgttacaaaacgcggcctgaacgtggatcaactaaatatgttgggcgaaaagctactggggcccaatgcctccccagacgggctgataccctggacgaggttttgtaaggaaaacattaatgataaaaactttcctttctggttgtggatcgaatcaatcctcgagttgataaagaaacatctcctgcccttatggaacgatggttgtatcatgggctttatatcaaaagaaagagagagagctttgctaaaggaccagcagcccggcacatttctgctacggttcagtgaaagtagccgtgaaggcgctattaccttcacctgggttgagcggagccagaacggcggtgagccagatttccacgctgtcgaaccctacacaaaaaaggaattgtccgcagtgacattcccagacatcattcgaaattacaaggtgatggcggctgagaacatcccagagaaccccctgaagtatctgtatccaaatatagacaaagaccacgcctttggaaaatattattccaggccaaaggaggcacctgaaccaatggagttggacggcccgaagggcacagggtatattaaaacggagttgatctctgtgtctgaggtgtag

SEQ ID NO: 26351 - DNA, 2145 bp, Artificial Sequence
  Description of Artificial Sequence: Synthetic coding sequence
atgtggatgagccagtggtacgagctgcagcagctggacagcaagtttctggaacaagtgcaccaactgtatgacgacagttttcctatggaaatccggcagtatctggcacagtggctcgagaagcaggactgggagcatgccgcaaatgacgtgtctttcgcaactatcagattccacgacttgctgtcacaactggacgaccagtacagcaggttttccttggaaaataattttctgctgcagcacaatattcggaaatctaagcgcaatctccaggacaatttccaggaggatcctatccagatgagtatgatcatctacagttgcctgaaggaggagaggaagatccttgagaatgcccaacgattcaaccaggctcaatctgggaacatccaaagcactgtcatgctcgataaacaaaaagagcttgatagcaaggtgagaaatgtaaaggacaaggtcatgtgtatcgaacacgagatcaaaagtctcgaagacttacaagatgagtatgacttcaagtgtaaaaccctgcaaaaccgggaacacgaaacgaatggcgtagctaagagcgatcaaaaacaggagcagctgctgcttaagaagatgtaccttatgctggataataaacgcaaggaagttgtccacaaaattatcgaacttcttaacgtgaccgaactgacccagaatgcactcattaatgacgaactggttgaatggaaaaggcggcagcagagcgcatgtattggcggtccaccgaatgcatgcctggatcagctgcaaaattggtttaccatagtggccgagtctctccagcaggtacgccaacagctgaaaaagctggaagagttggaacaaaaatatacgtatgaacatgaccccattacgaaaaataaacaggtgctatgggacaggactttcagcctcttccagcagctgatccaaagttccttcgtggttgaacggcagccatgcatgcctactcatcctcaacggcctctcgtcttaaagactggagtgcagtttacggttaagctccgactcctggtcaaactccaagaactcaactataatcttaaggtgaaggtcctttttgataaggatgtgaacgagaggaatacagtcaagggctttcggaaattcaacatcctggggacccacaccaaggtgatgaacatggaagaatctacgaacggtagcctggccgccgaatttcgacacttacaactcaaagaacagaagaatgccggaacgagaaccaacgaaggaccgcttattgttaccgaggagttacattccctctcattcgagacgcagctttgccagccaggactggtgattgacctggagacgacttctttacccgtggttgtgatttccaatgtgtcgcagttgcccagcggctgggcctccattctctggtataacatgctcgtagctgaacccaggaacttgtcctttttcttgacacccccctgtgctcgttgggcacagctttccgaagtactcagttggcagttctccagcgttacaaagcgtggcttgaatgtcgaccagctgaacatgctgggcgagaaactgcttggtccaaatgcttctcccgatgggctcattccatggacgcgcttctgcaaggaaaatatcaatgataaaaacttcccgttctggttgtggattgaaagcattctcgaattgattaagaagcacttacttccgttgtggaacgacgggtgcatcatgggcttcataagcaaagagcgagagagagccttgcttaaagaccagcagcccggcacttttctgcttcggttctccgagtctagcagagagggcgcaataaccttcacgtgggtggagcgctcgcagaacgggggcgaaccagactttcatgcagttgaaccttatactaagaaagaattatccgctgttacgtttcctgatatcatcagaaattacaaagttatggcagcagaaaacatacccgagaaccccttgaaatatctatacccaaatatcgataaggaccacgccttcgggaagtattattctcgccccaaggaggcacctgaaccaatggagctcgatggccccaagggtaccggatacatcaagaccgaactgatctcagtgtccgaagtgtag

SEQ ID NO: 26352 - DNA, 2253 bp, Artificial Sequence
  Description of Artificial Sequence: Synthetic coding sequence
atgagccagtggtacgagctgcagcagctggacagcaagttcctggaacaggtgcatcagctttacgatgacagcttcccaatggaaattcgccaatatctggcacaatggcttgagaaacaagattgggaacacgctgccaacgatgtctctttcgcaactattaggtttcacgacctactgtcacagcttgatgaccagtattcacgtttttccttggagaacaacttccttttgcagcataacattaggaaatcaaagcgcaatctgcaggataatttccaggaggaccccatccagatgagcatgataatatacagctgcctcaaagaggaaagaaagatcttagagaatgcccagagattcaaccaggcacagagcggtaatatccagtccacagtgatgcttgacaaacagaaggaacttgacagcaaagtccggaacgttaaagacaaggtgatgtgcatcgagcatgagatcaaatccttggaggacttgcaagacgaatatgatttcaaatgtaaaacgttacagaatcgggagcacgagacaaacggggtagccaaatcggaccagaagcaggagcagttgctgctgaagaagatgtacttgatgcttgacaacaaacgcaaagaggttgtccacaaaataattgagctgctgaatgttactgaacttacacaaaacgcactcatcaatgatgagctggtggagtggaagcgcaggcagcagtcagcgtgtatagggggacctcctaatgcttgcctggatcaactgcagaattggtttactatcgtggcggaatccctgcaacaggtacgccaacagctgaagaagttggaagagctcgaacagaagtacacatacgagcatgatcccattacaaagaataagcaggtgctttgggacaggaccttttcgctattccagcagttgatccagagctctttcgtggtggagaggcagccatgcatgccgacgcatcctcagagacctctcgtgctgaagactggtgtgcagttcaccgtaaagctgaggctactggtaaaacttcaggagctgaactataacctgaaggtgaaagtcctttttgataaagatgtcaacgaacggaatactgtcaagggatttagaaaatttaacatattggggacgcatacaaaagtcatgaacatggaggaatcaactaacggaagtttggccgctgagtttcgccacctgcaacttaaggaacagaaaaatgctgggactaggaccaacgaggggcccctcatagtgaccgaagaactgcattccctttcctttgaaacccagttgtgtcaaccgggtctagtgattgacctggaaacaacaagtctccccgtagttgtaatcagcaacgtgagccaactaccatcgggatgggccagtatactgtggtataacatgctcgtcgccgagccgcggaacctgtcattttttctgactcccccctgcgccaggtgggcccagttatctgaggtactctcttggcagttcagttccgtaactaagagaggcctgaatgtggatcaattgaacatgctcggagaaaaactgctgggccccaatgcctcacccgatgggcttataccatggacgagattttgtaaagagaacatcaacgacaaaaactttcccttctggttatggatagaatccatccttgaactgatcaagaagcatttgctgcctctttggaatgatgggtgcattatgggctttatctccaaggaacgtgagagggccctgctcaaagaccagcagcctgggacatttctgctccggttctccgagagttccagagagggagctataacatttacgtgggttgaaaggtcacaaaacggaggggagccggacttccatgccgtcgagccatacactaagaaagaactgtccgcggtgactttccctgacataattagaaattataaggtcatggcagccgagaatattcccgagaaccccctgaaatacttgtatccaaatatagacaaggatcatgctttcggcaagtactacagccgtcctaaggaagcaccagaaccaatggagctcgacggaccgaaaggaaccggatacattaagactgagctgatttctgtcagtgaggtacacccttctaggttgcaaaccaccgacaacttattgccaatgtcccctgaggaatttgatgaggtgagtcggattgttggaagtgtcgaattcgatagcatgatgaacaccgtgtag

SEQ ID NO: 26353 - DNA, 543 bp, Artificial Sequence
  Description of Artificial Sequence: Synthetic coding sequence
atgagccagtggtacgagctgcagcagctggacagcaagttcctggagcaagtgcaccagctctacgacgattctttcccaatggagatccggcaatacctagcacaatggctggagaagcaggactgggagcacgccgctaacgacgtgtccttcgcgaccatcagatttcacgatttgctctctcaactggacgaccaatatagccggttcagtctggagaataactttctgctgcaacataacatcaggaagagcaaacgaaatttgcaggacaattttcaggaggatcccatccagatgagcatgattatttattcatgtctgaaagaggaacgaaagatcctggagaatgcccaacggttcaaccaggcacagtctgggaatattcagtccactgtgatgctcgacaagcagaaggagctcgactctaaagtgcggaacgtcaaagacaaagtgatgtgtatcgaacacgagattaagtccctcgaggacctgcaggacgagtacgacttcaagtgcaaaacgctccaaaacagatag

SEQ ID NO: 26354 - DNA, 213 bp, Artificial Sequence
  Description of Artificial Sequence: Synthetic coding sequence
atgagccagtggtacgagctgcagcagctggacagcaagttcctggaacaggtccatcagctgtacgatgactcattccccatggagatccgccagtacctggctcagtggcttgagaagcaggattgggagcacgccgcgaacgacgttagctttgctaccatccgattccacgacctgttatcacagctggatgatcagtatagtcgttag

SEQ ID NO: 26355 - DNA, 582 bp, Artificial Sequence
  Description of Artificial Sequence: Synthetic coding sequence
atgagccagtggtacgagctgcagcagctggacagcaagttcctggaacaagtgcaccaactgtacgatgattcatttcccatggagattcggcagtatcttgctcagtggctggagaaacaggactgggagcacgctgcgaatgacgtttccttcgcaaccatacgttttcacgacttgctttcccagcttgacgaccagtacagccgcttctcattagagaataattttctgctgcaacataatatcaggaagtccaaaaggaatctgcaggacaactttcaggaggaccccatccaaatgtctatgattatttacagctgcctaaaagaagagcgaaaaatacttgaaaacgcccagcgcttcaatcaagcccagtccggtaacatccaatcaaccgtcatgctcgataagcagaaggaactggacagtaaggtcaggaatgtgaaggacaaagttatgtgtattgaacatgagattaagtccctggaggaccttcaggatgaatatgatttcaagtgcaagactctgcaaaaccgcggctcctcgagccagaacaatcgcgtagcggaatgccactag

SEQ ID NO: 26356 - DNA, 453 bp, Artificial Sequence
  Description of Artificial Sequence: Synthetic coding sequence
atgagccagtggtacgagctgcagcagctggacagcaagttcctggaacaggtccaccagctgtacgacgatagcttcccaatggaaattagacagtatttggcccagtggctcgaaaaacaggactgggaacacgcggcaaacgatgtctcgtttgcaacaatcaggttccatgatctgctttctcagcttgacgaccagtattcccggttctcgctggaaaacaacttcttgctccagcacaatatacgaaaaagcaagcgcaacttacaggacaacttccaggaggaccccattcagatgagcatgatcatctattcttgtctgaaggaagagagaaaaatcttagaaaatgctcagaggttcaaccaggcccagagcggcaatatacagtctacagtgatgttggacaagcagaaggagctagacagcaaggtgcggaatgttaaatag

SEQ ID NO: 26357 - DNA, 582 bp, Artificial Sequence
  Description of Artificial Sequence: Synthetic coding sequence
atgagccagtggtacgagctgcagcagctggacagcaagttcctggaacaagttcaccaactgtatgacgattcttttccaatggaaatccgccagtatttggcacagtggttggaaaagcaggattgggagcacgctgcaaatgatgtttccttcgcaaccattaggttccatgacctactgagccagctcgatgatcagtattccaggttcagtctcgaaaacaatttcttactccagcataatattaggaagtcaaaaaggaacctgcaagacaacttccaagaggatccaatccagatgtctatgataatctatagctgccttaaagaagagagaaaaattctcgagaacgcccagaggttcaaccaggcccagtcggggaacattcaatccacagtcatgctcgacaaacagaaagagctcgactcaaaggtgagaaacgtcaaagataaagtgatgtgtatcgaacacgagatcaagtcactcgaagatttgcaggatgaatatgattttaagtgcaaaactttgcaaaaccgaggatcgagctcgcagaacaatagggtggctgaatgtcactag

SEQ ID NO: 26358 - DNA, 483 bp, Artificial Sequence
  Description of Artificial Sequence: Synthetic coding sequence
gagtgccacgaggaccccatccagatgagcatgatcatctacagctgcctgaaggaggagcgcaagatcctggaaaatgcacaacgcttcaatcaagcccagtctggaaacattcaaagcacggtcatgctcgataagcagaaggagctggactcaaaggtgcgaaacgtgaaggacaaagttatgtgcatcgaacacgagatcaagtccctggaggatctgcaggacgagtacgactttaaatgcaagactctgcagaacagggagcatgagaccaatggagtcgctaaatccgatcaaaaacaagagcagctgctccttaagaaaatgtaccttatgctcgacaataaacgaaaggaggtggtgcacaagataatagaactcctgaatgtcaccgaactgacacagaatgcactgattaatgatgaactggtcgaatggaaacgcaggcaacagtctgcctgtatcggggggcctccctag

SEQ ID NO: 26359 - DNA, 2556 bp, Artificial Sequence
  Description of Artificial Sequence: Synthetic coding sequence
atggcccagtgggagatgctgcagaacctggacagccccttccaggaccagctccatcagctgtattcacattctctactgccggtggacatacggcagtacttggctgtgtggatagaagaccagaactggcaagaggctgcattgggtagcgatgattccaaggccacaatgctcttctttcatttcctggatcagctaaattatgagtgcggaaggtgctcacaagaccccgaatctctgcttctgcagcataatctgagaaagttttgtagggatatccagccattctcccaggatcctacacagcttgcagagatgatcttcaatctgcttttggaagagaagcggatcctgatccaagcacagagggctcagctggaacaaggagagccggtgctcgaaactccagtagaatcacaacagcacgaaattgagtctaggatcctggatctcagagccatgatggaaaaactggtgaagtccatatcacagctgaaggaccagcaggacgtgttctgctttcgttataagatacaggccaagggtaaaacccctagtctcgatcctcaccagacaaaggaacagaagatcctccaggaaactctcaatgaactagataagcgtcggaaagaagtgcttgacgcatcaaaagcactcctgggccgccttaccactcttattgaacttctgcttcccaagttggaggaatggaaggcacaacaacaaaaagcctgtatccgagctcccatcgaccacggactggaacagctggagacgtggtttacggccggtgccaagctgctgttccacctgcggcagttgctcaaggagctgaagggcctaagctgtcttgtgagctaccaggacgatcccctaacaaaaggggtcgatctaaggaacgcccaggtaaccgagctgctgcagagactcctccaccgagccttcgtggtcgaaacccaaccgtgtatgccacaaaccccacatcggccactcatccttaagacaggctctaaatttacggtgagaactcgcctactcgtccggctccaagaggggaatgaaagtttgaccgtggaggtcagtatcgacaggaacccgccacagctccagggcttccgtaagtttaacattttgacgtccaaccaaaaaacactaacccctgaaaaaggacagagccagggactcatatgggatttcggctatctgaccctggtggaacagcgatcagggggctcaggaaagggatccaacaaggggcccctgggcgtgaccgaggaactacacattataagcttcacagttaaatacacatatcaggggctaaagcaggagctcaagaccgacacccttcccgttgttatcatctctaatatgaatcagctctcaatagcctgggcatctgtcctgtggttcaacctgctgtcgcctaatctgcagaatcagcagttctttagcaacccacccaaagcaccttggagtcttctggggccagctctctcctggcaattctccagttacgtaggacgaggacttaattccgatcaactatcgatgctccggaacaaactcttcggacaaaattgcaggacagaagatccactcttaagctgggcagactttacgaagagggagagcccacctggcaagctgcctttctggacgtggctggataagattctagaactggtgcacgatcaccttaaagacctgtggaacgacgggagaatcatgggtttcgttagccgcagccaggagcggcgcctcctcaaaaagacaatgagtggaacttttctgctgcgattcagcgaaagctcagagggaggcataacctgttcctgggtggagcatcaagacgacgacaaggttttgatctattccgtgcagccgtataccaaggaggtgctgcagagcctcccgctcacggagatcatccgccattatcaactgttgacggaggagaacatccccgaaaatcctctgcggtttctctacccacggattccacgggacgaagcatttggttgttactaccaggagaaagtgaacctacaggagcgcaggaaatatctgaaacacaggctgattgtcgtttcgaacaggcaagtagatgagttgcagcagcctttagagctaaagcccgagcctgagcttgaaagtctggagctcgaactaggcctcgtcccagagcctgagctgagcttggacctggaaccactgttgaaggccggcttagatttgggcccggaactggaatccgttctcgagtctacactggagccagttatcgagccgacactctgcatggtttcccagacagttccggagccagaccaggggccagtcagtcagccagtaccagagccggatctcccctgtgacctcagacacctgaatacagagccaatggaaatttttagaaattgcgtgaagatagaagagatcatgccgaacggcgatccacttcttgccggtcaaaacaccgtggacgaggtttacgtatcccggccatcgcatttctacacggatggccctcttatgccctcagatttctag

SEQ ID NO: 26360 - DNA, 1383 bp, Artificial Sequence
  Description of Artificial Sequence: Synthetic coding sequence
atggcccagtgggagatgctgcagaacctggacagccccttccaggatcagcttcaccagttatactcacactccctcctgcctgtagacatccgccaatacctggctgtttggatagaggaccagaattggcaagaggccgcccttggaagcgacgacagcaaggccactatgctgttctttcattttcttgatcagctaaactacgaatgtgggcgttgtagccaggacccggaatctctgttgctacagcataatctccggaagttttgtcgggatatccaagacccaacccagctggctgaaatgatctttaacctgctgttggaggagaagaggatcttgatccaagcacagcgggcacagctagagcagggagagccggtcttggagaccccggtggagtctcagcagcacgagatagagagccgcatcctggatcttcgggccatgatggaaaaactggtaaaaagcatctcacaactgaaagatcaacaggacgtgttctgtttcagatacaagatccaggccaagggcaaaacgccctccctcgatccccatcaaacaaaggagcagaagattctccaggaaaccctcaacgaactcgacaaacgccgcaaggaagtgttagatgcctcaaaggccctactgggtagactcacaacactgattgagctcctgctgccaaagctcgaagagtggaaggctcagcagcaaaaagcttgcataagggctcccatagatcacggcttggagcagctcgagacctggtttactgcgggagctaaactcttattccacttgcggcagcttctgaaagagctaaaaggacttagttgcctggtgagctaccaggacgatcccctcaccaagggcgttgatttacgtaacgcccaggtgaccgagctcttacaacggcttctgcaccgtgccttcgtggttgaaactcagccctgcatgccacagaccccccatcgccctctgatcctcaagacaggttctaaatttacagtgaggacacgcctcttggtgcgtttgcaagagggtaatgagagcctcacagttgaggtgagtattgatcggaatccccctcagctgcagggatttcgcaagtttaatatcctcacgagtaaccagaagacacttactcctgaaaagggccagagccaggggctgatctgggactttgggtacctaacattagttgagcaacgctccggtggatcaggcaaaggatctaacaagggtccactgggcgttacagaggaactgcacataataagctttacagttaagtatacttaccaaggcttgaaacaggagctcaaagtgtccgagaatggtggccagggggaacgcaagcagctttggaaaaaggcctag

SEQ ID NO: 26361 - DNA, 2544 bp, Artificial Sequence
  Description of Artificial Sequence: Synthetic coding sequence
atggcccagtgggagatgctgcagaacctggacagccccttccaggaccagttacaccaactgtattctcactcgctgttgcctgtagacatccgacagtatctggcagtgtggattgaggatcagaactggcaagaggcggccttggggtcagacgattcaaaagccaccatgctgtttttccacttcctggatcagctgaattacgagtgtggacggtgttcgcaggatcccgagagcctcctactgcagcacaatctccgcaagttttgcagagacatccaagatcctacccagttggctgagatgatattcaacttgctgctggaagagaaacgcatattaatacaagcgcagcgcgctcaactggagcaaggggaaccagtgctagaaacccctgtggaatcccaacagcatgaaattgaatcaagaatcctcgatctacgagctatgatggaaaaactggtcaagtcgatcagccaacttaaggatcagcaggacgttttctgttttagatataagattcaggctaaaggcaagacaccaagcctcgatccccatcagactaaagaacagaagattctccaggagaccctgaacgaactggataagcgcagaaaggaggtgttggacgcctcaaaagctctattgggacgtctgacgacgctgatagaactcctgttgcccaaactcgaggaatggaaagcgcagcaacagaaggcatgcatacgtgccccgatagaccacggcttggagcagctggagacatggtttacagctggcgccaagctccttttccaccttcggcagctcctgaaagaactgaaaggcctgtcgtgtctcgtgagctaccaggatgatcccctcacaaagggggtggacttgcgcaatgcgcaggtaaccgagctgttgcaacgtttgcttcacagagcctttgtagtagagacccagccatgcatgccccagacccctcacagacctttaatcttaaaaaccgggtccaagttcaccgtgagaacccggttactcgttcgattgcaggagggtaatgaatccctcaccgtcgaggtgagcatcgacagaaatccaccacaactccagggcttccggaagttcaatatactaactagtaatcaaaagaccctgacacccgagaagggccagagccaggggctgatctgggactttggctatttgaccctggtggagcaaagaagcggaggctctggcaaggggtctaacaaagggcccctgggcgttacagaggaactgcacatcatatctttcaccgtaaagtacacatatcagggacttaagcaagaattgaaaactgacacattgcccgtggtgatcatctctaacatgaaccaactgagcattgcgtgggccagcgtgctctggtttaacctcttaagccccaatctccagaatcagcaatttttttctaatcccccaaaggctccatggtcacttctgggaccggcactgagctggcagtttagttcctacgtcgggagagggctcaactcggatcagctgtccatgctgcggaacaagttgttcggtcagaattgcagaacagaggatccgctgttgtcctgggccgatttcacaaagcgtgagagtccccctgggaaactcccattctggacttggttggacaagatcctggagctagtgcacgaccacctgaaagatctttggaatgacgggaggatcatgggcttcgtttccagaagtcaggagcgcagactgctgaaaaaaaccatgtcgggcacattcttactgcgtttcagcgagtccagcgaagggggaattacttgttcgtgggtggagcaccaggacgatgataaagtgctcatttatagcgtacagccctacaccaaggaggtgttacagtcactgcccctgaccgaaatcattaggcactaccagttgcttacagaagaaaacattccagaaaacccgctccggtttctctacccacgcattccacgggatgaagcctttggctgctactaccaggagaaggtgaacctgcaggaaaggaggaagtacctcaaacacaggctgatcgtcgtgtcaaaccggcaggttgacgagcttcagcagccattagaactcaagccagagccagaacttgagtcactcgaactggagctgggcctggtccccgagccagagctctctctcgacctggaacctctcttgaaggccggcttggacctgggacctgagctggagagcgtactcgagtccacattggagccagtgatcgaacccacgctgtgcatggtgagtcagaccgtcccagaaccagatcagggaccggtaagtcagcctgtgcccgaacctgacctgccctgcgatctgaggcatctcaacactgaacctatggagatttttcggaattgcgtgaaaattgaggagattatgccaaatggcgacccccttcttgcaggccagaacaccgtggatgaggtttatgtctctaggccttcccatttctacacagatggacccctaatgccgagtgacttttag

SEQ ID NO: 26362 - DNA, 2313 bp, Artificial Sequence
  Description of Artificial Sequence: Synthetic coding sequence
atggcccagtggaaccagctgcagcagctggacacccggtacctggagcagctgcatcagctgtacagtgatagcttccctatggaactccgccagtttctggctccatggattgaaagccaggattgggcctatgctgcgagtaaagagtcccacgccaccctcgtgttccacaatctgctgggcgagattgatcagcagtattcaagatttttgcaggaatctaacgttctctatcagcacaacctgcgaagaattaaacaatttctgcagagccgctacctagagaaacccatggagatagcacggattgtggcccgatgtttgtgggaggaatcccgtttgctccagaccgctgcgaccgccgctcaacagggcggccaagctaatcaccccacagccgcagtggtgaccgagaaacagcagatgctggagcagcaccttcaggacgttcgcaagagggtccaggatctggagcagaagatgaaagtcgtggaaaacctccaggacgattttgacttcaactacaaaactctaaagagccagggtgacatgcaggatctcaatggaaacaaccaaagtgtgacaagacagaaaatgcagcagctggagcagatgctcacggctctcgaccagatgagacgctcaattgtctctgagttggcaggacttctatccgccatggagtatgtccagaagacattgacagatgaggaattggcagattggaagaggaggcagcagatcgcgtgcatcggtgggccccctaatatttgcctcgaccggcttgagaactggataacttctttagccgaatcccagttgcagacccgacaacaaatcaaaaagctggaggagttgcagcagaaagtctcctacaagggagatccgattgtccagcatcgccccatgctggaggaaagaattgtggagctttttaggaatctgatgaagtctgctttcgttgtggaacggcagccctgcatgcccatgcaccccgatcggccgttagtgatcaaaaccggtgttcaattcaccactaaggtcagactgctggttaaatttcccgaactaaattatcagctgaagataaaagtgtgcatcgataaggactcaggcgacgtcgccgcactacgaggatcccggaagtttaacattctgggaactaatacgaaagtgatgaacatggaggagtctaacaatggctccctgtccgcagaatttaaacatctgaccctgcgcgagcagagatgtggcaatggtggacgcgccaattgcgacgcctcactcatcgtgacggaggagttgcatcttatcacattcgaaacagaggtttaccaccagggcctgaagatcgacctggagactcacagcctgcccgtggttgtgatttcgaatatctgccagatgccaaatgcatgggcctccattctctggtataatatgcttacgaataatccgaaaaacgtgaattttttcactaagccccccatcggcacttgggatcaggtcgccgaagtcctgtcctggcagttctcctcaacaaccaaaagaggcctgtcaatcgaacaacttacaactctcgccgaaaaactgctcggtcccggtgtgaactatagtggatgtcagattacctgggccaaattctgtaaggagaatatggccggaaagggtttttccttctgggtgtggctggacaatataatcgatctcgttaagaagtacatccttgctctttggaatgagggctacattatgggatttatctcaaaggaacgagaacgcgctattctgagtacgaagccccccggcacattcctgctgcgattcagcgagtccagcaaggaaggaggcgtgaccttcacatgggttgagaaggacatttccggtaagactcaaattcagtctgtcgagccatatacaaagcagcaactgaataatatgtcctttgcagagataataatgggatacaagattatggacgctacgaacatcctggtgagccccctggtgtacctgtatcctgatattcccaaagaagaagccttcggaaagtactgccgacctgagtcccaggagcacccagaagctgaccctggcagcgcagctccgtacctaaaaaccaagttcatctgtgtgactccaaccacttgtagtaatacaatcgatctgccgatgagccccaggaccctagactcacttatgcagttcggcaacaacggagagggggccgaaccttccgcgggcggacagttcgagtcgctcactttcgacatggaactgacctccgagtgtgcaacatcccctatgtag

SEQ ID NO: 26363 - DNA, 2019 bp, Artificial Sequence
  Description of Artificial Sequence: Synthetic coding sequence
atggagatcgcccggatcgtggcccggtgcctgtgggaggagagccgccttttacagaccgctgctacggccgcgcaacagggcggccaggcgaatcacccaactgccgccgtggttacagaaaaacagcagatgctggaacagcacctgcaggacgttagaaaaagggtgcaggatttagaacagaagatgaaggtagttgaaaacctccaggatgattttgattttaactataaaactctgaagagtcagggggacatgcaggacctgaatgggaacaaccagtccgtgacgcggcagaagatgcagcagttggaacagatgctgacagcacttgaccagatgcgtcgatctattgtgtcagaactcgctggtcttctttctgccatggaatacgtgcaaaagaccttgaccgatgaggaacttgctgattggaaaaggcggcaacagatagcttgtatcggcggccctcctaacatttgcctggaccgactggagaactggatcacctcactggctgaaagtcagcttcagaccaggcagcagatcaaaaagcttgaagagcttcaacagaaggtgtcttataaaggggacccgattgttcagcatcgacccatgttagaagaacggatcgtggagctttttcgcaacttgatgaaatcagcttttgttgtggagcgccagccctgcatgcctatgcaccccgaccggcccctggtcattaagacaggggtccagttcacaaccaaggtgcgcctgctcgtgaagtttcccgagctaaattaccagttaaagattaaggtatgtattgacaaagactctggcgacgtagcggcccttaggggatcacgcaaatttaacatcctgggaaccaacaccaaagtcatgaacatggaggaatcgaacaatggctctttgtcagctgaatttaaacacttaactctgcgcgaacagcgatgtggtaacggaggccgggccaactgcgatgccagtctgatcgtgaccgaagaattgcacctgatcactttcgaaacagaggtataccaccaaggcctgaaaatcgaccttgagacacacagcctgccggtggtggtgattagtaatatctgtcagatgcccaacgcctgggcctccatcctctggtataatatgctcaccaacaaccccaagaacgtaaatttttttacaaagcctccaatcggaacctgggaccaggttgcagaagtcctcagttggcaatttagtagtacaactaagcgtggattgtcaattgagcaattgaccacactagctgaaaaactgctgggtcccggggtgaactatagtggctgccaaattacttgggcaaaattctgcaaagaaaacatggccggcaaggggtttagtttttgggtgtggctggacaacattattgatctagtaaaaaaatatatccttgccctatggaatgaaggctacattatgggttttatctccaaggaaagagaacgagcaattttgagtacaaaacctccaggcaccttcctccttcgattcagtgaaagctccaaagagggtggcgtaaccttcacctgggttgagaaagatatttcaggcaaaacgcagattcagtccgttgaaccctacacaaagcagcaactgaataatatgtccttcgctgagatcatcatgggatacaagatcatggacgcaacaaatatattagtaagccccctggtgtacttatatcccgatatccccaaggaagaggcttttggcaaatactgtcggcccgaaagccaggaacaccccgaggcagaccccggatcggctgcgccctatctgaagactaaattcatctgcgtgacccccaccacctgttctaacaccatagatctccccatgtcgccccggaccctggacagcctgatgcagttcgggaataatggagaaggggccgaaccttcagctggcgggcaattcgagtcgctgactttcgacatggaactgacaagcgagtgcgccacatcccctatgtag

SEQ ID NO: 26364 - DNA, 2310 bp, Artificial Sequence
  Description of Artificial Sequence: Synthetic coding sequence
atggcccagtggaaccagctgcagcagctggacacccggtacctggagcagctgcatcagctgtacagtgacagcttccctatggaactgaggcagttcctagccccctggatcgagagccaagattgggcttacgccgcttctaaagagagccatgccacgttggtgtttcataaccttctgggcgagatcgaccaacagtatagccgttttctccaggaaagcaatgttctctaccagcataacctccggaggataaagcagtttctccagtcacgttacctggaaaagccaatggagatcgcccggatcgttgcacgctgcctgtgggaagaatcaagactgctgcaaaccgccgcaacagccgcccagcagggagggcaggccaatcatccgaccgctgctgtcgtcacggagaagcaacagatgctagagcagcacttgcaggatgtgcgcaagagagttcaggacctggagcaaaagatgaaagtggtcgaaaacctgcaggatgactttgacttcaattataagactctcaagagccaaggtgatatgcaagatttgaatggtaataaccagtccgtaactcgccagaaaatgcaacaactggaacagatgcttacagcactcgaccaaatgagacggagtattgtgtctgagcttgccggattgctttctgcaatggagtatgtgcagaagacactgacggatgaggagctcgcagattggaaaaggaggcaacaaatcgcttgcattggtggcccacccaatatctgtctcgaccgcttagaaaattggattaccagcttagccgagtcccagttacagaccagacaacagatcaagaaactggaagaattacagcagaaggtgtcctacaagggggatccaatcgttcaacaccgtcctatgctggaggaaagaatcgttgagttgtttagaaacctgatgaagagcgctttcgttgtggaaaggcagccatgcatgcccatgcacccagaccgacctctcgtgatcaagaccggcgttcagtttacgactaaagttagactgctagttaaattccctgagttaaactaccagcttaaaataaaagtgtgtatagacaaggattctggcgacgtggcagctctgcgtgggagccggaagtttaatattctaggcaccaacactaaagtcatgaatatggaggaaagcaacaacgggtctctgtccgcagaatttaaacatctcacattacgcgagcagagatgcggcaacggcggacgggcgaactgtgacgcgagtctcatcgtgacagaggagttacacttaatcacatttgaaacagaggtctatcatcaagggctaaaaatcgatctagagacccattcgctgcccgttgtggtgatctccaatatttgtcagatgccaaatgcttgggcgagtatcctgtggtacaacatgctcaccaacaacccaaaaaacgtgaactttttcacaaagcccccaataggcacttgggatcaggtggcagaagtcctgtcgtggcagttttccagcacaaccaaaaggggactgagcatcgagcagctcacgacattggcagaaaagctactgggtcccggtgtcaactacagcggctgtcagattacatgggccaaattttgtaaggagaacatggcaggcaagggtttcagtttctgggtttggctggataatatcatagatctcgtaaaaaagtatatactcgcgctgtggaacgaaggatacataatgggatttattagtaaagagcgagagcgggccattctctcgaccaaacctccaggcacctttctcttacggttctccgagtcttctaaagaaggcggagtcacctttacctgggtggagaaggacatctctggcaagacgcagattcaaagtgtggagccttacacaaagcagcagctcaacaatatgagttttgcggaaatcattatgggctataagataatggacgctaccaatattctggttagcccacttgtgtatttataccccgacatcccaaaggaggaggctttcggaaaatattgtcgaccagaaagtcaggaacatccagaggccgatcccggcgctgccccttaccttaaaaccaagttcatttgtgtaacacccacgacgtgctcgaacacaattgacttgccgatgtcccctagaaccctagacagtttaatgcagttcggcaacaacggggaaggagcagaacccagcgcaggagggcagtttgaatctctaacatttgatatggagctcactagcgaatgtgcgacttcaccaatgtag

SEQ ID NO: 26365 - DNA, 2169 bp, Artificial Sequence
  Description of Artificial Sequence: Synthetic coding sequence
atggcccagtggaaccagctgcagcagctggacacccggtacctggagcagctgcaccagttgtactccgattcttttcctatggagctgagacaattcctcgccccttggatcgagtctcaagattgggcttacgccgcttccaaggaaagccacgccacactcgtgttccacaatttgctcggagaaatagaccaacagtattccagatttctccaggagtcaaatgtattatatcaacacaacctgcgccgaattaaacagttcttacaaagtcgatatctagagaaacccatggaaattgcacggatcgtcgcgagatgtctctgggaggaatctcgcctcctccagacagccgccacagctgctcagcagggtggtcaggctaaccaccctactgctgcagtggtaaccgagaaacagcaaatgttggagcagcaccttcaggacgtgagaaagagagtgcaggacctggaacaaaagatgaaggttgtggaaaatttacaggacgacttcgactttaattacaagaccctcaagagccagggagacatgcaagatctaaatgggaataatcagtctgtgaccagacagaagatgcagcaacttgagcagatgctaacagccctggatcagatgcgcagatccattgtctctgagttagctggcttgctttcagctatggaatacgtgcagaagacactgaccgacgaagaattggcggactggaaacggagacagcagatagcctgcattgggggccccccaaacatctgtctagatagactagagaactggatcacatcactggccgaatcacagctccagacaagacagcagatcaaaaaacttgaggagttacaacagaaggtttcctacaaaggagatcccatcgttcagcataggcccatgctcgaggaacggatcgttgaacttttccgtaacctcatgaagagcgctttcgtagtagaacggcagccttgcatgcctatgcatcctgatcgacctttggttatcaaaaccggcgtgcagttcacaacaaaggtacgactgttggttaaatttccagagctcaattatcagctcaaaataaaagtgtgcatcgataaagacagtggcgatgtggccgctttaaggggcagtcgcaagttcaatatcctcggaactaacaccaaagtcatgaacatggaggaatctaataatggttctctaagtgctgagttcaaacacctcacactgcgcgagcagcgctgtggaaacggcggcagagcaaactgcgatgcatccctgatcgtgacagaagagctgcatctgattaccttcgagaccgaggtttaccatcagggcctcaagatcgacctggagacccatagcctgcccgttgtcgtcatcagcaacatttgtcagatgccaaatgcttgggcgtccattctctggtataatatgctcaccaataatcccaaaaacgtgaacttctttaccaagccccccatcggcacttgggaccaggtagctgaggtgttgagttggcagtttagtagtaccaccaaacggggcctgtctatcgagcagcttacaacgttagccgagaaactgctaggccccggggtaaattacagtggttgtcagatcacctgggcgaaattctgcaaggaaaacatggcaggcaagggctttagtttttgggtctggctggataatatcatcgatctcgtgaaaaaatacatcttagctctttggaacgagggatacataatgggctttatctccaaagaaagggagagggctattctgtcaactaagcctccaggtacttttctgcttcgattctcagagtcctccaaggagggcggggtcacttttacctgggtcgagaaagatatctccgggaagacgcagatccagtccgtggaaccttatacaaaacagcagctcaataacatgagctttgccgaaatcatcatggggtataagatcatggatgctacaaatatccttgtgtctccactggtgtatctgtaccccgatatacccaaggaagaggctttcggcaagtattgtagaccagaatcacaggaacaccccgaagctgatccaggaagtgcagcaccctatctgaagaccaaattcatctgcgttacaccctttatcgacgccgtgtggaagtag

SEQ ID NO: 26366 - DNA, 2247 bp, Artificial Sequence
  Description of Artificial Sequence: Synthetic coding sequence
atgagccagtggaaccaggtgcagcagctggagatcaagttcctggagcaagtcgatcagttttatgacgacaactttcccatggagatccggcacttactcgcccagtggatcgaaaaccaagattgggaagcagcatcaaataatgaaacaatggctaccatactattgcagaacctgctgattcagctggacgagcaacttggccgtgtcagtaaagaaaagaacctgctgctgattcacaatctgaagagaattagaaaagtactgcagggaaagttccacggaaaccctatgcacgtggccgtagtgatcagcaattgcctcagggaggaacggagaattctcgctgcagccaacatgcctgtgcagggccctctcgagaagtccctgcagagcagctcagtctcagagcggcagaggaacgtggaacacaaggtggccgctattaaaaattctgtacaaatgaccgaacaggacaccaagtacttagaggatctgcaggacgaattcgactacaggtacaagacaattcaaactatggatcaatctgataagaattctgctatggtgaatcaggaggtgctgactctacaggaaatgctgaactcattggactttaaaaggaaggaggccctatctaagatgacccagataattcacgagaccgaccttctgatgaataccatgcttatcgaggaactccaggactggaaacggaggcagcagattgcatgcatcggagggccactgcacaatggcttagaccagcttcagaactgttttacgttgctggctgagagtctattccaactccgaagacaactggaaaagctggaggaacagagcacgaagatgacttatgagggtgatcctatacccatgcaacgtacccatatgctggaacgcgtgaccttcctcatctacaacctcttcaaaaattctttcgtggtagagcgccagccatgtatgcctacacaccctcagcgcccattagtgctgaagaccctgatccagttcaccgtgaaactacgacttctgataaaactcccagagctcaactaccaggtcaaggtcaaggcttctatcgacaagaacgtgtctacgctgtccaataggaggttcgtgttgtgcggcacaaacgtgaaagcaatgtcgatcgaggagtcaagtaacggcagcctgagtgtggagtttcggcatctacaaccaaaagaaatgaagtcttccgcaggcggtaaagggaatgaggggtgtcatatggtcacggaggaattgcatagtattactttcgaaacccagatctgcctgtacgggctgacaattgatttggagacatcaagcttgcctgttgtgatgatctccaacgtgtcacagttacctaatgcttgggcctctattatttggtacaacgtgtccaccaatgactcacaaaatcttgtattcttcaataaccctccgcccgcgactctgagccagctcctcgaggttatgagctggcagtttagtagctatgtgggacgtgggctgaattctgaccaattgcatatgttggcagagaagctgactgtccagtccagttattccgacggccatctcacatgggccaagttttgcaaggaacatcttccagggaaaagctttacgttctggacttggttagaagcaattctggacttaataaaaaagcatatcttgcctttatggattgacggctatgtaatgggattcgtctccaaagaaaaagaaagattattgctgaaagacaaaatgccaggcacatttctgctcagattttctgagagccatctgggagggattactttcacctgggtggaccatagtgagtcaggagaggtgagattccatagcgtcgagccctataacaagggtcggctctcagctctgccttttgcagacatactccgcgactacaaagtgataatggcagagaatattcccgagaacccccttaaatacttataccctgatatacccaaggataaggccttcgggaaacactatagctctcagccatgtgaggtatcccgccctactgagcggggggataaaggctatgtgccatctgtatttattccaatctcaacaatcaggagcgattctactgaaccgcactcgccctcagatttattgcctatgagcccctccgtgtatgcagtcctcagggagaacctgtctcctacaacaatcgagacagccatgaagtccccctattcagctgagtag

SEQ ID NO: 26367 - DNA, 2247 bp, Artificial Sequence
  Description of Artificial Sequence: Synthetic coding sequence
atgagccagtggaaccaggtgcagcagctggagatcaagttcctggagcaggtggaccaattttacgacgataattttcctatggagatccgccacctcttagcacaatggattgagaaccaggattgggaagctgcaagtaacaacgaaaccatggctactatattgttgcagaacctcctgatacaattggatgaacagctgggtagagtttccaaagagaaaaacctgcttttaatccataacctcaagcggattcgaaaggtcctgcaaggcaaatttcacgggaatcccatgcacgtggcagtggttatatcaaactgtctgagagaggaaaggcgaattctggcggccgccaatatgccagtgcagggaccccttgaaaaatcccttcagagcagcagtgtaagcgagcggcagagaaacgtggagcataaggtagcagctatcaagaactccgtacagatgacagagcaggatactaagtatctggaggacctccaggacgaattcgattaccgctataaaaccatccagacaatggaccaatccgataaaaacagtgccatggtgaaccaagaggtactgacccttcaagagatgcttaattctctggatttcaaaagaaaggaggcgctaagcaagatgacccagataattcatgagactgatctcttgatgaacaccatgctgatcgaggaactgcaggattggaaacggaggcaacaaatcgcgtgtatcggggggccattgcacaacggcctcgaccagctccagaattgcttcacactccttgcagagtcactgttccagctgcggagacagctggagaagcttgaggagcaatccactaagatgacttacgagggggatcctataccaatgcagagaacccatatgctggagagagtgacttttctcatatataatctcttcaagaacagttttgtcgttgagcgacagccttgtatgcctactcatccgcagagacccttggttcttaagacccttatccagtttactgttaaacttcgactactgatcaaattgccggagctgaattaccaggtcaaagtaaaggcttccattgataaaaacgtctcaacgttgtccaaccgccgtttcgtactctgtgggaccaacgttaaggctatgtctattgaggagtcttccaatggcagcttaagtgttgaatttaggcacctgcagcccaaggaaatgaaatcttccgccggtgggaaggggaatgaaggctgccacatggtgactgaggaattacattccatcacattcgagacacaaatttgcctgtacggtctgactatcgacctggagaccagctcccttcctgtggtgatgatatccaacgtgagccagctgcctaatgcatgggcatcaattatctggtacaacgttagcacaaacgactcacagaacctagtcttcttcaataatcctcccccggccaccctgtctcagctcttagaagttatgagctggcagttctcttcctacgtgggtaggggactgaattcagatcagttacacatgctggcagagaaactaacagtacagagctcgtacagcgatgggcatctgacctgggctaaattctgtaaggagcacctgcctggtaagtccttcactttctggacttggctggaagccatactggatctgatcaagaagcatattttacctctttggattgatggttacgtaatgggatttgtctctaaagaaaaagaaagattgctgctcaaagataaaatgccagggacgttcttattaagattcagtgagtcccatttgggcggtattaccttcacttgggtggaccactctgagtctggcgaggtgcgctttcactctgtagagccctacaataaaggacgcctctcagcactgcccttcgcggacattttaagagattataaggtaatcatggccgagaacataccggagaaccccctgaagtatctgtatcctgatattcccaaagacaaggcgtttggtaagcactactcatctcagccctgcgaggtttctcgcccaacggaacgcggggataaaggctacgtcccttcggtctttattccaatttccactattaggtctgactctactgagccgcactccccgtctgatttactgccaatgagcccgagcgtctacgctgtcctgcgggagaacctgagcccgaccaccattgagacagctatgaagagcccttacagcgccgaatag

SEQ ID NO: 26368 - DNA, 354 bp, Artificial Sequence
  Description of Artificial Sequence: Synthetic coding sequence
atgagccagtggaaccaggtgcagcagctggagatcaagttcctggagcaggtggaccagttttacgacgataacttcccaatggaaattcggcacctgctggcacagtggatagaaaatcaggattgggaggctgcctcaaacaacgaaacaatggctaccatccttctccagaatctgttaattcagctcgatgagcagttgggtagagtgagcaaggaaaagaatttgctactgattcataatttaaaaagaatcaggaaagtgcttcagagtcctgggctggctactgctcagctgccgctggatcgccatggtgagacctgcattcaacggtcaaaatcatgtccgtag

SEQ ID NO: 26369 - DNA, 78 bp, Artificial Sequence
  Description of Artificial Sequence: Synthetic coding sequence
atgagccagtggaaccaggtgcagcagctggagatcaagttcctggaacaggtggaccagttttatgacgacaattag

SEQ ID NO: 26370 - DNA, 240 bp, Artificial Sequence
  Description of Artificial Sequence: Synthetic coding sequence
atgagccagtggaaccaggtgcagcagctggagatcaagttcctggaacaagtagaccagttctacgatgataactttccaatggagattcgacatctgcttgctcagtggattgaaaatcaggactgggaggccgcatcaaataatgaaaccatggctaccatactgctgcagaacctgctaatccagctggatgagcagcttggaagagtttcgaaagagaaaaaccttctgctgtag

SEQ ID NO: 26371 - DNA, 2385 bp, Artificial Sequence
  Description of Artificial Sequence: Synthetic coding sequence
atggccggctggatccaggcccagcagctgcagggcgacgccctgcggcagatgcaggtgttatacggacaacatttcccaatcgaggtgcgccattatcttgctcagtggatcgagagccagccatgggatgccatcgacttggacaatcctcaggacagggcccaggctacccagcttctggagggccttgtgcaagagcttcagaaaaaagcagaacaccaggtcggtgaggacggtttcctgttaaaaatcaagcttggacattacgccacgcagcttcagaagacctacgataggtgtccgctggagctcgtgagatgcattagacatattctctataacgagcagcggttagtgagagaagctaataattgcagctctcctgcgggtatactggtggatgccatgtcccagaaacacttgcagataaaccagacgttcgaggaactgagactcgttactcaggataccgagaacgagttgaagaagttgcagcagacccaggagtacttcataatccagtatcaggagtccctccggatccaggcccagtttgcgcagctggcccagctgtctccgcaggaaaggttgagccgcgagactgccctgcagcagaagcaggtttctctggaagcttggttgcaaagggaagcccaaactctgcaacaataccgagtggagctggccgagaagcaccagaaaacactgcagctgttacgcaagcagcagactataatcctggatgacgaattgatccagtggaaacggagacagcaactcgcaggtaacggtggtccccccgaggggagccttgatgtgcttcaatcctggtgtgagaagctggctgagataatttggcaaaatagacagcagattcgtcgcgctgagcacttatgccagcagttgcccatcccaggacccgtggaagagatgcttgccgaagtgaacgcaaccattacagacataataagcgccctggtcacgagtacgtttataatagaaaaacagcctccccaagtgcttaaaacacagacaaaatttgccgcaacggtcaggttacttgtgggcggtaagttgaacgtgcatatgaatcctccccaggtcaaggcgacaattatcagcgagcagcaggccaaaagcctattgaaaaacgagaatacacgtaacgagtgttctggcgaaatcctgaataactgttgcgttatggagtaccaccaggctacaggaactttaagtgcccatttccgaaatatgagtctcaagcgcattaagcgtgctgataggagaggggccgaatcagttacagaagaaaagtttaccgtgctttttgaatcgcagttttccgtggggtctaacgagttggtcttccaggtgaaaacactcagcttaccagtggtggtaattgtccacgggagccaggatcacaacgccacagctacagttctctgggacaacgcctttgctgaacccgggcgagttccatttgcagttcctgacaaggtcctctggccgcagctttgtgaggccctgaacatgaagttcaaggccgaggttcagtcaaatcggggtctgacgaaggaaaacttagtatttcttgcgcaaaagctattcaacaactcctcctctcatctggaggactattcaggcctgtctgtctcctggtctcagtttaatcgggaaaacctacccggttggaactatacgttctggcaatggttcgacggcgtgatggaagtgttgaagaagcaccataaaccccactggaatgatggagcaatcctcggcttcgtaaataagcagcaagcccacgacctcctaataaacaaaccagacgggaccttcctcctccggttttctgatagcgagatagggggcatcacaatagcctggaaattcgatagtcccgaacgcaacctctggaaccttaagccttttactactcgggactttagcatacggtcactggcagatagactcggcgacctctcctatctgatttatgtcttccctgaccgtccaaaagatgaagtattttctaagtactatactccagtgctggctaaggctgtcgatggatacgtcaaaccccagatcaagcaggttgtgcccgagtttgtgaatgccagtgccgacgccggcggcagcagcgccacttacatggaccaagccccatcgcccgcagtatgccctcaggctccatacaacatgtacccccagaaccccgaccatgtgcttgaccaggatggcgagtttgacttggatgaaacaatggatgtcgcgaggcacgtcgaagagctgctgcgcaggccaatggacagcctcgactctaggctgtctcccccagcgggcctgtttacctcagcaaggggcagcttgtcttag

SEQ ID NO: 26372 - DNA, 378 bp, Artificial Sequence
  Description of Artificial Sequence: Synthetic coding sequence
atggccggctggatccaggcccagcagctgcagggcgacgccctgagacagatgcaggtactttacggacagcacttccccatcgaagttcgccactacctcgcacagtggatcgagtctcaaccctgggacgcaatagacctcgataacccacaagatcgggctcaggctacccagctccttgaaggtttggtacaggagcttcagaaaaaggcggagcatcaagtcggcgaagatgggtttttgcttaagattaaacttggccattacgctacccagcttcagaaaacctatgacagatgcccccttgagctcgtgcgctgtatcaggcatattctttacaacgagcagcgcttggttcgcgaagcaaacaattag

SEQ ID NO: 26373 - DNA, 2376 bp, Artificial Sequence
  Description of Artificial Sequence: Synthetic coding sequence
atggccggctggatccaggcccagcagctgcagggcgacgccctgaggcagatgcaggtgctgtatggccagcactttcctattgaagtccggcactacctggcccagtggattgaaagtcaaccctgggacgcaattgaccttgataatcctcaggacagggcccaggctacccagttacttgagggcctagtgcaggaactccagaaaaaagctgagcatcaggtaggagaggacgggttccttctgaaaatcaagctgggccattatgctacacagttacaaaagacatatgaccggtgtccactggaactggtacgctgcattcggcatatcttatataacgagcagcgactggtcagagaggctaacaattgcagctccccagctggcatcttagtcgatgcaatgagccagaagcacctgcagatcaaccagacttttgaagaactcaggttggtcacacaggacacggagaatgaattgaagaagctgcagcagacccaggagtatttcatcatacagtaccaagaaagcctcagaatacaggctcaatttgctcagctagcccagttgtcccctcaggagaggctgagtagagaaaccgccttacagcagaaacaggtatctctggaagcctggttgcaaagagaggcacagaccctccagcagtaccgcgtcgagctggcagagaagcatcaaaagacactccaacttctccgtaaacaacagactatcatcttggacgatgaactgattcagtggaagaggcgccagcaactggccggtaatggcggcccgccagagggcagcctcgacgtcctgcagagttggtgtgaaaagttggctgagattatctggcagaaccggcagcaaatccgacgggccgaacacttatgccagcagctgcccattcccggccctgtggaagagatgctggcagaagttaatgccactatcacagacatcatatcggctctggtgaccagcaccttcatcatcgaaaagcagccgcctcaagttttgaaaacccagacaaaattcgccgcaactgttaggttgctcgttggggggaagctgaacgtgcacatgaacccaccccaggtgaaggccaccatcataagtgaacagcaagccaaaagcctgctgaagaacgaaaacaccagaaatgagtgctcaggggaaatcctcaacaattgctgcgtcatggagtaccaccaggctaccggtacactgtccgctcactttagaaacatgtccttaaagagaataaagagggccgatagacgcggggccgagtcagtcaccgaggaaaaattcaccgtgctgtttgagtcacagttctccgtgggaagtaatgagctggtctttcaagtgaagaccctgtctttgccggttgtggttatcgttcacgggagccaagatcacaatgcaactgctacagtcctctgggataatgcattcgccgagccaggacgagtacctttcgccgtccccgataaggtgctgtggccacaattgtgtgaggccctgaacatgaagttcaaggcagaggtgcagagtaatcgtggcctgacaaaggagaacctagtttttttggcccagaagctgttcaacaattcttcctcacacttggaagactacagcgggctctccgtctcatggtctcagtttaatagagagaacttgcctggctggaactatactttttggcagtggtttgatggcgtcatggaagttctcaaaaagcatcacaagccacattggaatgacggtggcttcgtcaataagcaacaagcccacgacctcctgatcaacaagcccgatggcacatttcttctgcgcttcagcgatagcgagatcggcggaatcaccatagcttggaaattcgacagtcccgagaggaacctgtggaatttaaaacccttcacaacgcgggacttctcaattagatccttggcagaccgcctcggcgacttgtcatacctgatttacgtttttccggaccgtccaaaggacgaggttttctccaaatattataccccagtgctcgccaaagccgtggatggctatgtcaagccacagattaagcaggtcgtccctgaatttgtgaacgcgtcagccgatgccggcggaagctctgcaacctacatggaccaagccccttcccctgctgtgtgccctcaagccccatacaacatgtatccacagaatcctgaccacgtgctggatcaggacggagaattcgatttagacgagaccatggacgtcgcccggcacgtcgaggaattgctgcgtaggcccatggactcactggatagccgtctgtcgccccccgcagggctctttaccagtgcgcggggctccttgtcatag

SEQ ID NO: 26374 - DNA, 2298 bp, Artificial Sequence
  Description of Artificial Sequence: Synthetic coding sequence
accgccatggccggctggatccaggcccagcagctgcagggcgacgcgctaaggcagatgcaggtcctttacggccagcacttccctatcgaggtgagacactacttagctcaatggattgagtctcagccttgggacgccatagacctagacaaccctcaggaccgcgcccaggccacccagttgcttgaaggactcgtgcaggaactgcagaaaaaagcagagcatcaggtcggcgaggatggtttcctgcttaagatcaagttgggtcattacgccacacagttacagaaaacctacgacagatgtccactagagctggtgagatgcattagacacattctttacaacgagcagaggttggtcagagaagctaataattgctcaagtcctgccgggattttggtcgacgctatgtcccaaaaacatctgcagatcaatcagacctttgaggagctccgactcgtgacccaggacacagaaaacgaactgaagaagctacagcagacacaggagtacttcataatacagtatcaggagtctttaagaattcaggcccagtttgcacaactcgcccagctgtctccacaggagcggctgtctagagaaacggcactccagcagaagcaggtgagtttagaagcctggctacagcgagaagcacagacactgcagcagtacagagtcgaactagccgaaaaacaccagaagaccctgcaactgctcaggaaacagcagactattattctcgatgacgagctgatccagtggaaacgccgtcaacagttggcaggcaatggcggcccccccgaagggagtttggacgtgcttcagtcatggtgtgagaaactagccgagatcatatggcagaacagacaacagatccgccgcgccgagcacctatgccagcaattgcctattccagggcccgttgaggaaatgctcgctgaggtgaatgcgacaatcacagatatcattagcgcgttagttacctcaacctttattatagagaaacagcctccacaggttttgaaaactcagacaaaattcgcggcaactgtgcgcctcctagtaggtggaaaattgaacgtgcacatgaaccccccccaggtgaaggcaactatcatcagcgaacagcaggccaagagcctccttaaaaatgaaaatacccgtaacgagtgttctggggagatcctaaacaattgttgcgtaatggagtaccatcaggcaacagggaccttgagcgcacactttcgtaacatgtcactcaaacggatcaagagagcagaccgccgcggagccgaaagtgtgacggaagaaaaatttaccgtcctgtttgaatctcagttttcggtaggatccaacgagctggtgttccaggttaagggacgcgtgccattcgcagtccccgataaggtgctatggcctcagttgtgcgaggctttgaacatgaaattcaaggctgaagtccaatcaaatcgaggacttacaaaagaaaacctcgttttcttggcacagaagctcttcaacaattcttccagccacttggaggattacagcggactctccgtgtcctggtcccagttcaatcgcgagaatctgccaggatggaactacacgttctggcagtggttcgatggcgtcatggaggtgctcaaaaaacatcacaagccccattggaacgatggcgccattttgggctttgtcaacaaacagcaagcacacgatctgctgatcaacaagcccgacggcacttttctgttgcgtttcagtgacagtgagattggcgggatcaccattgcctggaagttcgactctcccgagaggaacttatggaaccttaagccttttacgaccagggacttctctattcgttccctcgctgaccgactcggagacctctcttatctcatttatgttttccctgataggcctaaagatgaggttttctcgaaatactatacaccagtgctggcaaaagccgttgacggttatgtgaaacctcagattaaacaggtagtgccagagtttgtgaatgctagcgctgatgcaggtgggtcttctgctacatatatggaccaagccccttctcctgctgtctgcccacaggctccatacaacatgtacccccagaacccggaccacgtgctagaccaagatggcgaattcgacctggatgagactatggatgtagcccgacacgtcgaagaactgctcagacggcctatggactcccttgattctcgactgagcccgccagctgggttgtttacgtcagccagaggatccctatcctag

SEQ ID NO: 26375 - DNA, 2295 bp, Artificial Sequence
  Description of Artificial Sequence: Synthetic coding sequence
atggccggctggatccaggcccagcagctgcagggcgacgccctgcgacagatgcaggtgttgtacgggcagcacttccctatcgaggtgcggcactatctggcccagtggatagagagtcaaccttgggacgcaattgacttggacaatcctcaggaccgtgctcaagccacccagctgcttgaagggttagtccaggagctccaaaagaaggcagaacatcaggtgggcgaggatggcttcctgctgaagattaaactgggccattacgcaacccaactccagtgctcgtctccagccggaatcctggttgatgctatgtcccaaaaacatttgcaaattaatcagacatttgaagagctccggctcgttacacaggatactgagaacgagctcaaaaagctgcaacagacccaagaatattttatcatccagtatcaggagtcacttcgaatccaggcccaattcgcccagctcgctcaactgagtccccaggagcgtctcagcagagagacagcgctccagcagaagcaggtatctttggaggcatggctgcaacgtgaagctcaaacgttgcagcagtatagggttgaattagcagagaaacaccagaagacactgcagctccttcgtaagcagcagaccattatcctagacgatgagctgattcaatggaagaggaggcagcagctggccggaaacggaggaccccccgagggttctcttgatgttctacaatcatggtgcgagaaactggcagagattatatggcagaatcgacagcaaatccggagggcagagcatttgtgccagcagctccctattcccggtcccgtggaggaaatgctggcagaagtcaatgccaccatcaccgatatcatatcggccttggtcacaagcacgttcattatcgagaaacaaccccctcaggtccttaagacccagacaaagtttgctgcaacagttaggctgctggtgggcggcaaactgaacgtgcacatgaatcctccccaggtgaaggcaactattatctctgagcagcaggctaagagcttgttgaagaatgaaaatacaaggaacgagtgctccggagaaatcctcaacaactgctgtgtcatggagtatcatcaggcaactggcacactgagcgcccacttcaggaacatgagcttaaagcgtatcaaaagggcagatagaaggggtgcagagtctgtgactgaggagaagttcactgtgttatttgagtctcaattttccgtggggtccaatgaactagtgttccaggtgaagaccctcagtctcccggttgtcgtgatcgtgcacggtagtcaggatcacaatgctacggccacggtgttgtgggacaacgctttcgctgagccaggacgcgtgccttttgctgtccccgacaaggttctgtggcctcagttatgtgaagccctcaatatgaaatttaaggccgaagttcagtccaatcgcggactgaccaaagaaaatttggtgttcttagctcagaagttgtttaataattcgagctctcacctagaagactactctgggcttagtgtctcctggtcccagtttaatcgggagaatctgcccggctggaactacacattctggcagtggtttgacggcgtcatggaggtgctgaagaaacaccacaagcctcactggaacgacggggccatccttggctttgtgaataagcagcaagcccatgatctgctcattaacaaaccagacggaacgtttttactccgcttctcagattcggagatcggaggcatcacgatcgcctggaaattcgatagcccagaaagaaatctatggaatttgaagcccttcaccacgcgggacttttcaattcgctccctggctgacaggctaggggatctgtcctatcttatttacgtcttccccgaccggccgaaagatgaggtgtttagcaagtactatactccggtgctcgcaaaagcagttgacgggtacgtgaagccgcagatcaaacaagtcgtgccagagttcgtaaacgcttctgccgatgcgggcgggtccagcgcgacatatatggaccaggctcctagccccgcggtgtgcccccaggcaccttataatatgtacccccaaaatcccgatcatgtgctcgatcaggacggagaatttgatcttgacgaaacgatggacgtggcccgacatgtcgaagaactgctgcggcgtcctatggatagtctagactcaagattaagtccgcccgcaggactcttcacctccgccaggggcagcctgtcctag

SEQ ID NO: 26376 - DNA, 2295 bp, Artificial Sequence
  Description of Artificial Sequence: Synthetic coding sequence
atggccggctggatccaggcccagcagctgcagggcgacgccctgcgacagatgcaggtattgtatggacagcacttcccgattgaggtgagacactacctggctcagtggattgagtcacagccatgggacgctattgatttggacaacccccaggatagagctcaagccacacaactgttagaagggttagttcaggagcttcagaaaaaggccgagcaccaggtgggcgaagacggtttcctccttaagattaagctgggccactacgccacccaactgcagtgctcatcacccgccggaattctggtagatgccatgtcccaaaagcacctacagataaatcaaacgtttgaggagctgcgtctagtcacccaggacaccgaaaatgagcttaagaaactgcagcagacacaagaatatttcatcatccagtaccaggaaagcctacggattcaagcccagtttgcacaactcgctcagcttagtcctcaggaacgactttcacgcgaaacagctcttcagcagaagcaagtgtccttagaagcatggctccaacgggaagcacagacattgcagcagtatcgggtcgagctggctgaaaaacatcagaagacgcttcagctgctccggaagcaacaaaccattattcttgacgatgagcttatacagtggaagcggcggcaacaactggccggcaatggcggccccccggaaggctcccttgacgtgcttcaatcttggtgcgagaagcttgctgagattatttggcagaaccgccaacaaatcaggagggcggagcacctgtgtcagcagttacctatcccaggacctgttgaggaaatgctcgctgaagtgaacgccaccatcacagacattatatccgctcttgtcacctccacctttatcatagaaaaacagccaccacaggttctgaaaactcagaccaagtttgcagccactgtccgcttgctggttggcgggaagctgaatgttcacatgaatcccccccaggtgaaagcaacgatcatctctgaacagcaggccaaaagcctcctaaaaaacgaaaacaccaggaatgaatgctccggtgagatcctgaacaattgctgcgtcatggagtaccatcaggctacagggaccctgagcgcacacttccgaaacatgagtcttaagcgcatcaagcgcgcagaccgaaggggcgctgaaagcgtcactgaagaaaaattcaccgttctcttcgaatcacaattttctgtgggcagcaacgagcttgtgtttcaggtgaagaccctcagtctcccagtcgtggtaatcgtccatgggtcccaggaccataatgctaccgcaaccgtgctgtgggataacgccttcgccgagccgggcagagtcccgtttgctgtgcctgataaggtgctctggccccaactctgcgaagctttgaacatgaagtttaaggccgaagtgcagtctaacagaggcctgacaaaagaaaacctcgtgttcctcgctcagaagctctttaacaacagtagttcccacctcgaggactattccggtttgtccgtgtcctggagccagtttaacagagaaaatctcccaggatggaactacaccttctggcaatggtttgacggtgtgatggaggtgctgaagaaacatcacaaaccccactggaacgacggcgctatcctaggatttgtgaacaagcagcaggcccacgatctgctcattaataagccagatggaactttcctgctccggttctctgacagcgagataggcggcatcactattgcctggaagtttgacagccccgagagaaacttatggaacctgaaaccatttaccaccagggatttcagcattcgctcacttgctgatcggctgggtgacctgagctacctcatttatgtttttcccgatcggcctaaggacgaagtttttagtaagtactacacccctgtcctcgccaaggcggtggatggttatgttaagccgcagatcaagcaagtcgtgcccgagttcgtaaacgcctccgctgacgcagggggaagtagcgccacctacatggatcaggccccgagccctgctgtatgtccacaggcaccatacaacatgtacccacagaacccagatcacgtactggatcaagacggtgagtttgatttagatgagacaatggatgtcgctcggcatgtagaagaactcttgcgtagacctatggacagtcttgatagccgtctctcaccccccgccggcctgtttacgagtgcaagaggatctttgtcgtag

SEQ ID NO: 26377 - DNA, 2364 bp, Artificial Sequence
  Description of Artificial Sequence: Synthetic coding sequence
atggccgtgtggatccaggcccagcagctgcagggcgaggccctgcatcaaatgcaagctctgtacggtcagcacttcccaatagaggtgcggcattacctttcgcagtggattgaaagccaagcctgggattccgtcgacttggacaatccccaagagaatatcaaggctacacagctgctggaggggttagtgcaggaacttcagaaaaaggccgaacatcaggttggcgaggatgggttcttgcttaagatcaagctgggccactacgcaactcagctgcagaacacctacgatagatgccccatggaattggtgcgatgcataaggcacattctgtacaatgagcagcgcctcgtcagggaggcaaacaatgggagtagcccagctggttcactagccgacgcgatgtctcagaaacacctccagatcaaccagaccttcgaggaactgcgccttgtgacacaggatactgagaacgaactaaaaaagctgcagcagacgcaagagtacttcattatccaataccaggagtcactgcgaatccaggctcagtttgggccactggcccagttgtccccgcaggagcgcttatctcgtgaaactgctctccagcagaagcaagtcagcctggaagcttggctgcaacgcgaggcacaaacactgcagcagtaccgagtcgagctggcagaaaaacatcagaaaacacttcagctgctgaggaagcagcagactatcattctagatgatgagctgatacagtggaaacggcgacagcagctggctggaaacggcggcccccctgaggggtcgcttgacgtcttgcagtcttggtgcgagaagctggccgagataatatggcagaatagacaacaaatcagacgcgcagaacatctgtgccagcagttgccaatccctggaccagtcgaggaaatgctagcggaagtgaacgccactattactgatataatttcggccttggtcactagcacctttattatagaaaagcagccaccgcaagtcctcaaaactcagaccaagttcgcggctacagtgcggctcctggtgggcggtaagttgaatgtgcatatgaacccgccgcaagtaaaggccactattatatcagagcagcaggcaaaaagcctgctgaagaatgaaaacactcgcaatgattacagtggcgagatcctgaacaattgctgtgttatggagtaccaccaagctacagggacactcagcgcccacttccgaaatatgagcctgaaaagaattaaaaggtccgatcgacgtggggctgagagcgttaccgaagagaagtttaccatcctcttcgaatcacaatttagtgtcgggggaaatgagctggtattccaggtgaagacgctgagtttgcctgtggtggtgatagtgcacggatcccaggataacaacgccacagctaccgttctgtgggataacgcctttgctgagccggggcgcgtgccattcgctgtgcctgacaaggttttatggcctcaactgtgcgaagcgcttaacatgaaattcaaagccgaagtccagtccaataggggcctgactaaagagaatctcgtcttcttagcacagaaactgtttaacaatagttcaagccacttggaagactacagcggactgtccgtctcatggtctcaatttaatagggagaatctcccgggaagaaactacacgttctggcagtggtttgacggtgtgatggaagtcttgaaaaaacacctcaagccacattggaacgacggggctatcctcggctttgtcaacaagcagcaggctcatgacttgctcataaataagcccgacggcacgtttttgttgcggtttagcgattcggagatcgggggtataactatcgcttggaaattcgacagccaggagcgcatgttctggaatctgatgcctttcactactagggacttcagtataaggagtctggccgataggcttggggatcttaattacctgatctacgtctttcccgatagacccaaagacgaggtatacagcaagtactacacaccagtgccgtgcgaaagcgcaacagcaaaggctgtggatggatatgtcaagccacagattaagcaagtggttcccgagtttgttaacgcgtctgccgacgccggaggaggcagcgctacttacatggaccaggccccaagtccggcggtttgtccccaggcacattacaacatgtacccccagaacccagactccgtgttagacaccgatggcgattttgacctagaggatactatggatgtcgcaaggcgggtagaggaactgttgggtagacccatggactctcagtggattcctcacgcacagagctag

SEQ ID NO: 26378 - DNA, 471 bp, Artificial Sequence
  Description of Artificial Sequence: Synthetic coding sequence
atggccgtgtggatccaggcccagcagctgcagggcgaggccctgcaccagatgcaggcgctgtatggccaacactttcctatcgaggtaaggcattacctcagccaatggattgagagccaggcatgggattctgtggacctggataatcctcaggaaaacataaaggcgacccagctgctggagggtctggtgcaggagctacagaaaaaggccgagcaccaggtgggggaggacggctttctcttaaaaatcaagcttgggcactacgcgacccagctccaaaacacctatgatcgctgtcccatggagctcgtgaggtgtattcggcatatactctataacgaacaaaggcttgtcagagaagccaataacggttcgtctcccgccggttctttggccgacgccatgtcccagaaacatctgcagatcaaccaaactttcgaagaattgcgactggtgactcagtag

SEQ ID NO: 26379 - DNA, 534 bp, Artificial Sequence
  Description of Artificial Sequence: Synthetic coding sequence
atgccccaggccttcctgctgggcagcatccacgagcccgccggcgccctgatggaaccgcagccctgtcctggcagtctagccgaatccttcttggaggaggaactgaggttgaacgcggaattgagtcaacttcaattttctgagcccgtcgggatcatctataatcccgtggagtacgcttgggagccacaccgcaactatgtcactaggtattgtcaggggcctaaggaagttctgttcctggggatgaatcccggaccatttggtatggcccaaaccggcgtgccttttggagaggttagcatggtgagagactggctcggtatcgtgggcccggtccttacaccgccgcaagagcaccctaagcgcccagttcttggtttagagtgtccacagtccgaagggccgaggcagagcatggggcacgagattaaatcagagttactgatgggtggatgttcctggatccgtggaaaaattcagtgcgacagggtgcaagttaggcggccaggcttcagcagccaattgtag

SEQ ID NO: 26380 - DNA, 813 bp, Artificial Sequence
  Description of Artificial Sequence: Synthetic coding sequence
atgccccaggccttcctgctgggcagcatccacgagcccgccggcgccctgatggaaccccaaccctgcccaggatccttagctgagagtttcctggaagaagaacttcggctgaatgcggagctgagccaactccagttctcggaaccagtaggcataatttacaacccagttgaatatgcttgggaaccgcatcggaattatgtgacgcggtattgtcaggggccgaaggaggtattgttcctgggcatgaatcccgggccattcggcatggcacagactggcgtacctttcggggaagtcagcatggttagagactggctgggaatcgtaggtcctgtgctgacgcctcctcaggaacacccgaaacgaccagtcctcgggttagagtgccctcagtcggaggtgagcggtgctagattctggggctttttcaggaatctgtgtggccaaccagaagttttcttccaccactgtttcgtgcacaatctttgtcccctgctctttcttgcaccttctggccgcaacctgacgccagcagagctccctgcgaagcagagagaacagctgctgggcatctgcgacgccgcactgtgtcggcaagtacaactgttaggggttaggttggtggtcggagtgggccggctcgctgagcagcgggcaaggcgggcccttgccggactcatgcccgaggtgcaggtggagggcctgctacatccatctcccaggaacccacaagcaaataaaggctgggaggcagtcgccaaggagcgactgaacgaactgggcctattgccactccttctgaagtag

SEQ ID NO: 26381 - DNA, 813 bp, Artificial Sequence
  Description of Artificial Sequence: Synthetic coding sequence
atgccccaggccttcctgctgggcagcatccacgagcccgccggcgcactcatggagccccagccttgtccagggtccttagccgagtcattcctggaagaggagctaaggttaaacgcagaactgagccagctgcagttttctgagcccgtcggaattatatataatccagttgaatacgcatgggagccacatcggaattatgtcacaagatactgtcagggccctaaggaggtgctattcttgggaatgaatcctgggccctttggcatggcccagaccggtgtaccttttggggaagtttcaatggttcgggattggctgggaatcgttggacccgtacttaccccaccccaggagcacccaaagagacctgtgcttggtttggagtgcccccagtctgaggtctccggggctcgattctgggggttctttcggaacctctgtggacaacctgaggtattcttccatcactgctttgtgcacaacctgtgtcctctcctgtttctggccccatctgggcgcaacctgaccccggccgagctgcctgcgaaacagcgggagcagttgctggggatctgtgatgcggccctgtgcaggcaggtgcagctgctgggggtgcggctagtggtgggtgtcggacggctggctgaacagcgcgcccgccgcgcgctggcaggtctgatgcctgaggtgcaggtggaaggactgcttcacccttcgccaaggaatccacaggccaataagggctgggaggctgtggcgaaggagcgcctgaatgagctgggtctacttcccttgctcctgaaatag

SEQ ID NO: 26382 - DNA, 249 bp, Artificial Sequence
  Description of Artificial Sequence: Synthetic coding sequence
atgccccaggccttcctgctgggcagcatccacgagcccgccggcgctttaatggaaccacagccatgtcccggttccctggctgagagttttctggaagaggaacttcgcctcaacgctgagctttctcagcttcaattttctgagcccgtgggaatcatatacaacccagtcgagtacgcctgggagcctcacagaaactatgttacgaggtattgccagggcccaaaggaagtgctattcctgtag

SEQ ID NO: 26383 - DNA, 519 bp, Artificial Sequence
  Description of Artificial Sequence: Synthetic coding sequence
atgccccaggccttcctgctgggcagcatccacgagcccgccggcgctctgatggagcctcagccatgtcccggcagccttgcagagtccttcctggaagaggagttacgtctgaatgctgaactctcccagttgcagttcagcgaacccgtgggcataatttacaatcccgtagagtatgcttgggaacctcatcgtaactacgtcacgaggtactgccagggtcctaaggaggtactgtttctcgggatgaaccccggaccctttgggatggcccaaaccggtgtgccatttggcgaagtgtcaatggttcgcgactggctcggaatcgtgggaccagtgcttactccccctcaggagcaccccaagaggccagttttgggattggaatgcccacaatcagaggtctccggcgctcgcttttggggatttttcaggaacctttgcggccagccagaagtgttctttcatcactgcttcgtccacaacctctgtccactgctgttcttagctccgtag

SEQ ID NO: 26384 - DNA, 291 bp, Artificial Sequence
  Description of Artificial Sequence: Synthetic coding sequence
atgccccaggccttcctgctgggcagcatccacgagcccgccggcgctttaatggagccccagccatgtcccgggagcctggcagaaagcttcctggaagaagagttgcgtctgaacgcagaactctctcagctgcagttttccgagcccgtgggcattatctacaatcccgtggagtatgcctgggagcctcataggaattatgtgactcggtattgtcagggtccaaaagaggtgctatttttaggcatgaaccctgggccttttggcatggcacagactggggtgtag

SEQ ID NO: 26385 - DNA, 273 bp, Artificial Sequence
  Description of Artificial Sequence: Synthetic coding sequence
atgccccaggccttcctgctgggcagcatccacgagcccgccggcgcactcatggagccccaaccttgtcctgggagcttagctgaaagttttctggaagaagaacttcgtctcaacgcagagttaagtcaattacagtttagcgagcccgtggggataatatataacccagtggaatacgcatgggagcctcacaggaactacgttacacgctattgtcagggacctaaagaagtcctgttccttggaatgaacccgggccctttcggctag

SEQ ID NO: 26386 - DNA, 534 bp, Artificial Sequence
  Description of Artificial Sequence: Synthetic coding sequence
atgccccaggccttcctgctgggcagcatccacgagcccgccggcgcgcttatggaaccccaaccctgccccggcagcttagctgagagttttctcgaggaggaacttcggctgaacgccgaactcagtcaattgcagttcagcgagccagtaggaataatatataaccccgtcgaatatgcttgggagccacatcggaattacgtgacacgctattgtcagggccctaaggaggtgctgtttttgggaatgaacccaggtccgttcggaatggctcagacgggggtgcccttcggtgaagtgtccatggtgagggactggttagggatcgtcgggccagtccttaccccccctcaagaacatcccaaacgtcctgtgctcggcttggaatgtcctcagagtgaggggcctaggcagtctatgggacatgagatcaagtctgaactcctgatgggcggatgctcctggattcgagggaaaatacagtgtgaccgggtccaagtacgtcgaccagggtttagttcacagctgtag

SEQ ID NO: 26387 - DNA, 327 bp, Artificial Sequence
  Description of Artificial Sequence: Synthetic coding sequence
atgccccaggccttcctgctgggcagcatccacgagcccgccggcgcacttatggagccacagccttgtccgggtagcctggcagaatcgttcttggaggaggagcttagattgaatgcggagcttagccagctgcagttttccgagccagtgggaatcatctataatccagttgaatacgcttgggagcctcacagaaattatgtcacccggtattgtcaggggcccaaggaagtgctcttcctggggatgaatcccggacccttcgggatggctcagactggggtgccgtttggagaggtgtctatggtcagagattggttgtag

SEQ ID NO: 26388 - DNA, 813 bp, Artificial Sequence
  Description of Artificial Sequence: Synthetic coding sequence
atgccccaggccttcctgctgggcagcatccacgagcccgccggcgcactgatggagccccagccttgccctggatccctcgccgagagcttcctcgaggaggagttgcgtctcaacgccgagctgagccagctgcagttttctgagcccgtcggaatcatttataatccagtggaatatgcttgggaaccccaccgaaattacgtaacgcgatactgtcagggccctaaggaggtgctctttcttggcatgaatccaggcccctttggaatggcccaaaccggagtgccatttggagaagtgagtatggtgagagactggctcggaattgtcgggcctgttctgaccccgccgcaggaacatcccaaaaggccggtactgggactggagtgcccgcagtccgaggtgtcaggagctcgcttttggggatttttcagaaatttgtgcggacaaccagaagtttttttccaccactgcttcgtgcataacctttgtcccctgctctttcttgctccctctggacggaacctaactccagccgaactgcccgctaagcaacgggaacagctgctgggaatctgcgatgccgcattgtgtcgtcaagtacaactgttgggggtgcgactggtcgtgggtgtgggccgcctcgcagagcagagagctcgaagagctctggctggactgatgccagaggtgcaggttgagggactgctgcacccgagcccacggaacccccaggccaacaaagggtgggaagccgtggcaaaggagcgacttaatgaactgggactcctcccacttttgcttaaatag

SEQ ID NO: 26389 - DNA, 534 bp, Artificial Sequence
  Description of Artificial Sequence: Synthetic coding sequence
atgccccaggccttcctgctgggcagcatccacgagcccgccggcgccctcatggagccccagccttgcccgggctccctcgctgagagttttcttgaggaggaacttcggctgaacgctgaattgtctcagttgcagttctcagagccagttggaattatctataatcccgttgaatacgcttgggaacctcatcgcaattacgtaacccggtattgccagggccccaaggaggtccttttcctcggtatgaaccctggtccgtttggtatggcacaaacaggcgtgccattcggtgaagtgtctatggtgagagactggctgggaatcgttggacccgttttgacaccgccgcaggagcaccctaaaagacctgtcctgggcttagagtgcccgcaaagcgagggacctcgccaatcgatggggcatgagataaaaagcgagcttttaatgggagggtgctcatggattcgcggtaagatccaatgtgatcgtgtacaggtgagacgacccggtttcagctctcaactgtag

SEQ ID NO: 26390 - DNA, 534 bp, Artificial Sequence
  Description of Artificial Sequence: Synthetic coding sequence
atgccccaggccttcctgctgggcagcatccacgagcccgccggcgctctcatggagcctcagccttgccccggatctctggcagaatctttcctcgaagaagaacttcgcctcaacgctgagctgtcccagctgcaattctccgaacccgtgggaatcatatataatcccgtcgagtatgcttgggagccacacagaaattatgtcacccggtattgtcagggtccgaaggaggttttgtttctgggaatgaatccaggaccctttggtatggctcaaactggcgtcccattcggggaggtttcgatggtgcgtgactggttgggcatcgttgggcccgtgctcactcctcctcaggagcatcccaaacgccccgtactcgggctagaatgccctcagagcgagggcccacgtcagagtatggggcacgaaattaagtctgagctccttatgggcgggtgcagttggatacggggaaagattcagtgtgatagggtccaggtgagacggccaggctttagtagtcagctgtag

SEQ ID NO: 26391 - DNA, 1170 bp, Artificial Sequence
  Description of Artificial Sequence: Synthetic coding sequence
atggccgagcccgaccccagccaccccctggagacccaggccggcaaagtgcaggaggcacaggatagcgacagtgattctgaagggggcgccgcgggcggcgaagccgacatggattttctgcgcaacctcttcagtcaaacgctctctttggggagccaaaaagaacgcctgttagacgaattaaccctcgagggagtggcccgatacatgcagagtgagcgttgtcgacgagtgatatgcttggtgggagccggaataagcacatccgctggcatccctgactttcgatctccctctaccggcctgtatgataatttagagaaataccatctgccctaccctgaagctatttttgaaatttcctactttaagaaacaccccgagccatttttcgccctcgcgaaggaactgtatccagggcagttcaagccaacgatctgtcattattttatgaggctcttgaaagacaagggcctgttattgcgctgttatactcagaacatcgacaccctggaacggatcgccgggctagaacaagaggacctggttgaggctcacgggactttctatacctcccactgcgtgtcagccagttgtcgtcatgagtatcctctcagctggatgaaggagaaaatattcagtgaagtaacacccaaatgcgaagattgccagtccctggtaaaacccgatatcgtttttttcggcgaatcgctgccggcccgtttcttttcctgcatgcagagcgattttctgaaagtagacttattgttagtgatggggactagcctgcaagtacagccattcgcatcactgatctccaaagcccctctgtctactccgcgcttgttgattaacaaagagaaggcaggccagtcagaccctttccttggcatgataatgggactgggcgggggaatggatttcgattccaagaaggcctaccgcgatgtagcgtggcttggcgagtgcgaccagggatgccttgctctggccgaacttttgggctggaagaaagagcttgaggacttggtgcgtcgggagcatgccagtatagacgcacaaagtggggccggggtgccaaatccttctacgtcagcaagccctaaaaagtcaccacctcctgctaaggatgaggcaagaactacagaaagagagaaaccccagtag

SEQ ID NO: 26392 - DNA, 816 bp, Artificial Sequence
  Description of Artificial Sequence: Synthetic coding sequence
atggccgagcccgaccccagccaccccctggagacccaggccggcaaggtccaggaagcgcaggactctgatagtgattccgagggcggggctgccggcggcgaagctgacatggacttcctccgcaacctctttagtcagacattatccctgggtagccaaaaggagcgcctgctcgacgagctcaccctcgaaggcgtagcacgctatatgcagtcagagcggtgcagacgggttatttgcctggtaggggccgggattagcacttccgcaggcatcccagatttccggagccctagtacaggcctgtatgataacctggaaaaatatcatcttccgtatcccgaggccatctttgagatctcctattttaagaagcaccccgagcctttcttcgctcttgccaaggaactctatcctggccagtttaagccgacgatatgtcactacttcatgcgcctattgaaagataaaggactcctccttagatgctatacacaaaacatcgacacactggagaggattgcaggccttgagcaagaagacctggtagaggcacacggcaccttctatacatcccactgcgtgtctgcaagctgccgccatgaatatccactctcttggatgaaggagaagatcttcagtgaggtcaccccgaagtgcgaggactgtcagtcactggtgaaacctgacattgtttttttcggcgaaagcctcccggcacggttcttctcatgtatgcagagtgactttctgaaggtggatctgctgctggtaatgggcacgagcctgcaaggtcggggcctggcggggtag

SEQ ID NO: 26393 - DNA, 393 bp, Artificial Sequence
  Description of Artificial Sequence: Synthetic coding sequence
atggacttcctgcggaacctgttcagccagaccctgagcctgggctcccagaaagaacggctactggatgaactgacactggagggggtcgctcgttacatgcagtccgagagatgtaggagggtgatctgtcttgtgggggcaggcatctctacctccgcaggcattcccgactttaggtccccctctaccggtttgtatgacaatctggagaaatatcatctcccttaccctgaggccatattcgaaattagctacttcaagaaacatccagaaccattcttcgctctcgcaaaggaactctatcccggccagtttaagccaaccatatgtcactatttcatgagacttttaaaggataaaggcctactcctgcgctgttacactcagtag

SEQ ID NO: 26394 - DNA, 1059 bp, Artificial Sequence
  Description of Artificial Sequence: Synthetic coding sequence
atggacttcctgcggaacctgttcagccagaccctgagcctgggctcgcagaaggagcgtttactcgacgaactgacgctggagggcgtcgctaggtacatgcagtctgaacgatgtcgtcgtgtgatctgcctcgtgggtgctggcatatctacatctgctgggattcccgactttcgaagtccctcaaccggtttatatgataacctcgaaaagtaccatctcccctatccagaggccatcttcgaaattagttactttaaaaaacatccggaaccattctttgcgctggccaaagagctgtatcctggtcagttcaaaccaaccatttgccattactttatgagactactgaaggataaagggctgttgctgagatgctatacacaaaatattgacaccctcgagagaatcgccgggctggagcaggaagacctggtggaggcacacgggactttctacactagccactgcgtgagcgcaagctgcagacatgaataccctttaagctggatgaaggaaaagatcttttcagaggtaacacctaagtgcgaggactgccagtccctggtaaagccggacattgtctttttcggggaatccttgccagcccggttcttctcctgcatgcagagtgattttctgaaagtagaccttctgctcgttatgggaacttccttgcaggttcagccctttgccagcctaatctccaaagcccctctgtcaaccccacgcctgctgataaacaaggagaaagcgggtcagtcggaccctttcctcggcatgatcatggggcttggcggtgggatggatttcgattccaagaaagcctatagggacgtcgcgtggttgggcgaatgcgaccagggctgcttagccctcgccgaactcctcgggtggaaaaaagagctggaggatctagtaaggcgggaacacgcatctattgatgcccagtcgggcgcaggggtgcctaacccgtctacgtctgcatcccctaagaagtccccccctcccgcaaaagacgaagctagaaccacagaaagggagaagccacagtag

SEQ ID NO: 26395 - DNA, 510 bp, Artificial Sequence
  Description of Artificial Sequence: Synthetic coding sequence
atggacttcctgcggaacctgttcagccagaccctgagcctgggcagccagaaagagcgcctgctcgacgagttgacactggaaggggtggctcgctacatgcagagcgaacgctgtaggcgggtgatctgtttggtaggtgctggcatcagcacaagcgctgggatcccagatttccggtcaccctcaaccggactttacgacaacctcgaaaaataccatctaccctatcctgaagctatattcgagataagctacttcaaaaagcatcccgaacccttctttgccctcgccaaggagctctacccgggtcagtttaaaccgactatttgtcattacttcatgcgacttcttaaggataaagggctgctcttacgctgctacacccagaatatagacacgctggagagaattgcaggattggagcaggaagatctggtggaggcccatggtacattttacacaagtcactgcgtgagcgccagttgccgtcacgaatatcctctgtag

SEQ ID NO: 26396 - DNA, 714 bp, Artificial Sequence
  Description of Artificial Sequence: Synthetic coding sequence
atggacttcctgcggaacctgttcagccagaccctgagcctgggctcccagaaagaaaggctgctggatgagctgaccctcgagggcgtggctaggtatatgcaaagtgaacggtgtcgccgggttatatgtttggtaggcgcgggcatcagtacaagtgccggtatccctgatttccgtagcccctcaactggactgtacgacaatttagagaagtatcatctgccttaccccgaggctatctttgagatcagttacttcaaaaagcacccagagcccttctttgccttggctaaagagctgtacccagggcagttcaagccgaccatttgtcattattttatgagacttctaaaagacaagggccttttgctaagatgttacacccaaaacattgacaccctcgagagaatcgctggcctggagcaagaagacttggtagaagcccatggcacattctacaccagtcattgtgtgagtgcctcctgtcgacatgaatatcctctgtcttggatgaaggaaaagatcttcagcgaagttactcctaaatgtgaggattgccaaagtttagtgaaacccgatattgttttcttcggggaatcactgcctgctcggttcttttcctgcatgcagtcagatttcctgaaagtcgacttgttgcttgtcatggggacctcgctgcaggtccagccattcgccagtctcatctcctag

SEQ ID NO: 26397 - DNA, 237 bp, Artificial Sequence
  Description of Artificial Sequence: Synthetic coding sequence
atggacttcctgcggaacctgttcagccagaccctgagcctgggctcacagaaggagcgtttgctggacgaacttactctggagggggtagcccgctacatgcaatccgagcgttgccgcagggtgatctgcctcgtgggggccggaatttctacctccgcagggatacccgacttcaggtctcctagcaccgggctgtacgataacttggagaagtatcatttaccgtatccatag

SEQ ID NO: 26398 - DNA, 222 bp, Artificial Sequence
  Description of Artificial Sequence: Synthetic coding sequence
atggacttcctgcggaacctgttcagccagaccctgagcctgggctctcagaaggaaagactgcttgacgagcttactctggaaggcgtcgccaggtacatgcagagcgagcgatgtcggagagtcatttgcttagtgggagcgggtatatcaacatccgccgggattccggattttaggtcgcccagtacggggttgtacgacaatctcgagaagtattag

SEQ ID NO: 26399 - DNA, 1170 bp, Artificial Sequence
  Description of Artificial Sequence: Synthetic coding sequence
atgagcgacgaggccgaggacagcgacagcgacagcgagggcggcgccgcaggtggggaggccgacatggattttctgagaaacctgttcagtcaaacgctgagtctcggttcccaaaaggaaaggctcctcgacgaactgaccttggaaggcgtggcccgctacatgcaatcggaaaggtgtaggagagtcatctgcctggtgggggctgggatctcaacctcagccggtattcctgatttcaggagccctagtaccggcctttacgataacctggagaaatatcaccttccatatccagaagcaatcttcgagattagttatttcaagaagcatccagagcctttttttgccttagcaaaggagctgtatccaggacagttcaagcccactatctgccactatttcatgcgcctgttaaaggacaagggactgcttcttcgctgctacacgcaaaatatagataccttggaacgtatcgccgggctggaacaggaggaccttgttgaggcccacggaactttttatactagtcattgtgtttccgcttcctgtcggcatgagtatcccctctcatggatgaaggagaagattttcagcgaagtgacgccaaagtgcgaggactgtcagagccttgtcaagcccgatatcgtatttttcggagaaagcctgccagccaggttcttctcatgcatgcagagcgacttcttgaaggtcgacctgttgttagtcatgggcacttctcttcaggtgcagccctttgcatccctgatctccaaggctcctctcagcacgcctcggctgctgataaacaaggagaaggcgggtcagtctgaccccttcttggggatgattatgggattggggggagggatggacttcgattccaaaaaagcctacagagacgtggcgtggcttggagagtgtgatcagggatgtctggctctggccgaactgctcggatggaaaaaagagctcgaagaccttgtacgaagggagcacgcatcaattgatgcacagggcggcggagggcctcagccacagcacttcagcttcccacaagaggtaccagctacgtgccaagggcgtggccaggacaacagagaaggggaaactcctgtgaccgctgctagccctcgaagggacgccgagctcctaagggattcctag

SEQ ID NO: 26400 - DNA, 1227 bp, Artificial Sequence
  Description of Artificial Sequence: Synthetic coding sequence
atggccgagaacggcgacaacgagaagatggccgccctggaggccaaaatatgtcaccaaatcgaatactacttcggagattttaaccttcctcgggataagtttctcaaggagcagatcaaactcgacgaggggtgggtgcctctggaaatcatgatcaaatttaaccgcctcaacagattgacaacagattttaatgtgatcgttgaggccctgagcaagtcgaaggcagagttaatggaaatatccgaagacaagaccaaaattcgcaggtccccatcaaagcctctgccagaagtgacggacgaatataagaatgacgtgaaaaaccgcagcgtttatatcaagggcttccctacagacgcaacacttgatgacataaaggagtggctcgaggacaagggacaggtgttgaacatccagatgcggcgtaccctgcataaggctttcaaagggtctatctttgtcgtctttgattcgattgagagtgccaagaaatttgtggaaactcctgggcagaaatacaaagaaactgacctcctgattttatttaaagacgattactttgctaagaagaatgaggaacggaagcagaacaaggtggaggcaaagttacgagccaaacaggagcaggaggcaaagcaaaagctggaggaggatgcagaaatgaagtctttggaggagaagattggctgcttgctcaaattcagtggagacttagacgatcagacctgccgggaagatcttcacattcttttttccaatcacggagagattaaatggatcgacttcgtacggggagcgaaggaaggaatcattctgtttaaagagaaagccaaggaggccttaggcaaagctaaggacgccaataacggcaacctgcagctcaggaacaaagaagtgacctgggaggtgctcgaaggagaggttgagaaagaggctctgaagaagatcatagaggatcaacaggaaagtctgaataagtggaaatctaaaggaaggaggttcaagggtaagggaaagggcaataaggcagcacagccggggagcggtaaaggaaaagttcaattccagggtaagaagaccaaattcgcctccgacgatgagcacgatgaacacgacgaaaacggcgccaccggccccgtcaagcgtgccagggaggaaaccgacaaggaggagcccgcgagtaaacaacagaaaacggaaaacggagccggggaccaatag

SEQ ID NO: 26401 - DNA, 1086 bp, Artificial Sequence
  Description of Artificial Sequence: Synthetic coding sequence
atggccgagaacggcgacaacgagaagatggccgccctggaggccaagatctgccaccaaatcgagtactacttcggggactttaacctaccacgggacaaatttttaaaggagcagataaaactggacgagggctgggtgcccctagaaataatgattaagtttaatagactgaatcgactgacgaccgattttaacgtcattgtggaggccctcagtaagtccaaggcagagctcatggagattagtgaggacaagacgaaaattcgcagatcacccagcaagcctctgcctgaggtcaccgacgagtacaaaaacgacgtgaagaacaggtccgtgtatatcaaaggtttccctaccgatgctaccctcgacgacatcaaggaatggcttgaggataagggtcaagtgctgaatatccaaatgaggcgtacgctgcacaaagcctttaaggggagcatttttgtggtattcgattctatcgaatccgctaaaaagtttgtggaaactcctggtcaaaagtacaaagagacagacttactcatcctatttaaggacgactattttgccaagaaaaatgaagagaggaagcagaataaggtggaggccaagttacgagctaagcaagagcaggaggctaaacagaagctggaggaagatgctgaaatgaagagccttgaagaaaagatcggttgcttactcaaattcagtggtgaccttgacgaccagacatgtcgtgaagacctccacatccttttctccaatcatggggaaatcaagtggatcgacttcgtaagaggtgccaaagagggcatcatccttttcaaggagaaggcgaaggaggccttaggcaaagccaaagatgcaaacaatggcaatttacaactgcggaataaggaagtgacgtgggaagtgctggagggagaggtggaaaaggaagcattgaaaaagatcattgaggaccagcaggaatcgctcaataaatggaagagcaaagggcccgtaaagcgggcccgggaagaaactgataaagaggaaccagcttctaagcagcaaaagaccgaaaatggagcgggcgatcagtag

SEQ ID NO: 26402 - DNA, 1227 bp, Artificial Sequence
  Description of Artificial Sequence: Synthetic coding sequence
atggccgagaacggcgacaacgagaagatggccgccctggaggccaaaatatgtcaccagattgaatactacttcggtgatttcaacttaccaagggacaaatttctgaaggaacaaatcaaactggacgagggctgggtcccattggaaattatgattaagttcaaccgcctgaatcgactcactacagattttaacgttatcgtggaagccctcagcaagtctaaggctgagctcatggagatctcagaagacaaaaccaaaatccgcagaagcccttccaagccactgcctgaggtaactgatgagtataagaacgatgtgaaaaacaggagcgtgtatatcaaaggctttccaacagacgccacccttgacgatattaaggagtggttggaagataaggggcaagtgcttaatatccagatgcggcgcacgctgcataaggctttcaaaggatctatctttgtcgttttcgatagcattgaaagcgctaagaaatttgtcgaaactcctggccagaagtacaaggaaaccgacctgctgattctgtttaaagacgactacttcgccaaaaagaacgaagagagaaaacagaacaaagttgaggcgaaacttcgcgccaaacaagagcaagaggccaaacagaaactggaagaggatgccgagatgaagtctctcgaggagaaaatcggctgcctgctaaagtttagcggcgacctggatgatcaaacctgcagagaggacctccatattttgttcagcaaccacggcgaaattaagtggattgattttgtacgaggagctaaggaagggatcatcctgtttaaggagaaggccaaagaagcattgggaaaagcaaaggacgcaaataatgggaaccttcaactgcggaacaaggaagtgacgtgggaagtcctcgaaggagaagtcgagaaagaggccttgaaaaagatcatcgaagaccaacaggaaagtctaaataagtggaagtcaaagggaagacgtttcaaaggaaagggcaaagggaacaaggctgcacaacctggctcaggtaagggcaaagttcagttccagggaaaaaagactaaatttgcaagtgacgatgagcacgacgaacatgacgagaatggagctactggtccggtgaagagggcgcgcgaggagacagataaggaagagcctgcatcaaagcagcagaagaccgagaacggcgccggagatcagtag

SEQ ID NO: 26403 - DNA, 405 bp, Artificial Sequence
  Description of Artificial Sequence: Synthetic coding sequence
atggccgagaacggcgacaacgagaagatggccgccctggaggccaagatatgtcaccaaatcgaatactattttggggattttaacttgccgcgggacaagttcctcaaggagcagatcaaactcgacgaaggctgggtgcccttggaaatcatgataaaattcaaccgactgaaccgcctgaccaccgattttaatgttatagtcgaggccctttcaaaatcaaaagccgaactcatggaaattagcgaggataagactaagatccgcaggtccccctccaaaccactgcccgaggtgaccgacgagtacaaaaacgacgtgaaaaacagaagtgtctatatctcacacccggtggctcatgtcggagtgcagtggtgcgaccacggccccttacagagctag

SEQ ID NO: 26404 - DNA, 363 bp, Artificial Sequence
  Description of Artificial Sequence: Synthetic coding sequence
atgatcaagttcaaccggctgaaccggctgaccaccgacttcaacgtgatcgtggaggctctgagcaaaagcaaagctgagctcatggagatttcagaagataagacgaagatcagaagaagcccatctaagccacttcccgaggtcacagacgaatacaaaaatgacgtgaaaaaccgtagcgtctatatcaagggtttcccgacggatgcgaccttggacgatattaaggagtggctggaagacaaggggcaggtattgaacattcagatgcgccgcactttacacaaagccttcaaaggaagcatatttgtggtgtttgattcaattgagtcagctaaaaaattcgttgaaaccccttag

SEQ ID NO: 26405 - DNA, 555 bp, Artificial Sequence
  Description of Artificial Sequence: Synthetic coding sequence
atggccgagaacggcgacaacgagaagatggccgccctggaggccaagatttgtcaccagatagagtattatttcggggacttcaacctgcctagggataagtttttaaaagaacagatcaagttagacgagggctgggtgcccctcgaaatcatgataaagttcaacagacttaatcgtctcacaaccgattttaacgtgatcgttgaggccttgtctaagagcaaggccgagctgatggaaatttcagaagataagaccaaaatccgacggtcccctagtaagccgttgccagaagttacggacgagtataaaaatgatgtgaagaacaggagtgtctatatcaaaggcttccccacagacgctaccctggacgatatcaaagaatggctcgaggataaaggccaggtgctaaacattcagatgcggaggaccctgcataaagcattcaaagggagcatctttgtggtatttgactccatcgaatctgctaaaaagttcgttgaaactcccgggcaaaaatataaggagacggatctgcttatcctcttctag

SEQ ID NO: 26406 - DNA, 252 bp, Artificial Sequence
  Description of Artificial Sequence: Synthetic coding sequence
atgcggcggaccctgcacaaggccttcaagggcagcatcttcgtggtgttcgactcaatcgagagcgccaaaaagtttgttgaaacccccggacaaaaatacaaagagacggacctgttaatcttgttcaaagacgattacttcgcaaaaaagaacgaagaacggaaacaaaataaagtggaggcgaaacttcgcgcaaaacaggagcaagaggctaagcagaaactggaggaagatgcagagatgaaatag

SEQ ID NO: 26407 - DNA, 5505 bp, Artificial Sequence
  Description of Artificial Sequence: Synthetic coding sequence
atgaagctgagcgtgaacgaggcccagctgggcttctacctgggctctctttcacacctcagtgcgtgtcctggcatcgatcctcggagctcggaagatcagcctgagtctcttaaaactggccagatgatggatgagtccgacgaagatttcaaggaactctgtgcctccttctttcagcgcgtgaaaaagcacggcattaaagaagtttcgggcgaaaggaagacacagaaggcagcctccaacggcacccagatcagatcgaagctgaagaggacaaagcagacggccacgaaaaccaaaaccttacaggggcccgccgagaagaaaccacctagtggatcccaggccccacgcacaaaaaagcagcgtgtgacaaaatggcaggccagcgagcccgctcactccgtaaatggcgagggtggggttctggccagtgcgcccgatcctcctgtgctgagggaaaccgcccagaatactcaaaccggtaaccagcaggaaccctcgcctaacctttctagggaaaagacccgagagaacgtgcctaacagcgattcccaacctccgccttcctgtctgacgacagccgtgcccagtccttctaagccccggacggcccagctagttttgcagaggatgcagcagtttaagagggcagatcctgagcgtctgcgccatgctagcgaagagtgcagtctggaagcagctagagaagaaaatgtgcctaaggatccccaggaggagatgatggccgggaacgtttatggactcggcccccccgctccggagtcagacgccgcagtggccttaactttacaacaggaattcgcacgggtcggagcttctgcccatgacgactctttagaggagaagggcctttttttctgtcaaatctgccagaagaatttgagcgccatgaatgtcactagaagagaacagcacgtcaatcgatgtcttgacgaggcggagaaaaccctgaggcccagcgtgccacagattccagagtgcccaatttgtgggaaacccttcctgaccttgaaaagtcgcacaagtcacctaaagcaatgtgccgtgaaaatggaggtgggtccgcagcttctactgcaggccgtgcgacttcagacagctcagcccgaagggtcttcaagtccacctatgttctcattctcagatcactctagagggttgaagcgacggggcccgacctcaaagaaggagccgcgcaaacgccggaaagtggacgaggccccctcggaagacttactcgtagccatggcgctgagtaggtccgaaatggaacctggggccgcagttccagctttgcgcctggagagtgccttttctgaacggattaggcctgaggctgagaataaaagccgaaaaaaaaagccgccagtctcgcctccactgctgctcgtccaggactccgagaccacaggcagacagatcgaagaccgggtggcacttttactgtccgaggaagtggagctctcctccaccccgcctctgcccgcatccaggattcttaaagagggatgggaacgcgccggccagtgtcctcctccccctgaaaggaaacaaagctttctttgggaagggagcgcactgactggcgcttgggccatggaagacttctacacagccaggctggtgcccccccttgtacctcagcgacccgcacaagggttgatgcaagagcccgtgccgcccttggtgccacctgaacactcggaacttagcgaaagaagaagccctgccctgcacgggacacctactgccggttgcggcagcagggggccaagtccttcagcaagccagagggagcatcaagccctgcaggatttagtggatctggctagggagggactgagtgcatcaccttggcccggctccggaggactggctgggagtgagggtacagccggattggatgtcgtccctggcggactgcccttgactggctttgtggtcccatcacaggataaacatcctgatcgcgggggtagaaccctcctcagtctgggactcctggtggccgatttcggtgcaatggtcaataatccacacctctctgacgttcagtttcagaccgactccggggaggtgctttatgcacataaatttgtgttgtacgcccgctgccctcttcttatccaatacgtgaataacgaagggttcagcgccgtggaggatggcgtcctcacccagcgggttctgctcggggacgtttccaccgaggccgcacggaccttcttgcactacctctatactgcagatacaggtctgccccctggactttccagcgagctgagttccctcgctcaccgctttggagtttccgagctcgtacacctttgtgaacaggttcccatagctactgactccgaggggaagccatgggaggagaaagaagccgaaaattgcgagagtcgggccgaaaactttcaggagctgctgcgatctatgtgggccgacgaggaggaggaggctgaaactctcctgaaatccaaagatcacgaagaggatcaggaaaacgtgaacgaagccgagatggaggaaatctacgagttcgctgccactcagagaaagcttctgcaggaggaaagagcggctggggctggcgaagatgcggattggcttgaaggcggttccccagtgtcgggacagctcttagctggggtacaggtgcagaagcagtgggataaggtcgaagaaatggagccactcgagcctggccgggacgaggctgccacaacctgggaaaaaatgggacagtgcgcattgccacctccgcaggggcagcatagtggagcaaggggggccgaggcccctgagcaggaggctcccgaggaggcattaggccacagcagctgttccagtccaagcagagattgccaggctgagcgtaaggaaggttctctgcctcattccgacgacgccggtgattacgaacaactgttcagcagcacacaaggggaaatttcagagccgtcccagataacaagcgaacctgaggaacaaagcggtgctgtgagggaaagagggttagaggtaagtcacagactggctccctggcaggcatccccacctcacccttgccgatttttgctgggaccaccccagggcggaagcccccgaggttcacatcacactagtggcagcagcttgtcaaccccccgctctcggggaggcacgagccaggtaggatcccccaccctcctgtccccggccgttccttcaaagcagaagcgtgaccggagcattttgaccctgtcgaaagagcccgggcaccaaaaaggcaaggagaggcgatcagtgcttgagtgtagaaataagggggtgctcatgtttccagaaaagtctccctccatagacctgacccagagtaaccccgatcactctagctcccgaagtcaaaagtctagttccaagctgaacgaagaggacgaagtgatattgctgctcgattcagacgaagagctggagctggagcaaacgaaaatgaagtccatttcatcggatccccttgaggagaagaaggcgttggaaatctctccgaggtcatgcgagcttttctctatcattgatgtggacgcggaccaggaaccaagtcagtccccgccgagatccgaagccgtcctccagcaggaagatgagggtgcactaccagaaaaccggggatccctcggcagaaggggggccccatggttattctgcgaccgggagtccagcccatctgaggcgtctaccacagataccagctggcttgtgccggcaactccactcgcttcccggagtagagactgctcttctcagacgcagatcagcagcttacgctccgggctagccgtccaggctgtgacacagcacacccctcgagcctcagtagggaacagggaggggaatgaggtggcgcagaaattctctgtcatcagaccccagactcctcctcctcagacacctagctcttgtcttacacccgtgtcgcctggcacctcagatggtcgccgacagggtcataggtcgccctccagaccgcatcccggcggacacccccattcttcccccctggcaccccatcctatcagcggagatcgggcccacttttcaaggaggtttttgaaacatagccctccgggaccttcattcctgaaccagacccctgctggcgaggtagtggaagtaggcgacagtgacgacgagcaagaagtggcctctcaccaagctaacaggtcaccacccctagacagtgatccccctattcctatcgacgactgctgttggcacatggagccactcagccccattcccatcgaccactggaacctggagaggactggccccttgagcacaagcagcccttccaggagaatgaatgaagccgctgattccagggattgccgaagcccgggactccttgacaccaccccgatcaggggaagttgcaccacccagaggaagctacaggagaagagctccggggctgggagcttgggtaacagtaggccctccttcctgaatagcgcgttatgggatgtctgggatggagaagagcagcggccacccgaaacacctccacccgcccagatgccgagcgcagggggcgctcagaagcctgaaggtctggaaacacctaagggggctaaccggaagaagaatcttcctccgaaagtacctatcacacctatgccacagtactctataatggaaacgcctgtgctgaaaaaggaactcgatagattcggggttcgaccactgcccaaacgtcagatggtgttaaagctaaaagagatcttccagtacacacaccagactctggactcggactcagaagatgaaagccagagtagtcagccactacttcaagcacctcactgccagactttggcgtctcagacgtacaagcctagtcgggccggggttcacgcacagcaagaggcgacaacaggacccggcgcccacaggcccaagggccctgccaagaccaaaggtccaagacaccagcggaagcatcatgaaagtattacgcccccgagcaggtctccgaccaaggaggcccctcctgggctcaacgacgacgcgcaaattcctgcctctcaggagagtgttgctacctctgtcgacggcagtgattcttccctatcatctcagtccagtagttcctgcgaatttggtgctgcctttgaaagcgctggggaggaagagggcgaaggggaagtgtctgcatcccaagccgccgtccaggcagcggatactgatgaagctttaagatgctatatccgctcgaaaccagccctctatcagaaagtgctgttataccagcctttcgagctcagggagctccaggcggaactgcggcaaaacggattaagggtttcctctaggcgactactggattttctggatacacattgtatcactttcaccactgccgcgaccaggagagagaagctccaggggcgaagaaggcagccccgtggaaagaagaaagtggaaaggaactag

SEQ ID NO: 26408 - DNA, 1404 bp, Artificial Sequence
  Description of Artificial Sequence: Synthetic coding sequence
atgagcagcatcctgcccttcaccccccccgtggtgaagcggctgctgggctggaagaagagtgccggaggctccggcggcgcaggcggcggggagcagaatggacaggaagaaaaatggtgtgagaaggccgtgaaaagtcttgtcaaaaagctgaagaagaccggacgactcgacgagctcgagaaagccatcactacccagaattgcaacactaagtgcgtgactattccctcaacatgcagcgagatatgggggcttagtacgccaaacaccatcgaccagtgggacacaacagggctttattctttcagcgaacaaacgaggagcctggatggacgtctgcaagtgtcacataggaagggcttaccgcacgtaatatactgccgcctctggagatggccagatcttcactcccaccacgaattgaaggccatcgaaaactgtgagtatgccttcaacctgaaaaaggatgaagtttgtgtcaatccttatcattaccagcgtgtcgaaacgcctgttctgccccccgttcttgttcctagacacaccgaaatcctcacggaactccccccactagacgactacacacacagcatccccgagaacacaaattttcctgccgggatagagccccagagtaactacattcccgaaacccctccaccgggctatatctcagaggacggagaaacctcagaccagcaactcaatcagagcatggatactgggtctcccgcggagctcagcccgacgaccttgagcccagtgaatcactcactggacttgcagcctgtgacctatagtgagcccgcattttggtgctcaatagcttactacgaactcaaccaacgagtgggcgagaccttccatgcttcgcagccaagtctgactgtggacggattcacagatccttctaactcagagcgattttgcctcggcctgcttagcaacgtcaatagaaacgctacagtggagatgacgagacgacatatcggccgcggcgtaaggctgtattatatcgggggggaggtgttcgcggaatgcctgtccgactcggccattttcgtgcagagcccaaactgcaaccagcggtacggatggcaccctgccacagtctgtaagattccaccagggtgtaacctgaagatctttaataatcaggaattcgcagcattactggcacagtctgtgaaccagggattcgaggcagtgtaccaacttactagaatgtgtaccataagaatgagttttgttaagggctggggtgccgaatataggaggcaaactgttaccagtactccatgttggattgaactccatctgaacggtcctctgcagtggctggacaaggtattgacgcagatgggatcccctagcgtgcggtgctcaagtatgtcttag

SEQ ID NO: 26409 - DNA, 1314 bp, Artificial Sequence
  Description of Artificial Sequence: Synthetic coding sequence
atgagcagcatcctgcccttcaccccccccgtggtgaagcggctgctgggctggaagaaatccgccgggggctcagggggcgccggcggaggcgaacagaatggacaagaagagaagtggtgcgaaaaagcagtcaagtcactcgttaagaaacttaaaaagactggcaggctggacgaactggaaaaggcaattacaacacagaattgtaatactaagtgcgtgaccatcccccggtctctggacggtcgcctgcaggtgagccatcgcaaggggcttccccatgtgatctattgcagactttggaggtggccagaccttcattcccatcatgagctaaaggctattgaaaactgcgaatatgccttcaatttaaagaaggacgaggtatgcgtgaacccctaccattaccaacgggtcgaaacacctgtcttaccccctgtcttggtccctaggcacaccgagatactgacagagctgcctcccttagacgattacacacactctataccagaaaacacaaatttcccagcaggcattgagccacagtcaaattacattccagaaactcctcctcctggatacattagtgaagatggggagacctctgaccagcagttaaatcagagtatggacacaggaagccccgccgaactgagtcctaccacgctgtcaccagtgaaccattccctggatttgcaacccgttacatattctgaacccgccttttggtgctccatcgcctactacgagttaaaccagcgggtgggggagacattccatgcctcccagccctccttaacggtggacgggttcactgaccctagtaattcggaacgtttctgtctcggcctgttgtccaacgttaaccgcaacgccacggtagaaatgacccgtagacacattggacggggcgtgcgcttatattacattggtggcgaggtgttcgcagagtgtctctcagattccgctatttttgtgcaatcacctaactgtaaccaaaggtacggatggcatccagccaccgtgtgtaagatccccccaggctgcaatctcaagatttttaataatcaggagtttgccgccctccttgctcagtcagtcaatcagggatttgaagccgtgtatcagcttactaggatgtgtacaatccgcatgagcttcgtgaaggggtggggtgccgaataccggagacagaccgtaacctctaccccctgttggatcgaactgcatctgaatgggccgcttcagtggctggataaggtgctgacgcagatggggtctccatcagtgagatgtagtagtatgtcgtag

SEQ ID NO: 26410 - DNA, 1404 bp, Artificial Sequence
  Description of Artificial Sequence: Synthetic coding sequence
atgagcagcatcctgcccttcaccccccccgtggtgaagcggctgttaggctggaagaagagcgcaggaggcagcggcggagctggaggaggtgagcagaatggtcaagaggaaaagtggtgtgagaaggccgtgaagtcactagtgaaaaaactgaagaagaccgggcggctggacgaactggagaaagccatcactacccagaactgcaatacgaaatgtgtgaccatcccctcaacttgtagtgagatttggggactttccacacccaatacaattgatcagtgggataccaccggcttatatagtttttcagaacagactcggagcttagacggccggctacaggtcagtcataggaagggacttccccacgttatctattgtcgcctatggcggtggccggatttgcactcccaccacgaacttaaggcgattgagaactgcgagtatgcttttaatctgaaaaaggatgaggtgtgtgtgaatccttaccattaccagcgtgtggaaactcccgttttgccgccagtgctggtgccccgtcatactgagattctgacggaactgcctcccctggatgattatacacattcaattcctgaaaatactaattttcctgcagggatcgagccgcagagcaactatatccctgagaccccacctcctgggtacattagcgaggatggggaaaccagtgaccagcaactcaatcagagtatggatactggctcccctgctgagctgagtcctactaccctcagtcccgtgaaccactctcttgatctgcaacctgtcacctatagtgaacccgcattctggtgtagcatcgcatattacgaactgaaccaacgagtcggggagactttccatgcctcccaacccagcttgactgttgatgggttcacagatccgagcaacagcgaacgattctgtctgggcctcctgagcaatgtcaaccggaatgccaccgtggaaatgaccagacgccacataggacgcggcgtgcgcctctactacatcggcggcgaggtgtttgccgaatgtctgagtgactctgccatctttgtgcagtccccgaattgcaatcaaagatacggttggcaccccgccaccgtttgtaaaatacctcccgggtgtaaccttaaaatcttcaataatcaggagtttgctgccctcttggcgcaaagcgtcaaccagggctttgaggctgtctatcagcttactaggatgtgcactatccgcatgagttttgtcaaaggctggggcgcagagtaccggagacagaccgtgacaagtacgccctgttggatcgagcttcaccttaatggacccctgcagtggctcgataaggtgcttacacagatgggatcccccagtgtgagatgctcgagcatgtcctag

SEQ ID NO: 26411 - DNA, 1278 bp, Artificial Sequence
  Description of Artificial Sequence: Synthetic coding sequence
atgagcagcatcctgcccttcaccccccccatcgtgaagcggctgcttggttggaaaaagggggaacagaatggccaggaggagaagtggtgcgaaaaagctgtgaaatctttagtaaagaaactcaaaaaaaccgggcagctggacgagctcgagaaagcgattaccacccagaacgtgaacactaagtgcataaccataccccggtccctggatgggaggttgcaagtctctcatcgtaaaggcctgccacatgtgatttattgccgcttatggaggtggccggatctgcactcacaccacgagctcagggctatggaactgtgtgaatttgcttttaatatgaaaaaagatgaagtctgtgtgaacccttaccactatcagcgggtagaaacaccggtcctacccccagtcctcgtgccacgacacactgaaatccctgccgagtttcctcccctagacgactatagccactccatcccagaaaacaccaatttcccagcaggcattgaaccacaaagcaacattcctgagacaccacctcccgggtacctgagcgaggacggagagacctctgatcatcagatgaaccattccatggacgccggctcccctaatctgtcccccaatcccatgtcaccagcccacaataatttggacttgcagcccgtcacatactgcgagcctgccttctggtgttcgatcagttattacgagcttaaccagcgggtgggcgaaactttccacgctagtcaacctagtatgacggttgatggctttaccgacccatctaatagcgagcggttttgcttaggtttgctatctaatgtgaaccgaaatgcagcagttgaactgacccgtagacatataggtagaggagtgcgtttatattatatcgggggcgaggtgttcgctgagtgtctatctgactcggccatctttgtgcaaagtccaaattgtaatcagaggtatgggtggcaccccgcaaccgtttgcaagatcccacctggatgtaacctgaaaatctttaacaatcaggagtttgcagctctgctcgcacagtctgtgaatcagggtttcgaggccgtgtaccagcttacaagaatgtgcactatccgaatgagcttcgtaaaaggctggggggctgagtatagaaggcagacagtcactagcaccccttgttggattgaactgcatctcaatggtcctttacagtggcttgacaaagtgctaacgcagatgggctcacccagtatccggtgcagctccgtatcctag

SEQ ID NO: 26412 - DNA, 1146 bp, Artificial Sequence
  Description of Artificial Sequence: Synthetic coding sequence
atgagctgcctgcacccccggcagacctggaagggcgccgccctggtgcacagaaaggcttggtggatgggacggagcctcgatgggagactgcaagtctcccacagaaagggcctcccgcacgtcatctattgccgcctgtggagatggcccgatcttcatagtcaccacgagctgcgagcaatggaattgtgtgaattcgcattcaacatgaagaaagatgaagtatgtgtcaacccttaccattatcagagagtagagactccggttttgcctccggtccttgtcccccgtcacacagagattcctgccgagtttcctcccttggacgactattcacattcaataccagagaacactaacttcccagctggtatcgaaccacagagcaatatccctgaaaccccaccgccgggctacctgtctgaagatggggaaacatctgatcaccagatgaaccatagtatggatgcagggtcacctaacctaagccccaacccgatgagcccagctcacaacaatcttgacttgcagccagtcacttattgcgagcctgctttttggtgctccatttcttactacgagctgaaccaaagggtgggcgagacttttcacgccagtcagccgtcaatgaccgttgatggctttacagaccccagcaattcagaacgtttttgcttgggcctgctgtccaacgtgaacaggaacgccgccgtcgagcttacacgcaggcatatcggtcgaggcgtgaggttgtattatatagggggagaagtgtttgccgagtgcctaagtgactccgccattttcgtccagtctcctaactgtaatcagcggtacggctggcaccctgccacagtgtgtaagatccccccagggtgtaaccttaaaattttcaataaccaggagtttgccgcattgctcgcccagtccgtaaaccaaggttttgaagcggtttatcagctgacacgtatgtgcaccattcgtatgtcttttgtgaagggctggggcgccgagtatcgccggcagacagtgactagcaccccatgctggatcgagcttcatctgaatgggcctctgcaatggctggacaaggttttaactcagatgggctctccttccataagatgttccagcgtatcctag

SEQ ID NO: 26413 - DNA, 1278 bp, Artificial Sequence
  Description of Artificial Sequence: Synthetic coding sequence
atgagcagcatcctgcccttcaccccccccatcgtgaagcggctgctcggctggaaaaagggcgaacagaatgggcaagaggaaaaatggtgtgaaaaagcagtaaaaagcctggtgaagaagctgaagaagacaggccagctggatgaactggaaaaagcaatcaccacacagaacgttaacactaagtgtatcactatcccgagatcacttgacgggcgcttgcaagtgagtcatcgcaagggtctgccgcacgtcatttattgcagattatggcggtggccagatctgcatagtcaccacgagctgagagctatggaattgtgtgaatttgcttttaacatgaaaaaggacgaggtgtgtgtaaatccctaccactaccagcgggtcgagacccccgttctcccccccgtgttagtcccccgacacacggaaatcccagctgagttccccccactcgatgattattcccacagtatacctgagaatacaaatttcccagccggaatcgagcctcagtctaatataccagaaacaccacccccaggctatctgtccgaggacggagaaaccagtgatcaccaaatgaatcattccatggatgccggaagtccaaacttgtcacctaatcctatgtcacctgctcacaacaacctggatctgcagcctgttacctattgcgaacctgccttttggtgttccatcagctattatgagctgaatcagagagtcggagaaactttccatgcatctcagccctccatgacggtggacggctttacagatccatccaatagtgagagattctgtttaggacttttgtctaatgtcaatcggaacgctgctgtcgagctgactcggagacatattgggaggggcgtccgactgtactatatcggcggagaggtatttgcagaatgcttgtccgattctgccatcttcgttcaatctcctaactgcaaccagagatatggctggcatcccgccaccgtctgtaagattccacctggatgcaatttgaagatcttcaataatcaggaatttgcagccttgctcgcccagtccgtgaaccaagggttcgaggctgtctatcagttgacgcgaatgtgtacaataagaatgtcttttgtaaagggctggggtgctgaataccgtcgccagacagtcacctccacaccttgttggatcgaactgcaccttaacggaccgctgcaatggctggacaaggttctgacgcagatgggctcacccagtattcggtgctcctctgtctcatag

SEQ ID NO: 26414 - DNA, 693 bp, Artificial Sequence
  Description of Artificial Sequence: Synthetic coding sequence
atgaaccacagcatggacgccggcagccccaacctgagccccaaccctatgtcaccggctcataacaatttagatctgcagcctgtgacatattgcgaaccagctttttggtgctctattagctattatgaactcaaccagcgcgttggggagacctttcatgctagccagccctccatgacagtcgatggtttcactgacccgtccaacagtgaaaggttctgtctgggacttctgagtaatgtgaacaggaacgccgcagtcgagttgacccggagacatatcggtaggggtgtgcgcctgtactatatcggcggcgaggtttttgcggagtgtctgtcagacagcgccattttcgtgcaaagtccaaactgcaaccagagatatggatggcacccagctactgtttgtaagatccccccaggttgcaacctcaaaatcttcaacaaccaggagttcgctgccctactagcccagagcgtgaatcaaggctttgaggccgtctaccagctgacccgcatgtgtaccattcggatgtccttcgtgaagggatggggggccgagtataggcgccaaacagtcacaagcacaccctgctggattgagctccacctcaatggcccactgcagtggctggacaaagtcttaacgcagatgggcagtcccagcattaggtgttctagtgtctcatag

SEQ ID NO: 26415 - DNA, 963 bp, Artificial Sequence
  Description of Artificial Sequence: Synthetic coding sequence
atggagctgtgcgagttcgccttcaacatgaagaaggacgaggtgtgcgtgaatccatatcactaccagagagttgagactccggttctgccaccagtgctcgtgcctcgacatacagagatcccagcggaattccccccccttgacgactattcacactctataccagagaacacaaattttccagccggtattgagcctcagtccaacatccccgagaccccgcctccaggctatttatcagaggacggagaaacttcagaccaccaaatgaaccatagcatggacgccgggtctccaaatctctccccaaaccccatgagccccgcgcacaataacttggatctccagcccgttacatattgtgagccagccttctggtgcagcatctcctactatgagcttaaccagagagttggtgaaactttccatgctagccagccgagcatgaccgtagacggctttactgacccctccaattccgagcggttttgcctcggtctgctctcaaacgtgaatcgaaacgccgcagttgaactcacccgtcgtcacattggacgaggggtgagactgtattacataggtggggaagtttttgccgagtgtctcagcgacagcgccatcttcgtgcaatcccccaactgcaatcaacgctatggatggcacccagctaccgtttgcaagattccaccaggatgcaacctaaaaatcttcaataaccaagagttcgctgctctcttagcacaatcagtgaatcagggcttcgaggccgtgtaccaactgactaggatgtgtacaatcagaatgtcctttgtaaaaggctggggggcagagtacaggaggcagacagtaaccagcacaccatgctggattgaactccatctgaacggcccactgcagtggctggacaaggtgttaacccagatgggcagccctagcattcgttgctcttcagtaagctag

SEQ ID NO: 26416 - DNA, 1281 bp, Artificial Sequence
  Description of Artificial Sequence: Synthetic coding sequence
atgttccggaccaagcggagcgccctggtgcggcggctgtggcggagcagggcacccggcggcgaggacgaggaagaaggcgctggaggggggggcggtggtggcgagctgcggggggagggggcgacagactccagggcccacggagctggagggggaggacctgggagagcagggtgctgtctcggcaaagccgtgaggggagccaaaggccaccaccatccacatcctccggcagctggagctggtgctgcaggcggggccgaggccgacctgaaggccctaacacattcagtgctgaagaaattgaaagagcggcagctagaattactgttgcaggctgtcgaaagccgagggggcacccggactgcttgtttgcttctccccggcaggctggactgcaggctggggcccggcgcccctgccggagcccaaccagcccaaccgccttcaagctattccctcccactcttgctgtgtaaagttttccgatggccggatctacgccacagcagcgaggtgaagagactgtgctgttgcgaaagctatggaaaaatcaaccccgaattggtctgctgtaatccacaccacctgtccagattgtgtgagttggagtctcccccacctccatacagtcggtaccccatggactttcttaagcctaccgctgattgtcctgatgcagttccttcatccgctgagacgggaggcacgaattatctggcaccaggtggattatctgattcacagctgcttctcgagcccggcgaccgatcacactggtgtgtggtggcctactgggaagagaaaacacgtgttggcaggctgtattgcgtccaggagcctagtctcgacatcttctacgacttaccacaggggaatggcttctgcctgggccagctgaattccgataacaagtcacaattagtccagaaagtgcggagcaaaattggatgtggcattcaactgacgcgagaggttgacggagtgtgggtttacaacaggagcagctaccctatatttataaaatctgctacacttgataaccccgacagcaggacacttctggtccataaagtgttcccaggattctccatcaaggcattcgattacgaaaaggcctactcattgcagcgccccaatgatcatgagtttatgcaacagccctggactggattcacagtacagatctccttcgtgaaagggtgggggcagtgctacacccggcagtttatctcgtcgtgtccatgctggctagaggtgatttttaatagccgctag

SEQ ID NO: 26417 - DNA, 636 bp, Artificial Sequence
  Description of Artificial Sequence: Synthetic coding sequence
atggacttcctgaagcccaccgccgactgccccgacgccgtgccctccagcgctgagactggtggtacgaattacctggctcccggcggactcagcgactcccagcttttgctagagcctggggatagatcccattggtgtgtagtcgcatactgggaggaaaagacccgtgtgggtcgcctctattgcgtgcaagaaccatcattagatatattttacgatttgccgcagggcaacggattctgtctgggtcagctgaactccgataataaatcccagttagtgcagaaagtaagaagtaagataggctgtgggatccagttaaccagagaagtggatggggtttgggtttacaacagatccagctatccaatcttcatcaagagcgccacactggacaatcccgacagcagaactcttttggtgcataaagttttcccaggtttttctataaaagcctttgactacgagaaagcctattccctgcagaggcccaacgaccacgagtttatgcagcagccctggaccgggttcactgtccagatcagctttgttaaaggatggggccagtgttataccagacagtttatttcttcttgcccgtgttggttagaggtgatctttaattctcgttag

SEQ ID NO: 26418 - DNA, 636 bp, Artificial Sequence
  Description of Artificial Sequence: Synthetic coding sequence
atggacttcctgaagcccaccgccgactgccccgacgccgtgccctcttctgccgagaccggtggcactaactacctagcgcctggggggctgtccgatagccagctgttgctggaaccaggcgatcggagtcactggtgcgtcgtagcatattgggaggaaaagacgcgggtgggtcggctttattgcgtacaggaaccatcactcgacatcttttacgacctgccacagggtaacggcttttgtctcggccagttgaatagcgataacaaatcccagctggtgcaaaaagtcaggtccaagatcggctgcggcatacagcttacccgagaggtagatggtgtttgggtgtataatcggtcctcctaccccatatttatcaaaagcgcaacactggacaaccctgacagtcggacactcctggtgcacaaagtattcccgggcttctccataaaggcgttcgactacgaaaaggcctacagcttacagcgaccaaatgaccacgaattcatgcagcagccctggaccggatttacggtgcagattagtttcgtaaaggggtggggccagtgttacacccggcagtttattagcagttgcccttgctggctcgaggtgatctttaattcccgctag

SEQ ID NO: 26419 - DNA, 270 bp, Artificial Sequence
  Description of Artificial Sequence: Synthetic coding sequence
atgaacagccagcagcagaagcagccctgcaccccccccccccagccacagcagcagcaggtgaaacagccctgccagccaccgccccaggaaccttgtatcccaaagacgaaagaaccttgtcacccaaaggtccctgaaccctgtcatccgaaggtccctgaaccgtgtcagcccaaggtcccagaaccttgccagcccaaggttcctgagccatgcccaagcactgtcacccccgcccctgctcagcaaaagaccaaacagaagtag

SEQ ID NO: 26420 - DNA, 270 bp, Artificial Sequence
  Description of Artificial Sequence: Synthetic coding sequence
atgaacagccagcagcagaagcagccctgcaccccccccccccagccacagcagcagcaggtgaaacagccatgtcagccccctccacaggagccttgcattcccaagaccaaggaaccttgtcatcctaaggttccagaaccttgccaccccaaggtgcctgaaccctgccaaccaaaggtcccagagccctgtcagccgaaggtgcccgaaccgtgcccttctactgtgacacccgctccagcacagcaaaaaaccaaacagaagtag

SEQ ID NO: 26421 - DNA, 4260 bp, Artificial Sequence
  Description of Artificial Sequence: Synthetic coding sequence
atggccgagggcctggagcgggtgcggatcagcgccagcgagctgcgcgggattctagcgaccttagcgcctcaggctgggtcacgggagaatatgaaagaacttaaagaggctcgccctaggaaagacaacagacgcccagacctggaaatctataagcccggcttaagccgcctaagaaataaacctaaaatcaaggaaccccctggtagtgaggaattcaaggatgagattgtaaatgatcgcgattgtagcgccgttgagaatggaacccaaccagtgaaagatgtatgcaaggagctgaataaccaggagcaaaatggccccatcgaccccgagaataaccgagggcaggagtctttcccgcggaccgcagggcaggaagatcgtagcctgaaaattatcaaaagaactaagaagccggatctgcagatatatcagcccggtcgcaggctccaaaccgttagcaaagagagtgccagccgcgtcgaagaagaggaggtacttaaccaggttgaacagctgcgcgtcgaggaggacgaatgtcgcggcaatgtggcgaaagaggaagtggcaaataagccagaccgtgccgagatcgagaagtctccaggcggaggacgggtgggcgccgcaaaaggtgaaaaggggaagcggatgggaaagggcgagggagtgcgagagactcacgatgatccggcccgcggcaggcccggcagtgccaaaagatattctagatctgataaaaggcggaaccgatacagaacgcgctccactagcagcgccggttccaacaactcagcggagggagctggactcacagataatggttgtcgcagacggaggcaggatcgaactaaggaaagacctagactgaagaaacaagtatccgtgagctcgacagacagccttgacgaagaccgaatcgatgagcctgatggcctgggcccgcggcggagctcagagcgtaagagacacctagagcgcaattggagtggtagaggcgagggggagcagaaaaattctgcaaaggaatatcgaggaacgcttagagtaaccttcgatgctgaggctatgaacaaggagagccctatggttagaagcgccagggatgatatggaccgcggcaaaccggataagggattaagcagcggtggtaaagggtctgagaagcaggagtcaaagaatccaaagcaggaactgagaggacgcggccgtggcatactgatccttccagcacacacgactttgtcagtgaactccgctggcagtcccgagtcagccccacttgggccaagactgttgtttggcagcggcagcaagggttccagaagttgggggcgcgggggcaccaccagaagactctgggatcccaataatcctgatcagaagcccgctctcaagacacagacacctcaactccatttccttgatactgatgacgaggtgagccctacttcttggggcgactcaagacaggcacaggctagctattataagttccagaacagcgacaatccctattattatcccaggactcccgggcccgcgtcacaatatccttacaccggatataaccctcttcagtaccctgtgggacctaccaatggcgtgtaccccggaccatattaccctgggtatcccactcccagcgggcaatacgtttgtagccccctgcccacgagcacaatgtcacccgaggaggtggagcagcatatgaggaatctccaacaacaggaactgcatcgccttctgcgcgtggctgacaatcaggagctgcaactttcgaatcttcttagtcgcgatcgcatctccccagaaggtctggagaagatggctcagcttcgtgcagaactcctgcagctgtacgagaggtgtatcttgctcgatatcgagttctctgacaatcaaaacgtcgaccaaattctgtggaaaaacgcattctatcaggtcattgaaaaattcagacagctggttaaggatccaaatgtggaaaatccggaacagatcaggaatcgcctgctggagttgctagatgagggctctgatttttttgattccctgctgcaaaaactgcaggtcacatataagttcaagcttgaagactacatggatggcctggcaatcaggtctaaaccgctgcggaagaccgtaaagtatgcactgatttccgcccaacggtgcatgatatgccaaggcgacatcgccaggtatcgagagcaagcatccgatactgcaaactatggtaaggccagaagttggtacctgaaggctcagcacatcgcccccaagaatggccggccttacaatcagttagcgcttctggcagtgtatacccgaagaaagctggatgctgtgtactactacatgcggtccttagccgcttcaaatccaattttgacagccaaggaatccttaatgtcacttttcgaagagactaaacgtaaggccgaacagatggagaaaaagcagcatgaggagttcgacttgtcaccagatcaatggcgtaagggcaagaagtcaacatttcgccatgtaggagatgacactacccgactcgaaatctggattcatccatcacatccgaggagtagccagggaacggaatcgggaaaagactcggagcaggagaacggcttaggctccctgtcaccatccgacctgaacaagcggttcatcctgagctttttgcatgcccacggcaagctctttacccgcatagggatggagacgtttcctgccgtcgcagaaaaagtgttaaaggagtttcaggtgctcttgcaacactccccatcgcctatcggctctactagaatgctacaactaatgacgatcaacatgttcgctgtgcacaatagtcagttaaaggactgcttcagtgaagagtgccggagtgtaatccaggagcaggcagctgctctgggattagctatgttctcattactggtacggcgttgcacctgcctcctaaaggagagcgctaaggctcagctgtcttctcctgaggatcaggatgaccaagatgatattaaagtgagcagtttcgtgccagacttgaaagagctcctaccttccgtgaaagtgtggtctgattggatgctgggctatccagatacttggaacccccccccaacaagtctcgaccttcctagtcatgttgcggtcgatgtatggtctacactcgctgacttctgcaacattctgacagcggttaatcaaagcgaagttcccttgtacaaggatcctgatgacgacctcaccctcctgatcctggaagaggatcgactgttgagtggatttgttccattgctcgccgccccacaagatccttgttacgtagaaaagacctctgacaaggtaattgctgcggattgcaaaagagtaactgtgctaaaatactttctcgaggccctgtgcggccaggaggagcccctcctggctttcaaaggagggaagtacgtcagcgttgctcccgtccccgacactatgggaaaagagatgggctctcaggaaggcactaggctcgaggacgaagaggaagatgtcgttattgaggattttgaggaggatagtgaggcagagggttccggcggcgaggatgacataagggaattacgtgctaaaaagctcgccctcgcccgcaaaattgctgaacagcaacgccgtcaggagaagattcaggcagtgctggaagaccactcgcagatgcggcaaatggagctggagatcagacctctgtttctggtcccagacacaaatggctttattgatcacctggcctcactggctcgcctgctagaaagcagaaagtatattttggtggtacccctcatagtgataaatgagctggatggcctcgctaaaggccaggaaacggatcaccgggctggcggctacgctagagtggtgcaggaaaaagccaggaaatctatcgagttcctggaacagcggttcgagtcgagagactcctgtctgcgggcccttacatcgcgcggcaacgaactagagtccatcgcttttcgttctgaggatattactggacagctgggtaataacgatgatctcattctatcttgttgcctgcattactgcaaggacaaagcgaaggacttcatgccagcatcaaaggaggagcctatacggctgttaagagaagtggtccttctcacagacgatcgtaacctgcgcgtgaaggcgttgacgagaaacgtgcccgttcgcgacatcccggcttttcttacatgggctcaggtaggctag

SEQ ID NO: 26422 - DNA, 993 bp, Artificial Sequence
  Description of Artificial Sequence: Synthetic coding sequence
atgcggttccggctgtgccaccagcggggctgctgcccccacgagcgagagaacacctgtacatgcaagatgattatcagttctcttcaggttatagctgcggattgcaagcgcgtaacggtgcttaagtatttcctggaggctctgtgtggacaggaggagccactgttagctttcaagggggggaaatacgtgtcagtggccccagtccctgatactatggggaaggagatgggttctcaagagggcactcgtttggaggacgaggaggaagacgtggtgatcgaggacttcgaagaggacagcgaggccgagggctctggaggagaggatgacatccgggaattaagggcaaaaaagctggcgttggcccgcaagattgccgaacagcagcggagacaggaaaaaatccaggcagtcctggaggatcatagtcaaatgcggcaaatggagttagaaatcaggcccctcttcttggtacctgacacaaatggcttcattgaccacctggctagcctggcccggctactggaatcccgaaaatatatcctggtcgtgcccctgattgtcatcaacgagttggacggtctggccaaaggacaggagacagaccaccgcgccgggggatacgccagggtggtgcaagagaaggcccgcaagtccattgagttcctggaacagcgcttcgaatcacgagactcctgtctccgcgcgctgacttctcgaggcaatgaactcgagtccatagcctttaggtcggaggacattactggtcaactcggtaataacgatgatctaatcctctcctgttgccttcactactgtaaagataaggccaaggactttatgcctgcttccaaagaagaaccaattagactcttgcgcgaggtcgtgctgctgacagacgaccggaatcttcgcgtgaaggcattgacacggaatgtgcctgttcgtgatatcccagctttcctgacgtgggcccaggtgggctag

SEQ ID NO: 26423 - DNA, 1536 bp, Artificial Sequence
  Description of Artificial Sequence: Synthetic coding sequence
atggagaccttccccgccgtggccgagaaggtgctgaaggagttccaggtacttctgcagcactcccccagtccaatcgggagtacccgcatgctccagttgatgaccataaatatgttcgcagtgcataattctcagctcaaagactgtttcagtgaagagtgtagaagtgtgattcaggagcaagccgccgcattaggacttgctatgttctctttgctcgtgagacgttgcacctgcctcctcaaggagtccgctaaggctcagctttcatctcctgaggaccaggatgatcaagacgacataaaggttagctcttttgtgcctgatcttaaagaattgctccccagtgtgaaggtgtggagcgactggatgctcgggtatcctgatacctggaacccacctcctactagtctcgatcttcccagtcatgttgcagttgatgtttggtctacactggcagacttctgtaatatattgacagccgtaaatcaatctgaggtgccactctataaagaccccgatgacgacctcactttactcatcctagaggaggataggttgctgagtgggttcgtgccgttgctggcagctccacaagacccctgctatgtcgaaaagacatcagataaggtcatcgctgctgactgcaagcgcgtcactgtgctgaagtatttcctggaagcactgtgtggccaagaagagcccctgcttgcatttaaaggtggcaagtatgtgagtgtggcgccggttccggacacaatgggtaaagaaatgggctctcaagaggggacccgcctggaagatgaagaggaggacgttgtgattgaagacttcgaagaggactcagaagccgaagggtccggcggtgaagacgacatcagagaactgagagccaagaagttagccctggcccgcaagatagcagagcagcagcgcagacaggagaaaatacaagctgtgctggaggatcactctcaaatgcgccaaatggagctcgagataagacccctgtttctggtgcctgacacgaacggcttcatagaccacctcgcatccctggcacggctcctcgaaagccgcaaatacatcctggtggttcctctcatcgttatcaatgagttggacggattagccaagggtcaagagacagatcatagagcaggcggctacgctcgggtggtccaggagaaggctaggaagagtattgaattcctggaacagaggtttgagtccagagatagttgcctccgcgctctgacctcacgcggcaatgagcttgagtctatcgctttccggtcagaagacatcaccggccaactgggtaataacgacgatctgatcctatcatgttgccttcactactgcaaggataaggccaaggacttcatgcccgcaagtaaggaagaacccatacgcctgctcagggaagtcgtcctcctcactgacgacaggaacctgcgagttaaagctctcactagaaacgtgccagtgcgagacatccctgcctttctcacttgggctcaggtgggctag

SEQ ID NO: 26424 - DNA, 4167 bp, Artificial Sequence
  Description of Artificial Sequence: Synthetic coding sequence
atgaaggagctgaaggaggcccggccccggaaggacaaccggcggccggatctcgaaatctacaaacccggtctgagtcggctccggaataaacccaagatcaaggagccccccggctccgaggagttcaaagacgagatcgtcaatgacagagattgtagtgccgtggaaaatgggacacagcccgttaaagatgtctgtaaggagttaaataaccaagagcagaatggccctatcgatccagagaataacaggggacaggagtctttcccaagaacagcaggtcaggaagatcgttccctcaagatcattaagcgcacgaaaaaacccgaccttcagatttatcagccggggagaagattgcaaactgtgagcaaggagtccgcctctagagtcgaagaggaagaggtgttaaaccaagtcgagcaattgcgagtagaggaagacgagtgtagggggaatgtggcaaaggaggaagtagccaataaaccggatagggcggagatcgagaaatctcctggcgggggcagggtgggggctgctaagggagagaaggggaagagaatgggtaagggggagggggtgagagagacacacgacgaccccgctaggggtagacccggttcagcaaagaggtattcgaggagcgacaagcgcaggaaccgctatcgcactcggagtacttcatcagcaggaagtaacaactctgccgagggagcaggactgacagacaacggctgtcgtagaagacggcaagatcgcaccaaggaacgccctagactgaaaaagcaggtgtcggtctcttccactgatagcctggatgaagaccgcattgatgagccagatgggctcgggccgagaaggagcagtgagcgtaagaggcacctggaaagaaactggagtggccggggggagggagaacagaagaattcagcgaaggaatatcgtggaacccttagggttactttcgacgcagaggcgatgaataaggagagcccgatggtacgtagcgcacgcgatgatatggaccggggaaaacctgataaagggctgagttcaggtggaaaagggtcagaaaagcaagagtctaaaaaccctaagcaagaacttagaggaaggggccgtggcattctgatccttccagcgcacacaaccctctctgtgaatagcgctggctcccctgagtctgcccctctgggaccccggcttctgtttggatctggctcaaaagggagccgttcatggggcagagggggaacaactcgacgtctgtgggatcctaataatcccgaccagaagcctgcattgaagactcaaacccctcagctgcacttcctggatacagacgacgaagtgtcgccaacttcctggggcgacagccgccaggctcaggcctcgtattacaaattccaaaactccgataatccctattactaccctaggactccaggccctgccagtcagtacccgtacacaggctacaaccctcttcagtatcctgtaggaccaaccaacggcgtgtaccccggcccttactatccagggtacccaaccccgtccgggcagtacgtgtgttctccgctgccaacatcaaccatgagcccggaggaagtggaacaacacatgcgcaacttgcagcaacaggagctgcatagactgctccgggtagccgataatcaggagcttcagctgtctaatctcttgagtcgggaccgcatcagccccgaaggacttgagaaaatggctcaactgagggctgaactgctgcaattatacgagagatgcattctgctggatatagagttctcagacaaccagaatgtggatcagatcctgtggaaaaacgccttttatcaagtcatcgaaaagtttcgtcagttggtgaaggaccccaacgtggaaaaccccgagcagattaggaaccgcttacttgaactgcttgacgaaggaagcgacttttttgatagcctactgcagaaactgcaggtgacctacaaattcaagctagaagactatatggacggtctggcaattcgctccaagccgctgcggaaaactgtgaaatatgccctgatcagcgctcagcgctgtatgatctgccaaggcgatatcgcacgttaccgcgagcaggcatctgatactgctaattacggcaaggctagaagttggtacttgaaggcgcagcatatcgcacctaagaacggtagaccttacaatcagctggccttgctggctgtgtacactagacggaagcttgacgccgtctattactacatgagaagcctggctgcaagtaacccgatcctaactgcaaaggagagcctcatgagcctattcgaagagaccaagaggaaagcggaacagatggaaaaaaagcagcacgaagaatttgatctgagtccagatcaatggaggaagggcaaaaagtcgacattccgacacgtgggggatgatacgacccgactcgagatctggatccatccctcacacccacgtagtagccagggcaccgagagtggaaaagatagcgaacaggaaaatggtctggggagcctttccccgtctgatctgaacaagaggtttatcctcagcttcctgcacgctcacgggaagctgttcactaggattgggatggagaccttccccgccgtggctgagaaggtgctgaaagagttccaggtattgctgcaacactccccatcccccataggctctacaagaatgctgcagctgatgactatcaacatgttcgccgtgcataattctcagctgaaggactgtttttccgaagaatgccgctcggtgatccaggagcaagccgctgcacttggcctcgccatgttcagcttgttggttcgtaggtgcacgtgtctccttaaagagtcagctaaagcgcagttgagtagccctgaggatcaggacgaccaggatgatattaaagtctccagcttcgtgccagatctcaaggaactgttgccttctgtaaaggtctggagtgattggatgcttggctatcctgatacatggaaccctcctcccacttccctggaccttccgtctcatgtggcagttgatgtttggagtaccctggccgatttttgtaatattttaaccgcagtcaaccagtcggaggtgcccttatataaggaccctgacgatgatttaactttattgatcttggaagaagaccgcctcctcagtggatttgttcctctgctcgccgctccacaggatccttgctacgtagagaaaaccagtgacaaggttattgctgccgactgcaaacgggtcaccgtgcttaagtacttcctggaggctctatgcggacaggaagagcctttgctcgcatttaaaggcggcaaatacgtctcagtcgctcctgtgccagacacaatggggaaggaaatggggagccaggaaggcacccgcttggaggacgaagaggaggacgtggttattgaggatttcgaagaggacagcgaggccgaagggagcggaggcgaagacgatattcgcgagctccgagcgaaaaagctggctctcgcgcgaaagatcgccgagcaacagcgccgccaggaaaaaatccaagccgtgctggaggatcacagtcagatgaggcagatggagctggaaatcagacctctcttcctggtgcctgataccaatggtttcatagatcacctcgcgtctctggcacggctcctggagtctcggaaatacatcctagtggtgccacttatcgttattaacgaactggacggtctggctaagggacaggagaccgatcatcgggcaggcggttacgcgcgggtagtacaggagaaggccaggaaatcaatagagtttcttgaacagcgcttcgagtctcgggacagttgcttgagagcactcaccagccgcgggaacgagctggagtccatcgccttcaggtccgaggacattacagggcaactcggtaacaatgacgacctcatactgagctgttgcctacattattgtaaagataaggccaaggattttatgcccgccagtaaggaggaacccatcagactcctgagggaagtggtgctgctgacagacgataggaacctgcgcgtaaaagccttaacaagaaacgtcccagtgagagacattcctgcctttctgacatgggctcaagtcggatag

SEQ ID NO: 26425 - DNA, 2364 bp, Artificial Sequence
  Description of Artificial Sequence: Synthetic coding sequence
atggccgccgcccggcccgcccggggccccgagctgcccctgctgggtttacttctcttactcctgttaggagacccaggcaggggggcagcctcatccgggaatgccacaggtccaggaccaaggtcagccggtggctctgcaaggagatctgccgctgtaacgggccccccccctcctctctctcattgtggccgggctgccccttgcgagcccttacgatacaatgtctgcctggggtctgttttgccttacggagccacatccactttactggccggagacagtgacagtcaggaggaggcacacggcaaactggttctgtggtccggacttagaaatgcccccagatgttgggccgttatacaaccactgttatgcgcagtctatatgccgaagtgcgagaacgatagagtcgaacttcctagcagaacactctgtcaagctacccgaggaccatgtgccatcgtggagcgcgagcggggctggccagacttcttaaggtgtaccccggaccggtttccggagggttgtacgaatgaggtgcaaaatattaagttcaattcctctgggcagtgcgaagtgccactagtgagaaccgacaaccccaagagttggtatgaggatgtggagggttgcgggattcagtgccagaatcccttgttcacggaagcagagcaccaagatatgcacagttacatcgccgcctttggagccgtaaccggcttatgcacgctgttcacactggccactttcgtggctgattggaggaactcgaacagataccctgcagtgatcttgttctacgtgaacgcgtgtttcttcgtgggcagtatcggctggctggcccagttcatggacggtgccagacgcgaaattgtctgccgtgctgatgggaccatgcgcctgggcgagcctacgtccaacgagacgctgtcttgtgtgatcattttcgtgatcgtgtactacgccctcatggccggtgtggtgtggttcgtggtcctgacgtatgcctggcatacctcctttaaggctctggggacaacataccagcctcttagtgggaagactagttactttcacttactgacctggagcctcccatttgtgttgaccgtcgcgattctggctgtggcccaggtcgacggggactccgtttctggcatctgcttcgtcggatataagaactacagatacagggctggcttcgtgcttgcccctatcgggctggtactgatcgtgggagggtacttcctgattcgtggagtaatgactcttttttccattaagtccaaccatcctgggttattatctgagaaagcagctagcaaaattaatgagaccatgctgcgactaggtatttttggtttcctggcctttggtttcgtactgatcactttttcctgtcacttttacgatttttttaaccaagccgaatgggagaggtctttcagagattacgtgctgtgtcaggccaacgtcaccatcggtctccccactaaacagcccatacctgattgtgaaataaagaatcgaccctctctcctggtggaaaagatcaatttattcgccatgtttgggaccggaatagccatgagcacctgggtatggactaaggctacattgctgatctggaggaggacctggtgcaggctgacagggcagagtgatgatgagcccaagaggattaagaagtctaaaatgatcgcgaaagcctttagcaagcgccacgagcttttacaaaatcccggccaagagctaagttttagcatgcatactgtaagtcatgatggacctgtggcaggtcttgcctttgatttaaacgagccgtcggccgacgtctccagcgcttgggctcagcacgtgactaagatggtcgccaggcgtggtgccatcctaccccaagacattagtgtgaccccggtagctactcccgtgcctcctgaagagcaggccaatctttggctggttgaggccgaaatctcgcccgaactgcagaagcgtctcggaaggaagaagaagagacgaaagcgaaaaaaagaggtctgtcccttggccccaccccctgaattacacccccctgctcccgcgccgagtacaatcccgcgccttccacagctgcccaggcaaaagtgtctcgtcgccgccggcgcctggggcgccggcgattcctgccgccaaggcgcctggaccttagtgagcaacccgttttgcccagaaccctcacccccgcaggatccgtttcttccaagcgcgccagcaccggttgcctgggcccatggtaggcgccaggggctcggacccattcacagcaggacaaatctcatggatacagagctcatggacgctgactccgacttttag

SEQ ID NO: 26426 - DNA, 231 bp, Artificial Sequence
  Description of Artificial Sequence: Synthetic coding sequence
atgagcgaccaggacagcagcgagatccacttcaaggtgaagatgacaacacatctgaaaaagcttaaggagagctactgtcaacgacagggtgtgcctatgaatagcttacgatttctctttgaaggccaaagaattgccgataaccatacaccaaaagagcttggaatggaggaagaggacgtcatcgaggtgtatcaggaacagacaggtgggcacagcacagtgtag

SEQ ID NO: 26427 - DNA, 306 bp, Artificial Sequence
  Description of Artificial Sequence: Synthetic coding sequence
atgagcgaccaggaggccaagcccagcaccgaggacctgggcgacaaaaaggagggggagtacattaaactgaaagtgatcggccaggactcctccgaaatccattttaaggtaaaaatgacgacgcacctcaaaaaactgaaggaaagctactgtcaacgccagggagtgccaatgaatagcctgcggttcttgttcgagggtcagcgaatagctgataaccatacacctaaagaactcggtatggaagaagaggatgtgatagaggtctatcaggagcaaactggcggccacagcaccgtgtag

SEQ ID NO: 26428 - DNA, 306 bp, Artificial Sequence
  Description of Artificial Sequence: Synthetic coding sequence
atgagcgaccaggaggccaagcccagcaccgaggacctgggcgacaagaaggagggcgagtacataaagcttaaagtgatagggcaggattcttccgaaatacactttaaggttaagatgactacccatttaaaaaaactgaaggaatcctattgccagcgccagggggtgccaatgaatagcttaagatttttgttcgagggccagagaatcgctgacaaccatactccaaaggagcttggaatggaagaagaggacgtgatcgaggtataccaggagcaaacaggaggccatagtacagtgtag

SEQ ID NO: 26429 - DNA, 189 bp, Artificial Sequence
  Description of Artificial Sequence: Synthetic coding sequence
atgaccacccacctgaagaagctgaaggagagctactgccagcggcagggggttcccatgaacagcctaaggttcctgtttgaagggcagaggattgccgataatcatacacccaaggagctgggcatggaggaggaggatgttatagaggtttatcaggagcagaccgggggtcattcaactgtgtag

SEQ ID NO: 26430 - DNA, 189 bp, Artificial Sequence
  Description of Artificial Sequence: Synthetic coding sequence
atgaccacccacctgaagaagctgaaggagagctactgccagcggcagggggtgccaatgaactcgctgagatttctctttgagggtcaaaggatcgccgacaaccatacaccaaaagagcttggaatggaggaggaggacgtcatcgaggtatatcaggagcagacaggaggccattccacagtctag

SEQ ID NO: 26431 - DNA, 795 bp, Artificial Sequence
  Description of Artificial Sequence: Synthetic coding sequence
atgccccggagcttcctggtgcggaagcccagcgaccccaaccggaagccaaactacagtgagctgcaggattcaaatccagagtttacctttcagcagccctacgatcaggctcatctgctggctgccatccctcctcctgagattctaaacccaaccgcaagcctccctatgctgatatgggacagcgttctggcccctcaggcacaacctattgcttgggcatctctccggttgcaggaaagtcccagggtcgccgaattgacgtcactttctgacgaagactccggaaaaggatcgcagccgccgtcaccacccagtcctgccccaagctcattctcttctacctcagtgagcagtttagaggcagaggcatacgcggcattccccgggctcggacaggtccctaaacaacttgcccagctgtccgaggcaaaggatctgcaggctagaaaagccttcaactgtaaatattgcaacaaggaatacctatccctaggggcccttaaaatgcacatacgctctcacacactgccatgtgtgtgtgggacgtgcggcaaagccttttctcgcccctggctgcttcagggccacgtccgcactcacaccggggaaaaaccgttttcgtgccctcattgcagcagagcttttgccgatcgcagcaacctgcgcgcacatctccagactcacagtgatgtgaagaagtatcaatgccaggcttgcgcaagaaccttcagcaggatgtcactgttacacaagcatcaggagagcggatgcagtggatgcccacgctag

SEQ ID NO: 26432 - DNA, 807 bp, Artificial Sequence
  Description of Artificial Sequence: Synthetic coding sequence
atgccccggagcttcctggtgaagaagcacttcaacgccagcaagaagcctaactatagcgaactcgatactcacactgtcataatatcaccatacctgtacgagtcatattccatgcctgtaatccctcagcctgaaattctgtccagtggtgcctacagtcccattactgtgtggacaacggcagccccattccatgcacaactacccaatggactgtcacccctgagtggctactcatcatctctgggaagagtaagccccccgcctccttcagatacatccagcaaggaccattccgggtccgagtcaccaatttctgatgaggaagagaggctgcagtccaaactctcggatcctcacgctatcgaagctgaaaagttccaatgcaatctctgtaacaagacctattcgacgtttagcgggctggcaaagcataaacagctgcactgcgacgcccaatctaggaagagcttttcttgcaagtattgcgataaagagtacgtgtcactgggggccttaaagatgcatatacggacacacacgttgccatgcgtatgcaaaatttgtgggaaggcatttagtaggccatggctgttgcagggacatattaggacccacacgggcgaaaagccttttagctgcccacattgcaatagggcttttgccgatcgatcaaatctccgagcccatctgcaaactcattctgatgtgaaaaagtatcagtgtaagaactgtagcaagactttcagcagaatgtccctgctacataagcatgaggaatccgggtgttgcgtcgcccactag

SEQ ID NO: 26433 - DNA, 807 bp, Artificial Sequence
  Description of Artificial Sequence: Synthetic coding sequence
atgccccggagcttcctggtgaagaagcacttcaacgccagcaagaaacccaactactctgaactagatacgcacacggttatcatctcaccttatttgtacgagtcttattcgatgcctgttatcccgcagcctgaaatactgtctagcggagcgtatagtcctatcaccgtgtggacgaccgcagcccccttccacgcccagcttccgaacggactctcaccactgagcggctacagctcctccctgggacgcgtttcgccccccccaccaagcgacacaagctctaaagatcacagcggctccgaatctcccatctctgacgaggaagaacggctgcagtccaagctaagcgacccacacgctatcgaagccgaaaaatttcagtgtaacctctgcaataagacctatagtacctttagcggactagcaaaacataagcagctgcattgcgacgcgcagtctcgaaagtcattttcttgcaagtattgcgataaggaatatgtgagcctgggcgctctaaaaatgcatattagaacccacacactgccatgcgtatgtaagatctgtgggaaagctttttcccgaccatggctgcttcaagggcacattcgtacacacacaggggagaagcctttttcatgcccccactgcaatcgagcctttgcggaccggagtaatctcagagctcatctccagacccatagcgacgtaaagaagtaccagtgcaagaattgctccaagacattcagtagaatgtcacttctgcataaacatgaggaatctggttgttgcgtagcgcattag

SEQ ID NO: 26434 - DNA, 879 bp, Artificial Sequence
  Description of Artificial Sequence: Synthetic coding sequence
atgccccggagcttcctggtgaagacccacagcagccaccgggtgcccaattaccggagactggagacccagcgggagataaatggagcatgctcagcatgtggtggattagtggtcccgctgcttccgcgagataaagaggccccctccgtacccggtgatcttcctcagccctgggaccgctcctctgccgttgcctgtatcagccttccgctgctgcccaggatcgaagaggccctgggggcttctggactggacgctctggaggtttcagaagttgacccacgggccagccgagcggcaatagtcccgttgaaggacagcctgaaccacctgaatctgcctcccctgctagtacttccaacccggtggagccccactcttggcccagatagacacggagctccagagaaactcctcggagccgagagaatgccaagggcccctggcggtttcgagtgttttcactgccacaagccttaccacactctcgctgggctggcacgacatagacaattacactgtcacttacaggtgggtcgagtgtttacttgtaaatattgcgataaggaatacacatcactcggcgccttaaagatgcacatacgcacccacactctcccatgcacgtgtaaaatttgtggaaaagcatttagccgcccatggttgctgcagggccacgttaggacacataccggtgaaaaaccgtatgcttgcagccactgcagccgggcttttgccgatcgttcgaacttacgagcccatttacaaacccactccgatgccaagaaatatcggtgtcgtaggtgcactaaaacctttagtcggatgtcactgcttgcccggcatgaagaatccggatgctgcccgggcccctag

SEQ ID NO: 26435 - DNA, 1398 bp, Artificial Sequence
  Description of Artificial Sequence: Synthetic coding sequence
atgggcggcgccgtggtggacgagggccccaccggcgtgaaggcccctgacgggggatggggctgggccgtactgttcggatgttttgtgatcacgggattctcttatgcttttccgaaagctgtttctgttttttttaaggagctgattcaagagtttgggattgggtattcagacaccgcttggatcagctcaattctcctcgccatgctgtacggtaccgggcctctctgtagtgtatgtgtgaaccgatttggatgccggccagtgatgcttgtaggtggcctgtttgcaagtctcggaatggtcgcggcgagcttttgccgctcaataattcaggtgtatttgactacaggagtgattactggcctgggtcttgctctcaacttccagcccagcctgatcatgctgaaccgatattttagcaagcggcggccaatggccaatggcctggccgccgccggctcacccgtcttcctctgcgcactatctccattggggcaactgctgcaggacaggtatgggtggcgcggcggatttttaattctgggcggcctgctactcaattgttgcgtgtgtgctgcactgatgagacccctcgtagtgaccgctcagcccggctccgggcctcctaggccctccaggagattgctcgatcttagtgtctttcgggacaggggatttgtcctgtatgcagtggcagcatcagtgatggtccttggactgttcgtgccccccgtctttgtggtcagttatgccaaagacctcggagttcccgatacaaaggccgctttcctgctgacgatattggggttcatagatatttttgcccggcctgccgccggctttgtcgcaggtttgggcaaggtgcgcccatactctgtgtacctgttcagcttctcaatgttttttaatggattagcagatcttgctggctcaacagccggggattacgggggactcgtggtcttttgcatattcttcggtatatcttacggtatggtcggagccctgcaatttgaggtgctgatggctattgtgggtacacacaagttctcaagcgctatcggacttgtgttgttaatggaggctgtggcagtgcttgttggacccccctctggcggaaagttgctggacgcaacccatgtgtatatgtacgtctttattctcgctggggccgaagtactgacctcctcattgattctgctgctgggaaatttcttctgtatcagaaaaaagcccaaggagcctcagcctgaagtcgctgcagctgaggaggagaagctccacaaaccacccgctgattctggggtggacctgagggaagtggagcatttcctgaaagcagaacctgaaaaaaacggcgaggtagtgcatacccccgagacctctgtatag

SEQ ID NO: 26436 - DNA, 1398 bp, Artificial Sequence
  Description of Artificial Sequence: Synthetic coding sequence
atgggcggcgccgtggtggacgagggccccaccggcgtgaaggccccagacgggggatggggatgggctgtgcttttcggttgcttcgtgatcaccggcttcagctacgcgttccccaaggctgtttccgtgttttttaaagagctcattcaagagttcggcataggatattccgacactgcgtggattagctccatcttgctggctatgctgtacggcacagggccgctgtgcagcgtctgtgtgaatcgtttcggctgtaggcctgtaatgctcgtcgggggactatttgctagtctcggcatggtggctgcctccttctgccgtagtatcatccaagtgtacctcaccactggtgtgattaccggcctcggactcgctttgaacttccaaccaagcctgataatgctaaacaggtatttttctaagagaagacccatggcaaacggtttggccgcagcggggtccccagtgtttctgtgcgccctgtcccctctgggtcaactgttacaggaccgctatggctggcgcggcgggttcctcatccttggaggactcctcctcaattgttgtgtttgtgcagcactgatgcggccactggtggtaaccgcacagcccggttccgggcctcctcggccttcgcgtagactcctcgatctgtccgttttccgtgatcgtggattcgttctttatgccgtcgccgcatccgttatggtgctgggtttgttcgtccctccagtgttcgtcgtatcctacgccaaggacctcggagtgccggataccaaggcggcgtttctcctcaccatcctcggattcatagacattttcgctaggccagcagcgggcttcgtcgctggactggggaaggtgagaccttattccgtgtaccttttttctttctcgatgttctttaatggacttgcagacctcgccggcagcactgcaggggactacggcggcctggttgtgttttgcatctttttcggcatcagctatggtatggtaggggctttacagtttgaagtgttgatggctattgtgggcactcacaaattttcaagcgccatcggactggtgttactcatggaggcagtggccgtgctggttggcccaccatctgggggtaagctgctagacgctacacacgtttatatgtatgtctttatcctggcaggcgcagaagttttaactagctcacttatcctgctgctgggtaatttcttttgcatccggaaaaaacccaaagagccccagcccgaggtggccgccgcagaggaggagaaactgcacaaaccccccgcggattcaggcgtcgatctccgtgaagtggagcattttctgaaggcagaaccagaaaagaatggggaggtcgttcacacccctgaaactagtgtctag

SEQ ID NO: 26437 - DNA, 1398 bp, Artificial Sequence
  Description of Artificial Sequence: Synthetic coding sequence
atgggcggcgccgtggtggacgagggccccaccggcgtgaaggcccctgatggcggttggggatgggccgtgctgtttggctgcttcgtcatcacaggattctcctatgcttttcctaaagccgtaagtgtctttttcaaagagctgattcaggaattcggaatcggttatagcgataccgcgtggatatcctccatccttcttgcaatgctctatggcacaggacccctgtgtagcgtctgcgtgaaccgattcggatgtcggcctgtaatgttggtcggcgggctgttcgcctccctggggatggtcgccgcatccttttgcagatctatcattcaggtttatctgacaactggcgtcatcaccggactcggactggccttgaactttcagcctagcttgatcatgctcaataggtacttctccaaacgaaggcctatggctaacgggctcgctgccgcggggtcaccggtatttttgtgtgccctgtccccccttggacagctactccaggataggtacggatggcgtggcggctttttaatcctgggggggctgctgctgaactgctgcgtgtgcgctgcattgatgcgccccctcgttgtcaccgctcagcccggaagcggccctccacgccctagcagaagactgctcgatttatctgtcttccgggaccgcggcttcgtactttacgcggtggccgcatctgtgatggtgctgggcctgttcgtgccgccagtctttgtggtgtcttacgcaaaggatctgggtgtaccagacactaaagccgcctttttgctaacaatattggggttcatcgatatctttgcccgcccagctgctggattcgttgctggactgggcaaggtgcgaccttactccgtgtacttatttagctttagcatgttttttaacggtttagcagatctggcaggtagtactgctggggattacggaggtctagtggtgttctgcatcttcttcggaatctcctacggtatggtgggtgctcttcagttcgaggtacttatggccatcgtcggaacccacaaatttagttctgccatcggcctcgtgctacttatggaagcagtcgccgtcttagtggggccaccgagtggggggaaactgcttgatgccacacatgtgtatatgtacgtgtttattcttgcaggagccgaggtcctgacttcctctcttattctcctcctgggcaattttttctgtattcggaagaaacctaaggagcctcaaccagaagtggcagctgccgaagaagagaagctgcacaagccccccgcagattctggtgtggatctccgggaagtcgagcactttctgaaggccgagccagaaaagaacggagaagtcgtgcacacacccgagacatcggtttag

SEQ ID NO: 26438 - DNA, 1398 bp, Artificial Sequence
  Description of Artificial Sequence: Synthetic coding sequence
atgggcggcgccgtggtggacgagggccccaccggcgtgaaggccccagacggcggctggggctgggcagtcttattcggttgctttgtgatcacaggctttagctacgcatttccgaaagccgtgagtgtcttcttcaaggaattaattcaagagtttgggatcggctatagtgacacagcctggatctcctctatacttcttgccatgctctatggtacaggccccctgtgctctgtatgcgtgaatcgattcgggtgcagacccgttatgcttgtgggagggctgtttgcgtcactaggcatggtcgccgcaagtttctgccggagcataattcaggtttacctcaccaccggggtgatcactggattggggctcgcactcaacttccagccaagccttattatgttaaaccgctacttctcaaaacgtcgacccatggccaacggactggccgccgccggaagtcctgtcttcctgtgcgctctgagtccattaggacaattgctgcaggatcgatacggctggcgcggtggattcctgatcttggggggactgctcctcaattgttgtgtgtgcgccgccttaatgagaccgctggtcgtgaccgctcagcccggttcaggaccccctagaccatcaaggaggctgctcgacctctctgtgtttagggaccggggctttgtactgtatgcagtggccgcgagtgtgatggtgctagggctttttgtaccacctgtgttcgtagtctcctatgccaaggacctcggcgttcctgacactaaggccgcctttttgctgaccattcttggcttcatagacattttcgcacgtcccgcagctggatttgtcgccgggctggggaaggtgaggccttattcagtgtacctgttttctttcagtatgttctttaatgggctggcagacttagccggtagcaccgccggcgattatggagggctggtcgtattctgcatcttctttgggatctcctacggaatggttggggccctgcagttcgaggtccttatggccatcgtgggcacacataaattttcttccgcaatcggtctcgtccttctgatggaggccgtagctgtgctcgtgggcccaccctctgggggaaaactcctcgacgccacgcatgtttatatgtatgtgtttattctggcgggtgccgaagttctcacgtcaagtctcatcttgctccttggtaactttttttgcatccgtaaaaagccaaaggaacctcagccggaagttgccgctgccgaggaggaaaaactccataagccaccagctgactctggcgtcgacctccgggaggtagagcacttcctgaaggcagagcccgagaagaacggagaggtcgttcacaccccggagacaagcgtgtag

SEQ ID NO: 26439 - DNA, 1470 bp, Artificial Sequence
  Description of Artificial Sequence: Synthetic coding sequence
atggtgcccagcagccccgccgtggagaagcaggtgcccgtggagcctggaccagaccccgagctccgctcctggcgacatctagtttgttacctctgcttttatggattcatggcccagatccgtcctggcgagagttttattactccgtacttactgggtccagataaaaatttcacaagggagcaggtaactaatgagatcactcccgttttaagctattcttatcttgccgtgctcgtccctgtcttcttgctgactgactacttacgatatacgccggttctcttgctgcaggggctgagtttcgtgtccgtctggcttctgttgctgctgggacactccgtggcccatatgcagctgatggaattgttctactctgtgaccatggctgccaggattgcctattctagctacatattttcccttgtgaggcctgctagatatcagagagtcgcagggtattctagggcggccgtgcttctcggtgtattcacctctagcgtccttggccagctactggtgactgtgggcagggtgagtttttccactctcaattatatctccctggcattcctgactttttccgtcgtgctggcacttttcctgaagaggccaaaacgctcactgttcttcaatcgcgacgatagggggcgctgcgagacatccgccagtgaactggagcggatgaacccaggacctggaggcaagcttggccacgccctgcgtgtggcctgcggggattctgtgcttgcccgaatgctgagagagctgggggactcactgaggagaccccagctaaggctttggagtctctggtgggtgtttaattcggctggttactatttggtcgtatattatgtacacattctgtggaatgaggttgatccaaccacaaattctgcccgcgtgtataatggagctgctgacgccgcatcaaccctgttgggagccatcacaagctttgccgccggctttgttaagatcagatgggcccggtggagcaagctgctgattgctggcgtaaccgccacacaagccggtctggtgtttcttctcgcccacacacgacatccaagctcgatatggctctgctacgccgcatttgtgctctttcggggctcatatcagtttcttgtgcccatcgctacatttcagattgcttctagtctgtcaaaggagctgtgcgcattagtgtttggcgttaacacattcttcgctactattgtgaagactatcattacgttcattgtgagtgacgtgagaggccttggattgcctgtaagaaagcagaacgaagagctgcatgtcgcttctctgagtttgtggaaaagtcatttacgtctcgccgctgacaccctgtcttcagaaggatccagtggttcaggccctcgttcttggttcctcagccccaccctccgcgcagccctccatggccctgtgtgtcctagcgaggtttgcccttcctag

SEQ ID NO: 26440 - DNA, 1776 bp, Artificial Sequence
  Description of Artificial Sequence: Synthetic coding sequence
atggtgcccagcagccccgccgtggagaagcaggtgcccgtggagccgggacccgaccctgagttgcgatcctggagacatttagtgtgctatctctgcttctacgggttcatggcacagattcgacctggcgaaagtttcataaccccatacctgcttgggccagacaaaaattttaccagagagcaggtcaccaatgagattacacctgtgcttagctactcttatttggctgttcttgtgcccgtgtttctgctgactgattatctgagatacacgcccgtactgctgctccaggggctgagcttcgtgtcagtttggttgcttctgctgcttggtcacagcgtcgcccatatgcagctcatggagctgttttactctgttactatggcagcaaggatcgcttactctagctatatattttcactggttaggcccgccaggtaccagcgagtggctggatattcacgcgccgccgttctgctcggagtctttacgtcttctgttttgggacagctactggtgacagtggggagagttagcttctccactctaaattacatctcactcgcgtttctgacattttctgtggttctcgccctctttctgaagcggccgaagagatccctgtttttcaacagagatgaccgtggtcggtgtgaaacatctgccagcgaactggagcggatgaatccaggtcctggtggaaagctagggcacgcgctgcgcgtcgcctgcggggactccgttctggcccgcatgttaagggagctgggagattctctccggcgaccacagctgcggctttggtccctctggtgggtctttaatagcgcagggtactacctggtcgtgtactacgtgcatatcctgtggaacgaggtagatccgaccactaattcagcaagagtctataacggagccgctgacgctgcctccactctccttggggcaattacaagcttcgctgccggctttgtaaaaatcagatgggcccgctggtctaaattgctcattgccggcgtaaccgctactcaggcgggcctggtctttctacttgcacatacacggcacccctcctccatttggctatgttatgccgccttcgtgctgtttcgcgggtcataccagttcttagtgccaattgccacattccagatcgcttcctctctcagcaaggagctctgtgccctagtattcggggttaacacattcttcgctaccatagttaaaaccatcatcacctttatcgtatcagacgtgaggggtctaggcctccccgtccgaaagcagttccagctctactccgtctattttctcatcctgtcgattatctacttcctcggcgcgatgttggatgggctaagacactgccagcgcggacatcaccctaggcagccccctgcacaggggcttaggagtgcagcagaggagaaggctgcacaggcgctaagcgtccaggacaagggattaggaggcctgcaacccgcccagagtccaccgctcagtcccgaggatagtttaggggctgtgggccctgctagcctggaacagaggcaatccgatccatatctggctcaagcgcccgctccacaggccgccgaattccttagtcccgtgacgacaccttcgccctgcactctttgttcggcccaggccagtgggcctgaagccgctgacgagacttgcccacagttagccgtgcatcctcccggagtgagcaagctcggactgcagtgtttgccaagcgatggcgtacagaatgtgaatcagtag

SEQ ID NO: 26441 - DNA, 846 bp, Artificial Sequence
  Description of Artificial Sequence: Synthetic coding sequence
atgctgcgggagctgggcgacagcctgcggcggccccagctgcggctgtggtctctctggtgggtctttaacagcgccggatactatctcgtggtttactatgtccacatactgtggaatgaagtggatcccactaccaattccgcccgcgtttataatggcgccgcggatgcggcttccactctgctgggcgctatcaccagcttcgcagctggatttgttaagattaggtgggcccgttggagcaaactcctgatcgcaggggttacagcaactcaggccggccttgtctttctcctggcccatacccggcacccttcttcaatttggttgtgttatgcggctttcgtgttattccggggaagttatcagttccttgtgcctatcgccacatttcagatagcttcctctctgtccaaagagctgtgcgcgcttgtgtttggtgtgaacacatttttcgctacgatagtcaaaaccataatcacttttatcgtgtcagacgttagaggtctcggcctgccggtgaggaagcaggccttgagaatgtcccgacctaggttggggctctgtttgcctggaccttttccaccccagtctgcggctcctgcccgcgccggcatggccgcatcgtctgcagaagaccctggttctgagagggggccttggagacgcgcagggaccgtggccgcccgcggcgaccctggtggagaacgtgggccttggaggcgcgagggaaccctagctgccagaggtgatcccgggggggagcgcggaccttggtggcgggaaggcacactcgcagccaaaccacggatgcagtgggtgacccgagccactgccccttag

SEQ ID NO: 26442 - DNA, 810 bp, Artificial Sequence
  Description of Artificial Sequence: Synthetic coding sequence
tgactgcggctgtggagcctgtggtgggtgttcaacagcgccggctactatcttgtggtgtattacgttcatattctgtggaacgaagtcgaccctaccacaaacagcgccagggtctacaatggcgcggcagacgcagcctccaccctccttggtgcaatcactagtttcgctgctggatttgtaaagattagatgggccaggtggtcaaaactgctgatcgcaggtgtgaccgctacccaggccggactcgtattccttctggcccacacaaggcatccttcttctatctggttgtgctatgctgcctttgtcttattcagggggtcgtaccagttcctggtgcccatcgctacgttccagattgcctcatcactgagcaaggagttatgtgctctggtgtttggtgtgaacacattttttgctaccattgttaagacgattataacttttattgtgagtgacgtgcgcggattagggctccccgtgaggaaacaggccctccggatgagccggcctcgcctggggctctgtctccctggtccttttcctccccagagcgcagctccagcacgcgcaggaatggctgcctctagtgccgaggatccgggatccgagcggggcccatggcgccgggcagggacggtcgctgcaagaggcgaccctggaggcgagcgaggcccttggaggcgcgaaggtaccttggctgctcggggagacccggggggcgagcgcggcccgtggtggagagaaggcactctcgcagccaaacctcgtatgcagtgggttacccgcgctactgccccttag

SEQ ID NO: 26443 - DNA, 549 bp, Artificial Sequence
  Description of Artificial Sequence: Synthetic coding sequence
atggtgcccagcagccccgccgtggagaagcaggtgcccgtggagcctggacccgatccagagctgaggagctggagacacctcgtgtgctacctgtgtttctacggcttcatggcacaaattcgcccgggagaaagcttcatcactccatacctgcttggacccgataagaactttacgcgggaacaggttaccaacgaaatcaccccagtgctgagttactcttatctggctgttcttgttcccgtgttcctcctgacggattacttgcgctacacgcctgtattgctgctgcagggattgagcttcgtcagtgtttggcttctgctgttgctgggccactctgtcgcccacatgcagctgatggagctgttctactctgtgacaatggcagctcgtattgcttattcatcatatatttttagccttgtgagacccgcacgctaccagagggtggctgggtactcccgggctgcggttctcctgggtgtgttcacatcgagcgttctcgggcaacttctggtgacagttgggagggtttctttttag

SEQ ID NO: 26444 - DNA, 465 bp, Artificial Sequence
  Description of Artificial Sequence: Synthetic coding sequence
atggtgcccagcagccccgccgtggagaagcaggtgcccgtggagcctggcccggaccccgagctgagaagttggagacatctcgtttgttacctgtgcttctacggatttatggctcaaattcggcccggcgagagctttatcaccccttacctgttaggcccagacaagaattttacacgagagcaagtgactaacgagataacacctgttctaagttactcttatctggcagtactggtacctgtgttcctcctgacggattacctgcgttataccccggtgttgctgctgcagggcctctcctttgttagtgtctggctgcttctactcttaggccattcggtggcccatatgcagctcatggagctgttctatagcgtgactatggccgcccgaatcgcgtattcatcatacatcttttctttggtgcggccagccaggtaccagcgagtcgctgggtag

SEQ ID NO: 26445 - DNA, 1656 bp, Artificial Sequence
  Description of Artificial Sequence: Synthetic coding sequence
atgcggccccagcccgccgagcccgcccccggcggccggggcaacgaggcgtgttccatccacagcgaggtgactaacgaaattacacctgtcctgtcctattcttatttagctgtcctagttccagtgtttcttctgaccgattacctgcggtacactccggtactgttgctgcagggcctctcttttgtgtccgtgtggctactccttctgctcggccactccgtggcgcatatgcaattgatggagttgttctatagtgtcaccatggccgcccgcattgcctattcatcttacatcttctccctggtcaggcctgccagataccagcgggtcgctggctattccagggccgctgtcctcctcggtgtgttcacgtcttcagttctcggccaactgctggtgacagtaggccgggtgtcctttagtaccttgaactacataagcctggcttttctgacattctcggtggtgctcgcccttttcctgaagagaccgaagcggtccctttttttcaatagggacgatcgcggcaggtgtgagacctcggccagcgagctggagcgcatgaacccaggcccaggaggtaaattaggacacgcattacgtgtagcctgcggtgactcagtgcttgcaaggatgctccgggaactcggagatagcttgcgccggccacagctgaggttgtggtctttatggtgggtgttcaactctgccggatattacttggtggtgtattatgtgcacattctgtggaatgaagtcgaccccacaacaaactcagctagagtttacaacggggccgcggacgccgcatcaaccttgctcggggctatcactagttttgccgctggttttgtaaagatcaggtgggcaagatggtcaaaactgttaatcgccggcgtgacagccacccaggctggcttagtctttctgctggctcacacaaggcaccccagctctatctggctttgttatgcagcatttgtgctttttcggggcagctatcagtttttagtaccgatagcgaccttccagatcgcctcctcactgagcaaggaactgtgtgcacttgtttttggggtcaacacattctttgccacaatcgtgaagacaatcatcacatttattgtcagtgatgtgaggggactcggcctacctgtgaggaagcagtttcaactatacagcgtttacttcctgatcctaagtattatctacttcttgggagctatgctcgacggacttcggcactgtcagcgaggtcatcatcctcggcagccgcctgcccaggggctccgcagcgcggccgaagaaaaagctgcccaggcccttagcgtgcaagataagggcctgggtggccttcagccggctcagtctccccctctgtcccccgaggattctctgggcgcagttggccccgcatccttagaacagcgtcaaagcgatccttatctcgcccaggcaccagccccacaagccgctgaattcctttctcccgtgacaacacccagtccctgcactttatgttcagctcaggcatccgggccagaagctgcggatgaaacctgcccgcaactcgccgtgcatccaccaggagtgtccaagctgggtttgcaatgtctgccttcagacggcgttcaaaacgtgaatcagtag

SEQ ID NO: 26446 - DNA, 186 bp, Artificial Sequence
  Description of Artificial Sequence: Synthetic coding sequence
atggtgcccagcagccccgccgtggagaagcaggtgcccgtggagcccggacctgaccccgaactgcgcagctggaggcacctggtctgttatctctgcttctacggcttcatggcccagattcgacctggggagtcgtttatcactccatacctgcttggccccgacaaaaacttcacgcgctag

SEQ ID NO: 26447 - DNA, 705 bp, Artificial Sequence
  Description of Artificial Sequence: Synthetic coding sequence
atggagcccagcagcaagaagctgaccggccggctgatgctggccgtgggcggggccgtcctagggagccttcagtttggatacaacaccggtgtcatcaacgcaccacaaaaagtgattgaggagttctataatcaaacatgggtacacaggtatggcgaatctatactgccaacaacgttgactacgctttggtccttgtctgtggccatattctctgtggggggcatgatcggcagtttcagcgtaggactgtttgtgaatcgctttgggcggagaaattctatgctgatgatgaacctgctggcctttgtcagcgcagtcctcatggggttcagcaagctgggcaagtcttttgaaatgcttattcttgggagatttatcattggtgtgtactgtggactgacaaccggttttgtacccatgtatgtgggagaggtcagcccaaccgctctccggggggccctgggaactctgcatcagctgggcattgtggtggggatcctcatcgcccaggttagctggggtcgaatttacttaccaggcactgctcccgcccactccttttccggtagccgtatttgcgctcagcaggggcgggtttcactcccgccatccccccatagccttgcagaagataactacggcacacaggtccagcgcacccagcaccacgggctgcccgtggattccaagatgacatag

SEQ ID NO: 26448 - DNA, 1377 bp, Artificial Sequence
  Description of Artificial Sequence: Synthetic coding sequence
atggagcccagcagcaagaagctgaccggccggctgatgctggccgtgggcggcgctgttctcggaagcctgcagttcgggtataatacaggagtgattaacgccccacagaaagtgattgaagaattttacaaccaaacttgggtgcatcgttacggagagtccatcctgccaacgacactcactaccttgtggagcttgtcagttgctatattcagtgtggggggaatgattgggagtttctccgtcggcctgtttgttaatcggtttgggagaaggaactcaatgctgatgatgaatctgctggcatttgtgagtgctgtgttaatgggattttccaagctggggaaatcattcgagatgctaattctggggagattcatcattggggtgtactgcggactaaccacgggattcgtaccaatgtatgttggtgaggtgtcccctaccgctcttcgaggggccttgggaaccctacatcagctcggtatcgttgtcggaatactgatcgctcaggtgttcggcttagattctatcatgggaaacaaggacctttggccccttctcctcagcattattttcattcccgcactgctgcagtgtattgttctgccattttgtccggaatcaccccgctttctcctcataaacagaaacgaggagaaccgggcaaagtctgttttgaaaaagctgcggggcactgcagatgtaactcacgatctgcaggagatgaaagaggagtcgagacagatgatgcgagaaaaaaaggtaaccatacttgagctgttcagatctcctgcctaccgacaacccatccttatcgctgtggtgttgcagttgtcccagcagctgagcggcattaacgccgttttctattactccaccagcattttcgagaaggccggagttcagcagccagtgtatgccactatcgggagtggcatagtgaatacagccttcacagttgtttctttatttgtggttgaaagggctgggcggcgaactctccatctcattgggctcgccggtatggcagggtgtgcaatactgatgaccattgctctcgccctgttggaacaattaccatggatgtcttatctatccatagttgctatcttcgggtttgtggcattctttgaggtggggcctggccctattccctggttcattgtggccgagttattcagtcagggcccccgccctgccgccattgctgtggcaggattctccaattggacaagcaattttatagtggggatgtgcttccaatacgtagaacagttgtgcggcccgtatgtgtttatcatcttcacagtgcttctggtgctgttttttatcttcacactaaacgggagcatgcccgagggaggcgattag

SEQ ID NO: 26449 - DNA, 1305 bp, Artificial Sequence
  Description of Artificial Sequence: Synthetic coding sequence
atggagcccagcagcaagaagctgaccggccggctgatgctggccgtcggaggagccgtgttggggtcactccagtttggctataatactggcgtcatcaatgcaccacagaaagttattgaagagttttataaccagacttgggtgcacaggtacggcgaaagcatcctgccaactacattgaccaccctgtggtcactaagcgtggccatctttagcgttggaggcatgatcgggagcttttctgttggcctgttcgttaaccgattcggcaggaggaattccatgctgatgatgaatttgcttgcctttgtccccatgtatgtgggagaggtctcgcctacagcactcaggggcgctttgggaactttacaccagctcgggatcgttgtgggcattattatatttatcccagcgttgctgcaatgtatcgtgctacctttttgcccggagtcgccacgttttctgctgataaatcgtaacgaagaaaaccgggcgaagagcgtcctgaaaaagctgcggggaacggcagatgtgacccacgatctccaggagatgaaggaggaatcccgacaaatgatgagagaaaagaaggtcactatactcgagctcttccgctccccggcataccgacagcctatactcattgccgtggtgctccaactgagccagcagctcagcggcattaacgcagtgttctactactctacaagcatattcgagaaagccggagtgcagcagccggtgtacgccacaatcggatctggaattgtaaatacagcttttaccgtggtatctcttttcgttgtggagcgcgcagggcggcgcactttacacttgattggtttggccggcatggcgggatgcgctatactgatgactattgctttagcccttctggagcagttgccttggatgagctatctttccattgttgccatctttggttttgtggctttcttcgaggtaggaccaggacccattccttggttcattgtcgcggaactgttctcccagggcccccggcctgcagccatcgccgttgccggattttcaaattggacatctaattttatagtcggtatgtgctttcagtatgttgagcagctctgtggcccttacgtgtttatcatattcacagtgctgcttgttttattcttcattttcacatactttaaagtgcccgagacgaaaggtaggacattcgacgagatagcaagtggcttccgacaggggggcgccagccagtctgacaagacccctgaagagttattccatccgctgggggccgattcacaggtgtag

SEQ ID NO: 26450 - DNA, 528 bp, Artificial Sequence
  Description of Artificial Sequence: Synthetic coding sequence
atggagcccagcagcaagaagctgaccggccggctgatgctggccgtcggcggagctgtgctgggctccctccagtttggctacaacacaggcgttatcaatgccccccagaaggtcatcgaagagttttataaccagacatgggtgcatcggtatggcgagtccatcttgcctactaccctcacaactctttggagcctgtctgttgctatcttctccgtcggcggcatgattgggagtttttccgtgggacttttcgtaaacaggtttggacggcgtaattctatgttgatgatgaacttacttgccttcgtcagcgcggtgctgatgggtttctccaaactcgggaaccccaagctcgagaccaccgacactcccctgccgaagaaatttcctttccgaccccaggcacggaaagtgaccgcggtacagtgtccgttttgtctaagcatctgtccgctacatagcctcctgattcttggacctactagtactgcaacagaagcgggaaaaggccacaatgtctag

SEQ ID NO: 26451 - DNA, 1479 bp, Artificial Sequence
  Description of Artificial Sequence: Synthetic coding sequence
atggagcccagcagcaagaagctgaccggccggctgatgctggccgttggaggagccgttcttggatcattgcagttcggctataacaccggtgtcatcaacgctcctcaaaaggtcattgaggaattttacaatcagacctgggtgcaccgctatggcgaatcgatcctgcccacgacactgacaaccctgtggtcattgagcgtagcaatctttagcgtggggggaatgatcggtagcttttctgtcgggctgttcgtgaacagattcggaaggcggaattctatgctgatgatgaatctcctcgcctttgttagcgctgtccttatggggttttccaagctggggaaaagcttcgagatgctgatcctggggcgatttatcatcggcgtctactgtggcctaaccacaggcttcgtccccatgtacgtgggggaggtgtcacctacggcactgcgcggcgcactgggaacactccatcagctggggattgtggttggcatccttattgcacaagtgttcggactggatagcatcatgggcaacaaggacctttggcccttattgctctccataatattcatccccgctttgttgcagtgcattgtgcttcctttttgtcccgagtctcccagattcctcctcatcaatcgcaatgaggagaaccgcgcgaaatcagtcttaaagaagttgcgagggacagctgacgtaacccatgacctgcaggagatgaaagaggagagtcgtcagatgatgcgcgaaaaaaaggtgacaatcctggagctctttagatcgcccgcttaccggcagcctatcttgattgctgtggtccttcaattatctcagcagctgagtgggatcaacgcagttttctattacagcaccagcattttcgagaaagcgggggtccaacagcccgtgtatgcgacgattggcagtggcattgtgaacacagcctttacagtggtatctctgtttgtcgtcgaaagggcagggcgtaggaccctgcatctgatcggcttggctggcatggccggatgtgccattctgatgacaatcgcgttggcactgctggagcagctcccctggatgagttatctatctatcgtggcaatctttgggtttgtggcgttttttgaggttggccccggtccaatcccatggtttattgtcgctgagctgttttctcagggtcctcgtccagccgctattgctgtggctggattctccaattggactagcaatttcattgtgggtatgtgttttcaatacgtggagcagctctgcggaccttacgtgttcattatctttacagttctgctggtgctcttctttatatttacatattttaaagtgccagagacaaaaggtcggactttcgatgaaattgcgtctggcttccgtcaggggggggcctcgcagagtgataaaactccggaagaactgttccatccactcggagccgatagccaggtctag

SEQ ID NO: 26452 - DNA, 753 bp, Artificial Sequence
  Description of Artificial Sequence: Synthetic coding sequence
atgctgatgatgaacctgctggccttcgtgagcgccgtgctgatggggttctcaaaactggggaagtcttttgaaatgcttatcctggggcggttcattattggcgtttattgcggcttaacaacaggcttcgtgcccatgtatgtcggtgaggtttctcctaccgccttgaggggggctctcggcactttacaccaactgggaattgtggttggaattctgatagcacaggtgtttggcctagactctattatggggaacaaggacctgtggccactgttactgagcattattttcatccccgcactcttacagtgtatcgttttgccattttgtccggagtctccacgattcctgctaattaatcgcaatgaggagaacagagccaagtccgtgctcaagaaactgcgcggcacagcagatgtgacccacgacctacaggaaatgaaagaggagtccagacagatgatgagagaaaagaaggtcacaattctcgagctctttcggtctccagcatacaggcagcccattctgatagcagtggtacttcagttatcacagcagctaagtgggattaacgctgtcttctattattcaacttcaatctttgagaaagctggcgtccagcaaccagtgtatgccaccatcggcagcgggatcgttaatactgccttcaccgtggtgtccgtatccctttgcctcctcgctccacccgcaaaaccccagggcggagggagtgcaatctttccatag

SEQ ID NO: 26453 - DNA, 1671 bp, Artificial Sequence
  Description of Artificial Sequence: Synthetic coding sequence
atgcccagcttcgacgaggccctgcagcgggtgggcgagttcggccgttttcagcgccgtgtgtttcttctgctgtgtttgaccggcgtcacattcgctttcctgtttgttggggtcgtattcctcggcactcagcccgatcactactggtgccgaggccccagcgcagcagccttagcggagcgatgcggatggagtccggaagaggagtggaatagaaccgctcctgctagccgcgggcccgagccgcctgaacgacgaggacgctgccagcgttacctactcgaagcagccaatgacagtgcaagcgcaacatctgctctgagttgcgctgaccctctagccgccttccctaacagaagtgctcctctagtgccttgtagggggggttggcgttacgctcaggcacattctaccattgtgtcggagtttgacttggtgtgcgtaaacgcctggatgctggatctaacacaggcaatccttaacttggggttcctcaccggcgcttttactcttggctacgctgcagatcgttatggaaggatcgtgatctacttactgtcctgcctgggcgtaggtgtcacaggggtggtcgtagcttttgcacccaattttcctgtttttgtcatattccgcttccttcaaggagtgttcgggaaaggcacgtggatgacctgttatgtgatcgtgactgagatagtgggcagcaaacaaaggcgcatagtcggcattgtgatccagatgttcttcactctgggtattatcattctccctggaattgcctatttcatccccaactggcagggcatccagctcgcaatcaccctcccctctttcctgttcctgctgtactactgggtagtgcctgaaagccccagatggctgatcacccgcaaaaagggagataaggctctacaaattctaaggcgcattgccaaatgtaacggcaagtatcttagctcaaactacagcgagatcacagtgacggacgaggaagtatccaacccatctttccttgacctggtccgcactcctcagatgcgcaaatgcacactgatcctcatgttcgcctggttcacatccgcagtcgtgtatcaggggctggtaatgcgcttaggtatcataggaggcaacctctacatagattttttcattagcggagttgtcgagctgcccggagcactgttgatcttgctgacaatcgagagactcggacggcgcctccccttcgcagcctccaacatcgtcgcaggcgtcgcctgtctggtgactgcctttctccccgaggggattgcttggttacgcacaacggtggcaacgctcgggagactaggaatcactatggcattcgaaatagtgtatttggtgaatagcgaactgtacccaacaaccctcaggaactttggcgtgtctttgtgttccggcctgtgcgatttcgggggcataattgcaccctttcttctgtttagacttgcagctgtgtggctcgagctgcccctaattatctttggaattctggcgagtatttgtggtggccttgttatgctgctaccagagacgaaggggattgctctccccgaaaccgtcgatgacgtggaaaaactgggatctccccacagctgcaagtgcggccgtaacaagaagacacccgtgtctaggtcccacctgtag

SEQ ID NO: 26454 - DNA, 1674 bp, Artificial Sequence
  Description of Artificial Sequence: Synthetic coding sequence
atgcccagcttcgacgaggccctgcagcgggtgggcgagttcggccgatttcagcggcgggtgttcctgttgctgtgtctgacaggcgtgacatttgcctttctattcgtcggggtggtgttcctgggaacacagccggaccattactggtgcagaggtccttcagccgccgcattggccgagcgatgcggatggtcacccgaggaggagtggaatcggacagcaccagcctccagaggacctgaaccgccagaaagacgtggtagatgccagcgatacttactcgaggccgccaacgactccgcgtcggctaccagcgccctctcttgtgcggatcccctcgccgctttcccgaaccgcagtgcacctctcgtgccatgccgaggaggatggcggtacgcccaggcacatagcacaatcgtgtcggagtttgacctggtctgtgttaatgcatggatgctggatttaacccaggctatcctcaatttagggttcctaacgggagccttcaccctgggctatgctgcggacagatatggccggattgtgatatacctcctttcctgtcttggtgttggagtaacaggggtggtggtggcattcgcaccgaatttccccgtgtttgtcatttttagatttctacaaggagtcttcgggaagggaacatggatgacttgttacgtgatcgtcaccgaaatcgtcggaagcaagcagcggcgaattgtgggaattgtgatccagatgtttttcacactcggtatcatcatcttgcctggaatagcttacttcatcccgaactggcagggcattcagctggccattactctccccagctttctctttctgctgtactattgggtggtgcccgagtcccctaggtggcttatcactcgaaagaagggcgataaggcactacaaatcctgagaaggatcgccaaatgtaatggcaagtatttgagctccaactattccgaaattacagtgacagatgaggaagttagcaatccttccttcctggatctagttcgtacccctcagatgcgcaagtgcacactaatcctcatgttcgcttggttcaccagcgccgttgtttaccagggactggtcatgaggttggggatcataggtgggaatctgtatatcgacttctttatcagtggagtggtcgagttacctggggctttgctaatcctcttgacgatagagcggttaggcaggcggctgcccttcgcagcctccaatatcgtcgccggggttgcttgtctcgttactgcctttctccctgaggcagggatcgcatggcttcgcactactgtcgctaccctgggtaggctaggcatcactatggcttttgaaatcgtctatttggtgaactctgaactgtatccaaccacgctacgtaactttggcgtgagcctgtgctccggtctgtgtgacttcggtggaatcatcgctcctttcttgcttttccgcctggccgcagtttggcttgagctccctctcattatctttggcatcctggctagcatttgcggaggattagtcatgctactgccagaaacaaaaggcatcgctctgccagaaacagtggatgacgtagagaaactgggaagcccccattcttgcaagtgcggcagaaataagaaaacccctgtgtctcggtcccatctgtag

SEQ ID NO: 26455 - DNA, 1017 bp, Artificial Sequence
  Description of Artificial Sequence: Synthetic coding sequence
atggagctgcggagcggcagcgtgggcagccaggccgtggcccggcgaatggacggagactcgcgcgacggtgggggcggtaaggacgctaccggctctgaggactatgagaacctgcctaccagcgccagtgtttccacccatatgaccgccggggcgatggcagggatcctggaacactcagtgatgtacccagtggatagtgtgaagacccgcatgcagtcactgtccccagatcccaaggctcagtatacatccatatacggcgccctgaagaaaatcatgagaacagaagggttctggaggcctcttaggggtgtgaatgtgatgattatgggggctggacctgcgcacgccatgtattttgcctgctatgaaaacatgaaacggacgcttaatgatgtgttccatcatcaaggaaattctcatcttgctaatggcatagctggatctatggctaccctgctgcacgacgctgtgatgaatcctgccgaggtagtcaaacagcgtctgcagatgtataactcacagcataggtctgcaatctcctgtatccggactgtatggaggacagagggcctcggagcgttttaccgtagctacaccactcaactgaccatgaacatcccattccagagtattcactttattacgtacgaattcttgcaggaacaggttaatccgcaccgcacctataatccacagtctcatatcatctctgggggtctcgctggagcattggcggcggccgcgaccacacctctggatgtttgtaagaccttgctgaatacccaggaaaatgttgcccttagcttggcaaacatcagcggacggctgtctgggatggctaacgcgttcagaaccgtgtaccagcttaatggattggccgggtatttcaaagggatccaggcgagagtgatctatcaaatgccatctacagccatatcttggagtgtgtacgaattctttaaatacttcctgaccaagagacagctggagaaccgcgctccctattag

SEQ ID NO: 26456 - DNA, 2268 bp, Artificial Sequence
  Description of Artificial Sequence: Synthetic coding sequence
atggcccggaagctgagcgtgatcctgatcctgaccttcgccctgagcgtcaccaaccccctgcacgaactgaaggctgcagcattcccccagaccacggaaaagatcagccctaattgggagagtggcatcaacgtggacttggcaatctcaaccaggcagtatcatctgcagcaactattctaccgttatggagaaaacaacagcctctccgtcgaaggattccgcaagttgctgcaaaacattgggattgataagataaaacggatacacatccaccacgatcatgaccaccattccgatcatgagcaccactccgatcacgaacgccactcagatcacgaacatcatagcgagcatgaacatcacagcgatcatgatcaccactctcaccataatcacgccgctagcggcaaaaataagcggaaggccctgtgtccagaccacgatagcgactccagtgggaaggaccctcggaatagccagggaaaaggtgctcaccggccagaacacgcgtcaggcagacgcaatgtaaaagattccgtctcagcaagcgaggttacctctaccgtttacaatacggtgtctgagggcacccacttcttggagacaatcgagacaccgagaccagggaagctgttccctaaggacgtgtcgtcctccactcccccctctgtaactagcaaatctcgggtctctaggcttgcgggcaggaaaacaaacgagagtgtaagtgagccccgaaagggattcatgtacagtagaaacacaaacgaaaacccccaggaatgtttcaacgcaagtaagttgctgacctcccatggcatgggcatccaggtacctctgaacgccacagagtttaattatttatgccccgctataattaatcaaattgatgcacgctcatgtctgattcacacatccgagaagaaagcagaaattcctccaaaaacctactcactgcagattgcttgggtgggagggtttatcgcaattagcattatctccttcctctctcttttgggtgtgatcctggttcctttgatgaacagagttttttttaagtttctcctgtccttcctggtggcccttgccgtcggcactctgagtggagatgcattcctacatctcctgccgcactctcatgccagccatcatcatagccactcgcacgaggaaccagccatggagatgaagaggggccccctattctctcacctcagttcccaaaatattgaggaatcagcctactttgactccacctggaagggattgacggcccttggcggactatacttcatgttccttgttgaacatgttctgacactgatcaaacagttcaaggataaaaagaagaagaatcagaagaagccagaaaacgacgacgacgtggaaatcaaaaagcagctgtccaagtatgagtcccagctctcaaccaacgaagagaaagtagacaccgacgatcgcacggaggggtacctgcgagccgatagccaagagcccagccatttcgattcgcagcagccagccgtgctggaggaggaggaagtcatgatcgcccacgcccacccacaagaagtctacaatgagtacgtgccgcgaggctgcaagaataagtgtcactcacatttccatgatacgctggggcagagcgatgatctgattcaccaccaccacgactatcatcacattctgcatcaccaccaccatcagaaccaccacccacactcacacagccagagatatagtcgagaggagttaaaagacgccggcgtcgctaccttagcatggatggtgattatgggggatggtcttcacaatttttcagacgggcttgccatcggcgccgcctttacagaaggtctttcaagcggtctgtccacctctgtggctgtgttttgtcatgagctccctcatgagttgggcgactttgccgtgctgcttaaggccggtatgaccgttaagcaagctgtgttgtacaacgcactatccgcgatgctcgcctacctgggaatggcgactggcatctttattggtcattacgcggagaatgtgagcatgtggatattcgccttaaccgcaggtctgtttatgtacgttgccctcgtggatatggtccccgaaatgctacacaacgacgcctcggaccatgggtgttcacgctgggggtacttttttctgcagaacgccggtatgctccttggctttggcatcatgctgttgattagcatttttgagcacaagattgtcttccggattaatttctag

SEQ ID NO: 26457 - DNA, 1302 bp, Artificial Sequence
  Description of Artificial Sequence: Synthetic coding sequence
atgggcatccaggtgcccctgaacgccaccgagttcaactacctgtgtccggctatcataaaccagatcgatgctcgctcctgtttaatacacactagcgagaagaaagcagagatcccaccaaaaacgtattctcttcaaattgcttgggtaggtgggtttatcgccatttctattattagttttctttcgctcttgggcgtgatattggtgcccctgatgaaccgtgtattttttaagtttctgctcagctttctggttgcactcgctgtggggacactgtctggggacgcatttctccatctgctgccacatagtcacgcctcccaccaccacagtcacagtcatgaggaaccagcgatggaaatgaaacggggtcccttattttcgcatctgtcgagtcagaacattgaggagtccgcttattttgactcaacttggaagggcttgactgcactgggaggcctgtacttcatgttcctcgtggagcacgtcctgactctcatcaaacaatttaaagacaagaagaagaaaaatcagaagaagccagaaaacgacgacgacgtggagataaagaagcagctgagcaaatacgagtcacagctttccacgaatgaggaaaaagtggataccgacgataggacggaaggctacctcagggctgatagccaggagccctctcactttgactcacagcagccggccgtattagaggaggaggaagtaatgatcgctcatgcacatcctcaggaggtgtataacgaatatgtgcctcgaggatgtaagaataaatgtcactcccacttccacgacacactcggacagtctgacgatctgatccaccatcaccacgactatcaccatatcctccatcaccaccaccaccaaaaccaccacccacattcccactctcaaaggtatagccgagaggaactaaaagatgcaggagtcgcaaccctggcttggatggtaatcatgggcgatggcctgcacaatttcagcgacggactcgccatcggggctgccttcacggagggactgtcctccgggctgtccacaagtgtagctgtgttttgtcatgagctcccacacgagctgggggatttcgccgtcttgctgaaagctggaatgacagtgaagcaggcagtcctgtacaatgctctgtctgccatgctggcatatctcgggatggccacaggcattttcattggacattacgcagagaatgtcagcatgtggatttttgccctgaccgctggattgttcatgtatgtggcccttgtagatatggtctctttttag

SEQ ID NO: 26458 - DNA, 1233 bp, Artificial Sequence
  Description of Artificial Sequence: Synthetic coding sequence
atgggcatccaggtgcccctgaacgccaccgagttcaactacctgtgcccagctatcatcaaccaaatcgatgccaggtcttgtctcatacacacttccgagaaaaaagcggaaattccgcctaagacctactctttgcagatagcatgggtgggcggcttcattgcaataagtattattagcttcttgagcctcctcggtgtgatcttagttcctttgatgaaccgggtcttttttaagtttcttctgagtttcctagtggcactggcagtggggaccctatctggcgacgcctttctccatttacttccgcatagccacgcaagtcatcaccattcacactcccatgaagaaccagccatggagatgaaacgcggcccgctgttctcacacctctcctctcagaatattgaggaatcagcctattttgacagtacctggaagggcctcaccgccctgggcggcctgtactttatgttccttgtggaacacgtgctgacgttgattaaacagtttaaagataagaaaaaaaagaatcagaaaaaacccgaaaatgatgacgacgtagaaatcaaaaagcagctgtctaaatatgagagccaactgtcaacgaacgaggagaaggtggataccgacgaccgcaccgagggataccttcgcgcagactctcaggaaccaagccactttgactctcagcagccagccgtgctggaagaggaggaagtcatgatagcccacgctcatcctcaggaggtctataacgaatacgtgccaaggggctgcaaaaacaaatgccacagccacttccatgatactctcggacagtccgatgacttgatccatcatcaccacgattaccaccacatcctgcaccaccaccatcaccaaaaccaccatccacattcccatagtcagaggtacagcagggaggaactgaaggatgcaggtgtggcaactttagcctggatggtgataatgggagacggactgcataacttcagtgacggtcttgcaattggcgctgcctttaccgagggcctgagcagtgggctgagcacaagtgttgctttggtggacatggttccagaaatgctgcacaacgatgcttctgatcatggctgcagccgatggggctatttctttttgcaaaatgccggtatgcttctcggctttgggataatgctgttgattagtatcttcgagcacaagatcgttttcaggatcaacttctag

SEQ ID NO: 26459 - DNA, 1833 bp, Artificial Sequence
  Description of Artificial Sequence: Synthetic coding sequence
atggacaccccccggggcatcggcaccttcgtggtgtgggactacgttgtgttcgctggtatgctggttattagcgctgccatcggaatttattacgcattcgcaggcggagggcaacaaacgtccaaggactttctcatgggcggtagacgaatgactgcggtccctgtggccctgtccctaactgcctccttcatgagcgccgtgaccgtcctcggaactccttcagaagtctatcggttcggcgccatcttcagcatttttgccttcacatacttttttgtggtcgtgattagtgctgaagtttttctgccggtgttctacaagctggggattactagcacatatgagtatctggagttgcgctttaacaagtgcgtacgcttatgtggcacagttcttttcattgtgcagaccatcctttataccggaatagtcatttacgcgcccgctctcgccctgaatcaggtgaccggctttgacctatggggcgcggttgttgctacaggtgtggtgtgtactttttattgtacgctgggtgggctgaaggccgtgatctggaccgacgtgtttcaggtggggatcatggtagctggattcgcttccgtgatcattcaagctgttgtaatgcaaggtggcatatctaccattctcaacgacgcatatgatggcggccgcctaaacttctggaatttcaacccaaatccactgcaacgccacaccttctggactatcattataggaggaacgttcacgtggacaagtatttacggtgtcaaccagagccaagttcagaggtatatcagttgtaaaagcaggtttcaggctaagctgagtctgtatatcaatctggtgggcttgtgggcaatactcacatgctccgtcttttgcgggctcgcactgtattcacggtatcacgactgtgacccatggaccgctaagaaggtcagtgcccccgatcagctgatgccctatctggtactggacattttgcaggattatccaggccttcctggactcttcgttgcctgtgcctactccggaacactgagcacagtgagtagctctattaatgctttggctgccgtcaccgtggaggatctcatcaagccatacttcagaagtttaagcgagagatccttgtcatggataagtcagggaatgtctgtggtctacggcgcactctgcattgggatggccgccctggcttctttaatgggcgcactgttacaggcagccctgagcgttttcggcatggttggggggcccttaatggggctatttgccctaggcatactggtgccattcgccaattctattggtgccctggtcgggcttatggctggcttcgcgatatctctgtgggtaggaatcggcgcacagatttatccgcctttgcccgagaggacactgcctcttcatctcgatatacagggttgtaattccacatataacgaaacaaatctgatgaccaccaccgaaatgccttttacgactagcgtgtttcagatttataatgtgcaacgcaccccgttgatggacaactggtacagtctgtcgtacctgtatttctcaacggtgggaacccttgtgacactgctggtcggcatactcgtctctcttagtaccggagggagaaaacaaaatctggatccccgatatatcctaaccaaggaagatttcctaagtaactttgatatcttcaagaaaaagaaacacgttctgtcttacaagagtcacccggtggaagatggaggcactgataatcctgcttttaaccatattgagttgaatagtgaccaaagcgggaagtccaacggtacaaggttgtag

SEQ ID NO: 26460 - DNA, 1071 bp, Artificial Sequence
  Description of Artificial Sequence: Synthetic coding sequence
atggacatggccgacgagcccctgaacggcagccacacctggctgtccataccctttgatttgaacggcagcgtcgtcagcaccaacacctccaatcaaactgaaccatattatgacctgactagcaatgccgtactgacctttatctactttgttgtttgcatcataggcctgtgcggaaatacactcgttatttacgtcatcctgaggtacgctaagatgaagacaataactaatatctacatcctcaatctcgccatcgccgacgagctgtttatgttgggccttcccttcttggcaatgcaagtggctttagttcattggcccttcggcaaagctatatgtcgcgtcgtaatgacggtggacggcatcaatcagttcacgagcatcttttgcttaacagtaatgagcattgacaggtacctggccgtggtgcatcctataaagagcgcaaagtggcgaaggcctaggaccgccaaaatgatcaccatggccgtgtggggagtgagtctcctagtgatactccctataatgatatacgcagggctgcgatccaaccagtggggaagaagcagctgtacaatcaattggcctggggagtccggcgcatggtatactgggtttataatttacacttttatcctcggctttctggttccactgaccattatttgcctctgttaccttttcatcataatcaaggtgaaaagttccgggatccgggtcgggtccagcaaaaggaaaaaatccgaaaagaaggtgacacggatggtgtcaatcgtcgtggctgtgttcattttttgctggctaccattttatatcttcaatgtctcttctgtctctatggccattagtcccaccccggcgctgaagggtatgtttgacttcgtcgttgtcctcacttatgctaactcgtgcgcaaacccaattctgtatgcatttctctcagacaactttaaaaaatccttccaaaacgtcttatgcttggtgaaagtcgacaattccaagagtggtgaagaggggtcatgcctggatatgattttcaggaacaataaaaacagaaaaaaatag

SEQ ID NO: 26461 - DNA, 1110 bp, Artificial Sequence
  Description of Artificial Sequence: Synthetic coding sequence
atggacatggccgacgagcccctgaacggcagccacacctggctgagtatccctttcgaccttaacggctcagtggtctccactaacacttcaaatcagacagagccatattacgatctgacatcgaacgcagtccttaccttcatttatttcgttgtgtgtattattggtctttgtggcaacacattggtgatctacgtgatactcaggtatgcgaaaatgaagacgatcacaaacatttatattctcaatctcgccatagccgacgaactgttcatgctcggcctcccttttctggcaatgcaggtggcattagttcactggccatttggcaaggccatttgcagagtcgtaatgactgtggacggcattaatcagttcacctcgatcttctgtctgaccgttatgtctatcgaccgctacctcgcagtggtccatcctattaagagcgcgaaatggagaaggcctcggacagctaagatgatcacaatggcagtgtggggtgtgtcactactggtcatcttgcctatcatgatttacgccgggcttaggagtaaccagtggggccgctcatcgtgcaccatcaattggccaggagaatctggtgcatggtacactggtttcattatttatacttttattttaggcttcctggtcccactgacgatcatctgcctttgttatttattcataataatcaaagtcaaaagctccgggatcagagtcgggagctctaaacgcaaaaagagcgagaagaaggtcacgcgcatggtgagcattgtggttgccgtgttcatcttttgctggcttcctttctatattttcaatgtgtcatcagtgagcatggcgatctctcctactccggctctgaaaggcatgtttgattttgttgtggtgttgacatatgcaaattcttgtgctaatccaatactgtacgcattcctgtccgacaatttcaaaaagtcgttccaaaatgtactctgtctggtaaaggtctcgggcaccgatgacggtgagcgttccgacagcaagcaggataagagcaggcttaacgaaaccacagagacacagaggaccttgctgaatggcgacctccagacatccatttag

SEQ ID NO: 26462 - DNA, 3315 bp, Artificial Sequence
  Description of Artificial Sequence: Synthetic coding sequence
atgcaggcccagcagctgccctacgagttcttcagcgaggagaacgcccctaagtggagaggcctactggtgcctgctctgaagaaagtgcagggacaagtccacccaaccttggaaagtaacgacgacgcactgcaatacgtcgaagagttaatcctccaactcctgaatatgctgtgccaggctcaaccccggtcagcttcagacgtagaagaacgggtccagaagagctttcctcatcctatcgataagtgggcaattgccgatgcccagagcgctatcgagaaacggaagcggaggaacccactgagtctaccggtcgagaagatacatcccctcctgaaagaagtccttggatataagatagatcatcaggtttcagtgtatatcgttgcagtcctcgaatatatttccgccgacatcctcaaacttgtgggcaattatgttcgcaatattcggcattatgaaattactaagcaagacatcaaagtagctatgtgtgcagataaggtattaatggatatgttccaccaggacgttgaagatatcaatatcctgtccctgaccgacgaagagccttcaacctctggagaacagacttactacgatctggtcaaagcattcatggccgaaattcgccagtatattcgagaactgaatctgataatcaaagtctttcgtgagcccttcgtgagcaattcaaagctgttcagcgccaatgatgtggagaatatctttagtcggatcgtggacatccatgagctcagcgtgaagcttttagggcatatagaagacacagtggaaatgacagacgaggggtcccctcacccgctagttgggtcttgttttgaggaccttgcggaagaattggcctttgatccatatgagtcatacgcaagagacatcctgagacctgggtttcacgatcgctttctgtcccagcttagcaagccaggtgccgccctgtatctccagtctatcggagaggggttcaaggaagctgtgcagtacgtcctgccccggctgctcctggccccagtataccactgtttgcattatttcgagctgctgaaacagctggaggaaaaatcagaagatcaggaagacaaagaatgcctcaagcaagccataactgctcttttaaacgtgcagagcgggatggaaaagatatgcagcaagtcattagccaaacgacgtctttccgaatccgcctgtcggttttattcccagcagatgaagggaaagcagctggcgataaaaaagatgaatgaaattcagaaaaacattgacggatgggagggtaaagatatcggacagtgctgtaacgagtttattatggagggaacccttacaagagtaggggctaagcacgagcggcacatcttcctttttgacggtctgatgatctgctgtaagtccaaccacgggcaaccgcggctgcctggcgcgtctaacgcagaatacaggctgaaggaaaagttctttatgcggaaggtgcagattaatgacaaggacgatacgaatgagtacaagcacgcttttgagataatactgaaggatgagaacagcgtgattttcagtgccaagtcagcagaggaaaaaaataattggatggccgcactcatttccttacagtataggtcaactctcgaaaggatgcttgatgtgaccatgctgcaggaggagaaagaggagcagatgagactgcctagtgccgatgtgtacaggtttgccgagcctgatagtgaagaaaacatcatctttgaagagaacatgcagcctaaagccggaatcccgatcatcaaggccggtactgtgataaagttgatcgaaaggcttacctaccatatgtatgctgacccaaattttgtacgaacttttctgaccacatatagatctttttgtaaacctcaggagttgctttctttgatcatcgaacggttcgagatccctgagcccgagccaactgaggctgatagaattgctatcgaaaacggtgatcagcccctgtctgctgagctgaagcggttcagaaaggaatatatccagcccgttcagctgagggtgctaaatgtttgtcgccactgggtagaacatcacttttacgattttgaacgagatgcttatctgctgcagaggatggaggaatttattggaacagtcaggggcaaagccatgaagaaatgggtggaaagcatcaccaaaatcatccagagaaagaaaatcgcaagggacaatggccctgggcacaacattacctttcagtccagtcctccaaccgttgagtggcatatttccaggcctggtcacatcgaaacattcgatttgctgacactccaccctattgaaattgcgagacagcttactctgctggagtccgacttatacagggctgtgcagccaagcgagcttgtcggatctgtttggacaaaggaggataaggaaatcaatagccccaatctgctgaaaatgattaggcacaccaccaatctgaccttatggttcgagaagtgcatagtcgagacagaaaacctggaagaaagggtggccgtggtttcacgcattattgagatactgcaggtattccaggagctaaacaactttaatggggtgcttgaggttgtgtccgcaatgaactccagcccggtatatcgacttgatcataccttcgagcagatcccctcaaggcagaagaagattctcgaagaagctcacgagctgtcagaggatcactataagaaatatctggccaaattacgatctattaaccctccttgcgtgccctttttcggtatttatctgaccaacatcctcaagacagaggaagggaatcccgaggtgctcaagagacatggcaaggagctcataaatttctccaaaaggagaaaagttgcagagattactggcgaaatccagcaatatcaaaatcaaccttactgcttaagagtagaatcagatatcaaaaggtttttcgagaatctgaacccaatgggtaattccatggaaaaggagtttactgattacttgttcaacaagtccctggaaattgaaccccgaaaccctaaacctttgccccggttccccaaaaaatattcatatccacttaaaagcccaggagtgaggccttctaacccaaggcccggcaccatgcgccacccaacccccctgcagcaggagccccgaaagataagctactcccggataccggagtcagagactgaaagcactgcttctgccccaaactccccaaatactgttaacacatccgcatgcttctggtgctttcaataccatcggtgtctgcagtgcatatag

SEQ ID NO: 26463 - DNA, 3957 bp, Artificial Sequence
  Description of Artificial Sequence: Synthetic coding sequence
atgcaggcccagcagctgccctacgagttcttcagcgaggagaacgctccaaaatggaggggacttctcgtccccgctctcaagaaagtgcagggccaggtacacccaactcttgagtcgaacgacgatgcactgcaatacgtcgaagaactgattctgcagctgctgaacatgctgtgccaggcccagccccgcagcgcctcagacgtggaagaaagggtgcagaagtcattcccccacccaattgacaaatgggccattgcagacgcccagtccgctattgagaagagaaagaggagaaatccattgtctttgcccgttgaaaagatccaccccctcctgaaggaggtgctggggtacaagatcgaccatcaggtgtctgtgtatattgtggcagtgctggagtacatcagcgctgatatcctgaaactggtgggcaactacgttcgcaacatacgccactacgaaatcacaaagcaggatatcaaggttgcaatgtgcgcagacaaggtcctgatggatatgtttcatcaagatgtagaagacataaatattttaagcctgacagatgaggagcccagtacctccggcgaacagacatattacgaccttgttaaagctttcatggccgagataaggcagtatatccgggaactgaacctgattatcaaagttttccgggagccctttgtgagcaactcaaaattatttagcgccaacgatgtcgaaaacattttttcacggatcgtggacatccatgagttatccgtgaaactcctcggccacattgaagacacggtggagatgacagacgaaggaagcccacatcctctggtgggatcctgttttgaggacttggctgaggagctggcttttgacccctatgagagctacgccagggacatccttagaccgggctttcatgaccgatttttatctcaactctccaagcccggtgctgccttatacctgcagagtatcggagaaggctttaaggaagcagtgcagtacgttttacctcgactcctcttggcccctgtctaccactgcttgcattattttgaattactgaagcagctagaggagaaatctgaggatcaagaagacaaggaatgtctgaagcaggcgattactgcgctcctaaacgtgcagtctggcatggaaaaaatctgcagcaaaagtctggcaaaacggcgcctcagtgaatccgcctgccgcttctactctcagcaaatgaaagggaaacagctggcaatcaagaagatgaacgagatccagaagaatattgatggctgggagggaaaagacatcggccagtgttgcaacgagttcattatggaggggacgttgacacgcgtaggagctaagcacgagcggcatatcttccttttcgatggcctgatgatctgttgtaagtctaaccacggccagcctagattgcctggtgcaagcaacgccgagtatcgcttgaaggaaaagttcttcatgcggaaggtccagatcaatgacaaagatgatacaaacgaatataaacacgccttcgagatcatccttaaagatgagaactcagtgatcttcagtgcgaagtcggccgaagagaagaataactggatggctgccctgatcagcctgcagtatcgaagcaccttggaacggatgttggatgtgacgatgctccaggaagaaaaagaggaacagatgaggctgccaagcgccgatgtatatagattcgcagaacctgactccgaagagaacattatctttgaggaaaacatgcagccaaaagccggaatcccgatcataaaagcagggaccgtcattaagttgatcgagaggctcacgtatcacatgtacgcagaccccaattttgttcgcactttcctgacaacgtaccggagcttctgcaaaccacaggaactgctctctctgattattgaacgcttcgaaatccctgagccggagcccaccgaagctgaccggattgccatcgaaaacggggaccaaccactgagcgcggaactgaagcggtttaggaaggaatatattcaaccagtccagctgagagtacttaacgtgtgccgccattgggttgagcaccatttttatgactttgagagggacgcatacctgttacagcgcatggaagaatttattggcaccgttagaggcaaggccatgaagaagtgggtggagtccataaccaaaatcattcagcgaaaaaaaatcgcacgagacaacggacctggccacaatattactttccagagcagccctcccacagtagaatggcacatctcccgcccaggacatatcgaaacgtttgatttgcttactctgcaccctattgaaattgcacgacagctcaccctactcgagagcgacctgtaccgggctgtgcagccatcagagttagtcggaagcgtatggaccaaagaagataaggagatcaattctcccaatctactgaaaatgattcgacatactacaaacctgaccttgtggtttgagaagtgtattgtggaaaccgagaatctggaggaacgcgtcgcagtggtctccagaataatagagattctgcaagtttttcaagaactcaacaatttcaacggcgtgttggaggtcgtttctgcaatgaatagtagtccagtctataggctggatcacactttcgagcagattccctcccgacagaagaaaattctggaagaggcccacgagctgtccgaggaccattataaaaagtatctggccaagctacggtctattaaccctccatgtgtccccttcttcgggatctatctcaccaacattctgaagactgaagaaggtaaccccgaagttttgaagcgtcatggcaaggagcttatcaacttcagtaaacgcaggaaggtggcagagatcacaggtgagattcagcagtaccagaaccagccatactgtctgcgggtggaatcagacattaaaagattctttgaaaacttaaaccccatgggaaactcaatggagaaagagttcaccgactacctattcaacaaatctctcgaaattgagcctcggaaccccaagccgcttcccagatttcccaagaaatatagctatcccctgaaaagtcctggcgtgagaccttctaatcctcgcccagggaccatgcggcaccctacgcctttacagcaggaacctcggaagatttcgtactcgcgcatccccgaaagtgagacagagtccaccgccagcgctccgaattccccccgcactcccctgacacctcctccagcttctggagcatcttccaccaccgatgtttgctcagtcttcgattccgaccactccagtcccttccattcaaggtcagccagcgtgtcctcaataagcctaaccaaaggcacagacgaagttcccgttccaccgccagtgcctccaagaagaaggcccgagtccgccccagctgaaagttcacccagcaaaattatgtccaagcacttagatagccctcccgccatcccaccgcgtcagcctacaagcaaggcctactcacctcgatactccatttctgaccggacctcgatctccgacccaccagaaagcccacccttactcccgccacgtgaacccgtgcggaccccggacgttttttcttccagcccccttcacctccagcctccccctttgggaaaaaagagcgaccacggtaatgctttttttccgaactcacctagcccctttaccccgcccccccctcagactccaagtccgcacggaactaggagacatctgccaagccctccattgactcaggaggtggatttgcactctatcgctgggccacccgtccctcctagacagagcaccagccagcacatccctaagctcccgccaaaaacctacaagcgtgagcatacgcacccatcaatgcaccgtgacggtccacccctgctagagaacgcgcacagttcctag

SEQ ID NO: 26464 - DNA, 4002 bp, Artificial Sequence
  Description of Artificial Sequence: Synthetic coding sequence
atgcaggcccagcagctgccctacgagttcttcagcgaggagaacgctcccaagtggcgcggcctgttggttccggccctcaagaaggttcaggggcaggtgcaccccactttagaaagcaacgacgatgccctgcagtatgttgaggagctaatacttcagctgctcaacatgctgtgtcaggcacagccacggtctgcaagtgatgtggaggaacgagtacagaagtcattccctcaccctattgataagtgggccatcgcagacgcacagtcagctatagagaagcggaaacggcgcaacccgctctcactgcccgttgaaaagattcatcccttgctcaaggaagtgttggggtacaaaatcgatcaccaggtgagcgtgtacatcgtggccgtcctggagtatatatccgctgatattctaaagctggtgggaaattacgtccgtaacattcggcattatgaaattacgaagcaggacatcaaggtggctatgtgcgctgacaaggtgctaatggacatgtttcaccaagacgtagaagacataaacatcctctctctaactgacgaagagcccagcaccagcggggagcaaacgtactacgatctggttaaggcttttatggcagagatacgccagtacattcgggaactgaatttgattattaaggtgtttcgtgaacccttcgtcagtaattccaagctctttagcgcaaatgacgttgagaatatctttagcaggatagtggacatccatgaactttcagtgaagctactcggccatattgaggatacggtggaaatgacagacgaaggatctccccatccactcgtggggtcctgcttcgaagatctggcggaggagctcgccttcgatccttacgaatcttatgcacgtgatatcttacggccggggttccatgatcgatttctttctcagctgtccaagccaggcgcagctctgtacctgcaatccataggagagggcttcaaagaagccgtgcagtacgtgctgccgcgcctcctgctcgctcctgtgtaccactgcctgcattacttcgagctgctaaaacaacttgaagagaagtctgaagatcaggaagacaaggaatgtttgaagcaggctataacagccttgctgaatgttcagagcggaatggaaaagatctgtagcaagtcgctggctaaacggaggttgtcggagtctgcctgtcgattttatagccaacagatgaaggggaagcagctggcgattaagaaaatgaatgagattcagaagaacatcgatggctgggagggaaaggatatcgggcaatgctgcaatgagtttatcatggaggggaccttgactcgagtgggtgctaaacacgagagacacatctttctctttgacggactcatgatttgttgcaagtctaatcacggtcagcctcggctgccaggcgccagtaacgccgagtatcgccttaaagaaaagttcttcatgagaaaagtgcagataaacgacaaggatgacacaaacgaatacaagcatgccttcgagataatcctcaaggatgaaaattcagtcatattctctgcaaaatcagctgaagagaaaaataattggatggccgcactgattagcttgcagtacagatccactctggagcggatgctggatgtcaccatgcttcaggaagagaaggaagaacagatgcgtctcccatcggccgacgtgtacaggttcgcagagccagactcggaggaaaatattatcttcgaagaaaacatgcagcccaaggcgggcatccccattattaaagccggtacggttattaagcttattgaaaggttgacttaccatatgtatgccgacccaaactttgtgcgtaccttcctgacgacgtatcggagtttctgtaagccccaggaattgttatctctgattatcgaaagatttgagatccctgaacccgagccgactgaagccgataggatcgccatcgagaacggagaccagcctctgtccgcagaactcaagagattccgcaaggaatatatccagcccgtccagctgcgcgttctaaacgtctgtagacactgggttgaacatcatttttacgactttgagcgggatgcatacctgctgcagcgcatggaggaattcattggcaccgtacgaggcaaggccatgaagaaatgggtggagtctattacaaagatcattcagaggaaaaagatagcccgtgacaatggccccggacacaatattactttccagtctagcccccccaccgttgaatggcacatctcccgccccggccacatcgaaacattcgacctcctcacgttgcacccgattgaaatcgctcgacagttaacgctccttgagtcggatttgtaccgagccgttcagcccagtgagttagtgggctccgtctggactaaagaggataaagaaatcaacagtccaaacctcctgaaaatgataaggcatactactaaccttaccttatggtttgagaaatgcatagtggagactgagaacctggaggaaagggtagcagtggtgtcccgcattatcgagattttgcaggtgtttcaggagctgaacaacttcaacggggtgctggaggtggtcagcgcaatgaatagcagcccagtgtatcggctggaccacacgttcgaacagatcccttcccggcagaaaaaaatcctcgaagaggcacacgagctctccgaagatcattataaaaaatatttggcaaagctccgatctattaacccgccctgtgtgccttttttcgggatttatcttactaatatattgaagaccgaagagggcaaccctgaagtcctaaaaaggcacggtaaggaacttataaatttcagtaagcggagaaaagtggccgagatcaccggagaaatacagcagtaccagaaccagccatactgcctgagagtggaaagcgatatcaaacgattcttcgagaatctgaatcccatgggtaattccatggaaaaagaattcactgactacttgtttaataagtcactcgaaatcgagccgcgaaatcccaagcctctgcccaggtttcccaagaaatactcataccctctcaaatctccaggagtgcgccccagcaaccccagaccaggcactatgagacacccaacaccccttcagcaggagcctcgaaaaataagctacagtagaattcctgagtcagagactgaatcgacagcctctgcacccaatagccccaggaccccactgacaccgcctcccgctagtggagcatctagcacgaccgatgtttgctcagtgtttgactccgaccatagctcccccttccactcgtcgaacgacacagtgttcattcaggttacgctgcctcatggccccaggtccgcttccgtttcttcgataagcctgacaaaagggaccgatgaggtgcccgttccaccacccgtgccaccccgacggcgtccagagtctgccccagccgagtcaagcccaagtaaaatcatgagcaaacaccttgatagtcctcctgccataccccccagacagcctacttccaaagcctacagcccacgatactccatttccgatagaacttcaatttccgacccaccggagtcaccccccctgcttcctcctcgcgaacctgtgaggaccccagacgtattttcttcttcccctctccacctgcagcctcctcccctcggtaagaagagtgatcacggtaacgcatttttccccaattccccgagccctttcacccccccacctcctcagacgccaagccctcacggcacgcgccgccatttgccctcacctcccttgacacaagaagtcgatctgcattcgatagccggcccccccgtgcccccgcgccagtccacctcacagcacattccaaagctccctcccaaaacttacaagcgtgaacacacacaccctagtatgcaccgagatggccctcctctattagaaaatgctcattcatcatag

SEQ ID NO: 26465 - DNA, 4002 bp, Artificial Sequence
  Description of Artificial Sequence: Synthetic coding sequence
atgcaggcccagcagctgccctacgagttcttcagcgaggagaacgccccgaaatggcgtggtctcttagtgccagcgctgaagaaggtccagggacaggtgcaccccacactcgagtcaaacgatgatgcactccagtacgtggaagagttaatccttcagctgctgaatatgctctgccaggcccaacctcgttctgcttctgacgtagaggagcgggttcagaagagttttccacaccctatcgacaaatgggcaatcgccgatgctcagtcagcgattgaaaagcgcaagcggcgaaatccactttctctacctgtggaaaaaattcatcctctcctgaaagaagtcttgggctacaaaatcgatcatcaggtttctgtgtatattgtagccgtcctcgaatatatatcggcagacatcctgaagctcgttggcaactacgtgagaaacatccgccactacgagatcacaaaacaggatataaaggtggccatgtgcgctgacaaggtccttatggatatgtttcaccaggacgtggaggacataaacatcctgagtcttacggatgaggaaccttccacaagcggcgagcaaacctattatgatttggtaaaggctttcatggctgaaattcgccagtatataagagaacttaatctgattatcaaagtgttccgggaaccttttgtatcaaactcaaagttattttcagcaaatgacgtcgaaaatattttttcaaggattgtcgatatccacgaattgagcgtcaagcttttagggcatattgaggacacagtagaaatgacggacgaggggtctcctcaccctcttgtcggatcatgcttcgaggatttagcggaggaattagccttcgacccatacgagagttacgcaagagatatcctgagaccagggtttcacgatcggtttctctctcagctatcaaagcccggggctgccctgtatctgcaaagtatcggcgagggattcaaagaggcagtgcagtacgttctccctcgcctgcttctcgccccagtgtaccactgtctgcattacttcgagcttttaaagcagctcgaggaaaaatcagaggatcaggaggataaagaatgtttaaaacaagcaattaccgccctgctaaacgtccagagcggaatggagaaaatctgctcaaagagcttagccaaacgtcggctgagtgagagtgcttgcaggttctacagccagcagatgaaaggcaagcagctcgcaatcaagaagatgaacgaaattcagaaaaacatcgacggatgggagggaaaggacatcggccagtgttgcaacgaatttatcatggagggcactttgacacgtgtgggcgctaagcacgagagacatattttccttttcgacggactgatgatctgctgtaaaagcaaccacggccagccaagacttccaggcgctagcaatgcggagtatagactgaaagaaaagttttttatgaggaaagtccagatcaacgacaaggatgacaccaacgaatacaaacacgccttcgagatcatccttaaagacgagaacagtgtcatcttctccgccaagtctgctgaagagaagaacaactggatggctgcacttataagtctgcagtacaggagtactctggagagaatgctggacgtaacaatgttgcaggaagagaaagaggaacagatgaggctcccctccgctgatgtgtatcggtttgccgagcctgacagcgaagagaacatcattttcgaggaaaatatgcaaccaaaggcaggtattccaattatcaaggccgggacagtaataaagttaatcgagcgcctgacctaccatatgtatgctgaccctaacttcgtcaggactttcctaaccacttaccgctcattttgtaagcctcaggagctgctctccttgatcattgagcgcttcgagattcccgagcctgagcctactgaagctgatcggattgcaatcgagaatggcgatcagcccctgagcgccgagctgaagagattccgcaaggagtatattcagcctgtacagctgagagtactcaacgtgtgccggcattgggtggagcaccacttttatgattttgagcgagacgcatacttgctgcagcggatggaagagtttatcgggaccgttcgcggcaaagcgatgaagaagtgggtggaaagtattaccaaaattatccagcgaaaaaagatcgcccgtgataacggacccgggcacaacatcacgttccagagctcccctccaactgtggagtggcacatctcacgaccagggcacattgagactttcgatcttctaacacttcatccgattgagatcgcaaggcaacttactctattggaatccgatttgtatcgggctgtccagcctagcgaactggtgggcagcgtgtggaccaaagaggacaaggagattaactcccccaacctattgaaaatgatccggcacactaccaacctgaccttgtggtttgagaagtgcatagttgaaacagaaaatctggaagaaagagtggccgtcgtctcgagaataatcgagattctgcaggtgtttcaggagttgaacaacttcaacggagtgctggaggtggtgtctgcgatgaattccagccctgtgtatcgcctggaccatacctttgagcagatccctagtcggcaaaaaaaaattctggaggaagctcacgagctgtcagaagaccattacaagaaatatctggccaaactgagatctattaatccaccatgcgtgccgttcttcgggatctacctgacgaacatccttaagaccgaagaggggaatccagaggtgcttaagcgacacgggaaggaactgatcaatttttcaaagcggcgaaaggtggccgagatcacaggggagattcaacagtaccagaaccagccctattgtctgcgagtcgagagtgatataaaacgattttttgagaatctgaaccctatggggaattcaatggaaaaagagttcacagactacttgttcaacaaatctctcgagattgagcctaggaacccgaagcctctgccccggtttcctaagaagtatagctaccccctgaagtctccgggtgttcgcccttctaaccctaggcctggaactatgcgccaccctaccccattgcagcaagagccccggaaaatcagttactccagaatccctgaatctgagacagagtctacagcctcagcgccaaactcccctcggacccccctgaccccccctccagccagtggagccagtagcacaacagatgtttgctcggtctttgacagcgatcattctagcccattccactccagcaacgacaccgtctttatacaggtgacactgccacatggaccgcgctccgccagtgtgtctagcattagtcttacaaaaggcacggatgaagtgcccgtgccaccaccagtgcctccaagaagaagacctgagtccgctcccgccgaaagtagccctagcaagatcatgtctaagcacctggactctcctccagccattccaccccgacaaccaacctccaaagcttacagccccaggtactccatcagtgaccgaacttccatcagcgacccacctgaatcccctccattgctgcccccacgtgaacccgtaaggactcccgacgtatttagcagctcaccattacacctccagccaccgcctctcggcaagaagagtgatcatggaaacgcctttttccctaactcaccaagtccatttactccaccgcccccccagaccccatcacctcacgggactaggcggcacctgccttcacccccactgacccaagaggtcgacctgcacagtatagcgggcccccctgtgccaccaaggcagagcacctcacaacacattccaaagttacctcccaagacgtataagagggaacacacccacccgagcatgcatagggatggcccgcccctgctggagaatgcccactcaagttag

SEQ ID NO: 26466 - DNA, 945 bp, Artificial Sequence
  Description of Artificial Sequence: Synthetic coding sequence
atgctgtgccaggcccagccccggagcgccagcgacgtggaggagcgagttcagaagtcctttccccaccccattgataagtgggctatcgcagatgcacagtccgccatcgagaagaggaaaaggaggaatcccctgagtttgccagttgaaaaaatccacccactgctgaaagaagtgcttgggtataagatcgatcatcaggtcagtgtttacattgttgctgtactggaatacatttctgccgatattttaaagttagtaggcaattacgtgcgcaacattcgacactatgaaattacgaaacaagacattaaagtggcgatgtgtgccgacaaagtgctcatggatatgttccaccaggacgtggaagatattaatattctttccttaaccgacgaagagccctccacatcaggggaacagacatactatgacctcgtgaaagcgtttatggccgaaataaggcaatacatcagagagttaaatctgatcattaaagtgtttcgcgagccgtttgtttctaattccaagctgtttagtgcaaacgatgtggagaacatctttagtcgtattgtggatatacacgagttgtccgtcaaactactgggtcacatcgaggatacagtggaaatgactgatgagggaagtccccatcccctcgtgggctcttgcttcgaggatctggccgaagaactggcttttgatccgtatgagagctacgcccgcgatatcctccggcccggattccatgacagatttctctctcagttgtctaagccaggagctgccctttacctacagtccattggcgaaggttttaaagaggctgtccagtacgtacttcctcgacttttgctcgccccagtctatcactgcctgcattacttcgagctgcttaagtttccttttggcgatctatcccgcctacgcgacagtgtgtag

SEQ ID NO: 26467 - DNA, 3153 bp, Artificial Sequence
  Description of Artificial Sequence: Synthetic coding sequence
atgaccgacgagggcagcccccaccccctggtgggcagctgcttcgaggacctggccgaagagctggcgtttgacccatatgagagctacgcccgggacattttgaggcccggttttcacgaccgcttcctctctcaactgtctaagcctggcgccgcactgtacctacagagcatcggtgaggggttcaaggaggcagtgcagtacgtattgccgcggctgttgttggcccccgtttaccattgtctccactactttgaattgctcaagcagctggaggaaaagtctgaggaccaggaggacaaggagtgccttaagcaagcaatcacagcgctgctgaatgtgcagagcgggatggagaaaatctgttccaagtcactcgcgaagcggcgactctctgagagcgcatgcaggttttacagccagcagatgaaaggtaagcagctggccattaaaaaaatgaacgaaattcagaaaaatattgacggttgggaaggaaaagacattggacaatgttgcaatgagttcattatggaaggaacgttaaccagagtgggcgccaaacatgagcgtcacatatttctgttcgacgggctgatgatttgctgtaaaagtaatcacggccaaccgcgcctgccaggggcctccaatgcagagtacagacttaaagagaaattcttcatgcggaaggtgcagatcaacgataaagacgacaccaacgagtacaagcacgcctttgaaattattctcaaggatgagaattccgtgatcttcagtgcgaagtccgccgaagagaaaaataattggatggcagcactgatttccctgcagtaccggtcaaccctagaacgcatgttagatgtgacaatgctccaggaagagaaggaagaacaaatgcgactgcccagtgctgatgtgtacaggttcgccgaaccagatagcgaagagaacatcatcttcgaggaaaatatgcagcccaaagcgggcatccccatcattaaggccggcacagttatcaagctgatcgagcgtcttacctatcacatgtatgccgacccgaatttcgtccgcacctttcttacgacctatcgaagcttttgtaagccacaggagctgctttctctgataattgagcggtttgaaatacccgaaccggagcccacagaggccgatcggatcgctatcgagaatggcgaccagcccctcagtgctgagcttaagaggtttcgaaaggagtacatacagccggtgcagctcagggtgttgaacgtgtgccgccactgggtggaacaccacttctatgactttgagcgcgacgcatacttgcttcagcggatggaagagttcatcggcacagttcgcggcaaggccatgaaaaagtgggttgagtcgataactaaaattatccagcgaaagaaaattgcgagggataacggtcctggccataacataaccttccaatctagcccccccacggttgaatggcacatatcaaggcctgggcatatcgagacctttgacttgttgaccctgcatcctatcgaaattgctagacaactcactctgctggagagtgacctatatcgagctgttcaaccatctgaattagtaggaagcgtgtggaccaaggaggacaaggagattaactcacctaacctgctgaaaatgatccgtcataccaccaacttgacactctggtttgaaaaatgcatcgtggagacagaaaacctggaggaacgcgtggcagtggtctcccggattatcgagatactgcaggtgtttcaggaactcaacaatttcaatggggtattagaggtggtttctgctatgaacagttccccagtttaccggctggatcatacgttcgaacaaatccccagccgccaaaaaaagatactggaagaggcccacgagttatccgaggatcactacaagaagtatttggccaagcttcggagtatcaatccgccatgcgtgccattcttcggtatttatttaactaatatcctcaaaaccgaggaaggaaatcccgaggtcttaaagcggcacggcaaggagcttattaatttttcaaaacggagaaaggtagccgagatcaccggggaaattcaacagtatcagaatcagccttattgtctgcgcgtcgagtctgacattaaaagatttttcgaaaatctaaacccaatgggaaacagtatggaaaaggaattcactgactacctgtttaacaagagcctggaaattgagcctcgaaatcctaagcccctgccacggttccctaagaagtattcctatccactgaaaagccccggcgtgaggccctcaaatccacggcccgggacaatgcgacaccccaccccgttgcagcaagaaccccggaagataagttacagcaggatccccgaatcagaaacggagagtactgccagcgcacctaactccccccgaacccccctgaccccccccccggcaagcggcgcgtcgtcaacaacggacgtctgctcggtgtttgatagcgaccattcgtccccattccatagcaggtccgcttcggtatcctctatatccctgaccaaaggaacagacgaagtccccgtgcctccgcccgtccccccaagaaggcggcccgagtccgcgccggccgagtcctccccttccaagatcatgagcaagcacctagactccccaccagctatcccgcctagacaacctacaagtaaagcctactctccccggtactctatctccgaccgaacttctatcagcgatccccctgagtcaccacctttgctgccgcccagagagccagtccgcactcccgacgtgttctcctctagtccactccatttacaaccacccccgctggggaagaagtcagaccacggcaatgcgttttttcccaattcccccagtccctttacaccacctccacctcagacaccttcaccacacggtaccaggcgtcacctcccctccccgccactgacgcaggaagtcgatctgcattctatcgcaggtcccccagtgcctcctcgacaatcaacctctcaacacattccgaagcttcccccgaagacctacaaacgagagcatacccacccgagcatgcaccgagatggtcctcctttactggagaatgcgcacagtagctag

SEQ ID NO: 26468 - DNA, 2358 bp, Artificial Sequence
  Description of Artificial Sequence: Synthetic coding sequence
atgagcgaccaggaccacagcatggacgagatgaccgccgtggtgaagatcgagaaaggagttgggggcaacaacggagggaacggaaatggcggcggagcttttagccaggccagaagctcatcgactgggtcgagttctagtactggaggaggtggtcaggaatcccagccaagccctctcgccctgctcgccgccacatgttcacgaattgagtcacccaacgagaacagcaataattcccaagggccctcccaatctgggggcacaggtgagctagatctgaccgccacccagctctcccagggagctaatgggtggcagataatttcaagctcaagtggtgccactcctacctctaaggagcagagcggctccagcactaatggcagcaatggtagcgaatctagcaaaaacaggaccgttagtggaggacagtacgtggtggccgccgcccctaaccttcagaaccagcaggtgctgacaggactgccaggcgtgatgccaaatatacagtaccaagtcatcccgcagttccagaccgttgacggccagcagctccagtttgccgcaaccggagcacaagtgcagcaggacggctctggacagatccagatcattcccggtgctaaccagcagataatcactaatcgtggatcaggtggcaacatcattgctgccatgcctaaccttctgcaacaagcagtgcctctgcaggggcttgctaataatgtgctcagcggccagacacagtacgtaacaaatgtgccagtggccctgaacggaaatatcaccctgctgccagttaattccgtgtcggccgcaaccctaacaccttcttcccaggctgtgacgatcagcagcagtggcagccaggaatccggttcccagccagtgactagtggaactaccatcagctcagcatccttagtttctagccaggcttcaagcagctccttctttactaatgctaactcttattcaacaacaaccactactagcaatatgggcatcatgaattttacgacatccggctcatctgggactaactctcaggggcagacacctcagagggttagtggcctccagggcagcgatgctctgaatattcagcagaaccagaccagtggcggcagcctgcaagctggccagcagaaggaaggtgagcaaaatcagcagactcagcagcagcagattctaatacagccccagttagtacagggtggccaggccttgcaggcgttgcaggctgctccactgagtgggcagaccttcaccacgcaggctatttcccaagagacactccagaatttgcaactccaggccgtgccgaacagtggccctatcattattcgtaccccaaccgtcggccctaacggccaggtcagttggcagaccctccagcttcagaacttacaggttcagaatccacaagcccagacgattacactggctcctatgcagggcgtctcactgggacaaactagcagctctaacaccacactgaccccgattgcctctgccgccagcattccagccggtactgtaacagtgaacgcggcacaactctcctccatgcctggcctccagaccattaacttaagcgcccttggcacctccggaatccaagtccaccccatccagggactgcccctggccattgctaacgcgccaggcgatcatggagcccagcttgggctgcacggtgccggcggcgatggcatccacgacgacacagctggaggagaggagggggaaaacagtccagatgcccagccacaggctgggcgcaggactaggagagaagcttgcacatgcccgtattgcaaggactcagaaggtcgtggaagcggggacccgggcaagaaaaagcaacacatctgtcatatacagggctgcgggaaagtatacggaaaaacgagccatctcagagcacatttacggtggcacactggggaacggccttttatgtgtacctggtcttattgcggcaagagattcacccggagcgatgagttgcaaagacataagcgcacgcataccggcgaaaagaagtttgcatgccccgagtgccccaagaggttcatgcggagcgatcacctctccaagcatatcaagacccaccaaaataagaaaggcggacctggtgtggcgctgtcggtcggcacacttcccctggatagcggcgctgggtcagaaggaagtgggaccgccactccttccgctctgatcacaacgaacatggtcgccatggaagctatatgtcccgagggcatagcccgactggccaactccggcataaacgtcatgcaggtggccgacctgcaaagcattaacatatcagggaatggcttctag

SEQ ID NO: 26469 - DNA, 2337 bp, Artificial Sequence
  Description of Artificial Sequence: Synthetic coding sequence
atggacgagatgaccgccgtggtgaagatcgagaagggcgtgggcggcaataatgggggtaatggcaacggaggcggtgccttttcacaggcacgctccagttctactggaagttcaagcagtaccggtggcggcggccaggagtcccaaccttcacctctcgctctgctagccgccacctgctctagaatcgagtccccaaacgagaactcaaacaactctcagggcccgagtcagagtgggggaacaggagaactggatctcacggccactcagctgtctcaaggcgctaacgggtggcagattataagttcatcgagcggcgccacaccaacatcgaaggagcagagcgggtcttccactaatgggagcaacggttccgagtccagcaaaaaccggacagtgagcggcgggcagtatgtggtggcagccgctcctaacctgcagaaccagcaggtactcactgggctgcccggcgtgatgcccaacatccagtatcaggtgatccctcagttccagaccgtagacggccagcagctgcagttcgcggcaacaggtgctcaggtccagcaagatggctcaggacagatccagattattccgggagccaatcaacagatcattacaaacagaggctcaggagggaacatcattgccgccatgccaaatctactccaacaggccgtgccccttcagggtctcgctaataacgtgctttccggccagactcaatacgtgaccaatgtccctgtggccctgaatgggaacattaccctactccctgtcaatagcgtgtccgctgcaacacttacacccagcagtcaggccgtcacaatctctagctcgggatcccaggagtcaggatctcagcctgtgaccagtggcacaaccatctcatcagccagtttggtttcgtcccaagccagcagctcaagcttcttcactaatgccaatagctattcaaccacaacaaccacctctaacatgggcataatgaatttcacaacctccggtagcagcggtacaaactcccaaggacaaactcctcagcgcgtgtccggactccagggcagcgacgctctcaatattcaacagaatcagacttcaggcgggtcactccaagcaggccagcagaaggagggagagcagaatcagcaaacacagcagcagcagattctgatccagccgcagctagtccaaggcggccaggcgctccaggctctgcaagcagcgcctctatctgggcagacctttactacccaggctattagccaagaaaccctacaaaatctccagcttcaagctgtgcccaattctggacctattataatacggacacctactgtgggccccaatggacaggtgagctggcagacacttcaattacaaaatctgcaggtgcaaaacccccaagcacaaactatcactcttgctcctatgcagggcgtgtcactggggcaaacgagctcatcgaacacaaccttgacacctatcgcatctgccgctagcattccagctggtacggtcaccgtgaatgccgcgcagctgtcaagcatgcctgggctgcaaaccatcaacctgtccgcactgggtacatcaggaattcaggtgcatcccattcagggtctgcccctggccattgccaatgcccccggagaccatggcgcacagctgggactgcatggggctggtggagacgggattcacgacgacacagctggaggggaggaaggcgaaaattccccggacgcacagccccaagcaggacgacggaccagaagggaggcctgtacctgtccttactgtaaagactccgagggaagagggagcggcgatcccggcaagaagaaacagcacatctgtcatatccagggctgtgggaaagtgtatggcaaaactagccacctgcgggcacatctgcgctggcacaccggtgagaggccttttatgtgcacatggtcttactgcggtaagagatttacacgcagtgacgaattgcagcggcacaagagaacacacaccggcgagaagaagttcgcctgtcccgagtgccccaaaaggtttatgcggtccgatcacttatctaaacacattaagactcatcagaacaagaagggtggacctggagtcgcactgtcagtggggacactgcctttggatagcggggcaggcagtgagggctcaggaacggcgacccctagcgccctcatcacaacaaatatggtggccatggaggctatctgtcccgaaggaatcgcgagactggctaatagtggaattaatgtgatgcaggtggctgatctgcagtccatcaatatctccggtaatggcttctag

SEQ ID NO: 26470 - DNA, 1413 bp, Artificial Sequence
  Description of Artificial Sequence: Synthetic coding sequence
atgagcgcccaggtgctgggcttcctgcggagctggacccccctgccgctggctgctccgcgcggcccggcagccgccgggaacgacgctggggcgccagctgcaactgccccgggcggtgaaggcgagcctcatagcagaccgtgtgacgccaggctgggctcaactgacaaggaactcaaagctggtgccgccgccaccggctctgcccccaccgcgccagggaccccatggcagagggaaccacgcgttgaagtgatggatccagctggtggccccagaggagtgctgccacgcccgtgccgggttcttgttctgctcaacccacgcggaggaaaaggcaaagcactgcagctgttccggtcacacgtgcagcccttgctcgccgaggctgaaatctcattcaccctgatgcttactgagaggcgcaaccacgcccgagaactggtacgaagcgaagagttaggacggtgggatgcactggtggtaatgtcaggggatgggcttatgcatgaggttgtgaacggacttatggagcgccctgactgggaaacggctatccagaagcccctgtgtagcctgccagcaggatccggtaacgcccttgccgcttcgctgaaccactacgcaggctacgaacaggtgactaatgaggacctactcacgaattgtactttgctgctgtgccgccgactgttatcgcctatgaatctactgagccttcacaccgcatctgggttgcgcttattcagcgttctcagcctggcatggggattcatcgctgatgtggacctcgagagtgaaaaataccgccgacttggcgaaatgagattcaccctgggtacatttctccggctggcggcgctacgtacttatagaggcagactggcttaccttcccgtcgggagagtcggctcaaagacaccagccagcccggtcgtggtgcagcagggcccagtggacgcccacctagttcctctcgaggaacccgtccctagccactggaccgtggtgcccgatgaggacttcgttctggtcctcgcacttctccacagccacctagggagcgagatgtttgccgcgccaatgggacgttgtgctgccggagttatgcatctgttttatgtaagagcgggcgtttctagggcaatgctgctgcggctgtttctggccatggaaaaagggaggcatatggagtacgagtgtccctatctggtgtatgtgcctgtggtcgcattcagactggaacctaaggatggcaaaggcgtgtttgctgtggatggcgaactcatggtaagcgaggccgtccagggccaagttcatcccaactacttctggatggtgtccggctgcgttgaaccccctccgtcctggaaaccacagcagatgcctccacctgaggaaccactttag

SEQ ID NO: 26471 - DNA, 1155 bp, Artificial Sequence
  Description of Artificial Sequence: Synthetic coding sequence
atggaccccgccggcggcccccggggcgtgctgccccggccctgcagagtgttagtcttgttaaatccaagagggggtaagggcaaggctcttcagctgtttcgcagtcacgttcagccactcttggcggaagccgaaatatcatttactctgatgctcaccgaacgacggaatcacgctcgcgaacttgtccgtagcgaagaattggggagatgggatgctctggtagtgatgagtggggatggtcttatgcacgaggttgttaatgggctgatggaacgacccgactgggaaaccgctattcagaagccactctgttccctgcctgcaggctccggaaacgccctggccgcttccttaaatcactacgctggatatgagcaggtcacaaatgaggacctgctgaccaactgcaccctcctattatgccgcagactcctcagccctatgaacttactgagcttgcacaccgcctctggcctgcgcctattttctgtgcttagcctagcatggggcttcattgccgacgtggacctggagtcagaaaaatacaggcggcttggggagatgcggtttaccttaggtacattccttaggctggcagccctccggacctacaggggcaggctggcctatttgcctgtcggccgggtggggtcaaagaccccggccagcccagtggtggtgcagcagggcccggtggacgcccacctcgtgccgctcgaggaacccgtgccctctcattggacagtggtcccagatgaggactttgttctggtgctggctctgctgcacagtcaccttgggagcgagatgtttgctgcaccgatgggccgctgcgccgctggcgtgatgcatctcttctatgtgcgggcaggagttagccgagctatgctgctccggctctttcttgccatggagaagggacgacacatggagtatgagtgtccctacctggtgtatgtgccagtggtggcattccggcttgaacccaaggacgggaagggcgttttcgccgtggatggagagttaatggttagcgaagcggtgcagggtcaggtacatcctaattacttttggatggtatccggatgtgtcgaacctcccccatcttggaagcctcagcaaatgccaccacccgaagaacctctctag

SEQ ID NO: 26472 - DNA, 1152 bp, Artificial Sequence
  Description of Artificial Sequence: Synthetic coding sequence
gagcccaccggcggcccccggggcgtgctgccccggccctgccgggtcctggtacttctgaacccccgaggaggaaaaggaaaagctctgcagctcttccgctcccacgtgcagcccttactggctgaagctgagatttcattcacattgatgctcaccgagcgtagaaatcacgcccgcgaactggtgcgaagcgaggagttggggaggtgggatgctctggtcgtgatgagtggggacggcctcatgcacgaggtggtgaatggactgatggagagacctgattgggaaactgccattcagaaacctctctgtagcctgcccgccggttccggcaatgcactcgctgcctccctgaatcattacgcgggctacgaacaggttactaacgaggatctgttgacaaactgtaccctgctgctttgtcgccgcctcctgagcccaatgaacctgcttagcctacataccgcttctgggttacgcctgttctctgtactctcactggcttgggggttcatcgctgacgtggacctggaaagtgaaaaatatagacggctgggcgagatgcggttcactcttggcaccttcctccggctggccgccctcaggacttacagaggtcgcctagcctatctgcctgtgggtagagtaggaagcaagacaccagcaagcccagtggtcgtgcagcagggccccgttgacgcgcatttagtgccactggaggagcccgtgccgtctcattggactgtggttcctgacgaggatttcgtcctcgtcttggctctgttgcacagtcatctcggaagcgagatgtttgccgcccctatgggccgctgcgcagccggggtaatgcacttgttttacgtccgcgcaggggtcagccgggccatgttgctgcgattgtttctggcgatggagaaaggaaggcacatggaatacgaatgcccatatctggtctatgtgcctgtagtggcattccggttggagcctaaagatggaaaaggtgtgtttgccgttgacggtgagcttatggtctctgaagccgttcaggggcaagtacatcccaattatttttggatggtgtctggctgcgtggaaccgccgccatcctggaaaccgcagcaaatgcccccacctgaagagcctttatag

SEQ ID NO: 26473 - DNA, 1155 bp, Artificial Sequence
  Description of Artificial Sequence: Synthetic coding sequence
atggaccccgccggcggcccccggggcgtgctgccccggccctgccgcgtactggtcctgcttaatcccagaggagggaaaggcaaggccctgcagttgttccgaagtcatgtgcagcccctcctagctgaagcagaaatatccttcacccttatgctcacagagagaagaaatcacgctagagaattggtgagaagtgaggaactggggcgatgggacgccctggtggttatgtcaggcgacggtttaatgcatgaggtggtgaacgggcttatggaacggccagattgggagacagccatccagaagcccctctgttccttacccgccggtagcggaaacgccctggccgctagccttaaccactatgccggctacgagcaggttaccaacgaagaccttcttaccaactgtacccttctgctgtgcagacgcctgctttcaccaatgaatctgttatctctgcacaccgcaagcggacttaggctattttctgttctttccttagcgtggggcttcattgctgatgtggacttggagtctgaaaaataccgccgcctgggtgaaatgaggtttacgctcgggaccttccttcgcctggcagctctgaggacatatcgtggtcgattggcgtacctgcccgtgggtagagttgggtccaagacacccgcgtcaccggtggttgtccagcagggtccagtagatgcacaccttgttcctctggaggaacccgtccctagccattggactgttgttcccgatgaggatttcgtactggtgttggcactcctccattcccacctgggttccgagatgttcgccgcgcccatgggtaggtgtgccgctggcgtaatgcatttgttctacgtaagggctggcgtatcccgggcaatgttactgcgactctttctggccatggaaaaagggcgtcatatggaatacgagtgcccctatctggtgtacgtacccgttgtagctttcaggctcgagccgaaagacggcaaaggcgtgttcgcagtcgatggggagctcatggtgtctgaagccgttcaaggccaagtgcacccaaattatttttggatggtgtctgggtgcgtcgaaccccctccttcatggaaaccccaacagatgcctcctcccgaagaaccactgtag

SEQ ID NO: 26474 - DNA, 1197 bp, Artificial Sequence
  Description of Artificial Sequence: Synthetic coding sequence
atggaccccgtggtgggctgcggccggggcctgttcggcttcgtgttctctgccggagggccacgcggggtgcttccgcgcccttgccgcgtccttgtccttctgaatccccgcggaggaaaagggaaagccctccaattgttccgaagccacgtgcagccgttgctagccgaagcagagatttcattcaccctgatgttaaccgagcgccgaaaccacgcccgcgagctggtgcggtcagaggagctcggtcggtgggacgccctcgtagtcatgtccggcgatggtctgatgcacgaggtggtgaacggactcatggaaaggccagattgggaaaccgcaatccaaaagcccctctgttctttacccgcaggttcaggcaacgccctggcagcgtctctgaatcactatgctggatacgaacaagtcactaatgaagacctgctcactaattgtaccttgctgctctgtagaagactgcttagcccaatgaatcttctgagcctgcacaccgcttcaggcctgaggctgttttcggtactgtcacttgcttggggattcattgccgacgtcgacctcgagagcgagaagtatagacgccttggcgaaatgcggttcaccctggggaccttccttagactggcagccctcaggacatacagaggtaggctcgcttatctccccgtaggaagagtaggcagcaagaccccagcctctcccgtggtggtgcagcagggtccagtggacgcccatctggtacctctggaggagccagttcctagtcactggactgtggtcccagatgaagattttgtactcgtactggcactgctgcattcacatctgggtagtgagatgttcgcagccccaatgggcaggtgcgccgccggcgtcatgcatctgttctatgtcagggccggagttagcagggccatgctgctccggctgtttcttgcaatggagaagggacgtcatatggagtacgaatgcccctaccttgtatacgtccctgtcgtggctttccgtcttgagccaaaggatgggaagggagtatttgctgtagatggagagttgatggtgtccgaggccgttcagggccaggtgcaccccaactacttctggatggtgagtggttgtgttgaacccccgccctcatggaagccccagcaaatgccacctcctgaggaaccactgtag

SEQ ID NO: 26475 - DNA, 1155 bp, Artificial Sequence
  Description of Artificial Sequence: Synthetic coding sequence
atggaccccgccggcggcccccggggcgtgctgccccggccctgcagggttctggtattgctgaacccaagaggcgggaaaggcaaggcactgcaattatttcgctcgcacgtgcagccactgttggctgaggcagaaatttcttttactttgatgctgaccgaacgcaggaaccacgcgcgcgagctcgtacggtccgaggagctggggcggtgggatgcgctagtcgttatgagcggagacggactgatgcacgaagttgtcaacggattgatggaacgcccagattgggagactgccattcaaaagccgctctgttctctcccagctgggtcaggaaatgctcttgcagcatcactgaaccattacgcaggttacgaacaagtaaccaacgaagatctgctcaccaactgtaccctgctgctgtgcagaagacttttgtctcccatgaatctgttgtcgctgcacacggcatcaggactcagactgttcagcgtcctttctcttgcgtggggcttcatcgcagacgtggacctcgaatcagagaaatatcggcgactgggagagatgagattcaccctgggtacctttttgagacttgcagccctgcgcacttaccgcggtaggctggcttacctgcccgtgggacgagtagggtcaaagacaccagcatcccctgtggttgttcagcaaggcccggtggatgcccatctggtgccacttgaggaacccgtgccaagccactggaccgtggtacccgacgaagatttcgtcctcgttctcgccctcttgcacagccatctgggcagcgaaatgttcgccgcgcccatggggaggtgcgctgctggagtgatgcacctcttttacgttagggcaggagtgtcacgagccatgctattaagactctttctggccatggagaaaggcagacacatggaatatgaatgcccatacctggtatatgtacctgtcgtagcatttaggctggagccaaaagacggcaaaggagtgttcgccgttgacggcgagcttatggtctctgaggccgtgcagggccaggtgcatcctaactatttctggatggtgagcgggtgtgtggagccaccgccttcttggaagcctcagcaaatgccaccccccgaagaacccttatag

SEQ ID NO: 26476 - DNA, 1965 bp, Artificial Sequence
  Description of Artificial Sequence: Synthetic coding sequence
atgaacggccacctggaggccgaggagcagcaggaccagcggcccgaccaagaattaaccgggtcctggggccacggtcctagatctaccctggtgcgagctaaggctatggccccaccaccgcccccacttgccgctagtaccccccttctgcatggcgaattcggcagttaccccgcccggggcccgagatttgctctgaccttaacctcgcaagccttgcatatacagcggcttagaccgaaaccggaagctagacctcgggggggtctcgtcccactggcagaagtgtccgggtgctgtacactgaggagtcggtccccatcagattctgcggcatacttctgtatttatacctacccaagaggtaggaggggagcccgaagacgcgccacccgcacgtttagggctgatggggcagccacctacgaagagaaccgcgccgaagcacagagatgggccacagctctcacttgcttacttcggggactaccactgcccggggacggagaaattactcccgacctgctccctagacctcctcggctactcctgctcgttaaccctttcggagggcgtggactggcctggcagtggtgcaagaatcatgtgctgcccatgatctcagaggctggtctgtcctttaacctaatccaaactgagcggcaaaaccacgctcgggagctcgtacagggtctgagcttgtccgaatgggacgggattgttaccgtcagcggagacggtctccttcacgaggtgctcaacggactgctcgaccggcccgactgggaagaggccgtgaagatgccggtgggcattctgccatgcggtagtggtaacgccctggccggggcagttaatcaacacggtggatttgagcccgctctgggcctagacctgcttctcaattgctcattactgctgtgtcgcggcggcggccatcccttggacctgctgagcgtcacattggcgtctggtagcaggtgcttcagctttctttctgttgcctggggcttcgtgtcagatgtggacattcagtccgagcgattcagagccctgggatccgctaggttcaccttggggaccgtgctgggtctcgctactctgcacacctatcggggcaggctgtcctacctgcctgcaaccgtagaaccagcctcccctacacctgcgcattcactccccagagctaaatcagagttgactttgactcctgaccccgcccccccaatggcacattcaccacttcacagatctgttagtgatctgccccttcccctcccccagccagcacttgcttcaccagggagccccgaacctttacccatcctgagcctgaacggtggcggaccagaactagccggagactgggggggcgccggtgacgctcccctgagcccggaccccctgctgagctctcccccaggatcccctaaagcagctcttcattccccggtgagcgagggggcccccgtcatcccgccaagctctgggttaccgctgcctacgccggacgccagggtcggcgctagcacctgtggcccgccagatcatttgttgcctccactggggacacctttgccacccgactgggtgaccctggagggagactttgttctgatgctggcaatttcacctagccacctgggtgctgatctagtggccgccccgcacgctcggttcgacgacggtctggtgcacctctgctgggtgcgtagcgggatttcacgagccgcgctcctaaggctgttccttgccatggagcgcggaagtcactttagtctagggtgcccacaattaggttacgctgccgcacgcgctttccggctagagccgcttactccccgtggcgtgctgactgtggacggagaacaggtggagtacggccctttgcaggcccagatgcatcccggaatcggcacccttctcacagggcctcccggatgtcccggaagggagccctag

SEQ ID NO: 26477 - DNA, 1851 bp, Artificial Sequence
  Description of Artificial Sequence: Synthetic coding sequence
atggcccccccccccccccccctggccgccagcacccccctgctgcacggcgaattcggctcatacccagcccgggggccccggtttgctctgactcttacctcccaggctcttcatatccagaggctgagacctaaaccagaggcccgccctagggggggcctagtgcctcttgctgaagtgagcggctgctgcactctccgttcgcgctcccccagcgactccgccgcttacttctgtatttacacttaccctcggggccgtcggggagctagacgccgcgctacccgaacctttagagctgatggagccgccacctatgaagagaatagggcggaagcccagagatgggccacagccttgacgtgcttgctgagaggcctgcccttgcctggtgatggagagatcaccccggaccttctaccgcgaccaccccgcctgctgctgttagtgaatccatttggtgggcgcggcctggcatggcagtggtgcaaaaatcacgtcttgccaatgatatcagaagccggactgtccttcaacttaatccagacggaacgccagaatcacgccagagagcttgtccaggggctctcactgtccgagtgggatggtattgtgactgtgtctggcgatggactcctgcacgaggtgttgaacggcctgctggacaggccagactgggaggaagcagttaaaatgcctgtcggaattctgccgtgtgggtccgggaatgctcttgcgggcgcagttaaccagcacgggggccccagctggggtgatagagacccatatatctcccactcagcgaaaccaacagtttcccaggtgaaccaaccggcctgcggcatgctcaccccttcatcctggacatttctcccagcttgttttcctgcagttagtagagcacctagaactctgcccggcatgggtggcactcaggcactgggctcagccagatttaccctcgggacagttctcggattagctaccttgcatacttaccgggggcgtctttcttatttgcctgccaccgtggaacctgcctctcccactccggcccattctcttcccagagcaaagagtgaattgactctgacccccgatcctgcccctccaatggcccattctccattacaccgctcagtgtctgaccttccactacctctgccccagccggctttggccagcccaggatctccagagccgctgcctatcctgtctctgaatggcgggggacctgagctggccggagactgggggggtgccggcgacgcgcccttgagccctgatcctctgttgtcaagccccccaggctcacccaaagccgcattacattcaccagtgtcagaaggggcgccggtgattccaccaagtagtggcctgccgcttcctacccctgatgcccgggtgggtgcatctacatgcggccctcccgaccacctgctcccccctttggggacccccttgccgcccgattgggtgactttagaaggggacttcgtcctcatgctagctatctccccctcgcatcttggggctgacctggtggcagcgccgcacgcgcgatttgacgacggactggtccatctgtgttgggtgaggtccggaatttccagggctgctcttctacgcctttttctggctatggaacggggatcacacttctcgctggggtgtccccagctcgggtacgctgccgcacgggcctttaggctagaacccctgacgccgcgtggagtgctgaccgtggacggagaacaagtggagtatggccctttgcaagcgcagatgcatccggggatcggtacgctcttgacaggaccgccgggttgtcccgggcgggagccgtag

SEQ ID NO: 26478 - DNA, 1884 bp, Artificial Sequence
  Description of Artificial Sequence: Synthetic coding sequence
atgaacggccacctggaggccgaggagcagcaggaccagcggcccgaccaagagcttacaggttcctggggtcatgggccacgctctacgctggtgagagctaaagctatggcccctccccccccgcccctggccgccagcactcctctcctccacggcgagtttgggtcttaccctgcgagaggacccagattcgcactgactctgacatcacaggccctacatatacaacgcctccgccccaagcactcagcagcttacttctgcatctacacctatccccggggacgccgcggcgcccggaggcgcgcaacccgtactttccgggccgacggggccgctacatatgaggagaatagggccgaagcccaaaggtgggccactgccctgacttgcctgcttcggggcctgcccctcccaggggatggtgagattacacctgatctcctgcctcggccacccaggctcctgctactggtgaatccattcgggggacgggggctcgcctggcaatggtgtaaaaatcacgtcctgccgatgatctcagaagccgggttaagctttaacctcatccagaccgaacggcagaaccatgctagggagctggtgcaaggcctgagcctgtctgagtgggacggcattgtgactgtaagcggagacgggcttcttcacgaggtgctgaacggcctcctggaccggccagactgggaggaggcagtcaagatgccagtgggtatcctgccatgtggtagcggcaatgcactggccggggcggtgaaccagcacgggggatttgagccagcccttggactcgacctgctacttaactgctccttactgctgtgtagaggcggcgggcaccccctcgaccttctcagtgtaacattggcatcgggctcccggtgcttctcctttctgtctgttgcttggggtttcgtgtctgatgtggatatccagtctgaacgtttccgagcccttggatctgcccggttcacactcggaactgtgctgggccttgccacccttcatacttatcgtggtaggcttagctatcttcccgcaaccgtagaacccgcgtcccctacccctgctcactctctgccaagagccaaaagcgagcttacattaacaccggacccagccccgccgatggcacattcaccgttgcaccgatccgtttcagacctgccactcccactgccccagccagctctggcctccccaggttctcccgagccattgcctattctgtccttgaatggcggagggcccgagctcgcaggtgattggggaggagccggcgatgctcccctgagtcctgaccccctgctgagttcaccaccgggatcgcctaaggccgctctgcatagccccgtaagcgaaggggccccagttattccaccgtcatcggggctcccgcttcccaccccagatgctcgcgtgggggctagcacgtgtggcccacctgaccacttattgccacccctgggcacacccctgccacccgattgggtcacactggaaggcgattttgtgctcatgttggccatttctccatcgcacctgggtgccgatctggtcgccgccccccacgcccggttcgatgatggcttggttcatctgtgctgggtcaggagtggcatctctcgcgcagcactgctgagactgttcctcgcaatggagaggggctctcactttagcttaggatgtccccagctgggatacgcggccgctcgggcatttagactggagcctctgactcctaggggggttcttacggtggatggcgagcaagtggagtacggcccattacaggcacaaatgcaccccggcattggaacgttactgacaggacctcctggttgcccagggcgcgaaccgtag

SEQ ID NO: 26479 - DNA, 150 bp, Artificial Sequence
  Description of Artificial Sequence: Synthetic coding sequence
atgaacggccacctggaggccgaggagcagcaggaccagcggagccctctcacttgttacttagggcgacctggctgcttctattggtccattcctttaggggtcggagcatggcctggatcaggggtgcggacgacgtgttttccatag

SEQ ID NO: 26480 - DNA, 2286 bp, Artificial Sequence
  Description of Artificial Sequence: Synthetic coding sequence
atgatcggctgcctgcacgcccgggtgagcggccccctgtgggacgccggactgtgccctgcttctagcagaagcgcacacacctgcttgagcctcagtgttagcgacgcccctgtatctccagctaccgcgccccactgtctgctactgtcaaccgcaccagccccaccctgtccgtgtcacggggttcttaactcacatccctttagccctccgttcccgcagagaccggatcaggagttgacagggagttggggccatggccctaggtctacattagtacgggccaaagcgatggcccctccacccccacctctagctgcatctacgccgctgctccacggagagttcggaagttatcccgcccggggtccccggtttgccctgaccctcacatctcaagctctccatatccagcgactacggcccaagcccgaggctagacccagaggaggcctggttcctctcgccgaagtgtcggggtgctgcacactgcgatccagatcaccttctgatagcgctgcctacttttgtatatacacatatccccgtggccgccgcggcgcgcgccgtcgggcaactcggactttcagggcagatggtgcagctacctatgaggaaaacagagctgaggcccagcggtgggcaacagccctgacgtgcctcttgcgcggcctgcccctccctggggacggggaaatcacgcctgatcttctgcctcgccccccgagactgctcttgctggtcaacccctttgggggtcgcgggctcgcctggcagtggtgtaagaaccacgtgttgcccatgatttccgaggccgggctgagcttcaacctcattcagaccgaaagacagaatcacgctcgcgagctggtgcagggtctctcactctcagagtgggacggcattgtcaccgtaagcggcgacggcctgctacacgaagtgctgaatggcctgctcgaccgccctgactgggaggaggcggtgaaaatgcccgtggggatcctgccctgtggtagcggaaacgccctcgccggcgcggtgaatcagcatggaggattcgagccagcgctcggattggatctgttattgaactgcagtctgcttctttgtcggggtggtggtcaccctctggatctgttgtccgtgaccctcgccagtggaagtcggtgcttctcttttttgagcgtagcatggggcttcgtctctgacgtagatattcagagcgagagatttcgggcgctgggctcggccagatttaccctcggcactgtgctgggcttggctactctgcacacataccgtggaagactaagctatctgcctgctacagtggagcctgccagccctactcctgcacactccctgccacgggccaagagtgagttgactctgacacccgatcccgcccccccaatggctcactcccccctccatagatcggtgagcgacctgccattgcctctgcctcagcctgctctggccagcccaggcagtcctgagccgctgcctatcttaagtctcaacgggggtggaccagagctcgccggtgactggggcggggcgggtgacgcgcccctgagcccagaccccctgctctcctctccaccaggatccccaaaggcagcacttcattcccccgtatccgagggcgcgcctgtgattccaccttcttcaggattaccactacccactcccgacgcccgtgtgggcgcatctacatgcggaccccctgaccacctcttaccacccttgggcacccccctgccacctgactgggttaccttggagggagatttcgtgctgatgctcgcaatatcacctagccacctaggtgcagaccttgtggctgcccctcatgcccgtttcgatgatggcttggtacatttgtgttgggtgcgttccggcatttcacgcgcagccctcctgcgactgttcctcgcaatggaacgtggctcacacttttctcttggatgtccgcagctcggctacgcagcagcccgggccttccgcctggaaccccttacgcctaggggcgttctcacagtggacggggagcaggttgagtacggacccctgcaggcgcaaatgcatcctgggatcgccaggggacggacacaaaccccagctctacccgctgccccggcactgtatggaaggcaacccggcgctgcacatggacttcagcctgtctgtcagggtgctgcactcttctttcataatagctggctttggggatcccaggacctgtttcggattgtgctgaccgaggccgtcggaggctag

SEQ ID NO: 26481 - DNA, 1965 bp, Artificial Sequence
  Description of Artificial Sequence: Synthetic coding sequence
atgaacggccacctggaggccgaggagcagcaggaccagcggcccgaccaagaactaactggcagctggggccacggaccacggagtactctcgttcgtgccaaggctatggccccgccccctcccccactggctgccagcaccccacttctgcacggtgaatttggcagctatcctgcccgcggcccacgttttgcgctcaccctaacaagccaggctctccacattcaacgcctaaggcccaagcctgaggcaaggccaaggggcggcctggtcccactcgcagaagtgtcggggtgttgcactctgagatctcggtctccgagcgattccgctgcctacttctgcatctatacctatccaagaggcaggcgcggagcaaggcgaagggccaccaggacctttagggccgatggagccgctacttacgaggagaacagagctgaggcccagcgctgggctactgctctcacttgtctacttcgcggccttccactgcccggggacggggaaatcacgcccgacctgcttccccgaccacctagactcctgctcctcgtgaatccatttggcggcagaggcttagcctggcagtggtgcaagaaccacgtgctcccaatgatctcagaagccgggctgtcattcaaccttatccaaaccgagaggcagaatcacgcaagagaactggtccaaggactgtcactgtccgagtgggacggaattgtgaccgtaagtggtgacggactgcttcatgaggtcctgaacggacttctggacagacccgattgggaagaagccgtgaagatgcccgtcggcatcctgccatgtggctccggcaatgccctcgcaggcgccgtgaaccagcacggtggatttgagcctgctctcggcctcgacctgcttctaaattgctctttgctgctctgtagagggggtggtcaccccctcgacctgctgtccgtgaccctagcctcaggatcccgctgctttagcttcctttcagtagcctggggtttcgtatccgacgtcgacatccagagtgaaagatttcgcgctctcgggagcgcccggttcacactggggactgtgctgggcctggccaccttgcacacctaccgcggtcggctgtcctacctgcctgccacggttgaaccagcatcaccaactccagcccattccctccctagggcaaagtctgagctcacactgactcctgaccctgcaccaccaatggcccatagtcccctacacagaagcgtctcagatctccccctgccattaccacaaccagcactggcaagtcctggtagtccagaacctttacctatcctctcactgaatgggggaggtcccgaattggcgggagactggggaggcgctggtgacgccccccttagccccgatcctctgctcagctcgcctcctggatctcctaaggccgctctgcatagcccagtttccgaaggtgcccccgtgatcccaccatcaagcggcctgccattgcctacccccgatgcccgtgtgggcgccagtacatgcggtccccccgatcacctcctcccccccctcggtaccccgctcccacccgactgggtgacactagagggagacttcgtcctcatgctagcaatttcaccctcgcatttaggggccgatctggtggctgccccgcacgcccgatttgacgatggcctggtgcacttgtgctgggtcagatccggtattagtcgggcagctcttctgcgccttttcctcgcaatggagagaggctcccacttttctctcggctgcccccagctcggatatgctgccgctagggccttcagactggagccgctgacgccgagaggtgtccttacagtggacggtgaacaggttgagtacggcccactgcaagcccaaatgcatccagggattggaactttactcacaggccctccggggtgtcctggacgcgagccctag

SEQ ID NO: 26482 - DNA, 1857 bp, Artificial Sequence
  Description of Artificial Sequence: Synthetic coding sequence
atggcccccccccccccccccctggccgccagcacccccctgctgcatggagaattcggatcatacccggctagggggcctaggttcgcactgacgctgacctcacaagccctccacatacaaaggcttcggccgaagcccgaggcccgtccccgcggaggcctcgtccctctcgccgaagtttcagggtgttgcacacttcgcagcaggtcacctagcgacagtgccgcgtatttctgcatttatacatacccgcggggacgacggggggccaggcggcgagcaacccgtacctttcgagctgatggagctgctacttatgaagagaatagagcagaggcccagcgatgggccacagctttgacatgcctcctccggggactaccactgccgggggatggtgagattaccccagacctgctgcctcgtcctccgagactgcttctattagtgaacccctttggtgggcgaggtctggcctggcaatggtgcaagaaccatgttctgccaatgattagtgaagcaggactgtccttcaacctgatccagaccgaacgacagaatcatgcgcgggaactggtccagggtctttccctgtccgagtgggacggcattgtgactgttagcggcgatggactgctccacgaggtcctcaatggcttactagataggcccgactgggaagaagccgtgaagatgcccgttggaatcttaccgtgtggcagtggcaatgccctagcaggggcggtcaaccagcatggaggatttgagccggccctcgggctggacttgctgctcaattgctctcttcttctttgccgtgggggcggacaccctctagatctgctttccgtcacactcgcctccggttctcggtgtttctcttttctaagtgtagcgtggggattcgtgagtgatgtggatattcaatcagagcgatttcgagcacttggaagcgctcggttcaccttgggaaccgttctcggcctggcaacactgcacacttacagaggccgcttgagttacctgcccgccactgtggagcccgcgtcacctactcccgcccattccctccctcgcgccaagagcgagttgactctcacgccagatccggcacctccgatggcacactctccgctccatcggtcggtctcagatctgcccctgcccttaccacagccagccctggctagcccagggagccctgagccactcccaattctctccttgaacggcggcggtcctgagttggctggggattggggcggtgccggcgatgctcccttgagtccggaccccttactgtctagtccaccaggaagtcctaaggccgccctccatagccccgttagtgaaggcgcgcctgtcatccctccttccagcggcctccccttaccaacgccagacgctagggtgggtgcttctacttgtggtcctccagatcatctccttccgcccctgggtacccctttgccccccgattgggtcacactggagggagacttcgtgctcatgcttgccataagccctagtcatctgggcgcggatctggtcgccgctcctcatgcccgatttgatgatggtcttgtgcacctttgttgggttaggagcggtattagcagggcagctttgctgcggctgtttttggcaatggagcgggggtcacatttctctcttggatgtccccaactggggtatgcagcggcgcgcgctttccgcctggagccgctcaccccgaggggcgtgctgactgtagacggagaacaggttgaatacggaccactgcaggcccagatgcatcctggcataggaaccttactgaccgggcctcccggctgccccggaagagagccctag

SEQ ID NO: 26483 - DNA, 1149 bp, Artificial Sequence
  Description of Artificial Sequence: Synthetic coding sequence
atgggccccaccagcgtgcccctggtgaaggcccaccggagcagcgttagcgactacgtcaattacgatatcatagtccggcactacaactacactggcaagctgaacatatctgcggacaaggagaattcaatcaaactcacctctgtggtttttatcctgatctgttgcttcattatactggagaatatctttgtgcttcttacaatttggaagaccaagaagtttcacaggcccatgtactactttatcgggaacctggctctgtcggacctcttggccggggtcgcgtatactgcgaatcttctactaagtggtgctaccacatataagcttacacccgctcagtggtttctgagggaaggctcaatgtttgttgcgctttccgccagcgtgttttctctgcttgccattgcgatcgagagatacatcaccatgctgaagatgaaactgcataacggttccaacaacttcaggttatttctgttgatctccgcctgttgggtgatcagcctcatcctaggcgggctgccaattatgggttggaactgtattagtgcactgtccagttgtagcacagtgttgcctctgtatcacaaacactacattctattctgcaccacagtattcacgctactgctgctgtccattgtgattctgtactgccggatctattctctcgtgcggactcggtctaggcggctgacctttcgcaaaaatatatctaaggcctctagaagcagcgaaaagtcactcgcacttctgaaaaccgtcatcatcgtgctgtcagtgtttatcgcatgctgggcccctctttttattctgctacttctggacgtgggatgcaaagttaagacgtgcgatatcctctttagagccgagtacttcctggtgcttgctgtactcaactctggaactaaccccatcatttacactcttaccaacaaagaaatgcggagagcttttataaggatcatgtcatgctgtaaatgcccctccggcgactccgccggtaagttcaagaggccaataattgccggaatggaattcagcagaagcaaaagcgacaattcctctcaccctcagaaggatgagggtgacaacccggaaactattatgagctctggaaacgtgaattctagctcttag

SEQ ID NO: 26484 - DNA, 1353 bp, Artificial Sequence
  Description of Artificial Sequence: Synthetic coding sequence
atgggccccaccagcgtgcccctggtgaaggcccaccggagcagcgtttctgactatgttaactacgacattatcgttcggcactataactataccggcaagctgaacatttccgccgacaaggaaaactctatcaagctgactagcgttgtcttcattctgatctgctgttttattatcctagaaaatatcttcgtgcttttaaccatttggaagaccaaaaagttccaccggccaatgtactattttattggtaatctcgccttatccgacctgctcgccggggtggcctacaccgccaacctgctgttgtctggcgccacgacctataagctcacgcctgctcagtggttcctcagagagggttccatgtttgtggccctgagcgccagcgtgttctctctgctagcgatagctatcgaaagatacatcaccatgttgaagatgaagctccacaacgggagtaataattttaggctgttcctcctgatctccgcctgttgggtcatcagcttaatcttaggtggccttcccattatgggctggaattgcatctcagctctctccagctgttcaacggtgttgccactttatcacaagcactatatccttttttgcaccactgtctttacgctgctgctcctgtccatcgtcattctgtattgtcgcatctactctctagttcggacgagaagcaggagactcacgttccggaagaacattagcaaggcgagcagaagctcagagaaaagcctcgccttacttaagaccgtgatcatcgtgcttagtgtgttcatcgcttgttgggctccactgttcatcctcctgctgttagatgtcgggtgcaaagtcaagacctgcgatattttatttcgcgccgaatactttctagtgttggctgtcctgaattcagggactaaccccatcatttataccctgactaataaagagaccctactggccaactcttccgacccctcctcccccgcctggaactcggccgctgccaaccggacgatccccccaaccccccggaagaccaaaggtacgacccaaaggcccttgtgcttactggagacgagcaccctgctgccacgtactggcagttgtccacccacaggctcagccctctatctagtggctggccaccctagcgtgtggaagaagatatctgggcttaggctccttcctggacgcagttgctgcaaacccgagggcggcagaggcaggatccggaccgcctggtggtgtcgtgtgctcgtggggagagtgtcatcttgtgaacagtgcacaggtaaaggtggagatcaagtcccagcttggaacatattcagcacacccttggagctatag

SEQ ID NO: 26485 - DNA, 726 bp, Artificial Sequence
  Description of Artificial Sequence: Synthetic coding sequence
atggccaccctgaaggaccagctgatctacaacctgctgaaggaggagcagactcctcaaaataaaataactgtcgtgggtgtgggggctgtcggaatggcctgtgcgattagcattcttatgaaagacttagcagatgagctggccctggtagatgtcatcgaagataaactcaagggggagatgatggacctgcaacacgggtctttgttcctgaggacaccgaagatagtatcaggcaaggactataacgtgaccgctaacagcaagctcgtgattattaccgcaggcgctcgtcaacaagaaggggagtcgcgccttaacttagtgcagagaaacgttaatatctttaagtttatcatccccaacgtagtgaagtacagccccaactgtaagctgttaatcgtaagcaacccagtagacatcctgacatatgtcgcatggaagatctctgggttcccgaagaacagagtaatcggaagtggatgtaaccttgattcagctcgatttaggtacctgatgggcgaacggctgggcgtacaccccctgtcttgccacgggtgggtgctaggcgaacacggtgatagctcagtcccagtgtggtccggcatgaacgtggctggggtaagccttaaaaccttgcaccccgatctcggaacagacaaagataaagaacagtggaaggaggttcacaaacaggtggtggaacgcgtctttacagaatag

SEQ ID NO: 26486 - DNA, 813 bp, Artificial Sequence
  Description of Artificial Sequence: Synthetic coding sequence
atgctgcaggcctgcaagatggagggcttccccctggtgccccccccttcagaggatctggtgccgtatgatactgatttgtatcaacgtcagacccatgaatattacccatatctatcgagtgatggggaaagtcattcagaccattactgggacttccaccctcaccatgttcattccgaattcgagagtttcgccgagaacaattttacagagctccagagtgtacaacccccccagctgcaacaactttaccggcacatggagctagagcaaatgcatgttttagatacgccgatggtccctccacatccatctcttggccaccaggttagctacctgccccgcatgtgtctacaatatcccagcctttcacctgcccaaccctcatccgacgaagaggagggggagcgacagtcaccccccctggaagtctccgatggagaggcagatggcctggagcccggccctggtctgttgcccggggagaccggtagcaagaaaaagattagactatatcagtttttgctggatctgctgcggagcggtgacatgaaggattccatctggtgggtagataaagataaaggaacatttcagttttcgtccaaacacaaagaggccctggcgcataggtggggcatccagaaagggaatagaaaaaagatgacttaccaaaaaatggctagagcgctccgtaactacgggaaaaccggcgaggttaagaaggtcaaaaaaaagttgacatatcagtttagtggagaagtactcggacgcggcggtctcgctgaaagaaggcaccccccccattag

SEQ ID NO: 26487 - DNA, 2403 bp, Artificial Sequence
  Description of Artificial Sequence: Synthetic coding sequence
atgggcagcagcaagaagcaccggggcgagaaggaggccgccggcacaacagccgctgcgggcacaggaggcgctaccgaacagcccccaagacatagggaacacaaaaagcacaagcacaggtctggagggtcggggggctccgggggagagcgcaggaaaagaagccgtgagaggggaggcgagcgcggaagtgggagaagaggagctgaagccgaggcccggagttctacccatggacgtgagcgaagtcaagctgagccctccgaacgtcgggtcaagcgagagaaacgggatgacgggtatgaggctgctgcgagttccaaaacgagctctggcgacgcctcctctctctcaattgaagaaacaaacaagttgcgcgctaagctggggctgaagcctctggaagtgaacgcaatcaaaaaggaggctgggactaaggaggaaccagtgaccgccgacgtcataaatccgatggcattgcgacagcgtgaagagttacgggagaagctggcagccgccaaggagaagaggcttctgaaccaaaaattggggaagatcaagaccctgggggaggacgacccctggcttgacgacaccgctgcatggatcgaaagatctaggcagctacagaaggagaaggatttggctgagaaaagagcgaaactgttagaggagatggatcaagagtttggggtgtcgactcttgttgaggaagagtttggtcagcgtcgccaggatctgtactccgctagggatctgcagggcctgaccgtcgagcacgccattgactcttttcgcgaaggtgagaccatgatacttacgttaaaggataagggagtactccaggaagaagaagatgtcctcgtaaatgtgaacctcgtagataaggagcgggctgagaaaaacgtcgaactgagaaagaaaaaacctgactacttaccatacgccgaggacgagtccgttgacgatcttgcccaacagaagcctcggtctatcctatcgaaatacgacgaggaactggaaggcgagagaccccacagctttagactcgaacaagggggtacagccgacggtctacgggagagggagctggaagagatacgcgccaagttacgcttacaggcccagtcactgtccactgtcggaccccgcctagcctccgaatatttaacacctgaggaaatggtgacgtttaaaaagactaaacgcagagttaaaaagataagaaaaaaagaaaaggaggttgtggtgagggccgacgacctgcttccgctcggagatcagacgcaggacggcgatttcggcagccgactcaggggcaggggacggcgccgggtgagtgaggtggaagaggagaaggagccagtgccccagcctttgcccagcgatgacacaagagtagaaaacatggatatctccgatgaagaagagggaggtgcgcccccacccggtagcccccaggttctcgaagaggatgaggcagagttagagctccagaaacagctggaaaaaggccgccgcctcaggcaactccaacagctgcagcagctcagggactctggagagaaagtggttgaaattgtaaaaaagctggaatctagacaacgcggctgggaggaagatgaggatccagagcgtaagggtgcgatcgtgtttaatgccacctccgagttctgcaggaccctgggcgagatccccacctacggtctggccgggaacagggaagagcaggaggagcttatggatttcgagcgtgacgaagagcggagcgctaacggtggctctgaatcggacggagaagaaaacatcggatggtcaactgtgaacctcgacgaggagaaacagcagcaagacttttcagcatcttctacaacaatcctggacgaagagccgatcgtcaatcggggccttgccgcagctctcctgctatgtcaaaacaaaggacttctggaaactactgtccaaaaggtcgcccgcgtcaaggcacctaataaatcactcccctccgccgtgtactgcatcgaagataagatggccatcgacgacaagtatagccgacgggaggaatatagaggattcacacaggactttaaagaaaaggatggatataagcctgatgtgaaaattgagtacgtcgacgagactggtcgtaaactaacccctaaggaggcctttagacagctgagccatcggttccacggtaagggtagtggcaaaatgaagacagagcggcggatgaaaaaactggatgaggaggccctcctcaagaaaatgtctagctcggatacaccactgggtaccgtagctttgctgcaggagaagcagaaggcgcagaagacaccttacatcgtactatccggctctgggaagagcatgaacgcgaacaccataacaaaatag

SEQ ID NO: 26488 - DNA, 1929 bp, Artificial Sequence
  Description of Artificial Sequence: Synthetic coding sequence
atggccctgcggcagcgggaggagctgcgggagaagctggccgccgctaaggagaaaagactcctgaatcaaaagctgggcaagattaagaccctgggagaagatgatccctggctcgatgacaccgccgcatggatcgagagaagtcgccaactgcagaaggagaaggatctggcggaaaaacgagccaagctgctagaagagatggatcaagagttcggagtatccaccctagtggaagaggaatttgggcagcgccggcaagacctgtactccgcacgggatctgcagggattaactgttgagcacgccatcgatagcttcagggaaggcgagactatgatccttacacttaaggacaaaggagtcctccaggaggaggaggatgtgctagtgaatgtcaacctggtagacaaggagcgcgccgaaaagaacgtggagttacggaagaagaagccggactatcttccttatgcagaagacgaatctgtcgacgaccttgcgcaacagaaaccgcgatctatcctgtccaagtatgacgaagaattagagggcgaacgtccacactcgttccggctggagcaaggcgggacagccgatggtctgagagagcgggagctggaggagattagagctaaattgcggctccaagcacaaagtttgtccaccgtaggccctagactggcctcagagtacttaacgcccgaagagatggtgaccttcaaaaaaactaagaggagagtgaaaaaaattcgaaagaaggagaaggaagtcgtggtcagagccgatgacctcctgccgttgggggaccagacccaagacggtgacttcgggtctcggttgaggggcagaggacgtaggcgtgtttctgaggttgaagaagaaaaggaaccagtcccacaacccctgccctccgacgataccagagtggaaaacatggatatcagcgacgaggaggaaggaggcgcccccccccccggatccccccaggtgctggaggaagacgaagctgaattagagctgcaaaaacagttagagaagggcaggaggctgcgccagctacagcagcttcagcagctgagagatagcggggaaaaagtggtcgaaatcgtgaagaagctcgaaagccgccagagaggatgggaggaggatgaggacccagagcgtaagggcgccatagtgttcaacgccacaagcgaattctgtagaacgttaggggagatcccgacgtatggactggccgggaatagagaggagcaggaggagctcatggactttgagagggatgaggagcggtccgctaacgggggctctgagagcgatggcgaagagaacatcgggtggagtaccgtgaatctggatgaagaaaaacagcagcaggacttctctgcttctagcaccactattctggacgaggaacctatcgtgaaccggggacttgctgccgcactgcttctctgccagaataaaggattactggagactaccgtgcagaaagtggcgcgggttaaagctccgaacaagtccctgccttccgccgtatactgcatcgaagataagatggcaatcgacgacaaatacagcaggcgcgaagagtatagaggatttacccaggacttcaaagagaaagacgggtacaagcccgacgtcaaaatcgagtacgtagatgaaaccggcaggaaattaacccctaaagaagcatttcgtcagctctctcaccggtttcatggaaagggttctgggaaaatgaaaactgagcggcgaatgaagaaattggacgaggaagcccttttgaagaaaatgagcagctccgatacaccgctgggaacagtggcactcctgcaggagaaacagaaggctcaaaaaacgccctatatcgtgctgagcggttcggggaaatctatgaatgctaataccattacaaagtag

SEQ ID NO: 26489 - DNA, 4392 bp, Artificial Sequence
  Description of Artificial Sequence: Synthetic coding sequence
atgaagaagaagaccgtgtgcaccctgaacatgggcgacaagaagtatgaagacatggagggtgaagagaatggggacaacaccatctccactggcctactctactcagaggctgataggtgtcccatctgtttgaactgtctgcttgagaaggaagtgggtttccccgaatcttgcaaccacgttttctgcatgacctgcattctgaagtgggcggaaaccttggcttcatgccctattgacaggaaaccgttccaggccgtttttaagttctcagccctggaggggtatgtcaaggtgcaggtgaaaaaacagctgagggaaaccaaagataagaaaaacgagaactcattcgagaagcaggtgtcttgccacgaaaactcgaagagctgcatcaggcgtaaggccattgtgagagaagacctgctgtcagcaaaggtgtgtgacctaaaatggatccaccgcaatagtctatatagcgaaacaggcggcaaaaaaaacgccgcaatcaagattaataagccacagaggagtaactggagtaccaaccaatgctttcgcaattttttcagcaatatgttcagtagcgtctcccattcgggggagagttcgttcacctatcgcgcttactgtaccgagtttatcgaagcctctgaaatctctgctttgatcagacaaaagagacacgagcttgaactgagctggttccctgacaccttgccgggtattggacgcatcggctttataccttggaacgtcgaaacagaggtcttgcccttgatttcctcggtcttaccccgaactatctttccgacctccacgatcagttttgagcactttgggacaagctgtaaaggttacgccctggcccatacccaggagggcgaggaaaagaaacagacttcaggcacaagtaacactcgcgggtctcgtagaaagcccgctatgacaactcctacacgaaggtctacgagaaataccagggcagaaaccgctagccagtctcagcggtcccctatttcggacaactccggttgcgacgcgccaggcaattctaatcctagcctgagcgtgccctccagcgccgagtctgagaagcagacacggcaggctcccaagaggaagagcgtgcgacgagggcggaagccccctctgttgaaaaagaaactaaggtccagcgtggccgccccagaaaaaagctcctcaaatgattccgtagacgaggagactgctgagtcggacacgtcgcccgtcctcgagaaggagcatcagccagacgtggacagtagtaatatttgcacagtacaaacccatgttgagaaccagagcgctaattgcctgaagtcttgcaacgaacaaatagaggagtccgagaaacacactgcaaactacgacaccgaagagcgcgtaggcagcagctcctcagagagttgcgcacaggatttacccgtgctggtgggcgaagaaggagaagttaagaagctggagaacactggaatcgaagctaacgtcctttgcctggagagcgaaatcagcgagaatatactggagaagggaggcgatccactggagaaacaggatcaaatcagcggactgagccagtctgaagtgaaaactgatgtgtgcacagttcaccttcctaatgattttcccacttgtctgaccagtgaatcaaaagtgtaccagccagtgtcctgtccgttaagcgacctctccgaaaacgtcgagtcagtggtgaacgaagaaaagatcacggaatctagtttagtggaaattaccgaacacaaggacttcactctgaaaacagaagagcttatcgagtcccctaagctggaaagtagcgagggagagatcatccaaaccgtcgacagacagtcagtaaagtccccagaggtacagctactgggtcatgtagaaactgaggacgttgagattattgcgacatgcgacactttcggcaatgaggactttaacaatatacaagattccgagaataacctccttaaaaataatcttttgaatacaaaactggagaagtctttggaggagaagaatgagagccttaccgagcaccctagaagtactgagttaccgaagacccatattgaacagatccagaaacatttctcggaagacaataacgagatgatcccgatggagtgtgatagcttttgctcagatcagaacgaatctgaggtcgaaccctcagtgaatgctgacctcaaacagatgaacgaaaatagcgtgacccactgtagtgaaaataatatgccctccagcgacctggccgacgagaaagtggagaccgtctcccagccttctgagagtcccaaagacaccatcgataagacaaaaaagccccgcaccagaaggagtcggttccatagccctagtacgacctggtcacccaacaaagacacaccacaagagaagaaaaggccacagtcacccagccctcgccgcgagactggcaaagaatcaaggaagagccagagtccatccccaaagaacgaatctgctagaggcaggaaaaagtccagatcgcagtcccccaaaaaggacatagccagagaacggcgccagtcccagagtcggagccccaagagggacactaccagggaaagcagaagatctgaaagccttagcccccggagagagacttcacgggagaataagaggtctcaaccaagagtgaaggatagctctcctggagagaagtctagaagccaaagcagagaaagagagtcagaccgggatggacagagacgtgagcgcgagcggcggacaaggaaatggagtcgaagtcgaagccactcccgcagtccatcaaggtgtagaactaagagcaaatcgagttcattcgggagaatagatcgcgattcctattccccaaggtggaaggggagatgggctaatgacggctggcggtgcccgaggggcaacgataggtaccggaagaatgaccccgaaaaacaaaacgaaaacacacggaaggagaaaaacgatatacatctggacgctgatgaccccaattcagcggataagcaccggaacgactgtcctaactggatcacagaaaaaatcaactcaggccctgatccaagaaccagaaaccccgagaagttgaaggaatcacactgggaagaaaacagaaatgaaaattctggaaattcttggaataagaactttgggagcggatgggtgtccaatcggggacgagggcgaggaaatagggggcgtggaacgtatcggagcagctttgcttacaaggatcaaaatgagaatcgctggcagaatcgcaagcccctttctgggaactccaattcgagtggttctgagagcttcaaattcgtagaacagcagagttataagcgtaagagcgagcaggaattttcttttgatactccggccgaccgcagcggctggacctcagcgtcatcatgggcagttagaaagacccttcctgccgacgtccagaactattattcccggcgggggcgcaacagctctggcccacagagcggatggatgaaacaggaagaagagacctcagggcaggattcatccctgaaagaccaaactaaccaacaggtagatggatcacagctgcctattaatatgatgcagcctcagatgaacgtgatgcaacagcagatgaacgcccagcaccagcctatgaacatctttccatatccagtaggcgtgcacgctccactgatgaatattcagagaaatcccttcaatatacatccccagctgccgctccatctgcatacgggagtgcccctcatgcaggtcgctacccctacgtcggtgtcccagggcctccctcccccacctccacctcctcccccatcccagcaggtgaattacatcgcctcacagcctgacggaaaacagctgcaaggtatccccagctcaagccacgtgagtaataacatgtctactccggtgctgccagccccaacagccgcccctggaaatacaggtatggttcaagggcctagcagcgggaatacatcaagcagctctcatagtaaagcaagtaatgccgccgtgaagctggcagagagcaaagtgtcggtagctgtggaagcctcagctgactcatctaaaactgacaagaagttacaaatccaagaaaaggccgcacaggaggtgaaacttgcaataaaaccgttttaccagaacaaagatattacaaaggaagagtataaggaaattgtccggaaagcagtggacaaagtatgtcacagtaagtcgggagaggtcaactccaccaaggtcgccaatctggtgaaagcttacgtggacaagtacaagtattcccggaagggtagccagaagaagactcttgaagaacctgtatccaccgaaaaaaatataggatag

SEQ ID NO: 26490 - DNA, 4392 bp, Artificial Sequence
  Description of Artificial Sequence: Synthetic coding sequence
atgaagaagaagaccgtgtgcaccctgaacatgggcgacaagaagtacgaagatatggaaggtgaagaaaatggggacaataccatttctacgggactgctatacagtgaagccgaccgttgccccatttgtttaaactgcctgctcgaaaaggaggtcggctttccagagtcttgtaaccatgtgttttgcatgacttgcatcctgaaatgggctgaaactctggcatcctgtccaatcgatcgtaaaccttttcaggcagtattcaaattctccgctcttgaaggatacgttaaggtacaggttaagaagcaactgcgcgaaaccaaagataaaaagaatgagaactctttcgagaagcaagtgtcctgccacgagaattccaaatcttgcattcgccgcaaggccatcgtgcgcgaggatcttttaagtgctaaagtgtgtgacctgaagtggattcaccgaaactcactgtactcagaaaccggaggcaagaaaaacgcagctatcaaaattaataagcctcagagatctaactggtccaccaaccagtgttttcgcaattttttttctaatatgttctcctctgtgtcgcactcaggcgaatccagcttcacctaccgggcttattgtactgagttcatcgaggcatcagaaatctcggccttgattaggcagaagcgccacgagctcgagctcagttggttccccgacaccttgccagggattggaagaatcggatttatcccatggaacgtggaaacagaggtgttgcccctgatttcctcggtgctcccccggactatatttccgacttctactattagctttgagcactttgggacaagttgtaaaggttacgcactggctcacacccaggagggggaagaaaagaagcagacatcgggtactagcaatacaaggggtagccggcgtaaaccggccatgacgacacctactcgcaggtccactcggaacacccgcgcggagacggcatcccaatcacaacggtcacccatttccgacaatagtgggtgcgacgctccagggaattcgaatccatcactcagcgtaccgagctcggcagagagcgaaaaacaaacgcgacaagctcccaagaggaagtcagtcaggcggggcagaaagcccccactcctcaaaaaaaaattgcgatcatctgttgcggctcctgaaaagtcaagctcaaatgacagcgtagatgaagagacagcggaatccgatacctccccggtcctcgaaaaggaacaccagccggacgtggactccagcaacatctgcacagtccagactcatgtcgagaaccaaagtgccaactgcctcaagtcatgcaatgagcagatagaagagagcgaaaaacacacggccaattatgataccgaggagcgagtgggttctagttcttctgaaagttgcgcccaggacctacctgtactggtcggggaagagggcgaagtaaaaaagttagaaaacactggcatagaagctaatgtgctgtgtctggagtccgagattagtgaaaacatactggagaagggaggagacccccttgaaaagcaggaccaaatctccggcctgagccaatcagaggtgaaaactgacgtgtgtactgtccatctaccaaatgactttcccacctgccttacgagtgagagtaaagtatatcagcctgtgtcctgcccactgtcagacctgtcagagaacgtggaaagcgttgtaaatgaagagaagatcacagaatctagcctggttgaaatcactgaacacaaagattttacgctgaagacagaagaactgatagaatctcctaaactagaatcctccgagggcgagataatccagacagtcgatcgccagtcagtgaagtctccggaagtccaactgttgggtcacgttgagactgaggacgtcgaaattatcgccacgtgcgatactttcgggaacgaagactttaacaacatccaagacagtgagaataacctcctcaagaacaatctcctgaataccaaattggaaaagtcactcgaggagaagaatgaaagcctgaccgagcacccccgtagcaccgagctaccgaagacgcacatcgaacagatccaaaagcatttctccgaggacaataacgagatgatacccatggaatgtgatagcttctgtagcgatcagaacgagagcgaggtcgaaccctctgtgaacgctgaccttaagcagatgaatgaaaattctgtcacgcattgtagcgaaaacaatatgccatcctccgatctcgcagatgaaaaagtggagaccgtgtcccagccctcagaaagccccaaagatactattgacaaaacaaaaaaaccccgtaccagacgatcgagatttcacagcccatcgacaacatggtctccaaacaaagacactccccaggaaaagaagagacctcaatcacccagtccacggagagagacagggaaggaaagccgcaagtctcagagcccctcccctaagaacgaaagcgcccggggacggaagaagagcagaagtcagtcacccaagaaggatatagcaagggagcgccgccagagccagtctcggagccccaaaagagatactacgagggaatcgagaaggtccgaaagcctgagtccacggagagagacatctcgcgagaacaagaggagtcagccccgagtgaaggacagttctccgggcgagaagtctcgctcccagtccagagagcgcgaaagcgatagggatggacaaaggcgtgaacgcgagcggcggaccagaaagtggtctcgctccagatctcattcaaggtcaccttcccgatgcaggaccaagtcaaaatcaagctctttcggtagaatcgaccgcgatagctattcaccccgctggaagggtaggtgggccaatgatgggtggcgatgccccaggggtaatgacaggtaccgaaagaatgatccagaaaagcagaacgagaatacgagaaaggagaagaatgacatccatctcgatgccgacgatccgaattctgcggacaagcaccgaaacgactgcccgaactggatcaccgaaaaaattaactccggtccagaccccagaacaagaaatcccgagaaactcaaggagtctcattgggaggagaatcgaaacgagaatagcggcaactcctggaataagaattttgggtccgggtgggtctccaataggggtcgcggccgggggaacaggggaagagggacatatagatctagtttcgcttataaagatcagaacgagaatcgatggcagaaccgcaagccactctccggaaactccaattcgagcggttccgaatcatttaagtttgtggaacagcaatcctacaagcgaaagtccgagcaggagttcagcttcgacacccctgccgatcgctctggatggacttcagcatccagctgggccgtcagaaaaacacttccagccgatgtgcagaattattactcccgacgaggcagaaatagttcaggccctcagagtggatggatgaaacaggaagaggagacctctggacaggactctagcctgaaggatcagaccaaccagcaggtagacggaagccagctgcctataaatatgatgcaacctcaaatgaacgtgatgcagcagcaaatgaacgcacagcaccagcccatgaacatctttccttatccagtcggggttcacgctcctctgatgaacatccaaagaaaccccttcaatatacacccccagctgccactgcaccttcatactggcgtgcccctgatgcaagtcgctactcctacctccgtgtcacagggattgcccccccctcctcctccaccccccccgtcacagcaagtgaactacattgccagtcagcccgacggcaagcagttgcaaggcattccatcctcatcccacgtctctaataatatgagcactcccgtgcttcctgctcctaccgctgctcctggcaacactggtatggtgcaggggccttcctctggaaacacgtcctcaagttctcacagcaaagcaagcaatgccgcagtcaagttagctgagagcaaggtatccgtggccgtggaggcttccgcagacagctctaagacagataaaaagctccagatccaggagaaggcagctcaagaagtgaagttagcaattaaaccattctaccagaacaaggacatcactaaggaagaatacaaagaaatcgttaggaaggctgtcgacaaggtctgccacagtaaatccggcgaggtgaatagcaccaaggttgccaaccttgtcaaggcatacgttgacaaatataaatacagcagaaaaggctctcagaaaaagactcttgaggagccagtttctacagagaaaaacatagggtag

SEQ ID NO: 26491 - DNA, 3447 bp, Artificial Sequence
  Description of Artificial Sequence: Synthetic coding sequence
atgaccacccccacccggcggagcacccggaacacccgggccgagactgcatcacaatcccagaggagcccaatatccgacaactcaggctgtgatgccccaggtaatagcaacccttccctgtccgtcccctccagtgctgagagcgaaaaacaaacccgtcaagcacctaagagaaagagcgttagaagaggcagaaagccacccctgctaaagaaaaaactgcgctccagcgtggcagcccctgagaagtcctctagcaatgattccgtcgatgaagaaactgcagaaagtgacacatcacccgtgctcgaaaaggaacaccagcccgacgtggattcctcaaatatctgcactgttcagacacacgtagaaaatcaatctgctaactgtttgaaaagttgcaacgagcagattgaggaatctgaaaaacataccgcaaattatgacacagaggaaagggtgggatctagttctagcgagtcttgcgctcaagacctccccgtcctcgttggcgaggagggtgaggtcaagaaactggagaatactggaatcgaagccaacgtgttgtgtctggagagtgaaatcagcgagaatatactggaaaaagggggggacccattagagaagcaagaccaaatcagcgggctgagccagtctgaggttaaaaccgatgtgtgtaccgtccacctgccaaacgactttcccacctgccttactagcgagagcaaggtataccagcccgtctcatgccccttgtccgatttatctgagaacgtggagtccgtcgtgaatgaggagaaaattactgagtcaagcttggttgaaattacagagcacaaggacttcacgctcaagaccgaggaactgatcgagagtcccaaacttgagtcttccgagggagagatcatacagaccgtcgatcgacagagcgtgaagtcccccgaagtgcagctactcggccatgttgagaccgaagacgtggaaatcatcgccacctgtgacacgtttggcaacgaggactttaataacattcaagactcagaaaacaacctgctgaagaacaaccttcttaataccaagttggagaaatccctcgaggaaaagaacgagtctctgacagagcaccctagaagcactgagctgccaaaaacccatatcgagcagattcaaaagcacttcagcgaggataacaatgaaatgattcccatggagtgcgactccttttgctccgaccaaaacgaaagcgaggtcgagccaagcgtcaatgcagatctcaagcagatgaacgagaatagcgtcacccactgcagcgaaaataatatgcctagctccgacctggctgacgaaaaggttgaaaccgtgtcccagccatcagagtcacccaaagatacaatcgacaaaaccaaaaagcccagaacacgccggagccgctttcacagtcctagcaccacctggtcccctaataaggacacaccacaggagaagaagcgtccccaatccccatccccgaggagagaaacggggaaggagagcagaaagtctcaatcaccgagtcccaaaaatgagtccgctcggggaagaaaaaagagccggtcccagagcccaaaaaaggatattgctcgggagcgcagacaatcccagtcccggtccccaaagcgagacactactagggagtcaaggagatctgaatccctctctcctagacgggagacctctcgggagaataaacgaagtcaaccacgtgtgaaagattccagccccggggagaaatccagatcccagagccgggaaagagagagtgatagggacgggcagcggagagagagagagcggcgcacgagaaagtggagccgatccagaagtcatagccgctctccttcgaggtgcaggaccaagtcaaaatcatcaagttttggtaggattgaccgcgattcctattctccaaggtggaaaggccgttgggcaaatgacggatggcgttgtccccggggcaacgaccgatatcgcaagaatgacccagagaagcagaatgagaatacacggaaagagaagaacgatatccacctcgacgccgatgaccctaatagcgcagacaagcatcgaaatgattgtcctaactggattaccgaaaagatcaacagcggacccgacccgaggactcgcaatcccgagaagcttaaggagagccactgggaagaaaaccggaatgaaaattcaggtaactcttggaacaagaacttcgggtctggatgggtgtccaacaggggccgcgggcgcggtaacagaggtagaggaacttacaggtctagcttcgcctacaaagatcagaacgagaacagatggcaaaacaggaagcccctgtccggtaattctaactcctccgggtccgaaagttttaaatttgtggagcagcagtcctacaagcgtaaatcagagcaggaattctcatttgacactcccgcagaccgctccggttggacctcggcctcttcctgggccgtccggaagaccttgccagcagatgtgcagaattattattctcgcagaggacggaattcctcagggccacagtctgggtggatgaagcaggaggaggagaccagcggccaggacagcagcctcaaggaccagacaaaccaacaggtggatgggtcccaactgcccataaatatgatgcaaccacagatgaacgtgatgcagcagcagatgaacgctcaacaccagccaatgaacatattcccttatcctgtcggcgttcacgccccgttgatgaatattcaaaggaaccccttcaatatacatccccaactgcccctacacctccacaccggtgtccccttgatgcaggtggctacacctaccagcgtttcacaaggcctgcctcccccccctcctccaccccccccctctcaacaggtgaactatatcgcctctcagcccgatggcaagcaactccagggaatccccagctcgagtcatgtgtctaacaatatgagcaccccggttctgcctgctccgacagctgccccaggaaacacaggaatggtgcaagggccctcttcaggaaatacaagttcatccagccactccaaagcatcaaatgccgccgtgaagttggctgaatctaaagtttctgtagcggtggaggctagcgccgatagctcaaagaccgataagaagctgcagatccaagagaaagccgcacaagaggtgaagctggcgataaaacccttctaccaaaataaggatattacgaaagaagagtacaaagagattgttaggaaagccgtggacaaagtttgtcattctaagagtggggaggtgaactctacaaaagtggcaaacctggtcaaagcatacgtggacaagtacaaatattcaagaaaaggatcacagaagaagacattggaggaaccagtttctaccgagaagaatatcgggtag

SEQ ID NO: 26492 - DNA, 1401 bp, Artificial Sequence
  Description of Artificial Sequence: Synthetic coding sequence
atggccgaggagcaggacctgagcgaggtggagctgagccccgtggggtctgaggaaccgaggtgcctcagcccaggctccgctcctagtctggggccagatggcggagggggaggttctgggctgcgggcttcacccgggcccggtgaattgggaaaggttaagaaagagcagcaggatggggaggccgatgacgataagtttcctgtgtgcattcgcgaagcggttagccaagtcctcagtgggtacgattggactctagtgccaatgcccgtgagggtcaatggcgccagtaaaagcaagcctcacgtgaaacggccgatgaacgcattcatggtctgggctcaggcagccaggagaaaactcgctgatcagtacccccacctacacaacgcggagctcagcaagacccttgggaaactgtggcgattgctaaacgaatccgacaagagaccatttatcgaggaggcggaacgcctacggatgcagcacaaaaaggaccaccccgactataaataccagccccgtcgccgcaaaaacgggaaagcagcccagggggaggcagaatgtcctggaggagaagctgagcagggcggcaccgcagcaattcaggcccattacaaatccgcacacttagatcaccgccatccaggggagggctctccaatgagtgacggaaaccccgagcaccccagcggacagtcgcacggtcctccgacacctccgacaacaccaaaaaccgaactacaatcaggtaaagcagatccaaagcgagatggccgaagcatgggggagggcggaaaacctcatattgattttggcaatgttgatatcggggagattagccacgaagtgatgagcaacatggagacttttgacgtggcagagctggaccagtacttacctccaaacggccatcccggacacgtgtcctcttactcagccgctggctatgggctgggcagcgccctggctgtcgcatcggggcacagtgcttggatttctaaaccacccggtgtcgctttacccactgtgtcccccccgggagttgacgcgaaggcacaggtgaagaccgagacagccggtccccaggggccaccacactatacagatcaaccaagcacaagtcagatcgcctatacaagtctgtccttgccgcactatgggtccgcctttccaagtatcagtcgccctcagtttgactacagcgatcatcagcctagcggtccttattatgggcatagtggccaggcctcgggtctgtacagcgcattcagttatatggggccttctcagagaccactgtacaccgcaatctctgatccctcaccaagtggccctcagtctcacagcccaacccattgggaacagccagtctacacgacactcagtcgaccttag

SEQ ID NO: 26493 - DNA, 1401 bp, Artificial Sequence
  Description of Artificial Sequence: Synthetic coding sequence
atggccgaggagcaggacctgagcgaggtggagctgagccccgtggggtcggaggagccacggtgtctcagcccaggttctgccccatccttggggcctgatgggggcggcggtggaagcgggttaagagcttcaccaggacctggtgagttgggcaaggtcaaaaaagagcagcaggacggtgaggctgatgacgacaagttcccggtttgcatacgcgaggccgtgtcacaggttctatctggatatgactggacccttgtacccatgcccgtgcgcgttaacggcgcctctaaatctaaaccccacgtgaaacgacctatgaacgctttcatggtctgggcacaagctgcaagaaggaaactggccgaccagtacccacaccttcataatgccgaactcagcaagactctgggtaagctgtggcgacttctcaatgagagcgacaaaaggcctttcatagaagaagcagaaaggctgcgaatgcagcataaaaaagaccaccccgactacaaataccagccaaggcggcgcaaaaacggaaaagccgcgcagggcgaagctgagtgtcccggcggggaggccgagcaaggtggtaccgcagccatacaagcacactataaatcggcccacctcgatcatcggcatcccggagagggcagtcctatgagcgatggtaatcccgagcacccatccgggcagtctcatggaccccccacacccccgacgacacctaagacggagcttcagagtggcaaagcggatcccaaacgagacggtcgaagcatgggggagggcggcaagcctcatatcgattttggcaacgtcgatattggcgagatcagtcacgaggtaatgagtaacatggagacgtttgacgtggcagagctagaccagtacctgcctcccaacggccatccaggacatgtcagctcttactccgctgctggttacggattgggtagcgcactagcagtggcatccggacactccgcatggattagcaaacccccaggagttgccctccctacagtatcaccccccggcgtcgatgccaaagcccaagtgaagactgagacagccggtccccagggcccacctcactacaccgatcaaccgtctaccagccagatcgcctatacctctctgagtctgccccattacggatcagctttcccatctatctcccggccccaattcgattactccgaccaccagccttccgggccatactacggccatagtggccaagcttccggcctgtacagtgcattctcatacatgggccctagccaaagaccgctctacacagctatttctgacccctctccttctgggccacagtctcactctcccacacactgggaacagcctgtgtatactaccctttccaggccctag

SEQ ID NO: 26494 - DNA, 861 bp, Artificial Sequence
  Description of Artificial Sequence: Synthetic coding sequence
atggccgaggagcaggacctgagcgaggtggagctgagccccgtgggatccgaagagccaagatgtctgtcacctggttcagctccaagcctggggccggatggcggtgggggcggctctggcctgcgagcctcacctggacctggggagctggggaaggttaagaaggaacagcaggacggggaggccgacgatgataaattcccagtttgtattcgagaggcagtgtcacaggtcttgagcggctatgactggaccctggtcccaatgcctgtcagagttaatggtgcctctaaatctaagccacacgttaagcgcccaatgaatgcttttatggtttgggcgcaggccgcacggcgaaaactggcggatcagtatcctcacctgcataatgctgagctctccaagacacttggtaaactgtggagattgctgaacgaatccgacaagagaccctttattgaggaagcggagagacttcgaatgcagcacaaaaaggatcaccccgactataagtatcagccgagacggcggaagaatgggaaagctgcacagggtgaagcagagtgtcctggtggcgaggccgagcaagggggaactgcggcaatccaggcacattataaaagtgcccacctcgatcatcggcacccaggggagggttccccaatgtccgatggcaatcccgaacaccctagcgggcagtcccatggacctcctacccctcctaccacaccaaagacagagctccagtcagggaaggctgacccaaagagggacggcaggcccagcccctcaggtccgcaaagccactctcccactcattgggaacagcctgtatataccacactgtcccggccctag

SEQ ID NO: 26495 - DNA, 642 bp, Artificial Sequence
  Description of Artificial Sequence: Synthetic coding sequence
atggccgaggagcaggacctgagcgaggtggagctgagccccgtgggctccgaagagccacgttgtctttctcccggctccgccccgtctctggggcccgatggcggtgggggagggtcaggcttgcgggcctcccccggccccggagagcttggcaaagtaaaaaaagagcagcaggatggtgaggcagacgatgacaaattccccgtttgcattcgcgaagcagtgagccaagtcctgtcaggctatgattggaccctagtgcccatgccggtgcgggttaatggagcaagcaagagcaagccgcacgtgaaacgacccatgaatgcctttatggtctgggcccaagccgcccgcaggaaacttgccgatcaatatccccacctccacaacgccgagttatctaagaccctggggaaactgtggcgcctccttaatgagtctgacaaacgacctttcatcgaggaggctgagaggctaaggatgcaacacaagaaagatcaccctgactacaaataccagcctcgcaggcgcaaaaatgggaaggcggcccagggggaggccgagtgtcctgggggtgaagccgagcagggcggcactgccgctatacaggcgcactataagagtgcccatttggactag

SEQ ID NO: 26496 - DNA, 1425 bp, Artificial Sequence
  Description of Artificial Sequence: Synthetic coding sequence
atggtgcagcagaccaacaacgccgagaacaccgaggccctgctggccggagaatctagtgactcgggagctgggttggagctcgggatcgcgagttcccccaccccgggatccactgccagcaccgggggaaaagcagacgatccaagctggtgtaagaccccctccggccatatcaagcggcccatgaatgcattcatggtgtggagccagattgaaagacgcaaaatcatggaacagtctcctgatatgcataatgctgagataagtaagcgactggggaagcgctggaaactactgaaagactccgacaagatccctttcatccgcgaagccgaacggctgcgtctgaaacacatggccgattatcctgattataaatatagacccaggaagaaagtgaagtctggaaacgctaactcctcctcctctgctgcagccagtagtaaacctggggaaaagggggataaggttgggggttctggcggtggaggacatggtggtggcggagggggaggatcatcaaacgctggcggcggaggcggaggagcatctggagggggcgccaactctaaacctgcccaaaagaagagttgcggctctaaggtggcgggtggcgccggcggaggagtgagcaaaccacacgccaagctaattttggctggtggaggtggagggggtaaggcggccgcggcagccgctgccagcttcgccgccgagcaagcaggcgccgctgcgctcctacctctgggggccgccgccgaccaccattctctttataaggctcgtacaccttccgcctcagcctccgcctcttccgctgcaagcgcctcagcagctttagccgcccctggcaagcacctggccgagaaaaaggtgaagagggtttacctgttcggagggctgggaacatcctcttccccagtcggaggcgtgggagccggtgctgaccctagtgacccactgggcctctacgaagaggagggcgctggctgctcaccagacgccccgtctctgtcaggaaggtcatccgctgccagctcacctgctgccgggcgttctcccgccgaccatcgtggctatgctagtctgagagccgcaagtccggcgccctcatctgcaccctcccacgcatcgtcctccgcctcatcgcatagcagttctagctcgtcatctggaagttcttcatcagacgacgaattcgaggacgacctgttagatctgaacccttcaagcaacttcgaatctatgtccctcggaagcttttcttcatcttccgccctagatcgggacctcgattttaatttcgagccaggaagcgggtcgcactttgagttcccagactattgcacacccgaggttagcgaaatgatcagcggtgactggttggagagctcgatatcaaacctggttttcacatattag

SEQ ID NO: 26497 - DNA, 1425 bp, Artificial Sequence
  Description of Artificial Sequence: Synthetic coding sequence
atggtgcagcagaccaacaacgccgagaacaccgaggccctgctggccggagaatcctccgactccggtgcagggctggagctagggattgcatctagcccgaccccaggctctaccgcttcaactggaggcaaagcggacgacccaagctggtgtaagacaccttccgggcatataaaaaggcctatgaatgccttcatggtgtggtcacaaatagaacgtaggaagatcatggaacagtcaccagacatgcacaacgccgagatttcgaaaagattgggaaagcgctggaagctcctgaaggactcagacaagataccttttattagggaagccgagcggctgaggctgaaacatatggctgactatcccgactataagtaccgtcctagaaaaaaggtgaagagcgggaacgcgaatagctcctcgtcagccgcagcctcaagtaagcctggggagaagggagataaggtcgggggaagtggcggaggaggtcacgggggggggggcggtggcgggagctccaacgctggaggaggcggggggggggcctcagggggaggcgcgaactcaaaaccggcccagaaaaagtcatgcggctccaaagtggccggcggagctggcggcggagtcagcaagccccacgccaagctaatcctggctgggggcgggggcggcggaaaggcggccgccgcggccgcagccagctttgccgctgaacaagcaggcgccgccgcgctgctccctctcggcgctgcggcagaccaccactccctttataaagcgcggaccccatcagctagcgcatcggcctcttcggccgcttcggcgtcagcggcgttggcagcacctggcaaacatctggcagagaagaaggtgaaacgagtgtatctgtttggcgggttgggaaccagctcctctccagttggcggcgtcggggccggcgccgacccctccgaccctctgggactgtacgaggaggagggcgctggctgctcccctgatgccccatcactctccgggagatcgtctgctgcgagctccccggccgcaggtcgaagccccgcagaccaccggggatatgcctcactgcgggctgcatctccggccccaagctctgccccatctcacgcttctagctccgcctctagtcactcatctagttctagcagttctggtagtagttctagtgacgatgaattcgaagacgatctgcttgatctgaacccttcttctaacttcgagagtatgagccttggttccttcagttcatcctcggccctggatagagacctggatttcaattttgagccagggtccggttcacacttcgagttcccggattactgcacacctgaggtgtccgagatgatttccggagactggctagagtcttctatctcaaaccttgtctttacctattag

SEQ ID NO: 26498 - DNA, 3318 bp, Artificial Sequence
  Description of Artificial Sequence: Synthetic coding sequence
atgctggagcccagcagcgtgctgcacgccaacgtgaaccaggcccccttgtggtgtcttgtcttgcgttggtgtcgggagtgcaaggacaccgtctgcggagggaaacaaaaatcgcgggtgaatcacacgtttcagagacgggaaatcgaagcaaaagaagcctgcgactggcttagagccgcggggttcccccagtacgcacaactgtatgaagattcccagttcccaatcaatatcgtggccgtgaaaaacgatcatgactttttggaaaaagacctggttgaacccctttgccggagactgaatactctgaataaatgcgcaagcatgaagctggacgttaactttcagcggaagaaaggagatgattctgacgaagaagacctttgcatcagcaacaaatggactttccagcggacatctagacggtggtcacgagttgatgacctgtacacgctcctgcctcgcggagacaggaacgggtcacccggcgggacaggtatgcggaacaccaccagctccgagagtgtcctcaccgacctgagtgagcccgaggtgtgtagtatccattccgagtcaagtggaggctctgattctaggagccagcccggacagtgctgtacagataatccagttatgcttgacgccccattggtgagttccagcctgccacaaccccctcgcgacgtactcaatcatccttttcaccccaagaacgaaaaaccaactcgagccagggctaaatccttcctgaagagaatggaaaccctgagaggcaaaggcgcacacggcaggcacaaggggtcaggaagaactgggggccttgtgatatctggccctatgctccaacaggagccggaaagctttaaggctatgcagtgtattcagattcctaatggagacctgcaaaatagcccacctccagcctgtcgaaagggacttccttgcagcggcaaatctagcggcgagtcttccccctctgaacactcatcgtccggcgtttcgaccccttgcttaaaggagaggaaatgccatgaggcaaataagaggggaggaatgtacctagaagacctggatgtccttgccggaaccgccctccctgatgccggagaccagtcacggatgcatgagttccattcccaggagaacttggttgtgcatatccctaaagatcataaacctggtacctttccgaaggctctctccattgaatccctctctcctaccgacagctccaacggcgttaattggaggaccgggagcatttccctggggcgggagcaagttccaggtgcccgggagccccgcttaatggcctcttgtcaccgcgcatcgcgagtctcaatctatgataatgtgcctggttcccatttatatgccagcaccggggatctgctggatctggagaaggacgacctatttcctcacctggatgatatcttgcaacacgtgaatggcctgcaggaagtcgtagacgactggagcaaagacgtgctcccagagttgcaaactcacgacactctggtgggggaaccaggactgtctaccttcccaagcccgaatcagatcacattggattttgagggaaattccgtgagcgagggccgcaccaccccaagtgatgttgaacgcgatgtgacaagtctcaacgaatccgagcctccgggcgtccgcgaccggagagacagtggcgtgggtgcctcactgacaaggcccaacaggcgcctcagatggaacagctttcagcttagtcatcaacctagacctgccccggccagtcctcatatcagttcccagacagcatctcaactctccctgttgcagcgttttagcttattgcggctgactgcaataatggaaaaacatagcatgtctaataaacacggatggacatggagtgtcccgaaattcatgaaacgcatgaaagttcctgactacaaggacaaggctgtgttcggtgtaccgctcatcgtacacgtccagcgcactggtcaaccactgccgcagagtattcagcaggctttgagatatctgcgttcaaactgtttggaccaagtgggattattccgaaagtctggcgttaagagccgcatccatgcactgcgccagatgaatgagaacttcccggagaatgtcaactacgaagaccagagcgcatacgacgtcgcggacatggtgaagcagttttttagagaccttcccgaacctctctttacaaacaagctgagcgagacattcctccatatatatcagtacgtgagcaaagagcagcggttacaggccgttcaggccgcaatacttttgctggctgacgagaaccgggaggtcttgcaaaccctcttgtgttttctcaacgatgtggtgaacctggtggaagagaaccagatgacacctatgaacctggctgtgtgcctcgcccctagcctatttcacctgaatctgctcaaaaaagaaagttctccgcgggtgatccagaagaagtatgctacaggaaagccggaccagaaagatcttaacgagaacctggccgcggctcaggggcttgcccatatgatcatggaatgcgacaggctcttcgaagtcccccacgagcttgttgcccagagcaggaattcctacgtggaggccgagatccacgttcctacactggaggaactcgggacacagctggaggagagtggcgcaacatttcacacttatctcaaccatctgatccagggactgcaaaaagaagctaaggaaaaatttaaagggtgggttacttgttccagcacagacaacactgatctcgctttcaagaaggtgggcgacggaaatcctctgaagctttggaaagcttcggtggaggtggaagcaccccccagtgtcgtgctgaatcgagtgctgcgggaacgccacttgtgggatgaagattttgtgcaatggaaggttgtggagaccctagatagacagaccgaaatataccagtatgtgcttaactctatggccccccaccccagtcgagacttcgtcgtcttgaggacatggaagacagacttgcccaagggaatgtgtacccttgtgagtctgtctgtcgaacatgaggaggcccagctgctcggaggagtgagggccgttgtgatggattctcagtacctgatcgagccatgtggatcaggaaagagtcgcttgacacacatctgcaggatcgatttaaaggggcactctccagagtggtactccaaagggttcggccacctatgcgccgctgaagttgcccgcataagaaattccttccaaccactgatcgccgagggccctgagaccaagatttag

SEQ ID NO: 26499 - DNA, 3342 bp, Artificial Sequence
  Description of Artificial Sequence: Synthetic coding sequence
atgttcagccaggtgccccggacccccgccagcggctgctactacctcaattctatgacccctgaaggacaggagatgtatttgcggtttgatcagactactcgtagatccccctatcgtatgagtaggattcttgctagacatcaattggtgactaaaatccaacaggagatcgaagctaaggaagcctgtgattggctgagagctgccgggttcccgcaatatgcccagttatacgaggattcgcagttccctattaatatagtggccgtgaaaaacgatcatgatttcctcgagaaggatttggtggagccactgtgcagaagactgaatactttgaacaaatgtgccagtatgaagcttgatgttaacttccagcgcaagaagggagatgattccgacgaggaagacttgtgcatttctaataagtggacctttcagcgcacctcacggcgatggtcccgggttgatgacttatacaccttactacctagaggtgacagaaacgggagtcctggcggcacaggaatgcggaatacaacgtcgtcagagtcagtattaacagacctgtcggaaccagaagtgtgttcaatacactcggagagttctggcggaagcgattcacggagtcagcctggacagtgttgcaccgataatcctgtcatgctagacgcccccctcgttagctccagcttgccccagccccctcgggatgtgctaaatcatccattccatcccaagaacgaaaaaccaacaagagcacgagccaaaagtttcttgaagcgcatggagactctgagagggaagggtgcccatgggcggcacaaaggatcaggcaggactggtggactggtgataagcggccccatgctccagcaggaaccagaatcgtttaaggctatgcagtgtatccaaatccccaacggggatctacagaatagtcccccccccgcttgtcgaaagggcctgccctgctccggaaagagttctggtgagtcttctccctcagagcattccagcagtggcgtgagtaccccttgcctgaaagagcgcaaatgccatgaggcaaacaaacgcgggggcatgtacttggaggacttagacgtactggccggcaccgctctcccagatgcaggggaccagagtcgcatgcacgaattccattctcaagagaacttggtggtgcacatcccaaaagaccacaagcccgggacatttcctaaagctctgtcaattgagtcccttagcccaaccgacagtagtaacggcgtcaattggcgaactgggtctatctccctcggcagagagcaggttccaggcgctcgcgagcctcgtctgatggcctcctgtcaccgagccagcagagtctctatttacgacaatgtgccaggctcgcacctttacgcaagcaccggggacctcctcgacttggaaaaagacgacctgtttccacatctggatgacatactccagcacgtgaacggcttgcaggaggttgtggatgactggagtaaggacgtcctaccagagctccaaactcacgacactctagtgggggagcctggtttgtctactttcccatcccctaaccagataactctggacttcgagggaaatagtgtcagcgaggggagaacaaccccctctgatgtcgagcgggatgtgacgtctctgaacgagtcagagcccccgggcgtgagagatcggagagatagcggagtgggcgcctcactgacccgtcccaatcgcagactgcgatggaattccttccaactgagccatcagccgaggccagcccctgccagtccacacatttcctcccagaccgcctcccaattgagcctgttgcaacgcttttccctgctgagactgaccgctattatggaaaaacactccatgtcaaataaacatggatggacgtggtccgtgccaaaatttatgaaaagaatgaaagtgcccgattacaaggataaagccgttttcggcgttccgctgatcgttcatgtgcaaagaacaggacagccgctgccacagagtattcagcaagccctccgttatttgaggagtaattgccttgaccaggtgggcctctttagaaagagcggagtgaagtctagaattcacgcgttgaggcaaatgaacgagaacttccccgagaacgtaaactacgaggaccagagcgcttatgatgtggcagatatggtgaagcagttcttccgtgatctgccagaaccactctttacaaataaacttagcgaaacctttctgcacatttaccagtacgtgagtaaggagcagagactccaggcagtccaagccgcaattctgttattagccgacgagaacagagaagtcctgcagacactgctgtgttttctgaatgacgtcgtgaacctggtggaggagaaccagatgacaccaatgaacctggcggtctgcctggcgccttccctgtttcacctaaacttgcttaaaaaagaatcaagcccccgggttattcaaaagaagtacgccactggaaagccggaccagaaagacctcaacgagaatttagcagcagcacagggattagcacatatgattatggagtgtgaccgtctgtttgaggttcctcatgaactagtggcacagtcgagaaatagttatgtcgaggccgaaattcacgtcccgactcttgaagaactggggacccagctggaagaatccggtgctacgttccatacttacttgaaccatttaattcagggcttacagaaagaagccaaggagaaattcaaggggtgggtgacgtgttccagcacagacaatactgaccttgcatttaaaaaggtgggggatggaaaccccctaaagttatggaaagccagcgtggaagtggaggctcctccatcagtggtactgaatcgggttctccgcgagagacatctgtgggacgaagactttgtgcaatggaaggtggtggagacacttgatcggcagacagagatttatcagtatgtgctcaacagtatggcccctcacccttcccgtgattttgtggttttgcggacctggaagaccgatctgccaaaggggatgtgtactctcgttagcctgagcgtagagcatgaagaagcccagctgttaggaggggtgagagctgtggtcatggacagccagtacttgattgagccatgcgggtcaggcaaatccaggcttacccatatctgtagaatcgacttaaagggacattctcctgagtggtattccaaagggttcggacacttatgcgccgctgaagttgcccgaatccgcaatagttttcaaccactgatcgccgagggtccagaaactaaaatctag

SEQ ID NO: 26500 - DNA, 2064 bp, Artificial Sequence
  Description of Artificial Sequence: Synthetic coding sequence
atgctggagcccagcagcgtgctgcacgccaacgtgaaccaggccccactgtggtgtttggttttgcgctggtgcagagagtgcaaggacacagtatgtggcggcaaacaaaaaagccgtgttaaccacacttttcagaggagagaaatcgaggccaaggaggcttgtgattggctgcgcgcggctggtttcccccagtacgcccaattgtacgaagattcacagtttcctatcaacatagtcgccgtgaagaatgatcatgacttcctcgaaaaggacctggtggaaccactgtgtcgcaggctcaacaccttgaataaatgtgcttctatgaaactggatgtcaacttccaaaggaaaaagggtgatgattccgatgaggaagatttgtgtataagtaacaaatggaccttccagagaaccagtcgcagatggagtagggtggacgacctctatactctgttacctcggggagatagaaacgggtcgcctggtggcacagggatgcgaaacacgacatcttctgagagcgtgctgacggacctgtcagagcctgaagtgtgcagcatccactccgagtctagcggggggtccgacagtcggagccaacccggtcagtgctgcacagataatcctgtgatgctggacgcccccctcgttagttctagtctcccccagccacctcgtgatgttctgaatcatccattccatcctaagaatgaaaagcctacccgggccagagctaaatccttcctcaagagaatggagaccctcagagggaaaggggctcacgggagacataaaggctccggacgaacggggggtctggtgataagcggacccatgctgcagcaggagcctgaatcttttaaggctatgcagtgtatacagattcccaacggagacctccagaattcccctccccccgcctgccgcaaaggcttaccgtgctcaggaaagagtagtggtgagagcagtccatctgagcactcgagctccggagtgtcgaccccatgtctgaaggagcgcaaatgccatgaggcaaacaagcggggggggatgtacctggaggaccttgatgttttggctggcaccgctctacccgatgctggcgaccagagcaggatgcacgagttccactcccaggagaacttagtggtgcacattcccaaagaccacaagcccggtactttcccgaaagccctttcgatcgagtcactcagccccaccgacagttcgaacggagtaaattggcgcaccgggagtatatctctgggcagagagcaggtacccggagcccgcgaaccacgcctgatggcgtcgtgtcaccgggcgtcaagagtatctatctatgataatgtgcctggctctcatctgtatgcaagtaccggcgatctactagatctggagaaggacgatctatttccccacctcgacgatatcctccagcacgtcaatggcctgcaggaagtagtggatgattggagcaaggacgtactgcctgagcttcagactcacgacacgctcgttggcgaacccggactgtctacctttccgagcccaaatcagataacactggacttcgagggaaattctgtaagcgaaggacgaacgactccctccgatgtggaaagggatgtcacatcactcaacgaaagcgaaccacctggtgtccgcgaccggagagatagtggtgtgggggcatcccttacacggcctaaccggcggttacggtggaattctttccagctgtcccaccaacctagaccagctcctgcctctcctcacatctcttctcaaaccgccagccaactgagcctacttcagcggtttagcttgctgcgccttacagccattatggagaagcactccatgagcaacaaacatggctggacctggtcagtacctaagttcatgaaacggatgaaggtgccagattataaagacaaagctgtgttcggggtgccattaatcgtgcacgtgcagcgtacagggcagcccctgccacaaagcatccagcaagcactcaggtatctccgcagtaactgccttgaccaggagtag

SEQ ID NO: 26501 - DNA, 2988 bp, Artificial Sequence
  Description of Artificial Sequence: Synthetic coding sequence
atgaagctggacgtgaacttccagcggaagaagggcgacgacagcgatgaagaggacctctgcatctcaaataaatggacattccagaggacatcccggcgatggtcccgggtcgatgacttatatactctgctcccacgaggcgatagaaacggttctccagggggaaccgggatgaggaacaccaccagcagcgaatccgttcttactgacctttcggaacccgaggtgtgcagcatacattcagaatccagtggcggtagtgactctcggagccagcccggccagtgttgtaccgacaaccctgtcatgctggatgccccacttgtaagctcttcccttccccagcctccaagagacgtgttaaatcaccccttccaccccaagaatgaaaagcccacccgggcaagagcaaaatcgttccttaagcggatggaaacattgcgaggcaaaggggcccacggccgccacaaaggttcagggagaacagggggattggtaatttctggaccgatgctgcagcaggaacccgagtcatttaaagccatgcagtgcattcagatcccgaacggagacctacagaattctccccccccggcctgcagaaagggcctaccttgctctgggaaatcttcgggtgagtcttctcctagtgagcacagctcctccggagtgagtacaccttgcctaaaagaacggaagtgtcatgaagctaataaaaggggcggaatgtatctggaggatctcgacgtgctcgccggcaccgcactcccggacgctggtgatcagtccagaatgcacgaattccactcccaggagaatttagtggtgcacatccccaaagaccacaagcccggcacctttccgaaagcactgtccattgagtcacttagccccaccgattccagcaatggcgtgaactggcgtacaggatcgatatctctgggtagagagcaggtgcctggcgcccgtgaacccagacttatggcctcctgtcatcgggctagcagggtctcaatctacgacaacgttcctgggagtcatctgtacgccagtacaggggacttgctggatctggaaaaagatgatctttttccccacctcgatgatattctgcagcatgtaaacgggcttcaggaagtggtggacgattggtctaaggatgtgctgcccgaactgcagacccatgatactcttgtgggcgaaccaggattgtctacatttcccagccccaaccagataactctggactttgagggaaactctgtctccgaggggcggactacaccaagcgatgttgaaagagatgtgactagtctgaacgaatctgagcctccaggagtaagagatcgaagagattcaggggtgggggccagccttactcggcctaaccggaggttgcggtggaactcttttcaactttcacatcagccaagaccagccccagcatctcctcatatttcatcgcagacggcaagccagctaagcctgctccaaagattctccctgctgaggttgactgccattatggagaagcacagcatgtctaataagcacggatggacgtggtcagtacccaagttcatgaaacgaatgaaggtgccagactacaaggataaggcggtattcggtgtcccactgatcgtgcacgtccagcgaacaggtcagcctctgcctcaatctattcagcaggctctgcgatatctccgatcgaactgcctggatcaagtgggcctattccggaagtccggggtcaaatcccgaattcacgccctccgacagatgaacgaaaatttcccagagaacgtcaactatgaggatcagagtgcttacgacgtcgcagacatggtgaagcagttttttcgagatctgccagagcccctgtttactaataagctatccgagaccttcctgcacatttaccagtacgtttcaaaagaacagcggctgcaggcagtgcaagccgcaatcctcctcctggcagacgaaaatagggaagtgttgcagacattattgtgcttcctgaacgatgtagtgaatctagtggaagagaatcagatgaccccgatgaacctcgcagtgtgcctagccccctcattattccatctgaatcttctaaagaaagaatcatcacctagggttatccagaagaagtacgccaccggaaagcctgaccagaaagaccttaacgaaaacttggccgcagcacagggtctggctcacatgatcatggaatgtgaccgcctctttgaggtaccccacgagttagtagctcagagccgcaactcctacgtcgaagcggaaatccacgtgcctactctggaagaactggggactcaacttgaagaatcaggtgcgacttttcacacttatctgaaccatctcattcagggtctccaaaaggaggcgaaggaaaagtttaaaggctgggtcacatgcagctctaccgacaataccgatcttgcctttaagaaggtcggggatggaaacccactgaaactgtggaaggcttcagtggaagtggaagctcccccctcagtcgtgcttaaccgggtgctgagggagagacacctctgggatgaagacttcgtccagtggaaagtcgtggaaactctggataggcaaacagagatatatcaatacgtgctgaattcaatggcccctcacccaagtcgagactttgttgtgctgcgcacttggaaaacagatttgcctaagggaatgtgtactctggtctccctttccgtcgaacacgaggaagcccagttgcttgggggcgtgagagcggtggtaatggacagtcagtatctgatcgaaccatgtgggagcggtaagtcccgcctcacacatatctgtagaatcgatctcaagggccactcgcccgagtggtattcaaaaggcttcggccatttgtgcgccgcagaggtggctagaatccgcaactcttttcagccgcttatcgcagagggtcctgagactaagatctag

SEQ ID NO: 26502 - DNA, 450 bp, Artificial Sequence
  Description of Artificial Sequence: Synthetic coding sequence
atggccagcagcgacatccaggtgaaggagctggagaagcgggcctcgggccaagcatttgaacttatactttctcccagaagcaaagaaagcgtgccagagtttccattgagccccccaaaaaaaaaggacctgtcgctggaggagatccagaagaagctggaagccgccgaagagagaagaaaaagccacgaagccgaggtattaaagcaacttgcagaaaagagggaacacgaaaaagaggtcctgcagaaggcaatcgaggaaaataacaatttttcgaaaatggccgaagaaaagctgacccacaaaatggaggccaataaggaaaatagagaggcccagatggctgcaaaactggagcgcttgcgggagaaggataagcacatcgaagaagtgcggaagaacaaggaaagtaaagatcccgcagatgaaaccgaagccgactag

SEQ ID NO: 26503 - DNA, 450 bp, Artificial Sequence
  Description of Artificial Sequence: Synthetic coding sequence
atggccagcagcgacatccaggtgaaggagctggagaagcgggccagcgggcaggctttcgagttgatcctatccccaaggagcaaagagtccgtgcccgagttcccactgtcaccgccaaagaagaaagatttgagtctcgaggaaatccagaagaaattggaggccgctgaggaaagaaggaagagccatgaggctgaagtgcttaagcagcttgctgagaagcgggagcatgagaaagaagtcttgcagaaggctatagaggagaataacaatttttcaaagatggctgaggagaagttgacccacaagatggaggccaataaagagaatagggaggcacagatggccgctaaactggaacgcctcagagaaaaagataaacacatcgaagaggtgcggaagaacaaagagagcaaggacccagccgacgagactgaggccgactag

SEQ ID NO: 26504 - DNA, 450 bp, Artificial Sequence
  Description of Artificial Sequence: Synthetic coding sequence
atggccagcagcgacatccaggtgaaggagctggagaagcgggcctctggacaagcttttgagcttattctgagcccacgcagtaaggaaagcgtgcctgaatttcccctgagccccccaaagaagaaagatctatccctcgaggagatacagaagaaattggaagcggcagaggagcggagaaaatctcacgaggccgaggtgcttaaacagctggcagagaagcgcgaacatgagaaggaagtactgcagaaggctattgaggagaataacaatttcagcaagatggccgaggagaagctgacccataaaatggaggccaataaggagaaccgagaggcccaaatggccgccaaattggagcggcttcgagaaaaagataagcacatagaagaagtacgtaagaacaaggagtccaaagaccccgctgatgagaccgaagctgattag

SEQ ID NO: 26505 - DNA, 525 bp, Artificial Sequence
  Description of Artificial Sequence: Synthetic coding sequence
atggccagcagcgacatccaggtgaaggagctggagaagcgggcctccggccaggcgttcgaattgatcctgagcccacgtagcaaggagagtgtcccagagttcccattgtcccccccgaagaagaaagacctgtccttggaagaaattcaaaaaaaactagaggccgccgaggaaagaagaaagtcgcatgaggcagaagtgctgaagcagctggccgagaagcgggagcacgagaaggaggtgctccagaaggccattgaagagaataacaactttagtaaaatggctgaggagaagttgacccacaaaatggaggcgaacaaggagaatagggaagcacagatggctgcaaagctcgaaaggttgcgggagaagatgtacttctggactcatggtcctggcgcccatccagcccagatatctgctgagcagtcgtgcctgcacagtgtgcccgccttgtgtcccgccctgggtctgcagagcgctctgataacttggagtgacttgtctcatcatcattag

SEQ ID NO: 26506 - DNA, 261 bp, Artificial Sequence
  Description of Artificial Sequence: Synthetic coding sequence
atggccagcagcgacatccaggtgaaggagctggagaagcgggcctccgggcaggcgttcgagctcattctatctcctcgctccaaagaatccgtgccagagttcccgcttagccctcccaagaagaaagacctctcattggaagaaatccagaagaagctggaggctgccgaggaaaggcgtaaatctcacgaagcagaggttctgaaacaactagcagaaaaaagggagcatgaaaaagaagtgctccagaaggcatag

SEQ ID NO: 26507 - DNA, 450 bp, Artificial Sequence
  Description of Artificial Sequence: Synthetic coding sequence
atggccagcagcgacatccaggtgaaggagctggagaagcgggcctccggccaggctttcgagctaattcttagccccaggagtaaggagtctgtgcccgagtttcccctgagccctccaaaaaagaaggacctcagcctggaggaaatacaaaagaagctggaggccgcggaggaacgcagaaagtctcatgaggctgaggttctgaagcaactcgcagagaagagagaacacgagaaagaagtgttgcagaaggcgattgaggagaataacaattttagcaaaatggctgaggagaaactcacgcataaaatggaggccaacaaagagaatcgcgaggcccagatggctgcgaagttggagagactgcgggagaaagataaacacatcgaggaggtgagaaaaaacaaggagagtaaagatccagctgatgaaactgaggccgactag

SEQ ID NO: 26508 - DNA, 3615 bp, Artificial Sequence
  Description of Artificial Sequence: Synthetic coding sequence
atgagcttcttcaacttccggaagatcttcaagctgggcagcgagaaaaaaaaaaagcagtacgagcatgtgaagcgggatctgaacccggaagatttttgggaaattatcggagagctcggggacggcgccttcggcaaggtgtacaaagcccaaaacaaggagacaagcgtgctggcggctgctaaggtcatagataccaagtctgaggaggagctggaagattacatggtggaaatcgacatcctcgcttcttgtgaccaccccaacattgtcaaacttctggacgcgttttactatgagaacaatctttggatactgattgaattttgcgccggcggtgcagtcgatgccgtgatgctggaattagagaggcccctcactgagtcgcaaatccaggtagtgtgtaagcaaaccctcgacgccctaaactacctgcacgacaataagataatccatcgggatctgaaggcagggaatatcctgtttactctggatggcgatataaagctcgctgactttggcgtgtctgcaaagaacacacggactatccagaggagagacagtttcatcgggacgccatactggatggcccccgaggtcgtgatgtgcgagacatccaaagaccgcccctacgactataaggccgatgtttggagtctggggatcaccctgattgaaatggctgaaatcgagcccccacaccatgagttgaatcctatgcgtgtgttgctgaagatcgctaagagtgagcctcccaccctggcccagcccagccggtggagttctaatttcaaagacttcctgaaaaagtgtctggaaaagaatgtggacgccagatggactacgtcgcaactgctccaacatcctttcgtgaccgtggattccaataaacctatccgcgaactgattgccgaggcgaaggctgaggtgaccgaggaagtggaggatggcaaagaagaagacgaagaagaggagactgaaaattcgctgcccatccccgctagcaaacgcgcttcctccgacctgtctatagcatccagtgaagaggacaaactgtcacagaatgcctgcattctggaatctgtgagcgagaaaaccgagcggtctaactctgaagacaagttgaatagcaagattttgaacgaaaagcctacaaccgatgagcctgagaaggcagttgaggatataaacgaacacattaccgacgcccagctcgaggctatgactgaactgcatgacaggactgcagttataaaggaaaacgagagagagaagaggccaaaactagaaaacctgccagataccgaggaccaggaaaccgtggacatcaattctgtgagtgaaggtaaggaaaacaacatcatgatcaccctggagacaaacattgagcataacctgaaaagcgaggaagagaaagatcaggaaaaacaacagatgtttgaaaacaagcttatcaagtcagaggagatcaaagatactattctgcagactgtcgacctcgtgtctcaggagacgggagagaaggaagccaacattcaggctgtagactctgaggtcggactgaccaaggaggacacgcaggaaaaactaggggaggacgacaagactcagaaagacgttataagtaacacatcagatgtgatcgggacatgtgaggctgcggacgtcgcccagaaagtcgatgaagacagcgcagaagatacccagtccaacgatggcaaggaagtggtggaggtgggccagaagctgatcaacaaacccatggtcggtccggaggctgggggtacaaaggaggtgcccataaaggagattgttgaaatgaatgaaatcgaggaaggaaagaacaaagagcaggcaatcaactcctcagaaaacatcatggatataaacgaagaacctggcaccacggagggcgaggaaatcaccgagagttccagtacagaggaaatggaggttagatcggtggtagcagatacagaccagaaggctctcggcagcgaggtccaggacgcttccaaagtaaccactcaaatcgacaaagagaagaaagagattccggttagcatcaaaaaagaacctgaagtcacagttgtgtctcagccgactgagcctcagcctgtgctgatcccatcaatcaatatcaactccgactccggagaaaacaaagaggagattgggagtctgtccaagactgaaaccatcctgccccccgaaagcgaaaatccaaaagagaatgacaacgatagtggcaccgggtcgaccgctgatacatcgagcatagatttgaatctgagcatcagctcatttttgtccaagaccaaggacagtggttcaatttcgctccaggagacaagaaggcagaagaagaccttgaaaaaaacccgtaaattcatagtggacggagtcgaggtctctgtgacgacatctaaaatcgttactgattctgacagcaagacagaggaacttagattcctccgcaggcaggaactccgggaacttaggttcctccagaaagaggagcaacgagcacaacaacaactcaactccaaactgcaacagcagcgggagcaaatcttccgacgatttgagcaggagatgatgtccaagaaacgtcagtacgatcaagagattgagaatctggagaaacaacaaaagcagaccatagagcggttggagcaagagcacacgaaccgactgagagacgaggctaagcggatcaaaggtgaacaggaaaaagagttgtccaagtttcaaaatatgcttaaaaatcgaaaaaaagaagagcaggaatttgtgcagaaacagcagcaagaactagatggctccctgaagaagatcatccagcagcagaaagctgagcttgccaacatcgagagggaatgcctcaataataagcagcaactcatgagggcacgcgaggcagccatttgggagctcgaagaaagacacctgcaggagaagcaccaactcttaaaacagcagctcaaggatcaatacttcatgcaacggcatcaactgctgaagcgacatgaaaaagagaccgagcagatgcagagatataaccagaggcttatcgaagagcttaagaacaggcagacacaggaaagggcgaggctgccaaagatacagaggagcgaggccaaaactagaatggcaatgttcaaaaagtccctgcgtatcaacagcaccgccacacccgaccaagatcgggataaaattaagcagttcgcggcacaagaggagaagcgtcagaagaacgaacggatggctcagcaccagaaacacgagaaccagatgagagacctgcagctgcaatgtgaagccaatgtccgcgagctgcaccagctgcagaatgaaaagtgccatctgctggtagagcacgagacccaaaagttgaaagagttagacgaggagcactcccaagagcttaaggaatggagggagaaactgaggcctcgaaagaagacactcgaagaagaatttgcgcgcaaactccaagaacaggaagtgttttttaaaatgaccggcgaatccgagtgcctaaacccctcaactcaatcccgtattagcaaattctacccaataccttcactgcacagcaccggatcgtag

SEQ ID NO: 26509 - DNA, 3708 bp, Artificial Sequence
  Description of Artificial Sequence: Synthetic coding sequence
atgagcttcttcaacttccggaagatcttcaagctgggcagcgagaaaaagaaaaagcaatacgagcacgtgaaaagggacttgaaccccgaggacttctgggagatcatcggtgaactgggggatggcgccttcgggaaggtctacaaggctcagaataaagaaacctcagtcctggcggctgcgaaagtgatagacactaagagtgaagaagagcttgaggattatatggttgagatagacattttagcctcctgtgaccacccaaatatcgtgaaactgctggacgccttctactatgagaacaatctgtggattctcattgaattctgcgccggcggggctgtggacgcagtaatgctagagctcgagcgtcctctaactgaatcacagatacaggtagtttgcaaacagaccctcgacgctctgaactatttgcatgataacaagataatacacagagatctgaaggccggcaacattcttttcaccctagacggggatatcaagctcgccgatttcggcgtgtccgctaaaaatacacgaaccatccagcgtagagatagcttcataggcacgccatactggatggcaccggaagtggtcatgtgtgaaaccagtaaagaccggccttacgactacaaggccgatgtctggagcttaggaataaccctgatcgagatggccgagattgagcccccccaccatgaactgaaccctatgcgggttctgctgaagatagctaagtcggaaccccccaccttagcccaacctagtcggtggtcctccaacttcaaggattttttgaagaagtgtcttgaaaagaatgtggatgccaggtggacaacctcccagctcttacagcacccattcgtgaccgtagatagcaacaagccaattagagagcttatcgccgaggccaaggctgaagtcaccgaagaagtggaggacggcaaggaagaagatgaggaagaagagacagagaatagtctgcctatccccgcctccaagcgcgcgtcaagtgacctctcaattgcctcctcggaggaggataaactcagtcagaatgcctgtattttagagtccgtttccgagaaaacagagaggagtaactccgaggataaacttaacagcaaaattctgaacgaaaaacccacaacagacgagcctgaaaaagccgtagaagatatcaacgagcatatcactgatgctcagttggaagcgatgactgagctacacgaccgcacagccgtgatcaaggaaaacgaacgggagaaacgccccaagcttgaaaatttaccagacaccgaggaccaggagactgtcgatattaatagtgtcagcgagggcaaggagaataatatcatgatcaccctcgaaactaacatagaacacaatttgaagagtgaggaggaaaaagaccaggaaaagcagcagatgttcgagaacaagctgattaaaagtgaggagattaaggatactattctacaaactgtagatctcgtcagtcaggagacaggggagaaggaggccaatatccaagccgtggattccgaggtgggcctgactaaggaagatacccaagaaaagctgggtgaagacgataagactcagaaagacgtcatcagtaacacctcggacgtgatcggaacctgcgaagctgctgatgtcgcgcagaaagtggatgaagactccgctgaagacacgcagtccaacgacggcaaggaagtcgtcgaagtgggccagaagttaataaataaacccatggtcggaccagaggcagggggaaccaaagaagtccccatcaaagaaatagtcgagatgaacgagattgaggaagggaaaaacaaagaacaggccattaattcctctgagaacatcatggacataaacgaagagcctggaaccaccgaaggagaagagatcaccgaaagttccagtacagaagaaatggaagtgcgttccgttgtggccgacaccgaccagaaagccctgggctcggaagtacaggacgcctcgaaggtgacaacacagattgacaaagagaaaaaagagataccggttagcattaaaaaagaacccgaggttaccgtggtgtctcaacctactgaacctcagcctgtcttgatcccgtcgatcaacatcaattctgatagcggtgaaaacaaagaggaaattgggagtctgtctaagacagagacaatcctgccccccgaatcagaaaaccctaaggagaatgataacgatagtgggactggcagcaccgccgacacctcttctatcgatttgaacctgtcaatttcatcatttttaagtaaaacaaaggactcagggtccattagtctgcaggagaccagacggcaaaaaaaaaccctgaaaaagacgaggaaatttatcgtggatggagttgaggtcagtgtgacgacttcgaagattgtgaccgattctgattccaagaccgaggagttgcgcttcctaaggagacaagagttacgagagcttcgctttcttcaaaaagaggagcagcgcgcacaacagcagctgaacagcaaattgcagcagcagcgcgaacaaatctttcgccgtttcgaacaggaaatgatgtccaagaaacgtcagtatgatcaggaaatagaaaacctggagaaacagcagaagcagacaattgaacgtctggagcaggagcataccaatagactgcgagatgaggccaagcggatcaagggtgagcaggaaaaagagctgagcaaattccagaacatgctaaagaataggaaaaaggaggtcataaacgaggtcgagaaggcccccaaggaattaagaaaagagctaatgaagcgccgcaaggaagagctggcccagtctcagcatgcccaggagcaagagttcgtgcaaaagcagcagcaagaactcgatggatccttgaagaagataatacagcagcaaaaggccgaactggcaaacatagaacgagagtgcctcaacaacaagcaacagctgatgcgggccagggaagcagccatttgggagctcgaagagcgacacctgcaagagaaacatcagttgttgaaacagcagcttaaagaccagtacttcatgcagaggcaccagctgcttaagcgccatgagaaggagacagagcagatgcagcgctataaccagagacttatagaggaactgaaaaatcgccaaactcaggagcgagcacgtcttcccaagatacagcgttctgaagccaaaaccaggatggcgatgttcaaaaaatccctgcgtattaactccactgcaaccccagaccaggatagggacaagatcaagcaattcgctgcccaggaggagaagagacagaaaaacgaacgcatggcccagcatcagaaacacgagaatcagatgagggatctgcaattacagtgcgaggctaacgtcagagagctgcaccaactgcagaacgaaaaatgtcatttactggtcgaacacgagacacagaaactcaaggagctcgacgaagagcattcacaggagttgaaggagtggcgagaaaaattgaggccacgcaagaagaccctcgaagaagaattcgctaggaaactccaggagcaagaggtttttttcaaaatgaccggggagagtgagtgtcttaatccatctacccaatcgcggattagcaagttctatccgatcccctcgcttcattcaacaggtagttag

SEQ ID NO: 26510 - DNA, 3444 bp, Artificial Sequence
  Description of Artificial Sequence: Synthetic coding sequence
atggacgagccccccttcagcgaggccgccctggagcaggccctgggggagccatgcgacctggacgccgctcttctgaccgacattgaggacatgctgcagctcatcaacaatcaggactcagactttccaggactctttgatcctccatacgctggatcaggggctggagggacagaccccgcttctccagatacctcctcccccgggagtctgagccccccccctgcaaccttgtcctcaagtctcgaggcattcctctccggcccacaggccgcccctagtcctctctcgcccccccagcctgctcccactcccctcaaaatgtatccatctatgccagcgtttagcccgggccccggtattaaagaggagtccgtgcccctctctatactgcaaacccccactccacaaccactgcctggcgctctattgccccagtccttccccgcaccagctcccccgcagttttccagcacccctgttttaggttatccatcgcctccaggcggcttcagtaccggctctccacctggcaacactcagcagcccttaccgggtttgcctctggccagccccccgggggtaccccccgtgtctttacatacccaggtacagtccgtggtccctcaacaactcctgacagtcaccgctgcccccacagcggctccagtcactacaactgtgacttcacagattcagcaggtgccagtcttacttcagcctcacttcataaaagccgattcgctcctgctcactgcgatgaagacagacggcgccactgttaaggccgctggcctgagccctttggtttctggaactacagtgcaaacaggacccctgcctactctagtatctggaggcaccattctagctactgtgcccctggtggtcgacgccgaaaagctgccaatcaatcgcctggccgctggaagcaaagcccctgcatctgcgcagtctcgaggggagaaaaggaccgcacacaacgcgatagagaaacggtaccggtcctcaattaacgacaagattattgagctgaaggacctcgtggtggggactgaagccaaactgaacaagtcagccgtacttagaaaagctatagactacattagattcctgcagcattccaatcagaagttaaagcaggagaacctgagtctgcgaaccgccgtgcacaaaagcaaaagcctgaaagaccttgtatctgcatgtggcagcggcggtaataccgacgtgttaatggaaggggtaaaaactgaggtggaagacaccctcaccccccccccaagcgatgctggaagtccctttcagtcatctccactaagcctcggcagcagaggctccgggagtggtggaagcggctcagactctgagcccgattcaccagttttcgaagatagcaaggccaaacccgagcagaggccctcgttacactccagaggaatgttggatcggtctcggctggcactctgcaccttggtattcctttgcctcagctgtaacccattagccagcttgctcggcgctagaggtctgccatctccttctgacacgacctccgtgtaccattccccaggtagaaacgtgcttggcaccgagagtagggatgggcctggctgggcacagtggttgctgccgccagtagtctggttgttgaacggtctgcttgtgttggtctccctcgtactactgttcgtctacggcgaacccgtcacgcggcctcattctggcccggcagtttacttttggcgacatagaaagcaagcagatctggatctcgctcgtggggattttgctcaggcagcccaacagctgtggctggcactccgcgcactgggcaggccactacccacgtctcatctggacctcgcttgctcactgttgtggaacctcatccgacacctactgcagaggctgtgggtggggagatggctggccggccgtgcagggggcctccaacaggactgcgctctcagggtcgacgcctcagccagtgcaagagatgcagccctggtgtaccacaagctgcaccagctgcatacgatgggtaaacatactggcggacacctgaccgccaccaatcttgccctctccgcactgaacttggccgagtgcgctggggacgctgtaagcgtagcaactctagccgagatatacgtagcggctgccctacgggtaaagacctctctgccaagagctttgcacttcctcacccggttcttccttagttctgccaggcaggcttgtctggcccagagcggatcggtcccgccggctatgcaatggctctgccatccagtgggccataggtttttcgttgacggcgactggtccgtgttatctacaccatgggagagcctgtacagtcttgcgggaaatcctgtggatcccctggctcaggtgacacagctttttagagaacacctcctggagagggctctgaactgcgttacacagccaaatccctcccccggcagtgccgatggcgacaaggagtttagtgatgctttggggtacctgcagctgctcaattcatgcagcgatgccgccggggcccccgcgtactccttcagtatctcctccagcatggcaacaactacaggggtcgaccccgtagcgaagtggtgggcttccctcactgccgtggtgatccattggctgcgtagggacgaggaagccgcggaacgtctgtgtcccctggtggaacatttgccaagagtgctacaagagtctgagaggccactgccacgggctgccctacattccttcaaagccgccagggctctcctgggctgtgccaaagccgaaagtggtccagcatccctgaccatctgtgagaaagcatccgggtacctgcaggatagcctcgcaaccacccctgcctctagctcaatagataaggcagtgcaattgttcctgtgcgacctgctgctcgtcgtgcgaactagcctgtggcggcagcagcagcccccagctccagcccccgcagcacagggaacatcgtcaagaccacaggcttcagctcttgagctgcgggggttccagcgcgacctcagctccttgcgacgcctggcgcagagcttccgcccggcaatgcgaagggtgtttctgcatgaggcgacagcccgtctgatggctggggcaagccccactaggacacatcagcttctggatcgctcacttcgaagaagggcaggaccgggagggaagggaggggctgtcgctgagttggaacccagacccaccagacgcgagcatgctgaggccttgctgctggctagctgttatttacctccaggattccttagcgcaccagggcagagggttggcatgctggccgaagccgcccggaccttagagaagttgggtgataggcgattgctccacgactgccagcaaatgcttatgcgactcggcggtgggacaaccgtcacaagttcatag

SEQ ID NO: 26511 - DNA, 3216 bp, Artificial Sequence
  Description of Artificial Sequence: Synthetic coding sequence
atggacgagccccccttcagcgaggccgccctggagcaggccctgggagagccatgcgacctggacgccgcgctcctcacagacattgaagacatgctccagctgatcaataatcaggatagcgattttccaggtctcttcgatccaccctatgccggatcaggagccggtggcactgatcccgccagtcccgacacctccagcccaggctccctgagcccaccacccgccactctgagttcctcgcttgaggccttcctcagcggaccacaggcagccccctcgcccctgtcccccccacagcctgcccccactcccctcaagatgtatccgagtatgccagctttttcgccagggcccggcatcaaggaagaaagcgtgcctctgagcatcttgcagacacctacgccccagcctctgcctggtgcgctgcttccccagtctttccctgcgcctgccccccctcagttcagctctacaccagtcctgggctacccttctccaccaggcgggttttccaccggatctccccctggcaatacccagcagccccttccaggactgccactcgcctctcctcccggcgtgccccctgtctctctccacacccaggttcagtcagtcgttcctcagcagcttctgactgtcaccgccgctcccaccgccgctccggtgaccacaacagtgacttcccagattcagcaggtgcccgtgctgctacagccgcatttcataaaggcggatagccttctgctgaccgccatgaaaacggacggcgctacggtaaaggccgctggcctgtctccccttgtatccggcacaaccgtccagactggaccccttcctaccttagtgtccggtggaacgatactggccactgtaccgctggtggtggatgccgagaaactgcctattaatcgtctagctgctggatcgaaagcaccagcctcagctcagagccgtggggagaagcggaccgcccataacgcgatcgaaaagagatatcgctcgtctattaatgataaaatcattgaactgaaagatttggtggttggaacggaagctaaactcaataagtcggcagttctgcggaaggccatcgactacatcaggtttctgcagcatagtaatcaaaagctcaaacaggaaaatctctccttacggacggccgtgcataaatctaagtcgctcaaagatctggtgtctgcttgcggctctgggggcaatacagacgtcttgatggagggcgtaaagaccgaagtggaggacaccttaactccccccccttcagacgccggatcgcccttccagagcagcccactgtccttaggtagccgcggctcgggatccggtggctctggcagtgactccgaacccgacagtccggtttttgaggacagcaaagctaaaccagaacagcgaccttccctgcacagtcggggaatgctggataggagtagactcgccctatgtaccttagtgtttctctgtctgagctgcaatccacttgcttctctgctgggcgctcgcggcttgccatctccctccgataccactagcgtttatcacagccccggaaggaatgtattggggactgaatcccgagacgggcctggctgggcgcaatggttgctgcctccagtggtttggctgctgaacggcctgctagttttggttagccttgtactgcttttcgtctatggcgagcctgtgacccggcctcactccggacctgcggtctacttctggcggcatagaaaacaggctgaccttgatctggcccggggggactttgctcaggcagcacaacagctctggctggcactccgtgcactggggaggcccctgccaacttcgcaccttgatttagcctgcagcctgttatggaacctgatcaggcaccttctgcagaggttgtgggttggaagatggctggctggaagggccggcgggctccagcaagactgcgctctgagagtggatgcatcagcgtcagctcgcgacgccgccctggtataccacaagctgcaccagttacacacaatgggtaaacatactggaggccatcttacagccacaaaccttgccctgtccgccctcaatttggccgagtgcgccggcgacgctgtctccgttgcgacactggccgagatttatgtcgccgcggccctaagagtcaagaccagtttgccccgggccttgcattttctcactcgcttttttctctcttccgctcgacaagcttgtctcgcccagtctggtagcgtgcccccagccatgcaatggctgtgccatcccgtgggccaccgcttctttgtggacggagactggtcggttctgtctaccccctgggagtcgctttacagtctagctggcaaccccgttgacccattggcccaggtcacccagcttttccgcgaacacttacttgagagagcactgaattgcgttacccagcctaatcccagtcctggatcggcagatggggacaaagaattctccgacgcgttaggctacttacagttgctgaattcatgtagcgacgctgcgggtgcgcccgcttattccttttctatctcttcaagtatggccacgaccactggtgtggatccagtggccaagtggtgggcctcccttacagccgtggtgatacattggctcagacgggacgaagaagccgccgaacgcctttgccccctggtcgaacacctgccccgggtgctgcaagagtccgagcgaccactgccccgcgccgctctccattcttttaaagctgcgagggcactgttgggctgtgccaaagctgaatctggaccagcctctctgacgatctgtgagaaagcatccgggtacctgcaggactccctggccacaacccctgcaagtagcagcattgacaaagccgtacagctgttcttgtgtgacctgctgctggtggtcaggacaagtctgtggcggcagcagcagcctcctgccccggctcctgcggcgcaaggaacatctagcaggccacaggcttcagctctagaactgcgggggttccagcgagacctctcttctcttcggcgcctcgcccagagtttcaggccagcaatgcggagattgatggatgtcctgaccagcgagtcggcctgggcccttcctcagcacctgggcaaaggttttcccagccctagcggacacaaagtgcctggatggcatggtagaatggactag

SEQ ID NO: 26512 - DNA, 3534 bp, Artificial Sequence
  Description of Artificial Sequence: Synthetic coding sequence
atggacgagccccccttcagcgaggccgccctggagcaggccctgggagagccctgtgatcttgacgctgccctgctgacagacattgaaggtgaagtgggggctggtcgagggagagcaaacggcctcgacgcacctcgcgcgggtgcagaccggggcgcaatggattgcacattcgaagacatgctccagcttataaacaatcaggattccgacttcccaggtctctttgaccccccatatgcgggatccggggccggggggacggatcccgctagccctgataccagcagccctgggtccctttctcctcccccggcgacattatcctcctcattagaggcatttctctctgggccacaagccgccccttcacccttatccccaccccagccggctcccacgccactcaagatgtacccttcgatgccagccttctctcctgggcctggcatcaaggaggaatctgttccactatctatactgcagacacccacaccccagcctctgccaggagcgctgctccctcagtcatttcctgcccctgccccacctcagttctcgtccacacccgtcctgggctatccttctccccccggtggcttcagcaccggttcccctcctggcaatacccaacaaccgttgcctggactccccctagccagtccgcccggggtaccaccagtgagtctccacacccaggtgcaaagcgtggtgcctcagcagctgcttacagttacagccgccccaaccgcagcacctgtcaccactacggtcacgtcgcagatccagcaggtgcctgttctcctgcagccacacttcatcaaggctgactcgctgcttctgaccgcaatgaagacagatggtgcaacagtgaaggctgccggattatcccctctggtgtccggtacgacggtccagactggtccactgcccaccctggtaagcggcggaaccattctggccaccgtgcctctggtggtcgatgcagagaagctccctataaaccgtctggccgctggttccaaagctccagcctctgcgcaatctagaggagaaaagcgcacagctcacaatgccatcgagaagcgctacagatcctccattaacgataaaatcatcgaactcaaggatctggtggtcggcacagaggcaaaattaaataagtcagctgtactccggaaggcgatcgattatatccggttcttgcagcacagcaatcagaagctcaaacaggagaatctgtccctcagaacagctgtacacaaatcaaaaagcctgaaagatcttgtttccgcttgcggaagcggaggtaataccgatgtactgatggagggcgtgaagactgaagtggaagacacgctgacaccgcccccctcagatgccggaagcccctttcaatcttccccgctaagtctgggttcgcgcggcagtggctctggggggagtggctctgattctgaacctgattctccagtgttcgaggactccaaagccaaacctgagcagcggcctagcctccactcaagaggaatgctggatagatccaggctcgctctgtgtactctggtgtttttgtgtctctcatgcaaccctcttgcctctctgctgggcgcacgaggcctgccttcaccatcagacactacttctgtctatcactcgcctgggagaaatgtactcggcactgaatctagagatggcccaggctgggcgcagtggctacttcctccagtggtgtggctgctcaatgggctacttgtcctcgtgtccctcgtattactttttgtctacggtgagccagtgacccgcccacacagcggccctgccgtctatttctggcggcatcgtaagcaggctgatctggacttggcaagaggcgatttcgcccaggctgcccagcaactgtggcttgctctgagagccctgggacgaccactccccacgagccacctggatctggcctgcagtctgttgtggaacctaatacgacacttactgcagcgtctgtgggttggacgctggctggcgggaagggctggcggtctccaacaggactgcgccctgcgcgtcgacgcgtccgctagcgcacgtgatgcggctctggtataccataagctccaccagctgcacacaatgggaaagcacacaggaggccaccttacagcaaccaatctggccctgtcagccctcaaccttgcagagtgtgcaggagacgctgtgtctgtggcaaccctggctgagatttacgtcgctgcagctttgagagttaaaacctctcttccacgagctcttcattttctgacccgatttttcctgtcctctgcccgtcaggcgtgcctggcccagtctggcagcgtcccgcctgctatgcagtggctgtgccatcccgttggccataggttttttgtcgacggcgactggagcgttttgtccactccgtgggaaagtctttattcattggctggaaacccagtggatccactcgcccaagttacgcagcttttccgagaacacttacttgaaagagccctgaactgtgtcacccagcctaatccaagtccagggagtgccgacggagacaaggaatttagcgatgctttagggtacttgcagctgctaaactcttgcagtgacgcagctggtgctcccgcatattccttcagcatcagttcatccatggctactactactggggtagatcctgtagcaaaatggtgggcctctttaaccgccgtggtgattcattggcttagaagggacgaggaggcggcagagaggctttgtccactggttgagcacctccctcgggtgctgcaggagagcgaaagaccactgcctcgggctgccctgcattcattcaaagccgcccgggccttgttgggctgtgcaaaggccgagtcaggacccgcctcactgacaatctgtgaaaaggcatccgggtacctccaggactccctcgcaacaacaccggcctcctcatccattgacaaggccgtgcagctgtttctctgcgacctgctgctggtggtaaggaccagcttatggcggcagcaacagccaccggcccccgcaccggccgcacaaggcactagcagccggcctcaggcctcagcccttgagttgaggggattccaaagggacctgtcttctctgcgccgactcgcacaaagcttccggccagctatgaggcgagtatttcttcacgaggccaccgcgcggctcatggctggagcttcgccaacacgtacacaccaattgctggataggtccctcagacgacgagctggccccggcggtaagggcggagctgtagctgagctggagccccgcccaacgagacgggagcacgcagaggccttattactagcctcctgctacctgcccccaggcttcctcagtgccccgggccagcgggtcggaatgctggctgaagcggcaaggacactcgaaaaattgggtgacaggagattgttgcacgattgtcaacagatgctgatgagactggggggcggcaccacagtgacctcttcctag

SEQ ID NO: 26513 - DNA, 3468 bp, Artificial Sequence
  Description of Artificial Sequence: Synthetic coding sequence
tgaaagatccggcgggccctgaccggcgaggtgggcgccggccggggtagagcaaacgggcttgacgctccccgagccggagccgatagaggcgcaatggactgtacattcgaggatatgttgcaattgattaataaccaggattccgactttccaggcctgtttgaccccccctatgctggaagtggagcaggcgggaccgaccccgcatcccccgacacatctagccccggctcactgtccccaccaccggcaaccctttcttcttcgctggaagctttcttatcaggcccccaagctgcccccagcccgttgagccctcctcagcctgcacctaccccacttaaaatgtacccaagcatgcctgccttttcccctggcccagggatcaaggaagaatccgtgccactgtccatactgcagaccccaaccccccagccccttccaggggcccttctgcctcagtcctttcccgcgcctgcacccccacagttttcctcaactccagtgctggggtacccttctccaccaggcgggttttctaccggttcgcctcctggtaatacacagcagccactgccaggactgcctctggcctccccacccggggtgcccccagtgtccctgcacacccaggtgcagagtgtggtaccccagcagttgttgacagtgaccgccgctcccaccgccgctccagtcaccacaacagttacctctcagatccagcaggttccagtgctgcttcagccacacttcatcaaggcagactctttgctgcttacagccatgaaaactgatggcgcgacagttaaggccgccggactgagccctctagtctccgggacgacagtgcagaccggacccctcccgactctcgtgtccggcggcaccattcttgccaccgttccactggtggtggatgcagaaaaattacccattaaccggctagcggccggctcgaaagcccctgcttccgcgcaatctcgaggcgaaaaacgaaccgcccacaacgctattgaaaaacggtacaggagctccatcaatgataagattatcgagctcaaagatttagtcgtaggtactgaggcaaagctgaataaatctgctgtgctgcggaaagcaatcgactacataaggtttcttcagcacagcaatcagaagctgaagcaggaaaacctctctcttcggaccgccgttcacaagtccaagtcactgaaagacttggtgagcgcatgtgggtcaggcgggaataccgatgtccttatggaaggcgtgaaaaccgaagtggaggataccctcacccccccaccttctgacgcgggaagcccatttcaatcctctcccctgtcactgggatctcgcggctctggtagtggcggctccgggagcgatagtgaaccagacagtccagtttttgaggatagtaaagccaaaccggagcagcgaccctccctgcattctagagggatgctcgacagatctaggctcgccctctgcacactcgtcttcttatgcctgtcttgtaaccctctggctagtctcctgggcgcaaggggcctaccatccccttcagatacaacatccgtttaccactctcctggtagaaatgtactgggaacagaatcccgggacgggcccggctgggcccagtggctgcttccccctgtggtgtggttactgaacgggcttctcgtgctcgtgtccctggtcttgctctttgtgtacggcgagccagtaacaagaccccactctgggccggcggtgtatttctggcgccacaggaaacaagcggacctggatcttgcaaggggcgactttgctcaagccgcacaacaactgtggctggcccttagagctttaggccggcccctccctaccagtcacctggatctggcctgtagcctactgtggaacctcattcggcatctgttgcagagactttgggtgggtcgctggttggcaggtcgcgctggtggtttgcagcaggattgcgcgcttcgagtggatgcgtcagcttcagctcgcgatgccgcactggtttatcacaagctgcaccagttacacacaatgggaaaacacactggtggccatctgactgcaacaaacctggctttgtctgcactcaaccttgcggagtgtgccggcgatgcagtcagcgtggccaccctggccgagatttacgtggccgctgcgctgcgagtcaagacttcgctgcccagagccctccactttctgaccagattcttcctctccagtgcacggcaggcctgcctagctcagtccggatccgtccctccagccatgcaatggctctgccatcctgtgggccatcgctttttcgttgatggcgactggagtgtgctcagtaccccctgggaatcactgtacagtctcgccggtaacccagtagaccctctggcccaggtcacacagttgtttcgcgaacacctgctggagcgggctcttaactgcgttacgcaacccaatccctcaccaggttcggccgacggggataaagaattcagcgatgcgcttgggtacctgcaactgctcaacagttgctctgatgctgccggggcccccgcgtacagtttctcaatcagctcttcaatggctaccacaaccggcgttgaccccgttgccaagtggtgggcaagcctgacagctgtcgttattcactggctcagacgggacgaggaggccgccgaacgtctgtgccccttagtcgaacatttaccaagggtgctgcaggaatcagagaggccactgcctagagcagccctgcacagctttaaggccgcgagggccctcttgggatgtgccaaggcagagtctggccccgcttccctcacaatctgcgagaaagcttcaggatacttgcaggattccctggcgacgactcctgcttccagtagtatcgacaaggccgttcagctttttctgtgcgacttgttgttagtggtgagaacttccttatggcgccaacagcagccacctgcccccgcccccgcggcacaaggaacctcaagtaggccgcaagcctcggccctggaactgagaggatttcagagagacctgtcctccctgaggcgtctggcccagtcttttcggccggcgatgcgacgggtattcttacacgaagcaacggctagactgatggccggagcctcccccacgaggacccaccagctgctggatcggagcctccgcagacgggccggccccggtggaaaggggggcgccgtggccgagctggagccacgccccactcgccgtgagcacgctgaggctctccttttagctagctgttacctccctccaggtttcctttccgcacctggccagcgcgtcgggatgttggctgaggctgccaggaccctggaaaagctgggcgaccgtaggctgttacacgactgccagcagatgttgatgcggctgggaggaggtactacagtcacaagcagttag

SEQ ID NO: 26514 - DNA, 2301 bp, Artificial Sequence
  Description of Artificial Sequence: Synthetic coding sequence
atgctggcccacctgagccgggccgccccctgccccctggccgccggcgcggtggccgctgtggccgtggcagtcacccgatcattgacggctcaatctctccggaccgccagacttgggcctgcgacggtgccaccttcaccccttcccgcaatcagcagcgaaccacacgatagggccgggaagactctgaccgaccccactagtcattttattgatcgcattaccgaagcctggtcccacgtgggatctcactccaaggccaagccagagcagcgacccagcctacatagccgaggcatgctggaccgttcaagattggctctgtgcactctggtctttttatgtctgagttgcaatcctctggcgagccttttgggagccagggggcttccttccccatcagacacgaccagcgtctaccactctccgggacggaacgtgctaggtacagagtccagggatggccctggctgggcccagtggttgctccctccagtcgtttggcttctcaatggacttctcgttctagtcagtctcgtactgctcttcgtttacggagaacctgtgacacgccctcattcaggccccgccgtgtatttctggcgccatcgtaagcaggccgatctggacctggcaaggggagacttcgctcaggcagcgcaacagctgtggctagctttgagagcacttggccggcccctgccaacctcccaccttgacctggcatgctctctgctgtggaatctcatccgccatctcctgcagcgtctatgggttggtcgttggctggccgggcgcgccgggggactacagcaagattgcgccctgagagttgacgctagtgccagtgcgcgagatgctgcactcgtataccacaagctgcaccagctccacactatggggaaacataccggaggccaccttaccgccacaaacctggctctgtctgcattgaacttagcagaatgcgccggagacgctgtctccgtggctaccctagccgaaatatatgtcgcagcggccttgagggtgaagactagtctgccccgcgcactccacttccttacacgctttttcctgagcagtgcccggcaggcatgcctggctcagtccggcagcgtaccccccgctatgcagtggttatgccaccctgtcgggcacagattcttcgtggacggtgattggagcgtgttgagcaccccctgggagagtttatatagcctggccggcaatcctgtcgatccccttgcccaggtgacccagctttttagagaacaccttcttgagagggcgttgaactgtgtaacccagccaaacccctcccccggctctgcggacggcgataaggagttttccgatgcactgggttatttacagttactcaatagttgcagtgacgcagcgggtgcccctgcttacagtttctccatctcatctagtatggccacgacaacgggtgtagatccagtagcaaaatggtgggccagtctcacagctgtcgtgattcactggctgagacgggatgaggaggccgctgaacgcctctgccctctagtcgagcacctgcccagagtgttgcaggagtctgagcgcccattgcctcgcgccgccctgcacagtttcaaagcagctcgcgcccttctgggctgtgccaaggccgaatctggccccgctagcctgacgatctgtgagaaggcttctggctacttacaggatagtctcgcaacaactcctgcatcctctagcatcgataaggcggttcagctctttctatgcgatctgctgctagtggttaggacctctctatggcggcagcagcagccaccagcacctgcccctgctgcccaggggacaagcagccggccgcaggcctcagccctcgaactcagagggttccaacgtgacttgtctagcttgcgtcggcttgcccagtcatttaggcctgccatgcgccgggtctttctgcacgaagccacagccagactgatggcaggggcttcacctacccggacccaccaattgttggacaggagtctgcggagacgggcaggacccggaggcaagggaggcgcggttgccgagctggaacccagacctaccaggcgggaacacgccgaggctctactcttggcttcttgctatctgcccccgggcttcctgagtgcgccgggccagagggtaggcatgctggctgaggcagcccgcaccctggagaaacttggcgacaggcggcttctgcatgactgccaacaaatgctgatgcgcctgggtgggggcaccaccgtcacctctagctag

SEQ ID NO: 26515 - DNA, 2682 bp, Artificial Sequence
  Description of Artificial Sequence: Synthetic coding sequence
atgaagaccgacggcgccaccgtgaaggccgccggcctgagccccctggtcagcggcactaccgtccagactggccctctgcctactctggtaagtggggggactatcctggccactgtccctctggtggtggacgcagagaagctgccaatcaacaggctagccgccggcagtaaagcgccagctagcgcgcagagccggggcgagaagcggacagcgcataacgcaatagaaaagcgttaccgcagcagcatcaacgataagatcattgaattgaaggatctggttgtgggtactgaagctaagctgaataaaagcgccgtcctcagaaaggcaatagattatattcgattcctgcagcactccaaccagaagcttaagcaggagaacctgagtcttaggaccgccgtgcacaagtcgaagtctctgaaagatctcgtgagcgcatgtggcagtggcggcaacactgacgttctgatggagggagtgaagacagaggtcgaagacacactgaccccacctccgagcgacgcaggctccccttttcagtcaagtcccctctccctcggatctcgcggatccggttcaggtggatcagggtcagattccgagccggacagcccggtgttcgaagactcaaaggcgaagccagaacagcgcccatcattgcacagtagagggatgctggacaggtcccggttagcactgtgtactctcgtcttcctgtgcttatcatgcaatcccctggcttccctcctgggggccagagggttgccgagccccagcgatacaacaagtgtctaccactctcccggacggaacgtgctaggaacagaaagccgggacggtcccggatgggctcaatggctgctgcctcctgttgtctggctgcttaacgggctgttagtgctggttagccttgtgttactgttcgtttatggggagccggtgacacggccacactctggtccggccgtgtatttttggcgacatcgaaagcaagctgatcttgatttagcccgtggcgactttgcccaagcagcccaacagttgtggctcgccctccgggcattggggcgacccctacccacctcccacttggatctggcctgctccctgctctggaatctcattcgacacctgctgcagaggctctgggtggggcgctggctggcggggagagccggaggtttacagcaagactgcgctctacgcgtcgacgccagcgcctcagctcgcgacgcagctctggtgtaccacaaattacaccagcttcatacaatgggcaagcatactgggggccatctgactgccactaacctcgcactcagtgcgctgaaccttgcggagtgtgctggcgatgccgtttccgtggcgactcttgctgagatctacgtggcagcagcactgagagtgaagactagcttgccaagagccttgcatttcctcacaagattcttcctgagttccgcccgccaggcctgccttgcccaaagcgggagcgtgcctccagctatgcagtggctttgccatccggttgggcataggttttttgtcgatggcgactggtctgtgctttccacaccctgggagtccctctattccctagctggaaatccagtggaccccctggcccaggtgacacagctgttccgtgaacatctccttgaaagagctctgaattgcgtgactcaacccaatccatcacctggatccgctgatggtgataaggagttcagcgatgccttaggatatctgcagcttctgaactcctgctcagatgcggccggtgcacccgcttatagctttagtatttcctccagtatggcaacgacaacaggtgtggatcccgtcgctaagtggtgggcctctctgacagctgtggtgatccattggctccggagggatgaggaagcggctgaacgcctctgccctctagtggaacacttgccgcgcgttttgcaagagtcagagagacctctcccacgagctgcactccactcttttaaggctgccagggcactgctgggctgtgcaaaggctgaatcgggccctgcgtccctcaccatctgtgaaaaggctagcggttacctccaggatagcctggccactacccccgcaagttcctcaattgacaaggctgtccagctgttcctttgcgatcttctgctggtggtgagaacgtccttgtggagacagcagcagccacccgctcctgcccctgctgcacagggaacaagcagtaggccgcaagccagtgctctcgaacttcgcgggtttcagcgagatctgtcctctttgagaagactcgcgcagtcattccggcccgcaatgcggcgagtttttctccatgaggccactgccaggctgatggcaggcgcctccccaactagaacccaccagctgctggatcggtctctccggaggcgcgccggacccggtggtaaaggaggtgccgtcgccgaattagagcctcgacctacccgcagggaacacgccgaagccctgctattagctagttgctacctgccccccggattcctctcagctcccggccaacgggttggcatgttagccgaggccgcacggaccctggagaaactgggggaccgccgcttgcttcacgactgtcagcaaatgctgatgcggctcggcggagggacaactgtgacatccagctag

SEQ ID NO: 26516 - DNA, 2955 bp, Artificial Sequence
  Description of Artificial Sequence: Synthetic coding sequence
atggactgcaccttcgaggacatgctgcagctgatcaacaaccaggatagtgacttccctgggctgttcgacccaccgtacgccggcagtggagcaggtggtacagaccctgcttccccggatactagctctccaggctccttgtcaccccctcccgccaccttgtcgtccagtctggaagcttttctgtccggtccacaagcagctccaagtccccttagtcctccacagcccgctcccacccctctgaagatgtatccctccatgcccgctttctcaccaggacccggaattaaggaagagtctgtccctctttcaatcctccagacacccacaccccagcccctgccagtacctaccctggtttcgggcgggacaatcctagccacagtgcccctggtggttgacgcagagaagctgccaattaatcggctcgccgctgggtctaaggccccagcatctgcacagtctaggggagaaaagcgcacagctcataacgcgatagagaaaagatatcgtagttccataaatgataagattattgaattgaaggatctcgtcgtcggaaccgaagctaaactgaataagagcgcggtgctccgcaaggcaattgactacatccgatttctgcaacatagcaaccaaaagctgaagcaagagaatttgtctctgcggactgcggtacataagtctaagagtctcaaagatctggtgtcagcttgcgggtcaggcggcaacactgacgtgcttatggagggtgtcaaaaccgaggtagaggatactctgaccccgcccccttccgacgccggatcgccttttcagtcctccccactgagcttgggatctcggggatctggatcaggcggctcgggctcagattcggagcctgacagtcccgtattcgaagactccaaagcgaagccggagcagagaccaagcctgcactcaaggggaatgctagataggtcaaggcttgccctctgcactttggtctttctgtgcctgtcatgtaacccgttggcctccctcctgggagcacggggcctgcccagtccctctgacaccacaagtgtttatcactccccaggcaggaatgtgctcggcaccgaaagcagggacggtcccgggtgggcccaatggctactgcccccagtggtctggctactcaatggcctgttagttttagtaagcctagtgcttctgtttgtctacggggaacccgtgaccaggccccattcgggccccgcagtgtacttttggcgccataggaagcaggccgacctggacctcgcacgaggagacttcgcccaggcggctcaacagctctggttagctctacgagccctgggacggccgcttcctacatcacatctagacctcgcgtgttccctcctctggaacctgatcagacatctgctccagcgattgtgggtggggagatggttggccggccgagccgggggactgcaacaggactgtgccctccgtgtggacgcatcagcttcagctagagacgctgctctggtatatcacaagctacaccagctgcatactatgggtaaacacaccgggggtcaccttaccgccaccaaccttgccctcagtgcactcaacctcgctgagtgtgcgggtgacgctgtgtcagtcgctacacttgcagaaatttacgtggccgctgccctgagggtcaaaacaagcttgccccgcgcgctgcatttcctaactcggtttttcttgtccagcgctagacaggcctgcctcgctcaaagcggatccgtgcctcctgcaatgcagtggttgtgccaccctgtaggccacagatttttcgtggacggagactggagcgtgctaagcacaccctgggaatctctgtacagcctggcgggaaacccggtcgatccactcgcccaggttacacagctgttcagagaacacctactggagcgagctctgaattgcgtgacccagcctaacccctcccctggcagcgcggatggcgacaaggaattctcagacgccttgggctaccttcagctgttaaatagctgttcagatgcggcgggcgccccagcctacagcttttcaatcagctcctccatggcaaccactactggggttgatcctgttgccaagtggtgggcatctctgacggcagtcgtgatccactggttacgtcgtgatgaagaggctgcagagcgcttgtgcccattggttgagcacttacccagagttctccaggaatctgagaggcctctcccccgggccgcattgcattctttcaaagctgctagggccttacttggctgtgccaaagcagaaagcgggcctgcttcacttacgatttgcgagaaggcctcgggttacttacaggacagcttggctacaacgccagcgagttcttcaattgacaaggctgtgcagctattcctgtgcgacttactgctggtcgttagaacttccctctggcgacagcaacagcctcccgcccccgctccggctgcccaagggacatcgagtcggccgcaggcaagtgctctagaacttaggggcttccaaagggatctttccagtctccgcaggctggcccagtcatttcggcctgcaatgcggcgcgtgtttctccacgaggccactgcccgcctcatggctggggccagtcctacacgaacccaccagctgcttgatcgcagcctccgacggagagccggtcccgggggtaaaggaggcgctgtggctgagcttgagcctagaccaacccgcagggagcacgccgaggcattgctcctggcaagttgttacctcccccccggcttcctgtcagcacccgggcagagagtgggcatgctcgcggaagctgcccgcacgctcgaaaagcttggcgacagacgactactgcatgactgtcagcagatgttgatgcgccttggcggaggtaccaccgtgaccagctcctag

SEQ ID NO: 26517 - DNA, 3222 bp, Artificial Sequence
  Description of Artificial Sequence: Synthetic coding sequence
atggactgcaccttcgaggacatgctgcagctgatcaacaaccaggacagcgactttcccggcctctttgaccccccccagccagctcccactcccctgaagatgtatccatccatgcctgctttctccccgggccccggtattaaggaagagtccgtgcctctgagcatattacagacccccacaccccaaccactgcctggagccctgcttccccagtcattcccagcgccagccccccctcagttcagtagcacacccgttctggggtatccatcgcccccaggaggattttccactgggagcccgcccggtaacacacagcaacccttgcccggcctccccctcgccagcccgccaggcgttcctccagtgtctctacacacccaggtgcagagtgtcgtaccacagcagctgctgaccgtgactgccgccccaaccgccgccccagtcaccacaaccgtgacttcccagattcagcaagtccctgtcctactgcagccccacttcatcaaggcagattcattgcttttgaccgctatgaagacagacggagcgacggtaaaagccgccggcttgtccccacttgtcagcgggaccacggtgcagactgggccgctgcccaccttggtgtctggagggacaatcctggctactgtgcctctggttgtcgacgcagaaaagctgcctattaaccggctggccgctggatcgaaggcgcctgccagcgctcaaagccggggagaaaaaaggacagctcacaatgctattgagaaaagatacaggtcctcaattaatgataagattattgaactcaaggatctggtcgtgggtacggaggccaagctcaacaaatctgcggtgctgcgtaaagcgatcgactacattcgattcctgcagcattcaaatcaaaagctgaagcaggagaatctaagcctccgcactgcagtacacaaatctaaatctctgaaagatctagtgagtgcatgcggctccggcgggaacacggatgtcttgatggagggagttaaaactgaagttgaggatactcttaccccaccgccgtcagacgccgggtccccttttcagtccagcccacttagccttggctcccgcggtagtggatctggcggctctggtagcgactcagagcccgatagccccgtgttcgaggactctaaggccaagcccgagcagcgaccctcgctccattcaagagggatgctcgatcgctcccgcttggccctgtgcacattagtatttctctgcctgagctgtaatccactcgcttccctgttaggagctcgcggactgcccagtccaagcgatactacttctgtctatcactcgcctggccgcaatgttctgggtaccgagtcccgcgacggccctggctgggctcagtggttgctcccgccagtggtttggctgctgaacggactgctggtcttagtcagtttggtgctgctgttcgtgtatggcgagcccgtgacgaggccccacagcggtcctgcagtttacttctggcgtcacaggaagcaggcagatcttgacctcgcaagaggcgacttcgcccaagccgcccagcagctgtggctggcgctccgcgcacttggcaggcctctgcccaccagtcatctggacctagcctgctcacttctctggaatctgatacggcacttgctccagagactctgggtgggaagatggctggccgggagggctggcggattgcagcaggattgcgctctccgtgtcgacgcgtctgcttccgcacgggacgccgccctcgtataccataaattacaccagctgcacacgatgggcaagcacaccggcgggcaccttacagcaaccaatctcgccctttctgccctcaaccttgctgaatgcgcaggagatgctgtgtctgttgcaacattggccgaaatttacgtcgccgctgctctccgcgtgaagacaagcctacctcgagccctacactttctaacccgcttcttcctgtctagcgccaggcaggcgtgcctggcccaatccggctccgtgccccccgccatgcagtggctgtgccatcctgtgggccacagattcttcgttgacggagactggagtgtcctttccacaccatgggaatctctgtacagcctggccgggaatcctgtggatccattggcacaggtgacgcaactgttccgagaacatctgctagaaagggctcttaactgtgtcacgcagccaaacccaagtccagggagcgcggacggcgacaaagagtttagcgacgctctgggctatttgcagctcctaaactcctgctcagatgccgccggcgccccagcctattcgttctcaatttcgagtagtatggccaccacaaccggggtagacccagtcgccaaatggtgggccagcctcaccgccgtcgtgatacactggctaaggcgtgacgaggaggcagctgaaagactgtgtcccctggtggaacacctcccacgcgttctgcaggagtctgaacgcccacttcctagggctgctctccactcttttaaggcagctcgggcgttgctgggatgcgccaaggctgaatcgggaccagcaagtctgacaatatgcgagaaagccagcgggtatcttcaggatagccttgcaactacccccgcatccagttcaatcgacaaagctgttcagctcttcctgtgtgatctcctgttggtcgtcagaacaagtttgtggcggcagcagcaaccgccagcgcctgcccctgcagctcaaggaaccagctcgcgaccccaggccagtgcactagagttgaggggtttccagagagatctgtcttcactgaggcgtctggcacagagctttcgtcctgccatgcggagagtcttcctccacgaggcgactgcccggttgatggctggtgcctcaccgactcggacccaccagttgttggacagatccctgcggcgcagagcgggaccaggggggaaaggcggcgcggtagcagagctggagccacggccaactcggagagagcacgcagaagccttactcctcgcttcttgctatctcccaccgggctttctaagcgctccagggcagcgagtcgggatgctggctgaggccgctaggacccttgaaaaacttggagatagaaggctgcttcacgactgccagcaaatgttaatgagactgggggggggtaccactgtcacctccagttag

SEQ ID NO: 26518 - DNA, 1413 bp, Artificial Sequence
  Description of Artificial Sequence: Synthetic coding sequence
atggacgagccccccttcagcgaggccgccctggagcaggccctgggggagccatgtgacttggacgccgcactcttgacagacattgaggatatgttgcagctcatcaacaaccaggattcagatttccccggattatttgatccaccatacgctggctcaggcgctggcggaacagatcctgcctctccggacacatcatctcctggtagtcttagcccgccacccgccaccctgtcgtcctccttggaggcttttcttagcggacctcaggcagccccttcccctttgagtcccccccaaccagcgcccactccattgaagatgtatccttccatgcccgccttttcaccaggtcctgggatcaaggaagagtctgtacccctctctatactccagactccaacgcctcagccgctgccaggtgccttgctgccccaaagcttccctgcgcccgctccaccacagttcagctccacgcccgtgctcggctatccatcccctcctggcggatttagtacaggttctccaccgggcaacacgcagcagccgctacccgggctgcccctggcatctcctcctggcgtcccacctgtgtcactccacactcaagtgcaatctgttgtgccccaacagttactgaccgtcacagctgcaccaacagccgctcccgtgacgaccactgtgacaagtcagatccaacaggtccctgtgctcctccagcctcatttcattaaggccgattccctgttattgacggctatgaaaactgacggagctaccgtcaaagcagctggcctgtctccgctggtgtccgggacgaccgttcagaccggccctctgcctacactcgtcagcggtggtacgattctggccactgtgcccttggttgtcgacgctgagaaattgcctattaacagactggccgcaggaagcaaggctccggccagtgcccagagtaggggtgaaaaacgaacagcccacaatgccatagaaaagagataccggtccagcattaatgacaagatcattgaactgaaagaccttgtggtaggcacagaggccaagctaaacaaaagcgccgtccttcgcaaggccatcgattacattagatttctccagcactctaaccaaaaactaaagcaagagaacctcagcctgcgaacagctgtccacaaatccaagagcctcaaggatctggtttcagcctgcggcagtggaggaaataccgacgttcttatggaaggcgtcaaaacagaagtcgaggacacattgactcctccacctagcgatgcaggaagcccgtttcagagctcaccactgagcttaggctccagggggtcaggcagcggcggatccggtagtgactctgagccagattctcctgtattcgaggacagcaaaaccgaatag

SEQ ID NO: 26519 - DNA, 645 bp, Artificial Sequence
  Description of Artificial Sequence: Synthetic coding sequence
ctgatgcccgcctgcctgcccggcaagcacaccggcggccacctgaccgccacaaatcttgctttgagcgcactgaaccttgcagagtgcgccggagatgcggtctctgtggctactttggctgagatctacgtggcggctgcgctacgagtaaaaacctcactgccccgcgccctgcatttcctgacacgattctttttaagctccgcacgacaggcttgcctggctcagtcaggatcagtgcctcccgctatgcagtggctctgccacccggtgggccaccgcttctttgtagacggcgactggtccgttctaagcaccccgtgggaatcactgtacagtctggctggcaaccctgtcgatccactggctcaggtaacacaactctttcgggaacatctactcgaaagggcacttaattgcgttacacaaccaaaccccagtcctggatccgctgatggggataaggagttcagtgacgcacttggatatctccaactgttaaacagctgtagcgacgcagcaggtgctcccgcctactccttcagtatctccagctcaatggctacaaccacaggtgatccctgtcccgggcagctgtgcactccgtctagactcccagggccctgctgggctgtaccatag

SEQ ID NO: 26520 - DNA, 747 bp, Artificial Sequence
  Description of Artificial Sequence: Synthetic coding sequence
atggagcgggccagcctgatccagaaggccaagctggccgagcaggcagagcgatacgaagatatggctgcgttcatgaagggcgccgttgagaagggagaagagctgagctgtgaggagcgtaatttactgagcgtggcatataagaatgtagtaggtggccagcgggccgcatggcgagttctgagctctattgagcagaagagcaatgaggagggttctgaggaaaagggccccgaggtgcgcgagtaccgcgagaaagtagaaaccgaactgcaaggggtctgcgacaccgtgcttggtctcctcgacagtcatttgattaaagaggccggcgatgcggaaagccgggtcttttatctgaagatgaagggcgactattacagatatttagccgaggtggccactggcgatgacaagaagcggattatcgacagcgcccgcagcgcataccaggaggccatggacatcagcaagaaagagatgcctcctactaaccccatccgccttgggttagcattaaactttagcgtatttcactacgagatagctaatagtcctgaagaagctatcagcctcgcaaaaaccacattcgatgaagcaatggccgacttgcacacactgtctgaggacagttacaaggattcaacacttattatgcaattgcttagggataatctgactctgtggacggccgacaatgctggcgaggagggaggtgaggcaccccaagagcctcagtcttag

SEQ ID NO: 26521 - DNA, 651 bp, Artificial Sequence
  Description of Artificial Sequence: Synthetic coding sequence
atggagcgggccagcctgatccagaaggccaagctggccgagcaggctgagcggtatgaggatatggctgcttttatgaagggagctgttgaaaaaggcgaagagttgtcctgtgaggaacgcaacctcctgagtgtggcttataagaacgtggtgggcggacagcgagcggcttggagagtgctaagctcaattgaacaaaagtccaacgaggagggttctgaagagaagggccccgaggttcgggaatatagagtgttctatcttaagatgaaaggggattattacagatatttggccgaggtcgccactggagatgacaagaaaagaattatagactcagctcgttccgcatatcaggaagctatggatatctccaaaaaggagatgccacctaccaatcccatccgcctcggtctggccctcaactttagtgtcttccactatgagatcgccaacagtccggaagaagcaattagcttagccaaaactacctttgacgaggctatggcagatctccacactctttcggaggacagctacaaggactctacactgataatgcagctattacgggataacctcactttatggactgcagataatgctggagaggaaggcggagaagctcctcaggagccccagagctag

SEQ ID NO: 26522 - DNA, 3702 bp, Artificial Sequence
  Description of Artificial Sequence: Synthetic coding sequence
atgggcttcctgaagctgatcgagatcgagaacttcaagagctacaaagggaggcagataatcggccctttccagcggttcaccgccattatcggccccaatggttcagggaagagtaatctcatggacgccatctcttttgttcttggggagaagacatccaacttaagagtcaaaactcttcgtgacctgattcatggtgctcccgttgggaaaccagccgctaacagagcctttgtcagcatggtgtactccgaggaaggggctgaggatagaaccttcgcaagagtgatagtagggggatcatctgagtacaaaatcaataataaagtcgtgcaattgcatgaatacagtgaggagttggagaagctcggcatccttattaaggcaaggaacttcctggtattccagggagcggtggagagcatcgctatgaagaaccctaaggagagaacagccttgttcgaggagatcagccggtctggcgaattggcccaggagtacgataaacggaagaaggaaatggtgaaagccgaggaggatactcagttcaattaccatcgaaagaagaacatcgcggccgaaagaaaggaagccaaacaggagaaggaggaagcggaccggtaccagcgattaaaggatgaggttgtacgcgctcaagttcagctccagctgttcaagctctatcacaacgaggtcgagatagagaagctcaacaaagagctagcctcgaagaataaggagatagaaaaggacaagaaacgaatggataaagtcgaagacgagctgaaagagaagaaaaaggaattaggaaagatgatgagagagcaacagcaaatcgaaaaggagattaaagaaaaggactccgaactgaaccaaaagagacctcaatatatcaaagcaaaggaaaatacatctcacaaaattaagaagctggaggcagcgaaaaagagcctgcaaaatgcacaaaagcactacaaaaaacgcaagggggatatggatgaactggaaaaagaaatgctcagtgtcgagaaagcccgccaggagtttgaggagcggatggaggaagaaagccaaagccaggggcgggatttaactcttgaggaaaatcaggtcaaaaaataccaccgcctaaaggaagaagcatctaagcgcgccgcaacactagctcaggaacttgaaaaattcaaccgggaccagaaagccgaccaggatcgcttagatttggaggagcggaaaaaggtggaaaccgaggcaaagattaaacagaagctaagagaaattgaagaaaatcagaaaaggattgaaaagctggaggaatatataacgacttccaaacaatctctggaggaacagaaaaaactcgagggagagctgaccgaagaggtggaaatggcaaaaaggcgaatcgatgagatcaataaggaacttaatcaagtgatggaacagctgggagacgctcgaatagatagacaggagagtagccgccaacaaagaaaggccgagattatggaaagcatcaagagattgtaccctggcagtgtgtatggtagattgattgacctgtgccaacccactcagaaaaaataccaaatcgctgttacaaaagttttgggcaaaaacatggacgccatcatagtcgactcagagaagacaggaagagattgtatacagtacataaaggagcagaggggagaaccagaaacatttctcccactggattacctggaggtcaagcctactgatgaaaagcttagagaactgaagggggcaaaactggtcatcgatgtgatcaggtatgagccaccccatattaagaaggccctgcagtacgcctgcggaaatgcactggtctgtgataatgtggaggacgcgcgcagaattgctttcgggggtcaccagcgtcacaaaacagtggcgctggacggcaccttgttccaaaaatctggggtcattagcgggggcgcctctgacctgaaagctaaggcgaggagatgggacgagaaggcggtcgataagctgaaggagaaaaaagagaggctgaccgaggagctgaaggagcagatgaaggctaagcgaaaagaagcggagttacggcaggtacagtcacaggcccacggattgcagatgagactcaagtactcacagagcgatctagagcaaaccaaaacgagacacctggctctaaacctgcaggaaaagagtaaactggaatccgagttggcaaacttcggcccaaggattaatgatattaaacgaattattcagtcaagagagcgggaaatgaaagatttgaaggaaaagatgaaccaggtcgaggacgaagtatttgaggaattttgtagggagatcggcgtccgcaatatcagagagtttgaggaagaaaaggtcaagcggcagaacgagattgcgaaaaagagattggaattcgagaaccaaaagactcgcctaggaatccagctggacttcgagaagaaccaactgaaagaggatcaggacaaggtccacatgtgggagcaaacggtcaaaaaggacgaaaacgagattgagaaactgaagaaggaggaacagcggcatatgaagattatcgacgagactatggcgcaactgcaagacctgaagaaccaacatttggcgaaaaagtcagaagtaaacgacaagaatcacgagatggaagagatcaggaagaagcttggaggagccaacaaagaaatgacccacctccagaaggaagtgaccgccatagaaactaaactcgaacagaagcgctcagatcggcacaatctcctacaggcctgtaagatgcaggatatcaaactgccactgagtaagggcaccatggatgatatcagccaagaagagggttcttctcagggtgaggacagcgtctctggtagccaacggatatcctcaatctacgccagagaggctcttattgaaatcgactatggtgatttatgtgaggacctaaaggacgcacaggcggaggaggagataaaacaggagatgaacactcttcaacagaaattaaatgaacaacagtccgtgctgcagagaatcgcggctccaaatatgaaagcgatggagaagctggaatcagtccgggataaatttcaggaaaccagcgatgagtttgaggcggcccgaaagagagctaagaaggccaagcaggcctttgaacagataaagaaggagagattcgacaggttcaatgcgtgtttcgagagtgtggctactaatatcgacgagatctataaggctctctccagaaatagcagcgcccaggcttttctaggtcccgaaaaccccgaggagccatatttggatggcattaactataattgtgtggcgcccggcaaaaggtttcggccaatggacaatctctctggcggcgaaaagacagtcgctgcccttgcactgcttttcgctatccattcttacaaacccgctcccttttttgttcttgacgagattgacgcagccctggacaacaccaacatcggcaaggtggccaattacataaaggagcaatctacttgcaattttcaggcaatagtgattagtctcaaggaagagttctacacaaaagccgaatcgcttattggcgtttatcccgaacaaggagattgtgtgattagtaaagtgctgacatttgatctgacaaaatatcccgacgctaatcctaatccaaatgaacagtag

SEQ ID NO: 26523 - DNA, 612 bp, Artificial Sequence
  Description of Artificial Sequence: Synthetic coding sequence
atgggcttcctgaagctgatcgagatcgagaacttcaagagctacaagggacgtcagattattggcccgttccagcgattcacggctatcattggccctaatggcagtggtaagagcaacctgatggacgcaatatccttcgtcttaggcgaaaagacaagcaacctgcgagtgaaaaccctgagagacctcatccatggcgcacctgtaggaaagcccgccgcaaacagggccttcgtatctatggtctactccgaggaaggagcagaggatcggactttcgcgcgggttatcgtgggaggctcttcagagtataaaatcaacaataaggtagtacagctgcacgaatattctgaggaactggagaagctgggcatcctaatcaaagctcgaaatttcttggtctttcaaggttgctgcggcatatactgccacgagacccccaaaaggggacaactgtatctgaagatctcaaggagcggggaactggcccaggagtacgataaacggaagaaggagatggtcaaggcggaggaggatactcaattcaattaccacaggaagaaaaacatcgccgctgagcggaaagaggcaaagcaggagaaggaatag

SEQ ID NO: 26524 - DNA, 1551 bp, Artificial Sequence
  Description of Artificial Sequence: Synthetic coding sequence
atgggcttcctgaagctgatcgagatcgagaacttcaagagctacaagggtcgccagataatcgggccatttcagcgtttcacagctattatcggccctaacggttccggtaaaagtaacctcatggacgccattagtttcgttttgggagagaagacttctaatttgcgtgttaagactctaagggacctgatccacggggcgccggtggggaagcctgccgctaatagggcgtttgtcagcatggtctacagtgaggaaggcgcagaggacaggacgtttgccagagtaatcgtgggtggatcctctgagtacaaaataaataacaaggtggtacagcttcacgaatactccgaggagcttgaaaaactgggtatattgatcaaggcccgcaatttcctggtctttcaggtgaagaaataccaccggttgaaggaggaagcctccaaaagagccgccactctggctcaggaactcgaaaagtttaaccgggaccaaaaggcggaccaggacagacttgatctggaggagcggaaaaaggttgagaccgaagctaagattaaacagaagcttcgggagatcgaagaaaatcaaaaaagaattgagaagctggaagaatatattactacatcaaagcaatccctcgaggagcagaagaagctcgagggggaactgactgaggaggtggagatggctaagaggaggatcgacgagatcaacaaagaactaaatcaggtgatggagcaacttggagacgctcgaatcgacagacaggagtcttctcgtcagcagagaaaggccgaaataatggaaagtattaagcgattgtacccaggttcagtgtatggacggttgattgatctctgtcagcctactcaaaaaaagtaccaaattgcggtgacaaaggttctcgggaaaaacatggatgcaatcatcgtggactcagaaaaaaccggccgggactgtatccaatatatcaaggaacagaggggggaacccgagacgtttttacccctggactacctggaggtaaagcccaccgacgaaaaattaagggagctcaagggggcaaagttggtgatagatgtcatacgctatgagcctccccatattaaaaaggccctccaatatgcgtgtggaaatgccttagtatgtgataatgtggaagacgcccggcggattgctttcggcggccaccagcgacacaagaccgtcgctttagatgggaccctgtttcagaaatcaggtgtcatctcaggtggagccagtgacctgaaggccaaagcgaggcgctgggacgagaaagctgtcgacaagctcaaggagaaaaaggaacgactgaccgaagagctgaaggaacaaatgaaggcaaagcggaaggaggcagaactgagacaggttcagtcccaggcccacgggctccagatgcgacttaaatacagccagtccgacctcgaacagaccaagacccggcatttggctctgaaccttcaagtggggccgggcctgcagccctgctcccccaaagcaatccacacctttttagcctag

SEQ ID NO: 26525 - DNA, 870 bp, Artificial Sequence
  Description of Artificial Sequence: Synthetic coding sequence
tgatggtacacccccacccccttctacagcagcctggaggccgccctcctaaacttccggccttccgcacctgtgtttcggatgctcgaggtgtcaatacctactccacataggtatgttcgcggtaagtcgaacctgatggatgccatcagttttgtgttgggtgagaaaacctccaatctgcgcgtaaagacactgcgggacttgatacacggcgcgccagtgggaaagccagccgcgaaccgagctttcgtgtctatggtgtatagcgaagagggggctgaggacagaaccttcgccagggtaatagtggggggctccagcgagtataagatcaataacaaggttgtgcagttgcatgagtatagcgaggaactcgagaaactgggtattttaattaaggccagaaactttctggtgtttcaaggcgcagtagagtcaatcgctatgaaaaatccaaaagaacgcaccgcccttttcgaggagatcagccgcagtggggaattagcgcaggaatatgataagaggaagaaagagatggtaaaggccgaagaagatacccagtttaattatcataggaagaagaatatagctgctgaaaggaaagaggccaaacaagagaaggaggaggccgaccgctatcagcggctcaaagatgaggtagtgagagcccaggttcagctccagctgttcaaattgtatcacaatgaagtcgagatcgagaaactgaacaaggagttagcatctaaaaataaagaaattgagaaggacaagaaacgcatggacaaggttgaggacgaactaaaggagaagaagaaggagctgggcaagatgatgcgagaacagcaacaaatcgaaaaagagatctag

SEQ ID NO: 26526 - DNA, 1995 bp, Artificial Sequence
  Description of Artificial Sequence: Synthetic coding sequence
atgagcggcgtgcggggcctgagccggctgctgagcgcccggcggctggctctcgctaaagcctggccaacagtgcttcagaccggcacacggggatttcatttcactgtggacggtaacaaacgagcgagcgcaaaggtgtccgatagtattagtgcccagtatcccgtcgttgatcatgagttcgacgccgtagtggttggagctgggggcgcaggcctgagagcagctttcggcttgagcgaggcaggcttcaacacagcttgcgtcaccaaactcttcccaacgagaagccatacagtcgctgctcaagggggcatcaacgccgcactaggaaacatggaggaggataattggagatggcatttttatgacacagtcaaagggtctgattggctcggagatcaagatgccatacattacatgacggaacaagcacccgccgccgtagtggagctggagaattatggtatgccattcagtaggaccgaggacggtaaaatttaccaaagggccttcggtggccagtcccttaagtttggaaagggggggcaagcccacaggtgttgttgtgtggcagacaggaccggccacagtctccttcatacactgtatggacggtcgctccgatacgacacttcctatttcgtcgaatacttcgcgctggatctcctgatggagaatggtgaatgccgcggtgtgattgctctgtgtatcgaagacggttctatccaccggataagggctaagaacacggtcgtcgcgaccgggggctatggcagaacctatttctcctgtacttcagcccatacatctactggtgatggcactgccatgatcacccgtgccgggctgccatgccaggatctcgaatttgtgcaatttcatcccacaggcatctatggcgctgggtgtctaattacggaaggatgcagaggtgagggcgggatattaattaacagccaaggagagaggttcatggaacgttacgcgccagtggccaaagatctcgcgagccgcgacgtggtgtcaagatctatgacactggagatacgggaaggaagaggctgcggccccgagaaggaccatgtgtacctccagctgcaccatctgccgcctgagcagctggccactcggctgcctggaatctctgagacagctatgattttcgccggcgtggacgtgacaaaggaacccatccctgtgcttcctacggtccattacaatatgggtggtattcctaccaactacaaggggcaagtgctgcgccacgtgaacgggcaggatcagatagtccctggcttgtacgcgtgcggagaggccgcctgcgcatccgtacacggcgctaatcgactcggagcaaactcgctgttagatctggtcgtctttgggcgggcgtgtgccctaagcatcgaggagtcctgccgtcctggcgataaagttcccccaatcaagccgaacgccggggaagaaagtgtcatgaatctagataagcttaggtttgcagacggctctattcggacgtctgaactgagactcagtatgcagaaatctatgcagaaccatgccgccgtgttcagagtggggtccgttctccaagaaggatgtggtaaaatcagcaaactgtacggagatcttaagcatctgaagacctttgatagagggatggtttggaatacagatctggtggagactctagaacttcagaacctgatgctctgcgcactacagacaatatacggggccgaggctagaaaagagtccaggggggctcacgctcgtgaagattacaaggtccggattgatgaatatgactactcaaaacccattcaaggacagcaaaagaaaccattcgaagaacattggcgcaaacacacgttgtcatatgttgatgttggtaccgggaaggtgacactcgagtaccgccctgtgatcgataaaacacttaatgaagctgattgtgcaaccgtccctccggcaatcagatcttattag

SEQ ID NO: 26527 - DNA, 1560 bp, Artificial Sequence
  Description of Artificial Sequence: Synthetic coding sequence
atgagcggcgtgcggggcctgagccggctgctgagcgcccggcggctggcccttgcaaaggcctggccaaccgtactgcaaacaggcactcggggattccattttaccgtggatggaaacaagcgagcctcagccaaagtgtctgactccattagcgctcaatatccggttgtggatcatgagtttgacgctgtcgtggtgggcgccgggggtgcgggtctgcgagcggcctttggattaagtgaggctggtttcaatactgcctgtgtaaccaaactgtttccaacaaggagccatacagtagccgcgcagggaggcattaatgccgccctggggaacatggaggaggacaattggcggtggcatttctacgacacttctacgggagatggcacggcgatgattactagggctggtttgccctgccaggacttggagtttgttcagttccatcctaccggcatctatggtgccggctgtctaattaccgaaggatgccggggggaagggggcattcttatcaattcccagggcgaacgcttcatggagaggtacgcgccagtggccaaggacctggcctcccgcgatgtggtgtctcgcagcatgacactggagatccgagaaggcagagggtgcggccccgagaaagatcacgtgtatttgcaactccatcacctgccacctgagcaattagctactcggctaccgggcatctccgaaaccgcaatgatattcgcgggcgttgacgtgaccaaggaacccattcccgtgctcccaaccgtacactacaatatggggggaatccccacaaattataagggacaagtcctccggcacgtgaacggccaggaccagatagtgcctggtctgtacgcttgtggggaggcggcctgcgccagcgttcatggggctaaccgattgggcgctaactctctgttagacctggtcgtgtttgggagggcgtgcgccctgagcattgaagaatcatgccgccccggagataaagtcccacctattaagccaaacgcgggagaagagtctgtaatgaacctggataaactccgctttgctgacggtagtatccggacttcagaactgagactctctatgcaaaagagcatgcagaaccacgctgccgtattcagggtggggtccgtgcttcaggagggctgtggaaagatctctaaactgtatggagatctgaaacacctcaagacattcgacagaggaatggtttggaatactgatctggtggaaacactggagctgcagaacttgatgttatgtgcactccagacaatttacggcgcagaagctaggaaggaatctagaggagcacacgccagagaagattacaaagtgagaattgacgaatacgattattcaaaaccaatccagggacaacagaaaaaaccctttgaggagcactggcggaagcacaccctgtcttacgtggacgtcggcaccggcaaagtgaccttggaatacaggcccgtcattgataaaaccttaaacgaggcagactgcgccacagtaccacctgccatacggagttactag

SEQ ID NO: 26528 - DNA, 6645 bp, Artificial Sequence
  Description of Artificial Sequence: Synthetic coding sequence
atgaagcggaaggagcggatcgcccggcggctggagggcatcgagaacgacactcagcccatattactgcagagctgcaccgggctagtaacgcatcgccttctcgaggaggataccccaagatacatgcgggcttcagaccccgcctctccgcacattggtagaagcaacgaagaggaggagacctcagactcctccctagagaaacaaaccagatctaagtactgcaccgaaacatctggagtgcacggtgactccccctacggctcaggcactatggatacacacagtctcgagagcaaagccgaacgcatcgcgaggtataaggcagaaaggcggagacaactagccgagaagtatggactcaccctcgacccagaggccgattctgagtacctctcccgatataccaaatcgaggaaggagcccgacgctgtggagaagagaggagggaagtctgataaacaagaggagtcgagccgcgatgctagctccctctatcccggcacagagactatgggcctgcgaacctgcgctggtgagagcaaggattacgcactgcatgtcggagatggtagttccgaccctgaggttctactgaacatcgagaatcagcgtaggggccaggagttgtccgctactagacaggctcatgatctgtcacccgccgcagaatcttcatctactttcagcttctctggtcgtgattcatcatttactgaggttcccagatcccccaagcacgcacactcctcctccctgcagcaggccgcttctaggtccccctcgttcggtgacccacagttaagccccgaagcgcgaccaagcaccggtaaacccaaacacgagtggttcctgcagaaagactccgagggagacacccctagcctgattaattggccaagtcgggtaaaggtccgggaaaagctggtgaaagaagaaagcgcccggaatagccccgaactggcttccgagagtgtcactcagaggcggcatcagccagcccccgtgcactacgttagctttcaaagcgagcactccgctttcgatcgggtcccttccaaagcggccggaagtacccggcaacctataaggggctatgtccagccagcagacactggccatacggcgaagctcgtgacacctgaaacccctgaaaatgcctctgagtgctcatgggtcgcttccgccactcagaatgtgccaaaaccccccagtctgacagtgcttgagggagacggacgcgattctccagtcttacacgtgtgtgagtccaaggccgaagaagaggagggggaaggggaaggcgaagagaaggaggaagatgtgtgcttcacagaagcactcgaacagtctaaaaaaacattgctggcactggagggagatggactggtgcgctccccagaggacccatccaggaacgaagatttcgggaagcccgccgtcagcacggtcaccctggaacaccagaaggagctagagaacgttgcccagcctccccaggcaccacatcagcctactgaaagaactggcagatccgagatggtgctttacatacagagtgagccggtgtcccaggatgctaaacctacaggacataaccgagaagctagtaaaaagcggaaagttcggacccgatcattatcagattttacagggccaccccaattgcaggcactgaagtacaaagaccctgcctctaggagagaacttgaactccccagttctaagaccgaagggccatacggcgagatttccatgctggataccaaagtatcagtggcccagcttagatccgcattccttgccagcgccaacgcatgccggcgcccagaacttaaatcccgcgtggagcggtcagccgagggccccggtctgcccactggcgtggagcgcgagcgcggatccagaaaacctaggcgatatttcagtcccggagagagtagaaaaacctccgagagattccggactcagcccatcacgtcagccgaacgcaaggagagtgataggtgcacttcccactcagagactcccaccgtggatgacgaagaaaaggtggatgagagggcaaagctgtccgtagctgcgaagcgcctcctgtttcgggaaatggagaagtcattcgatgagcagaacgtcccaaagaggaggagtaggaacaccgcggtcgagcaaagactgaggagattgcaggacagatccttgacccagccaataacaactgaagaagttgtgatcgccgctacagagcccattccggcgagctgctctgggggcactcacccagttatggctcggctgccctcccccactgttgcacgttcagccgtgcagcctgcacgcctgcaggcgtcagcgcatcagaaagcactggccaaagaccagacgaatgaaggaaaggagctggcagaacagggggaacccgattctagcacattatcactggccgagaaattggccctgttcaataagctgagccaacccgtttccaaagccatttctaccaggaaccgcattgatacgaggcaacggcggatgaacgcccggtaccagacccagcctgtgactctgggagaggtggagcaagtccagtccgggaaactgatacctttctcacctgctgtgaatacaagtgtgtcaactgtggcgagcactgtcgcgcccatgtacgccggcgatcttcggacaaagcctcctctcgaccacaatgctagcgccactgactacaagttctcgtctagtattgaaaatagcgacagcccagtccgaagcattcttaagtcccaggcatggcagccgctggtggaggggtccgagaataagggaatgctccgtgaatatggagagactgaatccaagcgagcgctgactggccgggatagtggcatggaaaagtacggtagcttcgaggaagccgaagcctcttacccaatcctgaacagagcacgggaaggagacagccataaggagtctaagtacgccgttccacgccgcgggagcttggaaagggcgaatccccctatcacccatcttggagacgaaccaaaggaattctccatggctaaaatgaacgcccaagggaaccttgatcttagagacagactgccttttgaagagaaggtggaggtcgagaatgtaatgaaaaggaaatttagcttacgcgctgctgaattcggcgagcccacatccgaacagaccgggactgcagccgggaaaacaattgctcagactacggctccagtgtcctggaagccccaagattccagcgaacaacctcaggagaaactgtgtaagaacccctgcgctatgttcgcagctggagaaataaagacccctaccggcgaggggctgctcgatagtcccagcaagactatgagcatcaaagaacggctcgctctactcaagaaatctggggaagaagactggcgcaatcgtctctcacgtcgtcaggaggggggcaaggcgcccgcctcatcgcttcatacccaggaagcaggcagaagcctgatcaagaagagggtgacagaatcaagagagtcacagatgaccatcgaagaacgaaaacagctgattaccgtgcgagaggaggcatggaagacaagggggaggggtgccgctaacgacagcacgcagtttaccgtcgcagggcgtatggtaaaaaaaggactggctagccctacagccatcactccagtggcttcgcctatatgtgggaagacaagggggacgactcccgtgtctaaacccctggaagacatcgaggcaagacccgacatgcagctggaaagtgacttaaagctggatagactcgagacattcctgagacgattaaacaacaaagtgggcggtatgcacgagaccgtgcttaccgtgactgggaagtccgtcaaagaggttatgaagcctgacgatgatgagacgtttgccaaattttatagatcagtggactacaacatgccacgtagccccgtggagatggacgaggactttgatgtgatctttgatccatacgccccgaaactcactagttctgtggccgaacataagcgtgctgttcggcccaaacgtcgggtccaagctagcaaaaacccgctgaaaatgcttgctgcccgggaagacctgctccaggaatataccgagcagcgtctgaacgtcgcttttatggagagcaagaggatgaaggttgagaaaatgagttcaaacagcaatttttccgaggtcactctggcaggacttgcctctaaggaaaatttctccaacgttagcctgcgcagtgtgaatcttactgagcaaaacagtaataattccgctgttccctacaagagattaatgcttctgcaaattaaaggccgaagacacgtgcagacaagattagtggaaccacgagccagcgccctgaatagcggggattgcttcctgctgctgagtccacattgttgctttctgtgggtgggggagttcgctaatgttattgagaaggccaaggccagcgagctggccactctgatccagactaaacgggagttgggatgccgggctacatatatacagacgattgaggaaggcattaatacacacacccacgccgcaaaagatttttggaaactgctgggaggacagacttcttatcagagtgcgggtgatcctaaagaggatgaactgtacgaggccgccattattgagacaaactgtatctatagactcatggacgacaagctggtgccagacgacgactactggggaaagattcctaagtgctccctgctgcaacccaaagaagttctggtttttgattttgggtcagaagtgtacgtatggcacggcaaagaagttactcttgcccagcgaaaaatcgccttccagctggcaaaacatctgtggaacgggacattcgactacgagaactgtgatatcaacccactcgatcccggggagtgcaaccctctgattccccgcaagggccagggtcgcccggattgggctatctttggccgactgactgagcacaacgagaccatcctgtttaaagaaaaattcctggactggacagaactgaagcgctccaatgaaaaaaatcccggggaacttgcccagcataaggaagatccacggaccgacgttaaggcttacgacgtgacccgcatggtttcgatgccgcaaacaacagccgggaccattttggatggtgtcaacgttggtcggggctacggcctcgtcgagggacatgataggcgccaattcgaaataactagtgtctccgtagacgtctggcacatacttgaatttgactatagtcgtttgcctaagcagagcatcggacagtttcatgagggagacgcatatgtagtgaaatggaagttcatggtgagcactgctgtaggctcgagacaaaagggagaacacagcgtgagggctgcagggaaggaaaaatgtgtttacttcttctggcagggccggcatagcactgtctcagagaaagggacctccgcactcatgacggtggaattagacgaggaacgcggcgcccaggttcaggtgctccagggcaaagagcctccatgttttcttcagtgctttcagggcggcatggtggtacacagtggtcgacgggaggaagaggaagagaacgtacagagcgagtggcggttgtactgcgtgcgcggtgaggttcccgttgaggggaaccttctcgaggtcgcatgccattgctcctctctccgctccaggacatcgatggtggttctgaacgtgaataaggcgttgatttacctgtggcacggctgtaaggcgcaggcccacacgaaagaagtaggcaggacggcggccaataaaataaaagagcaatgtccactagaggctggcctccactccagcagcaaagtgactatccatgaatgtgacgaaggatccgaaccactcgggttctgggatgctctcgggagacgcgatcggaaggcttacgactgtatgctacaggaccccgggagctttaatttcgccccacgcctttttattctgagttcctcaagcggagatttcgctgccacagagttcgtttatcccgctagagcaccgtccgtagtctctagtatgcctttcctccaggaagacctgtacagcgctccacagccagcactattcctggtagacaatcaccatgaggtctacctttggcagggatggtggccaatagaaaacaaaataactggcagtgcaagaataagatgggcatctgataggaagtctgccatggaaaccgtcttgcaatactgtaagggaaaaaatctgaaaaagccagctccaaaaagctacctgattcatgctgggctggagcctttgacttttacaaacatgttcccatcctgggaacatcgagaggacattgcagagatcactgaaatggataccgaggtgagcaatcaaataaccctggtggaggatgtcctggccaagctttgtaagacaatatatccactcgccgatctgctggctcggcctcttcctgagggtgtggatccactgaaactggagatctatctcacggacgaggacttcgagttcgccttggacatgactagagatgagtataacgccttgcccgcctggaaacaggtgaacctgaagaaggccaagggccttttctag

SEQ ID NO: 26529 - DNA, 6645 bp, Artificial Sequence
  Description of Artificial Sequence: Synthetic coding sequence
atgaagcggaaggagcggatcgcccggcggctggagggcatcgagaacgatacgcagccaattctgcttcaatcatgcactgggcttgttactcatcgtctactcgaggaggacactccaagatacatgagagcttctgacccagcctccccacatatcggaagatctaatgaggaagaagagacatcggacagctctctagagaagcaaaccaggtcgaagtactgtaccgagacaagcggcgtgcatggtgactcaccatatggcagcggtaccatggatacccactccttggagtccaaagcagagcgcatcgcaaggtacaaggccgaacggcggagacagctggccgaaaagtatggtttgacactcgaccctgaagctgatagcgaatacctgtccagatacaccaagtctcgcaaagaacctgacgctgtcgaaaagcgcggtggtaaaagcgacaagcaagaggagagttcaagagacgcaagcagcctttaccctggaaccgaaacaatgggactgagaacctgtgccggagagagcaaggactatgctctacacgtgggcgatggctcaagcgaccccgaggttctcctgaacatcgaaaaccagagaaggggccaggagctcagtgcgacccgacaggcccatgacctaagtcctgctgctgaatccagtagcacgtttagcttctcaggcagggactcaagtttcaccgaagtgcctagatctcccaagcacgcacatagttctagcctgcagcaggcggctagtagatcaccttccttcggggaccctcaactgtctccagaagcccggccaagcactgggaaaccgaaacacgaatggttccttcagaaggacagcgagggcgacacacccagcctgattaattggccgagcagagttaaggttcgggagaagctggtcaaagaggagagtgctagaaattctccagaactggcatccgaatcagtgactcagcgccggcatcagcccgcgcccgtacattacgtaagctttcagagtgagcatagcgctttcgaccgcgttccatcgaaagccgccggttctactcggcagccaatcaggggctacgtacaaccagctgatactgggcatactgcaaaactcgttactcccgagactcccgaaaacgcatccgagtgctcatgggtcgcatccgctacacaaaacgtgcccaagccaccaagtctgactgtcctggagggcgatggccgagatagcccggtgctgcatgtctgcgaatccaaagccgaggaggaggaaggggagggcgagggcgaggagaaagaggaggatgtctgcttcaccgaggcgcttgaacagtctaagaagaccttactcgccctggagggcgacgggctggtcagatcccctgaggaccccagccggaacgaagactttggaaagcccgccgtgtcaacagtgacactggaacaccagaaagagctcgaaaatgtggctcaacctccccaagcaccccatcagcccaccgagcgcactgggcggtccgaaatggtgctgtatattcagtctgaacccgtgagccaggacgccaagccaaccggccacaatcgggaggcctccaaaaaacgcaaagtgcgcactagatcgctgagtgacttcacaggcccccctcagttgcaggccctcaagtataaggatccagcttcccggcgggagttagagttgccctcgagtaaaacagaaggaccatacggagaaatatccatgctcgataccaaggtgtccgtggcgcagctgcggtccgcattcctcgcttcagccaacgcttgcagacgacccgaactcaaatcacgcgtggagcgttctgctgagggtccagggctgcccaccggagtcgagagagagaggggctccagaaagccccggagatacttttctccaggagagagccgcaaaacgagcgagcggtttcggacacagccgatcacctccgctgagcgtaaagaaagcgaccgctgcactagtcactctgaaacacccactgtggacgatgaagagaaggttgatgaacgggctaaactcagcgttgccgcaaaacgcctgctttttcgcgaaatggaaaagtcctttgatgagcaaaatgtgcccaagcggcgttcccggaatacagcggtggaacaaaggcttcggaggctccaggataggtctctgacccagcccatcaccaccgaagaggtggttatcgccgccactgaacctatacctgcaagctgttcaggaggcacacatcctgtgatggcccgactgccgtcccctacagtggcacgcagcgcagttcaacctgctagactgcaagcctcggcacatcagaaggcgcttgccaaggatcaaacaaacgaggggaaggaacttgctgaacaaggggagcctgacagtagtacactcagccttgcggagaaattagcccttttcaataaactttctcagcccgtgtcaaaggccatctctactcgtaataggatcgacactcggcaaaggcggatgaatgcccgttaccaaacccagcctgtcacactgggtgaagtggagcaggtgcaaagcggaaaactgattcccttctctccagccgttaataccagcgtgtcaacagttgcatcaactgtggcccccatgtatgcgggcgacctgaggaccaaaccccctctggatcataacgccagtgctactgattataagttttccagttctatagaaaacagcgattcccccgtgagatctatcttgaagagtcaggcttggcagcctctggtggagggctccgagaataaaggcatgctgcgggagtacggcgagactgaaagtaaaagggctttgactggtcgtgactcaggtatggagaagtacggcagtttcgaagaagcagaggccagctatcccatcctcaaccgcgcgcgtgagggagattctcacaaggagtctaaatacgccgtgcctaggcgagggagcttggagcgcgccaacccgcctatcacgcatctgggggatgagccaaaggaattttcaatggcaaagatgaacgcccagggcaatctggatctccgggaccggttgccatttgaggaaaaggttgaggtcgagaacgttatgaagaggaagttctccctgcgcgcagcagagttcggggagccaaccagcgaacagactgggacagcggccggaaagacaatcgcacagactaccgcacccgtgagttggaagcctcaggacagttccgaacagccccaagagaagctgtgtaaaaatccgtgcgccatgttcgccgccggagaaatcaagacacctactggggaagggctgctggactccccctccaaaaccatgtctatcaaggagcgactggcgctgcttaagaaatctggcgaggaggattggaggaataggctgagcagaagacaggaaggagggaaagcaccagcctcatcactgcacacccaagaggcagggagatccctgataaaaaaaagggttactgaaagcagagaatcccagatgacgattgaggaacggaagcagctgataacagtgcgcgaagaggcttggaaaacccgcggccgcggagctgccaacgattccacccagttcacagtcgccggacgaatggtgaaaaagggcctcgctagccctaccgctatcactccagtggcttctccaatctgcggaaaaacccggggcaccacacctgtcagtaagccactcgaggatatagaggcgcgacctgatatgcagctcgagtccgacctcaaacttgacaggttggaaacattcttgaggcgattgaataacaaggttgggggaatgcacgagactgtgctgactgtcaccggtaaaagcgttaaggaagtgatgaaaccggatgacgacgagacctttgcaaagttttataggtctgtcgactataacatgccccgttcaccagttgagatggacgaggattttgacgtcattttcgacccttacgctcccaagttgacgagtagtgtggccgaacataagcgcgcggtaaggccgaagcgccgtgtgcaggcatctaaaaatccactgaagatgctggccgccagagaggatttgctgcaggaatatactgagcaaagactcaacgtggcattcatggagtccaaacggatgaaagtcgaaaagatgagctccaacagcaatttctccgaagtgactttggccgggctggctagtaaagaaaacttctccaacgtttccctgaggtctgtgaacctgaccgagcagaactcaaacaattccgccgtaccttataagaggctgatgctacttcagattaaagggcgaaggcacgtccagacacgcctcgtggagccacgggcctccgcacttaattctggggactgctttcttctgctgtcacctcattgttgtttcctgtgggttggggaatttgccaacgttatcgagaaggctaaagcgtcagaactagctacccttattcagaccaaacgggaattggggtgtagggccacatacattcaaactatagaagaggggattaatacgcacacccatgcagccaaagacttttggaagctcctaggcgggcagaccagctaccagagcgctggagatcccaaggaagacgaactgtacgaggcagctattattgagacaaactgtatataccggctgatggatgataagctggtccccgatgatgactattggggtaagatacccaaatgcagtctgcttcagcctaaggaagttctggtgtttgacttcggcagtgaggtgtatgtgtggcacggcaaggaagtgactttagcacagcgtaagatcgcatttcagctcgcaaagcatctgtggaatggcaccttcgactatgagaactgtgatattaacccccttgatcccggggagtgcaaccctctaataccacgaaaaggccaagggcgcccagactgggccatcttcggccggctgaccgaacacaacgagactatcctgtttaaggaaaaattcctcgactggaccgaactcaaacgctctaatgagaagaatccaggggaactggcccagcacaaggaggatccccgcacagacgtaaaggcgtacgatgtgactcgcatggtctcgatgccccagactacagccggcaccatcctggacggggtgaacgtcggaagagggtacgggctggtcgagggccatgatcgaagacaattcgagatcacttctgtttccgtcgacgtctggcacattcttgagtttgattatagccggctgcctaagcagtcgattggtcagtttcatgagggcgacgcctatgttgtgaagtggaagtttatggtttcaaccgccgttggttcccgacaaaagggagagcattcagttcgagcggccggtaaggaaaagtgcgtgtatttcttctggcaggggagacattccactgtgtccgagaaaggaactagcgcactgatgacagtggaacttgacgaggagaggggcgctcaggtgcaggtcctgcagggcaaggagccaccttgtttcctgcagtgtttccagggcggaatggtcgtgcatagcggacgccgagaggaagaggaagagaatgtgcaatcagaatggcgtctatactgtgtccgaggggaagtaccggtcgagggaaacctgctcgaggtcgcctgccattgcagcagcctccgcagccggacaagtatggtggtactgaacgtgaataaagctttgatctacctgtggcacggatgcaaggctcaggctcacacaaaggaagtggggcgcacggcagctaacaaaattaaggagcagtgcccactagaagcgggactgcactcatctagcaaggtgaccatacatgaatgtgatgagggatccgagccactcggcttttgggatgccttagggagaagggacagaaaggcctacgactgtatgctgcaggaccccggcagcttcaactttgcccccagactcttcatactgtcttccagttctggagattttgcagccacggagttcgtgtatcccgccagggccccctccgtggtttcctccatgccctttttacaagaggatttgtactccgctcctcagccagcactttttctggttgacaaccaccacgaggtgtatctatggcagggatggtggccaatcgagaataagattactggctccgccaggatccggtgggcatcggaccgcaaatccgcgatggaaacagtgctgcagtattgtaaaggcaagaatctcaaaaagccggcccccaagtcctatctgatccacgccggtctggagcctctgacatttactaacatgtttccttcttgggagcatagggaggatattgcagagataacagaaatggatacagaagtcagcaaccagataaccctggtggaggacgtcctcgctaagctctgcaagactatttaccctctggctgaccttctcgctagacctctgcccgagggagtggatcccctcaagctggaaatctacctgactgacgaggattttgaattcgcgctcgatatgaccagagacgaatataatgcgctccctgcctggaagcaggtgaaccttaagaaggcaaagggcctgttttag

SEQ ID NO: 26530 - DNA, 5367 bp, Artificial Sequence
  Description of Artificial Sequence: Synthetic coding sequence
atgaagcggaaggagcggatcgcccggcggctggagggcatcgagaatgacactcagccaatcttgctgcagagctgtaccgggcttgttactcacagactgctggaagaggacaccccaagatatatgcgggcaagtgatcctgccagccctcatatcggcaggtccaacgaggaggaggaaacttcagactcgtccttagaaaagcagacaagaagtaagtactgcacagaaacttcgggtgtgcatggcgatagcccctatggatcaggaacgatggatacccatagtctcgagtccaaagccgaacggattgcacgctacaaggcagaaagacggagacagctcgcggaaaaatatggcctcactttagatccagaggctgatagcgaatacctatcccgctataccaagtctcggaaagagccagacgcagtcgagaagcgtggggggaaatccgataagcaggaagagagctcccgcgacgcttcctcactttatcccggaaccgaaactatgggcctgagaacgtgtgctggggagagcaaggactacgctctgcacgtcggcgatggtagctctgatccagaggttctcttgaacatcgaaaaccagaggcgcggccaagagctctctgcgacgcggcaggctcatgatctgtcccccgcagctgaaagcagttctactttctcttttagcggcagagacagcagcttcaccgaggtacccaggtctccgaaacacgcccatagtagttccttacagcaagccgcaagtcggtctccatcattcggtgacccccagctgtcgccggaagcccgtcctaggtgcactagccatagtgaaacgccaacagttgacgacgaggagaaggtggacgagagggccaaattaagtgtggctgccaaaagattgcttttcagggagatggaaaagagtttcgacgagcagaacgtccctaagagacgcagtcggaataccgcggtggagcaaagattgagacgtctccaggaccggtctctcacccagcccattaccaccgaagaagttgtgatcgcagccaccctgcaggcaagcgctcaccaaaaggcactggcaaaggatcaaacaaatgagggcaaagagctcgccgaacagggagagcctgatagttcaacactttcactggcagaaaagctggctctgtttaacaaactctcacagccagtatctaaggctatctccacaaggaataggatagataccagacaaagacgcatgaatgcccgctatcaaacacagccagtgacgctcggcgaggtggagcaggtgcagagcgggaagctcatcccatttagtcctgctgtaaacacctctgtgagcaccgtggcgtcaactgtcgctccgatgtacgccggagatctccgcactaagcccccattagaccataatgcaagtgcaaccgattataaattttcatcttccattgagaactcagactcgcccgttcgcagcattcttaagagccaagcttggcagcccctggtggaaggctcagaaaataaaggcatgctcagggagtatggagagactgagagcaaaagagccctgactggccgggatagcggtatggaaaagtatgggtcattcgaagaggccgaggcctcttacccaatcttgaacagagctagagaaggggatagtcacaaagaaagcaagtatgcggttccacggaggggcagcctggagcgcgctaacccccccataacacatctgggagacgaacctaaggaatttagcatggccaagatgaatgctcaaggcaacctagacctgcgcgaccgactgccattcgaagaaaaagtggaggtcgagaacgtgatgaaaaggaaattttccttaagggccgcagagttcggtgaacccacaagcgagcaaaccggaacagcggccggcaaaaccattgcccagaccaccgccccagtttcctggaagccccaagattccagcgagcagccacaggaaaaactatgtaaaaacccgtgcgcaatgtttgccgccggcgagatcaagactccaacgggcgaggggttgttagacagtccctccaaaactatgagcatcaaagagcgacttgctctgctcaagaaatcaggagaggaggattggcgcaataggctgagcagacgacaggagggcgggaaagcgcccgcttcctcattacacactcaggaagccggacggagcctaataaagaagcgggtcaccgaatcccgcgagtctcagatgactatcgaggaaagaaagcagctgataactgtccgagaagaggcttggaagacgcgcggccggggagccgccaatgattcaactcagttcaccgtggcgggccgcatggttaagaaggggctggccagtcccacagcgatcacccccgttgcctctcccatctgcggtaaaacgagaggcacgaccccagtctctaagcccctcgaagatatcgaggctcgcccagacatgcagcttgagagtgacctgaagcttgataggctggagacctttctgcgaagactgaacaataaagtaggaggtatgcacgaaactgtgctcacagtgaccggaaagagcgtcaaagaggttatgaaacctgacgatgacgagacgttcgcaaaattttacaggagcgtagattataatatgccacggtccccagtagagatggacgaagacttcgatgtcatcttcgacccgtatgcacccaagttgacttccagcgtagctgagcacaaaagggcagtgcgtcctaagaggagggtacaagcttctaagaaccccctcaaaatgctggctgccagagaagatctgctgcaggaatacaccgagcagaggctgaacgtagcattcatggagtctaaacgcatgaaggtcgagaagatgtcttcaaacagcaactttagcgaggttacactggcaggcctcgcctccaaggaaaatttctccaatgtatccctgagatctgtcaatttgaccgaacaaaactccaacaacagtgccgttccttataaacgtctgatgttactacagattaaggggagacgacacgtccagaccaggctggtcgaacctcgggcatcagccctgaattccggcgattgctttctcctgctctccccacactgttgcttcctgtgggtcggggagtttgctaacgtcatcgaaaaggctaaggctagcgagctggcaaccctgattcaaacaaaaagggagctcggctgccgggcaacatacatccagactattgaggagggcattaacacacacacccatgccgcaaaagatttttggaaactgttaggcggtcaaacctcttaccagagcgctggggacccaaaggaggacgagctgtatgaggcagccattatcgaaactaattgcatctaccggctgatggacgataaactggtacctgatgacgattactggggtaagattcctaagtgctctctgctgcagccgaaagaagtgttggttttcgatttcgggagtgaggtgtacgtgtggcacggtaaggaggtgactctagctcaacgtaaaatcgcattccaattagctaaacacttatggaacggaaccttcgattacgagaattgcgacataaatccccttgaccctggtgagtgcaatccgctgattcccagaaaggggcaagggcgacctgattgggctatctttggtaggctgaccgagcacaacgagaccatcttgtttaaagagaagtttcttgactggacagagctgaagagatctaacgagaagaaccccggggagctggcacagcacaaggaggatccccgcacagatgtgaaggcctatgacgtcacacgcatggtttccatgccacaaaccacagccggtaccatactggacggagtgaatgttgggcgggggtacggcctcgtagagggccatgatagaaggcagtttgagattacgagcgtgtctgtggacgtgtggcacatcctggagtttgactatagccggctgccgaagcagtctatcggccagtttcacgagggggatgcctatgtggtgaagtggaagttcatggtgtcaacagccgtggggtcgaggcagaagggcgaacacagtgttagagccgccggtaaggagaagtgcgtctacttcttttggcaaggcagacatagcactgtatctgagaagggcacaagcgccctgatgacggtagaactggatgaggagcgtggagcgcaagtgcaggtgctgcagggaaaggaaccaccctgtttcctacagtgcttccagggaggtatggtcgtgcattcagggcggagggaggaagaggaggagaatgtccaatctgagtggaggttatattgtgtccggggggaagtgcccgtggagggaaatcttctggaagtggcctgccactgctcttcgctcaggagccgcacgagcatggtggtcttgaacgtcaataaggctcttatatatctgtggcacggatgtaaggcacaggcccacaccaaggaggtgggccgcaccgccgctaacaagatcaaagaacagtgccctctcgaagcaggtttgcacagtagctcgaaagttaccattcacgaatgcgacgaaggctcagaacctttgggtttttgggatgccttgggcaggagagatagaaaggcttacgattgcatgttgcaggacccggggagctttaacttcgccccccgcttgtttatcctgagctcttcctctggcgacttcgcagctaccgagtttgtatatccagctcgcgctccatctgtggtgagctccatgccttttcttcaggaggacctgtacagcgcccctcagcccgccctcttcctagtggataatcaccatgaggtctatctctggcaagggtggtggccgatcgagaacaaaatcaccggcagcgcacggatccggtgggcctccgaccgaaagtccgctatggagactgtcctccaatattgcaagggtaagaacctgaagaaacctgctccgaaatcctatcttattcacgcggggctggagcccctgacctttactaacatgtttcccagttgggaacaccgagaagacatcgccgagatcaccgaaatggacaccgaagtgtcgaaccagatcaccctcgtggaggatgtcctggcaaagctgtgtaaaactatttatcccctagcggacctcctggcccgaccactgcccgaaggagtcgatcctctcaagctggaaatatacttgaccgatgaagactttgaattcgcccttgatatgacgcgcgacgaatacaatgccctgccggcctggaagcaggttaatctgaaaaaagccaagggtctgttttag

SEQ ID NO: 26531 - DNA, 3387 bp, Artificial Sequence
  Description of Artificial Sequence: Synthetic coding sequence
atgttcgccgccggcgagatcaagacccccaccggcgagggcctgctggactctcctagcaaaaccatgagtattaaggaacgcttggcccttctcaaaaaatcaggagaagaggactggcgcaaccgcctgagtcgtaggcaggagggcggaaaagcccctgcctcatctttacatacgcaagaagccggccgatcactcatcaaaaaagaggaaggcggcgtggctgatgacagcgcgatatctaatttgttgtggcgcgtcaccgagtctagggagagtcagatgaccattgaggaacgtaagcagctcattaccgtaagggaggaagcatggaagacaagaggcaggggagctgccaacgattcaacccaatttaccgttgccggaagaatggtcaaaaaaggccttgccagccctacagcgattactcctgtggcatctccaatctgcggcaagacaagaggtacgacacccgtctccaaacccctggaagatattgaggccagaccagatatgcagctcgaatcagatctgaaactggaccggctcgagactttcctcagaagactcaataacaaggtgggcggtatgcacgaaaccgttctcacggttaccggcaaatctgtgaaggaagtaatgaaaccggatgacgacgagacctttgccaaattttatcggtcagtggactataacatgccaaggagtccagttgaaatggatgaggacttcgatgtgatttttgatccttatgcacccaaactgacctccagcgtggccgagcacaaaagagccgtccggccaaaacgccgggtccaggccagcaagaatcctctcaagatgctggcagctcgagaggacctgctgcaggaatatacagaacagcgtctgaatgtggcattcatggaaagtaagaggatgaaggtcgaaaagatgagttccaactccaactttagcgaggtcaccctggcagggttggctagtaaagagaacttctcaaatgtttctctccgcagcgtgaacctgactgagcaaaattccaataatagcgcagttccgtataaacggctgatgttactgcagattaagggtagacgccacgtacagacacgccttgtcgagcctagggcgagcgcgctgaatagtggggactgttttcttctactctcccctcattgttgcttcttgtgggtcggggaattcgccaatgttatcgagaaagctaaggcaagtgaactcgcaacacttatacagaccaagcgggagctgggatgtagggccacctatatacagaccatcgaagagggtataaatacacacacgcacgccgcaaaggatttttggaaactgttagggggacagacctcataccagagtgccggcgatcccaaagaagatgaactctacgaggccgccatcatagagaccaattgcatctatcgactcatggacgataagcttgtcccagacgatgactactggggcaagatccccaagtgtagtctgctgcaaccgaaggaagttctggtgttcgacttcggtagcgaagtgtacgtgtggcatggaaaagaggttacactggcgcaacgaaagattgcgttccagctggctaaacacctatggaatggaaccttcgactatgagaattgcgatatcaaccctctcgatcccggagagtgtaatcctctgatccccagaaaaggccagggtagaccagactgggccatttttggtagactcaccgaacataatgaaaccatcctgttcaaggagaagttccttgattggacagaactgaaacgctctaatgagaagaaccccggtgagctggcacagcataaggaagacccccgcaccgacgtgaaggcatacgacgttacacggatggtcagcatgcctcagacaaccgcgggaactatcctggacggggtgaacgtaggcaggggctacggacttgttgaggggcatgatcgcagacaattcgagattacctcagttagcgtcgacgtttggcacatcctcgagtttgattactcccgactccccaagcagtccatcggtcagttccatgagggggatgcctacgtcgtcaaatggaaatttatggtgtccactgctgtcggaagcaggcaaaaaggcgagcactctgtcagggccgcaggcaaagagaaatgtgtttattttttttggcagggaaggcatagcacagtgtcagaaaaaggaacttctgcattaatgacagtggagttagacgaggaaagaggagcgcaagtccaagtgctgcaagggaaagaaccaccatgtttccttcagtgtttccagggcggaatggtggtgcacagcggtagaagggaggaagaagaggaaaacgtgcagtctgagtggcggttgtactgtgtgcgaggcgaggtgccagtggagggtaatctgctcgaggtggcttgccattgttccagcctgagatcaaggacctccatggttgtcctaaatgtgaacaaggccttaatttatttatggcacgggtgtaaagcccaggcacacacaaaagaggttggtaggaccgcagccaataagataaaggagcagtgtccactggaagccgggttacattcatcttccaaagtaactatccacgagtgcgatgaggggtccgaacccctcggcttctgggatgccctcggtcgccgggatcgcaaagcctatgattgtatgctccaggacccagggtctttcaatttcgctcctcgtctcttcatcctgagttccagctctggagacttcgccgctactgagtttgtatacccggcacgcgcgccttcagtggtgtcaagcatgccattccttcaagaagatctgtactccgcccctcagcccgccctatttttggtcgacaaccaccacgaggtctatctgtggcaggggtggtggcccattgaaaacaagataacaggcagtgcccgtatccgctgggcatcggatcggaaatcagccatggagactgtgcttcagtactgcaaggggaagaacttaaagaagcctgctcccaaaagctacctcatccacgcaggcctagaacccctgaccttcaccaatatgttcccctcatgggaacatcgagaggatatcgcggagatcaccgagatggacacagaagtgagtaaccagattactttggtggaggatgtgctagccaagctgtgcaaaacaatttatcctctggcagatcttcttgcaagaccacttcccgaaggcgtggaccctttaaagttagagatctacctcacagacgaagactttgaattcgctctcgatatgacaagggatgaatacaacgccttaccggcttggaaacaggtgaacctcaagaaagctaaaggtttgttttag

SEQ ID NO: 26532 - DNA, 2301 bp, Artificial Sequence
  Description of Artificial Sequence: Synthetic coding sequence
atgaagcggaagttcagcctgcgggccgccgagttcggcgagcccacatccgagcagacaggaaccgctgctggtaagaccatcgcccagacaaccgccccagtgtcttggaaaccacaagactcttccgaacaaccgcaggagaaactctgcaaaaacccttgcgctatgttcgccgctggagaaatcaagacgccaacgggagaaggcctgctggactctccatctaaaacgatgtccatcaaagagcggctggcacttctgaaaaagtcaggagaggaagactggaggaatcgcttatcccggcgccaagaaggcgggaaagcacccgcttctagtttacacactcaggaagccggccgcagcctcattaagaaacgcgtgaccgaatcgcgagagagtcagatgacaatcgaggagcgcaagcaactcatcaccgtgcgtgaggaggcgtggaaaacacgtggccgtggggctgctaatgactctacccagttcactgtcgccgggaggatggtgaagaaaggcctcgcctccccaacagcaattactccagtggcctctccaatttgcggcaaaacgcgtgggacaacgccggtttccaaacccctggaggacatagaagctcgcccagatatgcagttggaatcagatttgaagctcgatcgactggagacattcctccgcaggctgaataataaagtgggggggatgcatgaaactgtcctgacagtgacgggcaaaagcgtcaaggaggtgatgaagcctgatgatgacgagaccttcgccaaattttataggagcgtagactacaacatgccaagaagcccggtggagatggacgaggactttgatgtaatctttgatccatatgcaccaaagttgacctcaagtgtggcggaacacaaaagggctgtgaggcctaaaaggcgcgttcaggcaagtaaaaaccccctgaaaatgcttgcagctagagaagatctgctgcaggaatacaccgaacagcgcttgaacgttgctttcatggaatcaaagagaatgaaagtcgaaaagatgtcctccaattccaacttctcagaagtgacgctggccggattggcaagcaaagaaaatttctccaacgtctccttgcgaagcgtcaatcttactgaacaaaactctaacaatagtgcagtgccctacaagaggctgatgcttctgcagataaagggccgaaggcacgttcagacaaggctagtggaacctcgagccagcgcgctcaattctggcgattgcttcctcttgctttcaccccactgttgttttctttgggtgggggaattcgctaacgtgatagaaaaagcaaaggcgtccgagctcgccactctgattcagacgaaacgagagctgggttgcagggctacctacatccagacaattgaagaagggatcaatacccatacacatgcagccaaagatttctggaagctcctgggcggtcaaaccagctatcaatccgcgggtgatcccaaagaagatgagctgtacgaagctgccatcatcgaaacaaactgcatctaccggcttatggacgataagctcgtgccggatgatgactattggggaaagatcccaaaatgctcactcctgcagcctaaggaggtcctggtttttgattttggctctgaagtttatgtctggcacgggaaagaggttacgctggcacagcggaagatagcctttcagctggcgaagcacctgtggaacgggacgtttgactatgagaactgcgacatcaatcctctcgatcccggtgagtgcaaccctttgattccacggaaggggcaagggaggccagactgggcaatttttggaaggttgactgagcacaacgaaaccatcctcttcaaagaaaagttcctcgactggaccgaactaaagcgaagcaacgagaagaaccccggagagctggcccagcacaaggaggacccccgtactgacgtgaaagcctacgatgtgacacggatggtgtctatgccccagacaactgccggaaccatcctcgacggggtgaatgtcggtcgaggttacggcctggtggagggtcatgaccgccggcaattcgagatcacaagcgtgtctgttgacgtatggcatattttggaatttgactacagccggctgccaaagcagtccattggccaattccatgaaggtgacgcctacgtagtgaaatggaaattcatggtaagtaccgccgttctcagggcttggcgtggagctaggggacgcgagttcgccggatctggcttaagcctgtag

SEQ ID NO: 26533 - DNA, 1758 bp, Artificial Sequence
  Description of Artificial Sequence: Synthetic coding sequence
atgaacagcagcgacgtgagcagcctgaagcaccccagcagcctggcctcccctaccgcaatcactccagttgcatctcctatctgcggcaagactaggggtactactcccgtaagtaaaccattggaggacatagaggcacgcccggacatgcagctggagagcgatctgaaacttgatcgcctggagacatttctgcgcagattgaacaacaaggtggggggcatgcacgagaccgtgctaacagttaccgggaaatccgtgaaagaggtgatgaaacccgacgacgacgaaacattcgcaaaattctataggagcgttgactataacatgccacggagtcccgtagaaatggacgaggatttcgatgtgatcttcgacccctacgcacctaagctcacatcaagcgtcgcggagcacaagcgagcagtccgacctaaacggagagtacaggcctctaagaatcctctgaaaatgctagctgccagagaggatttattacaagaatacacggagcagagactgaatgttgcgtttatggaatcaaagagaatgaaagtagagaagatgtccagtaattcgaacttttccgaggttaccctagccggtctggcaagtaaagagaacttctcaaacgttagtctgagaagtgttaaccttactgagcagaattctaataattcagccgtcccatacaaaagactgatgcttctccagattaagggtcgacggcatgtccagacacggcttgtggaacccagagccagtgcgctgaacagtggtgattgcttcctcctgctgtctcctcactgctgctttctgtgggtcggcgagtttgccaacgtgattgagaaggccaaggcctctgagcttgcaactttgatacagaccaagcgcgaactcggatgccgcgctacctatattcagaccatcgaagagggcattaatacacatacccatgctgcaaaggacttctggaaacttctgggtgggcaaacatcttatcaaagcgccggggatcccaaggaggacgagctttatgaggccgcaatcattgagacaaactgtatataccgccttatggatgacaagttggtcccagacgatgactactggggaaaaatacctaagtgcagtctgttacaaccgaaagaagtcctcgttttcgacttcggatcagaggtgtacgtgtggcatggcaaggaagtgacacttgcccagcgaaaaattgctttccaattggctaagcatctctggaacggcacttttgattacgagaactgtgacatcaatccgctggaccccggcgagtgcaatcctttgatcccccggaaaggtcaagggaggcctgactgggcgatcttcggtagattaacagaacataacgaaaccatcctgttcaaggagaaatttttagactggactgagctgaagaggtcaaatgagaaaaaccctggggagttggcccaacataaggaagaccctaggacagacgtcaaggcctacgacgtgactcggatggtttcaatgcctcagactactgccgggactattctggacggtgtgaacgtgggtagaggctatggactcgtcgagggtcacgacagaaggcagtttgagataacatcagtgtccgtcgatgtgtggcatattctggaattcgactacagtagacttccgaagcagagcattggtcagttccacgaaggcgacgcctacgtggttaaatggaaatttatggtctcaaccgccggttag

SEQ ID NO: 26534 - DNA, 636 bp, Artificial Sequence
  Description of Artificial Sequence: Synthetic coding sequence
atggtggcccacaaccaggtggccgccgacaacgccgtgagcaccgcagcagagccacgccggaggccggagccgagttcttccagttcctcatctccggccgccccagcccgccctcgcccttgtcccgctgttccagcacccgctccaggagatacccactttcgcactttccggagccatgcagattatagaagaattacccgtgcctcagctcttctcgatgcctgcggcttttactgggggccccttagcgttcacggagcacatgaacgtctgcgcgcagaaccggtgggtactttcctggtgcgggacagtaggcagaggaattgctttttcgcattgagcgtcaagatggcatcagggcccacaagcatacgtgtgcacttccaggcgggaaggttccaccttgacgggtccagggagtccttcgactgcttatttgagctacttgagcactacgtcgctgccccgcgccgcatgttgggtgctcccctccgacaacgtagagttcgaccactgcaggaactctgccgtcagcggatagttgctaccgtcggccgggagaatctagcgcggatccccctgaatcctgtcctcagagactacctctcttccttcccttttcagatctag

SEQ ID NO: 26535 - DNA, 678 bp, Artificial Sequence
  Description of Artificial Sequence: Synthetic coding sequence
atggtgacccacagcaagttccccgccgccggcatgagccggcccctcgatacgtctttgagactgaagaccttcagttccaaaagcgagtatcagttggtagttaatgccgtgaggaaactgcaggagtctggcttttactggagtgccgtcaccggcggggaggctaacctcctcctctctgccgagccggcaggaacctttctgattcgcgactcatccgatcagagacatttcttcaccctcagtgttaagactcagagcgggacaaagaatttgagaattcagtgcgaaggagggagctttagcttacagtccgatcccagaagcacgcagcccgtgccccggttcgattgtgttctcaaactcgtccaccactacatgccaccccccggtgcaccatcttttccatcgcctcccacagagcccagctctgaagtgccagagcagcctagcgcccagccgctgcccggcagcccccccaggcgggcttactatatttatagcggtggcgagaagatccctctggtgttgagccgtccgctctcttcaaatgtcgctaccttgcagcacctgtgccgaaaaacggtgaatggccacctggattcctatgaaaaggtaacacagcttcctggacccatccgtgagtttctcgatcaatacgacgcaccgctgtag

SEQ ID NO: 26536 - DNA, 1302 bp, Artificial Sequence
  Description of Artificial Sequence: Synthetic coding sequence
atggccgagctgcggcccagcggcgcccccggccccaccgcccccccagcaccgggccccacagctccgcctgcatttgcctccctgtttcctccgggtctacacgccatttatggagagtgtcgcaggctgtacccggaccagccgaatccgttacaggtgactgccatcgtaaagtactggctgggcggacctgatcccctcgactacgtcagtatgtacaggaacgtgggcagcccttctgccaatatcccggaacattggcattatataagcttcggattaagtgacctgtatggtgataatcgggtccatgaatttaccggtacagatggccccagcggctttggctttgagctgacctttagattaaaacgtgaaacaggtgagtctgctcccccaacgtggccagccgaactgatgcagggtctggctcgatacgtcttccaaagtgagaacacgttttgttctggcgatcacgtatcatggcactcgccattggacaactccgagagccggatccaacatatgctcctgaccgaagacccgcaaatgcagcctgtgcagactccgtttggagttgtcacctttcttcagattgtgggagtgtgcacagaggagctacattctgcacagcagtggaacgggcagggcatcctggaactgttaagaacagtccccatcgctggtggcccatggctcattacagatatgagacgcggcgagacgatatttgagattgacccacatctgcaggagagggtggataagggaatcgagaccgacggcagtaatctgagcggcgtctcggcaaaatgcgcatgggatgacctatctcgacccccggaggatgacgaggattcacgttccatctgtattggtacacaaccgcggcgactgtcgggcaaagacacagaacagatccgcgaaacccttaggcggggattggagatcaactccaaacccgtgctcccgcccataaatccccagaggcagaatggactggcacacgacagggccccctcccggaaggacagtcttgagtccgattcaagtacggccatcatccctcatgagctgatacggacacgacagttggagagcgtgcacctcaaatttaatcaggaatctggcgcactgatcccactgtgcctgagggggagacttttgcatggaagacacttcacctacaagagcattacaggtgacatggcgattaccttcgtttccactggggttgagggtgccttcgccaccgaggaacatccgtacgctgcacatggcccctggctacagctctag

SEQ ID NO: 26537 - DNA, 1455 bp, Artificial Sequence
  Description of Artificial Sequence: Synthetic coding sequence
atggccgagctgcggcccagcggcgcccccggccccaccgccccccctgcccccgggcctaccgcccctcctgcattcgcgagcctcttcccaccaggactccatgctatttatggtgagtgcaggcggttgtaccctgatcaacccaaccccctgcaggtcacggctatagttaagtactggttgggtgggcccgaccctctagactatgtgtctatgtatagaaatgtcggatcaccaagcgccaatataccagaacactggcactatatttcatttggtctctccgacctgtacggggataatcgcgtgcacgagttcactggtacggacggcccaagcggattcggcttcgagttaacattcagactaaagcgagagacaggggagtctgctcctcctacatggcctgccgagctaatgcagggactcgctaggtacgtgttccagtccgagaacacattttgcagcggtgaccacgtttcttggcatagccccctggacaattctgaatcgagaatccagcatatgctgctcaccgaagacccccagatgcagcctgtgcagacccccttcggcgtggtgaccttcctacagattgtgggcgtctgcacagaggaactacactccgcacaacagtggaatgggcaaggtatactggagttgctgcggactgtccctatcgcaggaggcccctggctgattaccgatatgaggaggggcgaaaccatcttcgaaatcgaccctcacctgcaggagagggtcgacaaagggatcgaaaccgacgggagcaacctgagcggtgtatccgcgaagtgcgcctgggatgatttgagcagaccccccgaggacgatgaagattcccggtctatatgtatcggtactcaacctagaaggctatccgggaaagataccgagcaaatacgcgagaccctgcgccggggactggagataaattccaagcccgtgctcccacccattaacccacagcggcagaacgggcttgctcatgatagggctccgtcgcgaaaggattccctagagagcgattcctccaccgccatcattccacacgagctgatccgaactagacaactcgaaagtgtgcatttgaagttcaaccaggagtcaggcgctctgatccccctgtgcctgcgtgggaggcttctccacggcaggcactttacctataagtcgatcacaggagatatggccatcacctttgtaagcacaggcgtggaaggagccttcgccacagaggagcacccctatgccgcgcatggaccatggcttcagattttgttaactgaagagtttgttgaaaaaatgctcgaagacctcgaggatttgacttctccagaggagttcaagttacccaaagaatacagctggccagaaaagaaacttaaggtgagcatcctgccagacgtcgtctttgatagcccgctccactag

SEQ ID NO: 26538 - DNA, 240 bp, Artificial Sequence
  Description of Artificial Sequence: Synthetic coding sequence
atggcccggagccggctgaccgccaccagcgtgagccaggtgcaggaaaatgggttcgtgaagaagttagaacctaagtccggttggatgacattcctagaggtgacagggaagatctgcgagatgcttttttgccccgaagcaatcctgctaacccgtaaggacactccatactgcgagaccggactgatctttctgaccttgaccaagaccatcgctaatacctatttttacttctag

SEQ ID NO: 26539 - DNA, 240 bp, Artificial Sequence
  Description of Artificial Sequence: Synthetic coding sequence
atggcccggagccggctgaccgccaccagcgtgagccaggtgcaggaaaatggattcgtgaaaaagttggagcctaaatctggctggatgacgtttctagaggtaaccggcaagatctgtgaaatgctcttttgtccggaggccattctcctgacacggaaggataccccatactgtgaaactggtctcattttcctaaccctgactaagacaattgctaacacatatttctacttttag

SEQ ID NO: 26540 - DNA, 1245 bp, Artificial Sequence
  Description of Artificial Sequence: Synthetic coding sequence
atgaacctgcagcggtactggggcgagatccccatcagcagcagccaaacgaataggtcatcatttgatctgctgccgagagagttccgtttagtggaggtgcacgacccccctcttcatcaaccatccgctaataagcccaaaccaccgacaatgctggatattcccagcgaaccctgttctctgaccatccacactattcagctaattcagcacaatcgtcggctaagaaaccttattgcaacggcccaagcacaaaaccagcaacagactgaaggagtcaagaccgaggaatccgaacctcttccttcctgccccgggtccccacccctgcccgatgatctcctgccgctcgactgtaagaaccctaacgctccatttcaaattcggcactctgatcccgaatctgatttctaccgcggaaagggagaaccggtcacagagctctcttggcactcatgccgacagctactgtatcaggcagtggctacgattctcgcacacgccgggttcgactgcgccaatgaatccgttcttgagaccctaaccgatgtggctcatgaatattgtctgaagtttactaaactactgcgctttgccgtagacagagaagctcggctcggtcagacgcctttccctgacgtcatggagcaggtctttcacgaggtcggcatcggatctgtcctgagcctgcagaagttctggcagcacaggattaaggattaccactcatacatgttacagatttctaagcagctgagcgaagagtatgagcgtatagtgaacccagaaaaggccacagaggatgccaagccagtgaagataaaggaagagccagtctcggatatcacctttcctgtatctgaggaactggaagcagacttggctagcggagaccagagtctgcctatgggcgtcctgggggcccagtctgagaggtttccctccaacctggaagtggaagcttcaccacaggcatcgagcgcagaggttaacgcctcacctctctggaacctggctcatgtgaaaatggaaccacaggagtctgaagaaggaaacgtcagcggacacggggtgctgggttctgatgtgtttgaggagccgatgtctggcatgtccgaagccggaattccacagagcccagatgatagtgacagctcatacgggagccacagtaccgatagtctcatgggtagtagccccgtgtttaatcagcgatgtaagaaaagaatgaggaagatctag

SEQ ID NO: 26541 - DNA, 840 bp, Artificial Sequence
  Description of Artificial Sequence: Synthetic coding sequence
atgaacctgcagagcggcaagggcgagcccgtgaccgagctgagctggcactcctgccgtcagcttctgtatcaggcagtggccaccattcttgcacacgctggcttcgattgtgctaacgaatcagtcctggagacactgactgacgtggcacatgaatactgccttaagttcacaaaacttctaagattcgctgttgaccgtgaagcacgactgggccagactccattcccggacgtgatggagcaggtgtttcatgaggtgggtattggctctgtcctgagccttcaaaagttttggcaacaccggatcaaagattaccattcatacatgctacaaatcagtaaacagttatcggaggaatacgaacgcatcgtgaacccagagaaggccacagaagatgctaagcctgtgaaaatcaaggaggaaccagttagtgacattaccttccccgtctctgaggagctggaggccgacctggcatctggtgaccagagtttgcctatgggcgtcctgggtgcccagtccgagagattccccagcaacctcgaagtagaagcgagcccacaagcttcaagcgctgaggttaatgcaagcccactgtggaacctcgctcatgtcaaaatggagccccaggagagcgaggaaggcaatgtgagcggacatggagtgctaggatccgatgtcttcgaggaacccatgagtggtatgagcgaagccggaatacctcagtcccctgacgactcggatagttcttacggcagccactccacagactcactcatgggttcctctcctgtcttcaatcagaggtgtaaaaaacgaatgaggaagatatag

SEQ ID NO: 26542 - DNA, 1239 bp, Artificial Sequence
  Description of Artificial Sequence: Synthetic coding sequence
atgctgcggtactggggcgagatccccatcagcagcagccagaccaacaggagctctttcgatctgctccctagggagttcagactggtggaagtgcatgatccacccctccaccagccatcagcgaacaagcctaagcccccaacgatgctcgacataccaagtgagccttgcagtctgacgatccacacaattcagcttatacaacacaaccgacggctccggaacctgatcgctacagcccaggcacaaaaccagcagcagactgagggagttaagacggaggaatcagagcccttgccctcttgtcctggtagtccgcctctgccagacgatctgctccctctggactgcaagaaccctaacgcaccttttcagatccggcacagcgatcctgagtcagatttctatagggggaaaggggagcccgttacagagctcagttggcactcctgtcggcagttgctgtatcaggcagtcgccaccattttggcacatgcagggtttgattgtgctaacgaatcagtgttagagaccttgacagacgtcgcccacgaatattgtctcaagttcacaaagcttctgcggtttgcagtcgatcgggaggctcgcctcggacagacacccttccccgatgtgatggaacaagtctttcacgaggtgggcatcggttccgtgttgagtctgcaaaaattttggcagcatcgtatcaaagactatcacagttacatgttacagatctccaaacagctgtctgaagaatatgaacgcatcgtgaaccctgagaaagctaccgaggatgctaagcccgtaaaaatcaaagaggaaccggtgagcgacatcacattccccgtatccgaggagttagaggctgacctagcttcaggcgaccagtccctgccgatgggcgtgttgggcgcacagtctgagaggtttccgagtaacttggaggtcgaggcttcgccacaagcttcttccgcagaggtaaatgcatctcccctgtggaacttagcccatgtgaaaatggagccccaagagtccgaggagggtaatgtctcaggacacggcgtactggggagtgacgtcttcgaggagcccatgtccgggatgtctgaggcaggtattcctcagagtcccgacgacagcgactcatcatacggctctcactccacggacagcctgatggggagttctccagtattcaatcagcggtgcaagaagcgtatgaggaaaatttag

SEQ ID NO: 26543 - DNA, 1239 bp, Artificial Sequence
  Description of Artificial Sequence: Synthetic coding sequence
atgctgcggtactggggcgagatccccatcagcagcagccagaccaaccggtcctctttcgatctcctgccacgggagttccgattggtggaggtccacgatccccctctccaccaaccctctgctaataagcccaaacccccaacaatgctggatattccgtctgagccttgctccctgacaattcacacaatccaactaattcaacataacagacgattgcggaacctgattgcaactgcacaggcccaaaaccagcagcaaacagagggagtgaaaacagaggaatccgagccattgccctcttgcccaggcagtcctcccttgccagacgatctgctgccactagattgcaagaatcccaacgctccattccaaatcaggcactccgaccctgagtccgatttttaccgaggcaagggcgaacctgtaacggaactgtcttggcatagctgcaggcagcttctttaccaggcggttgcaacaatactggcacatgccggcttcgactgcgcaaacgaatccgtgctcgagaccctgaccgacgtggcacacgaatactgtctcaaatttactaaactccttagatttgctgttgatcgagaggcgcgcctcgggcagactccattcccagacgtgatggagcaggtttttcatgaggtcggtatcggctccgtcctttctttgcaaaagttttggcagcaccgcatcaaagattatcactcctacatgctccaaatatcgaagcagctcagtgaggaatatgagaggatcgtcaacccagaaaaagctacagaggacgctaaacccgtgaaaatcaaggaagagccggtaagcgatataacgttccctgttagcgaagaactggaggcagatctggcatccggagatcagagcctcccaatgggcgtgctgggagcccaatcagagcggtttccttcgaatttggaagtcgaagcatctccacaggcttccagtgctgaggtaaacgcaagtccgctctggaacctcgcgcacgtgaagatggagccacaggagtcagaggaaggcaacgtttcggggcatggcgtgctgggcagtgacgtattcgaggagcctatgtccggcatgtccgaggccgggatcccacagtctcccgatgacagcgactcatcatacggatcccattcgacagattccctgatgggctcctctcctgtgtttaatcagaggtgcaagaaacgaatgcgcaaaatctag

SEQ ID NO: 26544 - DNA, 1239 bp, Artificial Sequence
  Description of Artificial Sequence: Synthetic coding sequence
atgctgcggtactggggcgagatccccatcagcagcagccagaccaatcgtagttccttcgatctgctgcctagggaatttcgcttagtggaagtacacgacccgcccctgcatcagcctagtgcgaacaagcccaaacccccaacaatgctggacatccctagcgagccatgttcactcactattcatacgattcaattgatccaacataatcggagactgcgtaatctcattgccacagcacaggctcagaatcaacagcagaccgaaggggtgaagactgaggaaagcgagccgttgccgagttgccctgggtctcccccccttcctgatgatctgttaccattagactgtaagaaccccaatgccccatttcaaatcagacatagcgatcccgaatcagatttttatcgtggaaagggggaacctgtaacagagttgtcctggcattcctgtcggcagcttctgtaccaggccgttgctacaatcctggctcacgctggattcgattgcgcgaacgagtctgtcctcgagacgctcacagatgtcgcccacgagtattgcctcaagttcaccaagttgctgagattcgccgttgatcgggaggcccgcctcgggcaaacaccttttcctgacgtgatggaacaggtgtttcatgaagtgggtatcgggtccgtgttgtccttgcagaaattttggcagcaccggattaaagattaccactcatacatgcttcaaataagtaagcagctctccgaggagtatgaacggatcgtgaaccccgagaaggcaaccgaggatgcaaagcccgtgaaaattaaggaagaacccgtcagcgatatcaccttcccggtgagtgaggaactcgaggcagacctggcgtccggcgatcaatctcttcctatgggcgtccttggcgcgcagtcggagcggttcccttccaatctcgaggtggaagcctccccacaagccagcagcgctgaagtaaatgcatccccgttatggaatcttgcccatgtgaagatggagccccaggagtcggaagagggcaatgtatctggacacggcgtcttggggagcgatgtgttcgaagaacccatgagcggcatgagcgaggccgggatacctcagagtcccgacgactcggacagcagttatgggtcccattccacagatagcttaatgggcagcagtccagtattcaatcagcggtgcaagaaacggatgcgaaagatttag

SEQ ID NO: 26545 - DNA, 1272 bp, Artificial Sequence
  Description of Artificial Sequence: Synthetic coding sequence
atggtgggcatgagccggctgcggaacgaccggctggccgacccccttacaggatgttctgtatgttgtaagtcatcctggaaccagcttcaggatctctgccggctggcgaaactcagctgtcctgctctcggcatctccaagcgtaatctgtacgattttgaggtggagtatctgtgcgactataaaaagatccgcgagcaagagtactatctagtcaaatggcgcggctaccctgacagcgaatccacatgggaacctcggcagaatttgaagtgcgtgaggattctgaagcaatttcacaaagacctggagagagaactgttgcggcggcatcataggtcaaagacccctagacacctggatccctccctcgctaattacctggttcagaaggccaagcaacgaagggccctgcgaagatgggagcaagaattgaatgctaagagatcccatctgggacggatcacagtcgaaaatgaggtcgacctggacgggcccccacgcgcttttgtatacatcaacgaatacagggtgggcgaagggattacactgaatcaggtggctgttggatgtgaatgccaagactgtttgtgggctccaaccggaggctgttgtcctggcgccagcctccacaaattcgcttacaatgatcagggtcaggtacgtttgcgtgcaggactgcccatttatgagtgcaatagtagatgtcgctgcgggtacgattgccctaatcgggtcgtgcagaaaggtataagatacgacctctgcattttccggaccgacgatggaagaggctggggagtacgtactcttgagaaaatcaggaaaaactcattcgtaatggaatacgttggcgaaatcattacctcagaggaggccgaaagacggggccagatctacgatcgccagggagcaacctacctctttgacctcgactacgttgaggatgtttacacggtggacgcggcgtattatggtaatatctcccatttcgttaatcactcctgtgacccgaatctccaggtgtataacgttttcatcgataacttagatgagagactgccccgtattgcctttttcgctactcgcacgatccgggctggggaagagctgaccttcgactacaatatgcaggtggatccagtcgacatggaaagcactaggatggatagcaattttgggcttgctggcctcccaggctcgcctaaaaaacgggtccgcatcgaatgcaaatgcgggacagagtcatgtcggaaatacctgttttag

SEQ ID NO: 26546 - DNA, 1239 bp, Artificial Sequence
  Description of Artificial Sequence: Synthetic coding sequence
atggccgagaacctgaagggctgcagcgtgtgctgcaagagcagctggaaccaactgcaggacctgtgcagattggcaaagctctcatgcccggcccttggtattagcaaaagaaatctatacgacttcgaggtggaatatctttgtgattacaaaaaaatacgggagcaagagtattatttggtgaaatggcggggctacccagattctgagagcacatgggaaccaaggcaaaatttgaagtgtgtacggattctcaaacagttccacaaggatctagaaagagagttacttcgacgacatcaccggtcaaagactcctagacacctagatccatccctcgccaattatctggtacaaaaggctaagcagaggagggctctacgacgctgggaacaagaactaaatgccaagcggagccatctcggaaggatcaccgtggagaatgaagttgatctggatgggcccccacgggcttttgtttatatcaacgagtatagagttggggagggcataacactcaatcaagtcgcggtcgggtgtgaatgtcaggactgtttgtgggcacctacagggggatgctgccccggggcctcccttcataaattcgcctacaacgatcaggggcaggtacgtctgcgagccggcttacccatttatgagtgtaattcccgttgccgctgcggctacgattgtcccaaccgcgtcgttcagaaagggatccgctatgacctgtgcatcttccgaacagatgatgggcgcggctggggagtgaggacgcttgagaaaatacggaagaactcattcgtgatggagtacgtcggggagatcattacatctgaagaagcagagcggcgagggcagatttacgaccgtcagggcgccacctatctcttcgatctcgattatgtggaggatgtgtatacagttgacgctgcttactacggtaacatctctcacttcgtgaatcactcctgtgaccccaatctgcaggtgtacaacgtgtttattgataatctggatgagaggttgcctaggattgcttttttcgcaacaaggaccattagagctggagaggagctgacatttgattataatatgcaggtcgatccagtggacatggaatcaacacggatggattcgaactttggcctggcgggtctgccgggtagtcctaagaagcgggttcggatagaatgcaaatgtgggaccgagtcttgtcgtaaatatctcttttag

SEQ ID NO: 26547 - DNA, 648 bp, Artificial Sequence
  Description of Artificial Sequence: Synthetic coding sequence
atggcctggatcagccggctgcgggagcacctggacggcccccccagagccttcgtgtacattaatgagtatagagtaggcgagggcatcactttgaatcaggtggctgtgggttgcgagtgccaggactgtctttgggccccaacaggaggatgttgccctggggcctccctgcataagtttgcctataacgatcaaggccaggtgcgactaagggctggcctgcccatctatgaatgcaattccaggtgcagatgcgggtatgattgccctaatagggtagttcagaaaggaatcaggtacgacttgtgtattttcaggaccgatgatggccgtgggtggggcgtgcggacccttgaaaagattagaaagaactcttttgttatggaccctgccttattgactgtgtgtctgaaacttccggcctttcccatgggtaaagcctgggagaccgatttgtcagtgactgggaccctagggaggggttgcggaaggggcgaggatcgactgcaagagtctcccttcccagttccagcacctagcgtgggttgcacatacaagcccccaccaacctttcgtaattctttctcaacttcccggttatctgtggtgggaattcacggcttgctgagaaggtctaagggatag

SEQ ID NO: 26548 - DNA, 1230 bp, Artificial Sequence
  Description of Artificial Sequence: Synthetic coding sequence
atggccgagaacctgaagggctgcagcgtgtgctgcaagagcagctggaatcaattacaggacctttgtcggctggccaagctctcttgtccagccctcggcatctctaagaggaatctgtacgattttgaagtcgaatatgttaggctgcaggaagacccaagaaccggcatacttccaggggagatggcctggataagtagactccgagaacaccttggcgctaccgcggagtcccaggtttgtgcctatccacaggctgtccctcaggggttgcgcaagggggctgccccagcagcaccacccgttaaagatccccccgcacctggaccgaaattgggccagctgcctggcgcagaaggtcaggctgaggcaggcgcaccgagcctcggggccggggctcaatgccaggcacatctcggcagaattacagtggagaatgaggttgatctggatgggccccctcgggcttttgtgtatataaacgaataccgagtgggagagggcatcacactgaaccaggtagccgtggggtgcgagtgtcaggattgtctgtgggctccaacaggagggtgctgcccaagacattgcactagtctacctaccatgacccgcgccagatgtgggttcgaacctggctgcccttccactagtgccacacccgccgctgctgccgcaatgaccgcccaaattgtgtggtaccgaagagtttcagatatgaccagcgcctcatcagcgcggatgatgggcgttgccggggccagtgccccttggcggcggtttgcgcgtactgcttcatcctggagtacctgggaacggtcattgccccagcgccggcagtctgggggccaaatctacgaccgccaaggagctacctatctgtttgatcttgattatgtggaagacgtatataccgtggatgcagcctattacgggaacatcagccatttcgttaaccactcctgcgatcccaatctgcaggtttacaacgtctttattgataacctcgacgaacggctgccaagcctgtccctgccacaagagccctccgggcaagcaagaagttcccccctcatcaccacatgtaaatggaccccttggacctggagggcacccgcttggacccctactctggcctggttaggctcactggctcctttgaggtcaggttcagtcctcaatgctagcgtggggctcagccccgcggcaaacaccagttcttccccgtag

SEQ ID NO: 26549 - DNA, 555 bp, Artificial Sequence
  Description of Artificial Sequence: Synthetic coding sequence
atggcctggatcagccggctgcgggagcacctgggcgccaccgccgagagccaggtgtgtgcttatcctcaggcagtgcctcaggggctgcgcaaaggcgccgccccagcagccccgcccgtaaaagatcccccggcccccggccccaaactgggccagctccctggcgctgaaggccaggctgagccaggctgcccatccacttcagcaacacccgcagctgccgcggcaatgacagcacagatcgtgtggtatagacgcgtgtccgatatgacaagcgcctcttctgccagaatgatgggcgtagccggggcgtcggctccttggcgtcggtttgctagaaccgcctcctcgtggagcacctgggaacgctcattaccgcagaggcgacagtcaggcggcgcgagatcgacgacggtgagggccccaccgactagtctgacttggactacgtggcgaacctgtaccccatggatgccccctacaatggctaccagtcctaccctctccacaactgtagtgactcccacttgccgatgtactacttcttcttag

SEQ ID NO: 26550 - DNA, 285 bp, Artificial Sequence
  Description of Artificial Sequence: Synthetic coding sequence
atgcgggccggcttcagcgacttccagctgatccgggaccaggtgctctttctgcaggatcaggcacagaggctgaccgagtggctgcaattatctggatttgagaacccagtgtcagaatccacaacgctatgtctcagagaacgcgaaaagagaatacccacgtgcgtcgctgtgtgcgtcccaagtcccgggacggtgcatacggcgctgctgcatcccactacattgtctcagagccgatcgtcgtccgaggctaagatgctcattatccataccgcttag

SEQ ID NO: 26551 - DNA, 594 bp, Artificial Sequence
  Description of Artificial Sequence: Synthetic coding sequence
atggacgtgggcagcaaggaggtgctgatggagagcccccccgactactctgccgccccgcgcggccgatttgggatcccttgttgtccagttcacctgaaacgcctgctaatagttgtagtcgtagtcgtgttgattgtggtggttattgtgggagcactgttgatgggcctgcatatgagccagaagcataccgaaatggtgctcgagatgagcataggagccccagaggcacagcagaggttggcacttagcgaacatctggtcactaccgctaccttttccattggctccacgggcttagtcgtgtacgactaccagcagctactcattgcctacaagccggcgcctgggacctgttgctacatcatgaagatcgctccagagagcattccaagcctcgaagctctgacccgtaaagtccacaattttcaaatggagtgctctttgcaggctaagccagctgtgccaacaagtaagctcggccaggccgaagggcgcgatgccgggagtgcccctagcgggggtgatccagcttttctcggcatggctgtaagtacgctgtgcggcgaggtgcccctatactatatttag

SEQ ID NO: 26552 - DNA, 576 bp, Artificial Sequence
  Description of Artificial Sequence: Synthetic coding sequence
atggacgtgggcagcaaggaggtgctgatggagagcccccccgactatagcgctgctcctagagggagattcggaatcccgtgttgccctgtgcatctcaaacgtctcctcatcgtggtcgtggttgtggtccttatagtcgtcgtgattgttggggccctgctaatgggtctgcatatgagccagaaacataccgaaatggtactggagatgagtatcggagcgcccgaagcccagcagcgactggccttgagcgagcacctcgttactacagctaccttttccatcgggtccacaggactcgtcgtttacgattatcagcagttgctgatagcttacaaaccagcaccagggacatgctgttatattatgaagatcgcgccagaatctattcccagtcttgaggcactaaccaggaaggtgcacaacttccaggcaaagccggcagtgcctaccagcaaactgggtcaagcggaaggacgcgatgctggaagcgctcccagtggaggagaccctgcctttctgggcatggctgtaagcacactctgcggggaagtgccattatactatatatag

SEQ ID NO: 26553 - DNA, 1158 bp, Artificial Sequence
  Description of Artificial Sequence: Synthetic coding sequence
atgatgatgatggccctgagcaagaccttcggccagaagcccgtgaaattccaactggaggatgacggagaattctacatgatcggcagcgaggttgggaattaccttagaatgttccgaggctccttgtataagcgctatccttctctatggcgccgcctggctaccgtggaagagagaaaaaaaatcgtggcgtccagccacggaaaaaagaccaaacccaatacgaaggaccatggctacaccactttggcaacatctgtcactttattaaaggcctctgaagtggaagaaattctggacggaaacgacgaaaagtacaaagcggtttctattagcaccgagcctcccacttatctgcgcgaacaaaaggccaaaagaaacagccagtgggttcccacccttcccaacagtagccatcacttggacgcagtgccctgttctaccactattaatagaaacaggatgggcagggacaaaaagagaacgttcccactctgtttcgatgaccacgaccccgctgtaattcatgaaaacgcctcacagccagaggttctcgttccgattcgccttgatatggaaatcgacgggcagaagctgcgggacgcattcacgtggaatatgaatgagaagctaatgacaccggagatgtttagcgagatcctgtgtgacgacttggacttaaacccgttgacttttgttcctgcaattgcatccgctatcagacaacagatcgaatcataccctaccgacagcattttggaggaccagtcagatcaaagagtgatcattaagttgaatattcatgtgggaaacatatctttagtggatcagttcgaatgggatatgagcgaaaaggagaacagtcctgaaaagttcgcgctgaagctctgttcagagctggggttggggggcgaattcgtcactacaattgcctactctatccgcggacagttgagctggcatcaaaaaacatatgccttttcagagaatccccttcccaccgtggaaattgctattcgcaatacaggggacgccgatcaatggtgtcctctgcttgagaccctgaccgacgcggagatggaaaaaaaaataagagatcaagacagaaacactcggcggatgcggaggctcgccaatactgctccggcatggtag

SEQ ID NO: 26554 - DNA, 1131 bp, Artificial Sequence
  Description of Artificial Sequence: Synthetic coding sequence
atgatgatgatggccctgagcaagaccttcggccagaagcccgtgaagttccaattggaagatgacggtgagttttatatgattgggagcgaagtaggaaactacctccgaatgtttcgagggagtctgtacaaacgctacccctccctgtggcgaaggctggcgaccgttgaggagcggaagaaaattgtggccagctcacacgaccatggatacaccaccctcgccaccagcgtaacattactgaaggcgagcgaggtggaagagatcctcgatggtaatgatgagaagtacaaagcagtctctatctctacagagcctcccacttatctgcgggagcagaaggcaaagcggaattcacagtgggttccaactcttccaaactctagtcaccacctcgatgcagtgccttgttctaccaccatcaatcgcaatcgcatgggtcgagataaaaagcgaaccttccccctctgttttgacgatcatgacccggccgttattcatgaaaatgcatcccagccagaagtcctcgtccctatccggttggatatggaaattgatggacagaaacttagggatgcgtttacgtggaatatgaacgagaaattaatgaccccagaaatgttttctgagatactgtgcgacgatctggatctgaatcccttgaccttcgtcccggctatcgctagcgcaatcagacagcagatagaatcttatcccactgattccatcctggaggaccagtctgaccaacgcgtcatcatcaagctgaacatccacgttgggaatattagtcttgtggaccagtttgagtgggatatgtctgagaaagaaaattcccctgaaaagtttgctttaaagttatgtagtgaactggggctgggaggcgagtttgtcactaccattgcttattcgatacggggccagctttcctggcaccaaaagacctatgctttctcagagaaccctcttcccactgttgagatcgccattaggaatacaggagacgcggatcagtggtgtcccctgctggagaccctgacagacgccgagatggaaaagaaaatacgagaccaggacaggaataccaggaggatgcggaggctggcgaacacagccccggcatggtag

SEQ ID NO: 26555 - DNA, 81 bp, Artificial Sequence
  Description of Artificial Sequence: Synthetic coding sequence
tggcggcggctggccaccgtggaggagcggaagaagatcgtggcctcgagtcacgccttgatgaccatgacccaactgtag

SEQ ID NO: 26556 - DNA, 7626 bp, Artificial Sequence
  Description of Artificial Sequence: Synthetic coding sequence
atggtggccctgagcctgaagatcagcatcggcaacgtggtgaagacgatgcagtttgagccgagtaccatggtctatgatgcgtgtcggataatccgggagcgcataccagaagcacctgctggcccgcccagtgattttgggctcttcttgagcgatgatgaccctaagaagggcatctggctggaagccgggaaggcattggattactacatgctccggaatggagatactatggagtatagaaaaaagcagcggcctctgaagattagaatgttggatggcaccgtgaaaaccattatggtcgacgacagcaaaactgttacggatatgcttatgactatctgtgccagaatcggcataacgaaccatgatgagtatagcctggtgagggagctgatggaggaaaagaaggaggagattaccggcactctgagaaaagataagactctgctgagagatgaaaagaagatggagaaactgaaacagaagctccacacagacgacgaactgaactggcttgatcacgggaggacactaagagaacagggagtggaggaacacgagactttactgctgagacgaaaatttttttacagcgaccagaatgtagatagcagagatccggtccaactgaacttgctgtacgtacaggccagagacgatatcttgaatggctctcatcctgtgtccttcgacaaagcctgcgagttcgcaggtttccagtgccaaatacagttcggacctcacaatgaacagaagcacaaggccggattcttggaccttaaggattttctacctaaagagtatgtcaaacagaagggcgagcggaagattttccaggcccataagaattgtggacagatgtctgaaattgaggcgaaggtccgctatgttaaacttgctcgctccctgaagacctatggagtgtccttctttttggtaaaggaaaaaatgaaaggcaagaataagctggtcccacggttacttggtataacaaaggagtgtgtcatgagggttgatgagaagactaaagaagtgatacaggagtggaacctgacaaacattaagcgttgggcagcttcccccaaaagtttcacgctcgactttggcgactaccaagatggctactacagtgtgcagaccactgagggggagcagattgcccaactgatagccggctatattgacatcattctgaagaagaagaagtcaaaggatcattttggcctggaaggtgatgaagagtcgacgatgttagaagattctgttagccctaagaaaagcaccgtacttcaacagcagtacaacagagtcgggaaggtcgaacacggaagcgtggccttacccgccattatgaggtctggcgcttccggcccagaaaatttccaggtggggagtatgcctcctgctcagcaacagatcacaagtgggcagatgcaccgcggacacatgccccctctcacgtcagcccaacaggcactcaccggaacaatcaactcatctatgcaagccgtgcaggctgcacaggccaccctcgatgactttgacacccttcccccactggggcaggacgctgcaagtaaagcctggagaaaaaataaaatggatgaatctaaacatgaaattcattctcaggtcgatgctatcaccgccggcaccgcttctgtcgtgaacctcacagccggagatcccgccgagaccgattatacagcggttggctgcgccgtgaccacaatatcaagcaacctgactgaaatgtcaagaggagtcaaattgctcgccgcacttctcgaagatgaagggggttctggaagacctctactgcaggcagctaagggccttgcgggagcagtgtcagagctgttacgaagcgcacagcccgcctctgcagaacccagacaaaatctcctgcaggcggctggaaatgtaggacaggcctcaggcgagttgcttcagcaaatcggggaatccgataccgacccccactttcaagacgctttgatgcagttagcaaaagcggtcgccagcgcggccgcagccttagtactcaaggcgaaaagcgtggcccagaggaccgaagactccggactacagacccaggtgattgctgcggccacgcaatgtgcactcagcaccagccagttagtcgcctgtacaaaggtagtcgctcccactatatccagtcccgtatgtcaggagcagcttgtcgaggccggacgtcttgtggctaaggcggtcgaagggtgcgttagcgccagccaagccgcaactgaagacggccagctgctgaggggtgtaggcgcagccgccactgccgtgacccaggcccttaatgagctgctccagcatgtcaaagctcacgcgacaggagctggtccagccggtcggtacgaccaagccaccgacaccattttgacagtgacggagaatattttttctagcatgggggacgccggagaaatggtgcggcaggctcgaatcctggcccaggcaaccagcgatctggttaatgcgataaaagcggatgctgagggggaatccgaccttgagaattcgagaaaactgctctcagccgctaagattctggccgacgccactgccaaaatggtagaggctgctaaaggggctgcagcacatcctgactccgaggagcagcagcagcgcctacgcgaggcagccgaaggactgcggatggccacaaacgctgccgctcaaaacgcaattaagaaaaaacttgtgcaacgtctggagcacgcagctaaacaagccgctgcctctgccactcagaccatcgcagcagcgcagcatgccgcttccacccctaaagcttcagctggaccccagccactgctggtacagtcctgtaaggcggttgcggagcagataccactgcttgtgcagggagtcagaggttcacaggcccagcctgatagcccgtcagctcagctggctttaatcgctgcatctcagagcttcttgcaacccgggggcaagatggtcgctgctgccaaagcctctgtccctacgatccaggatcaagcttccgctatgcagttatcccagtgcgccaagaatctgggcacagccctggctgagcttagaacggccgcccagaaggcccaagaagcatgcggcccgctggagatggattccgcattgagcgtggtccagaatctggaaaaagacctgcaggaggtgaaagcagcggcgagagacggcaagctgaagccacttccgggtgagaccatggagaagtgcactcaggacctaggcaatagcacgaaggcagtgtcctctgctattgcacagttactaggcgaggtggcgcagggcaatgagaattacgcggggatcgccgctcgggacgttgccggcgggctgagatctctagcccaagccgcgaggggtgttgctgcactgacctccgacccagcagtgcaggctatcgtgctggatacagctagtgatgttctggataaagcctcatcactgattgaggaggccaaaaaagcagccggccaccccggcgatcctgagtcccagcagagactcgcccaggtagctaaggcagtgacccaggcactaaaccggtgcgtgagctgtttgcccggccaaagagacgtcgataacgctttaagggcagtcggggacgcctccaaaagactgttgagtgattcactccctcccagcactgggacatttcaggaggcacagtccagattgaatgaggccgcagcagggctgaaccaggctgcgacggagctggtgcaggcaagtaggggcactcctcaggacttggccagagcgtcgggaagatttgggcaggatttttccaccttcctggaggcaggagtggaaatggccgggcaggcaccttcacaagaagatcgagcacaagtggtgagcaacctgaagggcatctcaatgagcagctctaagctcctccttgccgcaaaggctctttcaactgatcccgcagccccgaacttgaaaagccagctggctgctgccgctcgggctgtcactgatagtatcaaccagctgatcaccatgtgcacccagcaggcacctgggcaaaaagagtgcgacaatgctctccgggagcttgagacagtgagagagcttctggagaatcctgtccaacccatcaatgacatgtcctacttcgggtgtctggattccgttatggaaaattctaaggtcctgggggaagccatgactggaatctcacagaacgctaaaaacggtaacctcccagagtttggggacgctatcagtaccgcttcgaaggcattgtgcggttttacagaggctgccgcacaggccgcttatttggtaggggtctcggaccctaattcacaggctggacaacagggtcttgtggagccaacgcagttcgctcgcgctaaccaggcaatccagatggcgtgccagagtctgggtgagcccggctgtacacaagcccaagtcctttcagctgccacgatcgttgcgaaacacacttctgcgttatgcaactcatgtaggctggcatccgcccgtactactaaccccactgccaagagacaatttgtccagtctgcaaaggaggtggccaatagtaccgctaaccttgtaaagacaatcaaagcactggatggtgcctttacagaggaaaatagagcccagtgccgggctgccactgcacctctcctagaagcggtggacaatctatcggccttcgcgagtaatcctgaattttcctcgattcctgctcagattagtccagaaggacgcgcagccatggaacctatcgtgatctctgctaagacaatgctcgagagcgctgggggtctgattcagactgcccgtgccctggcggtgaatccacgcgatcctcccagctggtctgtcttggccggacactcccgaacagtgtctgactcgattaaaaagcttattactagcatgcgcgacaaggcgccgggccagctcgagtgcgaaaccgcgattgcagctctgaacagctgcctccgcgatctcgaccaggcttcactggccgcagtgagccagcaattggcacctcgtgaaggcatctcgcaggaggccctgcacacccaaatgttaacagctgttcaggagatctcccacctgatcgaacctctggccaacgcagcaagggctgaagcctctcagctagggcacaaggtctcacagatggcccaatacttcgagcctctgaccctggcagctgtgggagctgcctccaaaactttgtcgcacccccagcagatggccttgttggatcaaactaagaccctggctgaatcagccttgcaacttctctacacggctaaagaggccggtggtaaccccaaacaggcggcacacacccaagaggccctcgaggaggccgtacagatgatgacggaggccgtggaagatctcaccactacgcttaacgaggccgcctctgcagctggtgtggtaggggggatggtggatagtatcacccaggccataaaccagctagatgagggaccaatgggcgagccagaaggttccttcgtagactaccagactacaatggtgcggactgcaaaggcaattgcagtgactgtacaggagatggtcactaagtccaatacatcacccgaggagctaggcccactggctaaccagttaaccagcgactacgggcggttggcctccgaagctaagccagccgcagtggcagctgagaatgaagaaatcggcagccatattaaacacagggtgcaggaactcggccacggatgcgccgcactcgtgactaaggccggcgctttgcagtgttccccctctgacgcgtacaccaaaaaggagctgatcgagtgtgctcgaagggtgagtgaaaaggtgtcacacgtgttagccgccctccaggccggcaaccgcgggacccaggcctgcatcacagcagcttctgctgtctctggcattatagctgacctcgacaccaccatcatgttcgcgaccgctggaaccctgaaccgggaaggcaccgagactttcgcggaccaccgggagggaatcctcaagacggcaaaggtcctggtcgaggataccaaagtgctggtccaaaacgcggccggaagccaggaaaaactggctcaagcggcccaaagtagcgtagccaccatcacaaggctggctgatgtggtcaagctgggtgcggcttcacttggggccgaggaccccgaaactcaggtggtcttgattaacgcagtgaaagacgtggccaaggctctcggtgacttgatttctgccacaaaagccgcagcagggaaagttggcgacgatccagcggtgtggcagctgaagaattctgctaaggtcatggtgactaatgtgacgtcacttcttaagacagtgaaggccgtggaggatgaagccaccaagggcacccgcgcgctggaggccactactgaacatattcgtcaggagcttgcagttttttgctctcccgaaccaccagccaagacgtcaacccccgaggacttcatccggatgacaaaagggattacaatggctactgcgaaagctgtggcagcgggtaattcttgccgccaggaggatgtgatcgctactgctaacctgtcaagacgagctatagctgatatgctgcgtgcgtgcaaggaggctgcatatcatcctgaagtggctcccgatgtacggctgcgggctctgcattacggacgcgaatgtgctaatgggtaccttgaactgctggaccacgtcctcctcaccttgcagaagccatccccagagctgaagcaacagctcactggccacagcaagcgggttgcagggagtgtgacagagcttattcaagccgcagaggcaatgaagggaactgaatgggttgaccccgaagacccaaccgtaattgccgagaatgagctgctcggcgctgcagcagcaattgaggccgcagcaaagaaattggagcagctgaagcccagggccaagccgaaagaagccgacgagtcactcaacttcgaggaacagatcctagaagctgctaagtccattgccgctgctacctctgccctcgtgaaggctgcatctgccgcccagcgcgagctggtagcccagggtaaagtgggggctatccctgcgaatgctttggacgacgggcagtggagccaggggctcatttcagcagctagaatggttgccgccgctactaacaatttatgtgaggctgcaaatgcagccgtgcaggggcatgctagccaggagaagcttatcagtagcgccaagcaggtagcagcctccacagcccagcttctggtggcctgtaaggtgaaggccgatcaggactccgaggctatgaagcgcctgcaggctgcgggtaacgcggttaagcgagcttcagacaacctggtgaaggctgcccaaaaggcagctgcattcgaggagcaggaaaacgagactgtggtagtaaaggaaaagatggtgggaggcatagcccagattatcgctgcgcaggaagagatgctgaggaaggagcgggaattagaggaagcaaggaagaagctagcccaaattaggcagcagcagtataaatttctaccatctgaacttcgcgatgagcattag

SEQ ID NO: 26557 - DNA, 7290 bp, Artificial Sequence
  Description of Artificial Sequence: Synthetic coding sequence
atggtggccctgagcctgaagatcagcatcggcaacgtggtgaagacaatgcaattcgaaccttcgaccatggtatatgatgcgtgtcgcattatcagggaacgaattccagaagcgcccgccggcccaccatccgacttcggcctcttcctcagcgatgacgatcccaaaaaggggatctggttggaggccggtaaagccctggactactacatgctgcggaatggagatacaatggagtacagaaagaagcagaggccactcaagatacgcatgctagacggcacagtgaagacaataatggtggacgacagcaagaccgtgaccgatatgctcatgacgatatgcgcacgcattggcattaccaatcatgacgagtactcgctggtgagggaattgatggaggagaaaaaagaggagatcacaggcacactgcgaaaagataaaaccctgttgcgcgatgagaagaagatggagaaactgaagcagaaactgcacactgacgatgagctgaattggctcgatcacggccggacgcttagagaacagggggtggaggaacacgagacattactgctgagacggaaatttttctattccgatcagaacgtggattctagagacccggtccagctgaacttattatatgtgcaggcccgcgacgacattttaaacggctcccatcccgtgtcatttgacaaagcctgcgagttcgctggtttccaatgccagatccaattcggaccccacaatgaacaaaaacataaggccggtttcctggatcttaaagactttttacccaaagagtatgtgaaacagaaaggtgaacgcaagatcttccaggcccataaaaactgtgggcagatgagcgaaatcgaagctaaggttagatatgtgaaactcgcgcgatccctcaagacttatggcgtgtctttcttcctcgtgaaagagaaaatgaaaggcaagaacaaactcgtccccaggctcctggggattaccaaagagtgcgtcatgcgcgtcgacgagaaaactaaagaagtgattcaggagtggaatctgaccaacattaaacgctgggccgcgtcccctaaaagtttcaccctggactttggtgattatcaggatgggtattactctgtgcagaccacggagggagagcagattgcacaactgatagcaggatatattgacattatcctcaagaagaaaaagtctaaagatcatttcggattggagggtgatgaagaatccacaatgcttgaggacagtgttagccccaaaaagtcaacagtgctgcagcagcagtataatcgtgtagggaaggtggaacacggttccgtggctctaccagccattatgagatcgggagcttctggaccggagaacttccaggtggggagcatgcctcctgcgcaacagcagattacctcaggccagatgcaccgcggacacatgccccccctgacttcagcacagcaggctctcacagggacgataaactcaagtatgcaggcagtgcaggctgcccaggccactctggacgactttgatacattgccaccactgggacaggacgccgcgtcgaaggcctggagaaagaacaaaatggatgaatccaagcacgagattcattcacaggtcgacgccataaccgccggcaccgctagtgtcgtaaacttgaccgccggggacccggccgaaactgactacacagcggtgggctgtgctgttacaaccattagcagcaacctcacagagatgtcgcgcggagtcaagcttctggctgcgctgctggaagacgaggggggctctgggcgacccctcctgcaggcggccaaagggctagccggagccgtgtccgaattgctcagatctgcccagcccgcaagcgccgaacctcgccaaaacctgttgcaggcagctggaaacgtggggcaggcctccggggaactgttacaacagataggcgaaagcgatacagacccacacttccaggacgccctgatgcagctcgcaaaggctgtggcctctgccgccgccgctctcgtgctcaaggcgaaatcagtagctcagcgcacggaggactccggtctgcaaacccaggtgatcgctgctgctactcagtgcgccttgagtactagccaactagtcgcatgcacaaaagtggtagctcctactattagcagtccagtttgtcaagagcagttggtagaagctgggcggctggtggcgaaggcggtggaaggatgcgtatcagctagccaggcagccactgaagatggacaactgctgagaggtgtaggagcagcggctactgccgtgacacaggcgctcaatgaattgctgcagcacgtcaaagcacacgcgaccggtgcaggacccgccgggaggtatgaccaggcaactgacacgatcttaacagtgacagagaacattttctcctccatgggggacgcaggcgagatggtgcgtcaagctcgcatcctcgcccaggcaacatccgacctggtcaacgctatcaaggcagacgctgaaggtgagagcgatttggaaaattcaagaaaactgctgtccgccgcgaagatcctggcagacgctactgccaaaatggtggaagccgctaaaggcgctgccgctcaccccgatagtgaggagcagcaacaaaggttgcgcgaggctgctgagggtcttcggatggctacgaatgctgccgcacagaatgctattaagaaaaagctggtccagagactggaacatgccgcgaaacaggctgctgcgtcagcaacccagaccattgccgctgcccagcacgcagcaagtacccccaaagcatctgcaggtccacagccattgctggtgcagagttgcaaggcagtcgctgagcaaatccctttacttgtgcagggagtacggggatcccaggctcaaccagacagtccatccgcccagctagccttgatcgctgccagtcagagttttctccaacctggaggtaagatggtggccgccgctaaggccagcgtcccaactatccaggaccaagcttcagctatgcaattaagtcagtgcgcgaagaacctgggcactgctctcgctgagttgcggacggcggcccagaaggcccaggaggcctgcggacccctcgagatggactctgcactctctgtggtgcagaaccttgaaaaagatctgcaggaagtaaaagccgccgcacgggacggtaaactgaagccccttcctggcgagaccatggaaaaatgtacacaagatctcggcaactctaccaaggctgtgtccagcgccattgcccagttactcggcgaggtagcgcaaggcaatgaaaattacgctggaattgccgcccgcgatgtcgcggggggactcagatcactcgcacaggcagccaggggcgtcgccgcccttactagtgaccctgcagtacaggcaatcgtcctcgacacagcaagcgacgtgctggacaaggcttcgtccctcattgaggaggccaagaaggccgccggtcacccaggtgacccagagtcccagcagcgactcgcccaggtggccaaggccgtgactcaggccctgaaccgttgcgtcagctgcttacccggacagcgggacgtggacaacgcgctccgggccgtaggcgacgctagcaaaaggttactgagtgattccttacctccctccactgggacattccaagaggcacagagcaggctaaatgaggcggctgccggcttaaatcaggcagccacagaacttgttcaagcaagcagggggaccccgcaggatttggcccgtgcctctggcaggtttgggcaagacttctctacgtttctggaagctggagtggaaatggcaggccaggcgcctagccaagaagacagggcccaggtggtttccaacttgaagggcattagcatgagcagctccaagttgttgctcgcagcaaaggctttatcgactgatcccgccgcacccaatcttaaaagccagctggctgccgccgccagagctgttactgacagcatcaatcagctgatcacgatgtgcacccaacaggctccggggcagaaggagtgcgataatgcactccgggagctagagacagttcgcgagttgctggaaaatccagtccagccgatcaacgatatgtcttactttggatgcctagactctgtgatggagaattctaaagtgttaggcgaggctatgactggaatctctcagaacgccaaaaatggcaatctgccagaatttggcgacgccattagcaccgcatccaaggccctgtgtggattcaccgaagcggctgcgcaagctgcatatttagtgggggttagtgatcctaatagccaagctgggcagcagggcctggtggaacctacccagttcgctcgggccaatcaggctatacagatggcgtgccaatctctgggagaaccaggctgcactcaggcccaggtgctgagcgcagccacaatcgttgccaagcatacttcagcattgtgcaacagctgtagactggctagcgctcggaccacaaaccctactgcaaagaggcaatttgtgcagtcagcgaaggaagttgctaatagtactgctaacctcgtgaaaaccatcaaagctctggatggtgcctttactgaggaaaaccgggcacaatgtcgggctgcgactgcccccctattggaggctgtggacaacctttctgcattcgcctcaaatcccgagttctcatccatacctgcccagattagcccagaggggcgagcagccatggaacccatcgtgataagtgccaagaccatgctggagagtgctggaggtttgattcagactgcacgtgcactcgccgtcaatcctcgcgaccctccaagctggtcagtcctcgcagggcactcgaggacagtcagcgatagcattaagaaactgatcacaagtatgagagacaaggctcctggacagttggaatgcgagaccgctattgctgctttaaattcttgcctgcgtgaccttgaccaagcttcattggcagcagtctctcagcaacttgcacctctgcaagaaatctctcatcttatcgagcctcttgcaaacgccgcgagggcggaagcctctcagctagggcataaggtgtcccaaatggcgcaatactttgagcctttgacattagccgccgtcggcgcagcttctaaaacactctcccatccccagcagatggctctcctcgaccagacgaaaacgctggctgaaagtgcactccagctcctttataccgctaaggaagctggcggcaatcccaaactggatgaggggccaatgggggaaccagagggaagctttgtcgactaccagaccacgatggtcaggactgcaaaggctatcgccgtcacggttcaggagatgatcggctctcatattaagcaccgggtgcaggagctgggtcatggctgcgccgccctcgttacgaaagccggtgccctccagtgcagccctagcgacgcgtatacaaagaaggagctaattgaatgcgccaggcgggtgtccgagaaggttagccatgtgttggccgctctgcaagctggtaaccgtggcacccaggcgtgtatcactgcagctagtgcagtgagcggcattattgccgacttggatacgaccatcatgttcgcgaccgctggcactttgaacagagagggcacagaaactttcgcagatcacagagaagggattcttaaaacggctaaggtcttggttgaagacactaaggttttggtgcagaatgctgccggatcacaggaaaaactggctcaggcagcccaatcgtcagttgcgactattaccaggctggctgatgttgtcaaacttggagccgcctcacttggcgctgaggaccctgaaacccaagttgtgctgatcaatgccgttaaagatgtcgcaaaggcgttgggcgacctcatatcagcaactaaggcagccgcaggcaaggtaggcgacgaccccgcggtatggcagttgaaaaattctgccaaagtcatggtcaccaacgtgacttccctgctgaaaacagtcaaggccgttgaggacgaagccaccaagggcacgcgggcactggaggccaccaccgaacacatccgtcaagagctggctccgccggcaaaaaccagtacccctgaggacttcatccgtatgactaagggcattactatggcaactgccaaagccgtggcagccggaaacagttgcaggcaagaggacgtgatagccactgctaacctgagtaggcgggctatcgcggatatgctccgcgcttgtaaggaagctgcctatcatccagaggtcgcacctgacgttagattaagagccctgcattacggccgcgaatgtgctaatgggtacctggaacttctggatcatgtgctgctgacactgcagaagccaagccccgagctcaagcagcagctgaccgggcactccaagagggtggcgggatccgttactgaactcattcaggccgccgaagccatgaaaggtacagagtgggttgatccagaagatccaaccgtaattgctgagaatgaattgctgggagctgcagccgcaatcgaggctgcagccaagaaactagagcagcttaaacctcgtgctaagccaaaggaggcggacgagtctctgaattttgaggagcagattctggaggcagcgaaaagcatcgccgcggccacttctgcactggtgaaagctgcatctgccgcacagagagagctagtggctcaagggaaggtcggagctattccggctaatgcgttagacgatggtcagtggtcgcagggcctgatctcagccgcacgaatggtcgccgccgccacaaacaatttgtgtgaagctgccaatgcagcagtccaaggacacgctagccaggagaagttgatcagcagcgcaaaacaggtggccgcgtctacagcacaactgctggtggcctgtaaggtcaaggcggatcaggatagcgaggcaatgaaaaggctgcaggcagcgggaaacgctgtgaaacgcgcttccgataatctggtgaaagcagcacaaaaagctgccgctttcgaagagcaggagaatgagacagtcgttgtgaaggagaagatggtcggcggtatcgcacagattattgccgcccaggaggaaatgctgcgaaaagagagggagctagaggaggcaagaaaaaagctagcacaaattcggcaacagcagtacaagtttttgcctagcgagctgagggatgagcattag

SEQ ID NO: 26558 - DNA, 3984 bp, Artificial Sequence
  Description of Artificial Sequence: Synthetic coding sequence
atggccgccagccggcggagccagcaccaccaccaccaccaccagcaacaactccaacccgccccgggagcatcggctccgccgccgcctcctcctccgcccctgagccctggcttagcacccggaacgacccctgctagtcccacagcaagcggccttgccccgtttgccagtccgcgacatggcttggctctacctgagggcgacggatctagggacccacctgacagaccaaggtcccctgaccctgtagatgggaccagttgctgtagcaccacctcgacaatatgcaccgtagccgccgccccggtggtgccagccgttagtacaagttccgcagcaggggtggctcccaaccctgccgggtccggaagcaataattctccctccagcagttctagccctacaagcagctcatcctccagtccgtcgtcgcccgggagttctctcgccgaatcgccagaagctgcgggcgtcagttccaccgccccgctggggccaggcgccgcaggaccagggacaggcgtgcccgcggtatccggggcactgagagagttgttggaagcttgtcgcaacggcgacgtgagccgggtgaagcggctggtagacgcagctaacgtgaacgcaaaagacatggcaggtcgtaaaagctctccccttcatttcgcagccggttttggacgaaaggatgtggtggaacaccttttacagatgggcgctaacgtacatgcacgggacgatgggggcctcatccccctccataacgcttgcagctttggccatgccgaggtagtgtcactccttctgtgtcagggagccgatcctaatgcaagagacaactggaattacaccccattgcacgaagctgcaattaaaggtaagatcgacgtttgcatagtgctgctgcagcacggcgccgatccaaacatacgtaatacagacggcaagtctgctttagatttagcagatcccagtgcaaaggccgtgttaaccggcgaatacaaaaaggacgaacttctggaggctgccaggagcggaaatgaggagaagctcatggcactgctgacccccctgaatgtcaattgccatgcctccgacggacgcaaatcaacaccactacatctggccgccggatacaacagggtcagaattgtgcaactactcctgcagcacggagctgatgtgcacgcaaaggacaaggggggccttgttccgcttcataatgcttgttcatacggtcactacgaggtgaccgagctgttgctaaagcacggagcctgcgtaaacgctatggatctgtggcaattcacacctctgcatgaagcggcgtctaagaatagagtcgaagtgtgctccttactgctgtcacatggggccgacccgactctcgttaactgtcacggaaaaagcgcagtcgacatggcaccaacgcccgaacttcgggaaaggctgacttacgagttcaaagggcactccctgttacaggccgctcgcgaagctgacctcgctaaagtaaaaaagacactggcacttgaaattatcaactttaaacagccacagagtcatgagaccgccctgcactgtgcagtcgcttccctccacccaaagcgcaagcaggtgacagaactcctgctccgaaaaggggcaaacgtgaacgaaaaaaataaagactttatgacgcctctgcacgtcgcagccgaaagggcccataacgatgtgatggaagtgctgcacaagcacggcgccaagatgaatgctttggacacccttggccagaccgctctgcatcgcgccgctctggccggacatttacagacttgcagattgttgctcagctacggttccgacccgtctatcatctcactccagggcttcaccgcagcccagatgggcaacgaggcggtacagcagattctgtccgagagcactccaatccgaacgtctgacgtggattacagactgctggaggccagcaaggccggagatcttgagacggttaagcagctatgtagctctcagaacgtgaattgccgcgatctggaagggcgtcactcaaccccactacacttcgcagcaggttataaccgcgtcagcgtggttgaatatcttctacaccacggtgcagacgtgcatgctaaggacaaggggggcctcgtgcctttgcataacgcgtgctcatatggtcactacgaggttgccgagctcctcgtgagacacggagcctctgtgaacgttgccgacctgtggaaatttacacctctgcatgaggcagccgccaaagggaaatatgagatatgcaagctgctcctcaaacacggcgcagatcccactaagaagaatcgggatggcaatacccctctggaccttgtgaaggagggagataccgacattcaggatctgctgcggggcgacgccgccttgctcgacgctgcaaaaaaagggtgtttggcccgtgtccagaagctgtgtacacccgagaacattaactgcagagatacacagggccgaaattccacacctttgcatctggcagccggctacaacaatctggaagtcgccgagtacttactggagcacggggccgacgtaaacgcccaggataagggcggacttataccactccataacgctgcttcttacggccacgtcgatattgccgcccttttgatcaagtataacacatgtgtgaatgctactgacaagtgggcattcacaccccttcacgaagctgcccagaagggtagaacccagctctgtgccttgcttctggcacacggagcagaccctacaatgaaaaaccaggaggggcagacaccactcgacttggccacagctgatgatataagagcactcctcatagacgcgatgccgcctgaagctctgcctacttgttttaagccgcaggctaccgtcgttagcgcctctctcatttcccccgcctcaactccctcctgcctgagtgcggcatcctctatcgacaaccttaccggaccactggcagagttagcggtgggtggggcctccaatgccggcgacggtgcagccgggactgaaagaaaggagggcgaagtcgccggcctggatatgaatattagccagtttctgaagtctctcggtttggaacatctgcgcgatatcttcgagaccgaacagattacactcgatgttctggctgacatgggtcatgaggaactgaaagagatcggcattaacgcctacggtcaccgccataaactaattaaaggcgttgaacggctcctgggaggtcagcaggggactaacccatatctgacttttcattgcgtgaaccaggggacaatcctgctcgacctcgccccagaggataaggagtatcagagtgttgaagaggaaatgcagtcgaccattagagaacaccgcgacgggggaaatgccggaggcatcttcaaccggtataacgtcattcgcattcagaaggtggtgaataagaaactgagagaacggttttgccaccgccaaaaggaggtgtccgaggagaaccataaccaccacaacgagcgcatgctgttccacggatcccctttcatcaacgcgattattcacaaggggttcgacgaacggcatgcatacataggtggtatgttcggtgcgggcatatattttgccgagaactccagcaagtctaatcagtatgtatatggaattggtggagggactgggtgcccgacccacaaggaccgctcctgttacatctgtcataggcagatgctcttctgccgggtcaccctgggcaagtcatttctgcagttcagcaccatgaagatggcacacgccccaccaggccatcactcggtgataggtcggccttcggttaatggcttggcctacgcagagtatgtgatatatcgaggcgaacaggcctatcctgaatatctgattacctatcagataatgaagcctgaggctcccagccagaccgccaccgccgcggaacagaagacttag

SEQ ID NO: 26559 - DNA, 3501 bp, Artificial Sequence
  Description of Artificial Sequence: Synthetic coding sequence
atgagcggccggcggtgcgccggcggcggcgccgcctgcgccagcgctgctgccgaggccgtcgaacccgcggcccgagagttgtttgaggcatgtcgaaacggggacgtggagcgcgtcaaaagactggtcacacctgaaaaggtgaactcaagagatacagctggccggaaatccacaccgctgcattttgccgctggcttcgggcggaaagacgtagtggaatacttactacagaatggtgcaaatgttcaagccagggatgatggtgggctgatccctctgcacaacgcctgcagcttcggacatgccgaggttgtgaatctcctccttcggcatggcgcggatccaaatgcaagggacaattggaactacacacctctgcacgaagcagcaattaaggggaagatcgatgtgtgcattgtcctgctgcagcacggcgctgagccaacaattcggaacacggacgggcgaacggcactcgaccttgcggacccatctgccaaggccgtgttgaccggtgaatacaagaaggacgagctattggagtcagccaggagcggtaacgaagaaaagatgatggcactgttaacccccctaaatgttaattgtcacgcatccgatggccgcaagagtacaccgcttcatctggctgcggggtataaccgcgtcaaaattgtgcaattattactgcagcacggcgctgatgtacatgcaaaagacaagggagacttagtaccgctgcataacgcttgctcctacggacactacgaagtgactgaactgcttgtcaagcatggagcttgtgtgaatgccatggacctctggcagttcacacctttgcatgaggctgcgtccaagaaccgcgtcgaggtctgtagccttctgctaagttacggcgctgatcctaccttgctcaattgccacaacaagagtgctattgatttagctcccactccacagttgaaagagaggttggcctatgagttcaaagggcactccctcctccaggctgccagagaggctgacgtgactcgcataaaaaagcatctcagcctggaaatggtcaactttaaacatcctcagacgcatgaaactgcactgcattgtgccgcagccagtccgtaccctaaaaggaaacaaatatgtgaactgctccttcggaagggtgccaacatcaatgaaaagactaaggagttcctgactcctcttcacgttgcgtcagagaaagcacataacgatgtagtggaggttgtcgtcaagcacgaggccaaggttaatgcacttgataacctgggccaaacaagtttgcatcgcgctgcgtattgtggtcacctccagacctgtagactgctcctcagttatggctgtgatcccaacataattagcctgcaaggtttcaccgccctccagatgggcaatgagaatgttcagcaactgctgcaggaaggaatttccctgggaaattcggaggctgacagacaactgctagaagcagccaaggccggggatgtagaaacagtgaagaagctatgcaccgtgcaatctgtaaattgtcgcgatattgaggggagacaaagcacaccacttcactttgctgccggctataatcgcgtcagcgtcgtggagtatttgctgcagcacggtgctgatgtgcatgccaaagataagggagggttagtgccccttcataacgcttgttcttatggccattacgaagtggccgaactgctggttaagcatggtgcggtggtaaatgtcgccgatttatggaaattcacaccactacacgaggcagctgcaaaaggcaagtacgaaatctgcaagctgcttctgcaacacggcgcggatcccacaaagaagaacagggatggaaatacgcccctggatttggtcaaggacggcgatacagacatccaggatctgcttcgaggtgacgcagcactcctggacgctgctaagaagggctgtctggctcgggtcaaaaagctatcctcaccagacaatgtcaactgtcgagacactcagggtcgacactccacgccacttcacctcgccgccggctacaataacctggaggttgccgaatatctactacaacacggtgcagatgtgaatgctcaggataaaggaggtctgatccctttgcataatgcagcctcttatggtcatgtggacgttgctgctctgctcattaagtataatgcgtgtgtcaatgccaccgataaatgggcctttacgcccctgcacgaagcagcccagaaagggcgaactcagctgtgtgctctgctgctggctcacggcgctgaccccacactgaagaatcaagagggacagacccctttagatttggtgagcgctgacgacgtatcagcactactgacggcagcaatgcccccttctgcgttgccctcgtgctacaaaccacaggtgcttaatggcgtccgttctccaggcgccactgctgatgccctgtccagcggcccatcctcaccctcatcactctccgctgcatccagtctggataacctgagcggcagcttctctgagctttctagtgttgtgagttctagcgggacagaaggtgcttcttcgttagaaaagaaggaagtccctggggtcgacttcagcattacccagttcgttaggaatctcggtttagagcacctgatggacatatttgagagggagcagataaccctcgatgtccttgtggaaatggggcacaaagaacttaaggagataggaattaacgcctacggccacagacacaaactgatcaagggggtggaacgattgattagtggtcagcagggacttaacccttacctgacacttaacacctcaggttcaggcaccattttgatcgatctgagtcccgatgacaaggagtttcagtctgtcgaagaggagatgcaatctactgtgcgggagcatcgggacggcggccacgcaggcgggatttttaacagatataacattctgaaaatacagaaagtgtgcaataagaaactctgggagagatacactcacaggcggaaggaggtgtctgaagagaatcacaatcacgccaatgagagaatgctgttccacggctcacccttcgtcaacgccattattcataaggggttcgatgaaagacacgcatatatcggtgggatgtttggcgctggcatctatttcgccgaaaacagcagtaaaagtaaccagtatgtctatggcatcggaggagggacaggatgccccgtgcacaaagacagatcctgttacatctgccaccggcaactcttattctgtcgtgtaacattaggaaaatcttttcttcagttcagcgccatgaagatggcacatagcccaccaggtcatcactctgtgacaggcagaccatccgtgaacgggctggctctcgccgagtatgttatctatcggggagaacaggcctaccccgaatatctaattacctaccaaattatgagaccggaggggatggtcgacggctag

SEQ ID NO: 26560 - DNA, 2139 bp, Artificial Sequence
  Description of Artificial Sequence: Synthetic coding sequence
atgcgggagcccgccctggccgccagcgccatggcctaccacccctttcacgctcccaggccggcggacttccctatgagtgccttcctggctgctgcacagcctagcttcttccccgctctagcactgccacccggggctcttgcaaaacctctgcccgatcccggccttgccggtgccgctgctgcagctgctgccgccgccgccgcagccgaagccggcctacacgtgagtgccctagggccccaccctcctgccgcacacttacgaagccttaagagcttggagccagaggacgaggtcgaggacgacccaaaagtcacgctcgaagctaaggagttgtgggatcaattccataagctgggtacagagatggtaatcacgaaaagcggaagacgtatgtttcctcctttcaaagttcgagtgtccggcctggataaaaaagcgaagtatatcttgcttatggatatcgtggccgcagatgattgccggtacaaattccataattctagatggatggttgctggaaaagcggaccccgaaatgcccaagaggatgtatatacatcccgactctcctgctaccggagagcagtggatggccaaacctgtggcttttcacaagcttaaactgaccaataatatcagtgacaagcacggattcaccattctcaactcgatgcacaagtaccaacccaggtttcatatagttcgcgcaaacgatatcctcaaactgccctactcaacatttagaacttacgtgttccctgagacagacttcatcgcggttaccgcctaccagaatgataagatcacgcagctcaagatcgacaataatccgttcgccaagggattccgggatactgggaatggccgcagggagaagcgcaaacagcttacacttcccagccttcgcttatacgaagaacattgcaagccagaaagggatggagccgagagcgatgcctcgtcttgtgaccctcccccggccagagaacccccaacaagtcctggtgccgcccctagccctctccgattgcaccgtgcacgggcagaggagaagtcttgtgccgccgacagcgacccagaaccagaaaggctctccgaagagcgagcaggcgcgccactgggacgcagtccagcgcctgattctgcctcgccaactagactgaccgagccagagagagctcgggagaggaggtctcccgaaagagggaaggagccagcagagagtggaggggatggaccattcggtttgcgatcccttgagaaagagcgtgctgaggctcgccggaaagacgaagggaggaaggaagctgctgaaggaaaggagcagggcctggccccgctggttgttcagactgacagtgctagccccctgggagctgggcacctgcctgggctggcattctcgtctcacttgcatggccagcagttcttcggacccttgggggcaggtcagccgctattcctgcaccctggccagtttactatggggcccggcgccttctctgctatgggaatgggtcacctgttggcttccgtggctggaggcgggaacggtggcgggggtggaccaggcaccgccgccgggctggatgctggggggctgggaccagcagcctctgctgcaagtacagctgcccccttccccttccatctctctcagcatatgctggcttcccagggtattcccatgcctacattcgggggcttgttcccatatccctacacgtacatggcagcagcagccgcggctgcttccgccttgcccgcaacttcagctgccgccgcagccgcagcggccgcaggctcgctgagccggtctccatttcttggctcagcccgccctcgcctacgattttctccatatcagatccctgtgaccatcccccccagcacatctctgctcaccactggcctggctagtgagggctccaaagctgctggcggcaactcccgagaaccgtcacctcttccagaactggccctacggaaagtaggcgccccatcccggggggcactcagcccttctggtagtgcgaaagaggccgccaatgagcttcagagcatacagcgactagtctctggcttggagagccagcgcgctctcagcccaggccgagaatcaccaaaatag

SEQ ID NO: 26561 - DNA, 981 bp, Artificial Sequence
  Description of Artificial Sequence: Synthetic coding sequence
atgagcgccttcctggccgccgcccagcccagcttcttccccgccctcgccctcccccctggggctctggccaagccactacctgatcctgggctcgctggggcagctgccgcagctgctgccgctgccgcagcagccgaggcagggctgcacgtctctgctttaggaccgcatccacctgctgcccatctgagaagcctgaagagtctggagccagaggacgaggtcgaagatgacccaaaagtcacactggaagcaaaggagctctgggaccagtttcacaaattgggcaccgagatggtgataacaaagtccggcaggaggatgtttccaccgtttaaggtgcgtgtgtcgggcttggacaagaaagccaaatacatcctgctaatggacatcgtagcagccgacgactgtcgctacaaatttcataattcacgctggatggtcgcggggaaggccgatccagaaatgccgaagaggatgtatatccatcctgattctcccgctacaggagagcagtggatggctaagcctgtcgcttttcataagctgaaactgacgaataacatcagtgacaagcacgggtttactatcctcaacagcatgcacaaataccagcctaggttccacatcgtgcgcgcaaatgacatcctcaagttgccctattctaccttccgcacctacgttttccccgaaaccgatttcattgccgtgaccgcttatcagaacgacaaaataacacagttaaaaatcgataacaacccttttgccaagggatttcgtgataccggcaatggtcgccgggaaaaacgaaagcagctaacgttacccagtctgaggctgtatgaagagcattgtaagccagaaagagacggggctgagtctgacgcctcgtcttgcgatccaccacctgcccgggagccgcccactagcccaggtgctgcacctagtcctctcagattgcaccgggccaggggatag

SEQ ID NO: 26562 - DNA, 996 bp, Artificial Sequence
  Description of Artificial Sequence: Synthetic coding sequence
atgaccgagcggccccccagcgaggccgcccggagcgacccccagctggagggcagagacgccgcggaggcttctatggcaccacctcatttggttttgcttaatggcgtggccaaagaaaccagtcgcgccgcagcagcagaaccccctgtcattgaactgggtgcccggggtggtcctggcggtggccctgctggtggcgggggggcggctagagatttaaagggccgcgacgctgccacggcagaagctagacacagggtacccacaaccgagctgtgtcggccccctgggccagctccagcgcctgctcctgcttctgtcactgccgagcttcccggcgacgggaggatggtccaactgtcccctccggcactagccgcccctgctgccccgggtagagccctgctttactcactgtcacagccgcttgcgtccctcggtagcggattcttcggcgagcctgacgcctttccgatgtttacaacaaataaccgggtgaaaaggcggccttcaccatacgaaatggaaatcactgacgggccgcacacaaaggtcgtgcgcagaatcttcaccaactcacgggagagatggcggcagcaaaatgtgaatggtgcgttcgccgaactcagaaagctgatccctacccatcctccagataagaaactgagtaagaatgaaatactgagactagcaatgaagtacatcaacttcctggctaaactcttgaacgaccaggaagaagagggcactcagcgagctaagactggaaaagatcccgtagtgggggctgggggcggaggaggtggcgggggaggtggcgctccccctgacgacctgctgcaggacgtgctgagccctaactcatcctgcggctcatccctggatggggctgccagcccagactcctatacggaagagccggcacccaagcacacggctagatccctgcatcccgccatgctcccagccgctgacggcgccggccctagatag

SEQ ID NO: 26563 - DNA, 1002 bp, Artificial Sequence
  Description of Artificial Sequence: Synthetic coding sequence
atgaccgagcggccccccagcgaggccgcccggagcgacccccagctggaaggacgagacgccgcagaggcgtccatggcaccgccccatttggtgctgctaaacggggtggctaaagaaacatccagggcggcagcggcagaaccgcccgtcatcgagttaggtgcacgcggaggaccaggcggtggcccagcgggcgggggcggagccgcgagagacttaaaggggagggacgctgctacagccgaggcaaggcaccgggtgcctaccacggaactgtgcagaccgcccggcccagcaccggcccctgctcccgctagcgttactgccgagctacctggtgacgggcgtatggtgcaactctcaccccctgcactggccgcccccgcagctccaggtcgggccctcttgtactccttgtctcagcccttggcctcactgggaagccatagtggcttctttggcgaaccagacgcttttcccatgtttactaccaataacagggtcaagcgccggccttcaccctacgagatggagattaccgacgggcctcacaccaaggtcgtaaggagaatcttcaccaactcacgagaacgctggaggcagcaaaacgtgaacggagcatttgcagagcttcggaaactgatacctactcaccctccggataaaaaactgtctaagaatgagattctgcgcctggccatgaaatacattaacttcctggccaaactcctgaatgatcaggaggaggaaggaacgcagagagccaaaacagggaaggaccccgtggttggggccggcggtgggggagggggaggtggagggggggccccaccggacgacctgctccaggatgtactctccccaaactcgtcttgtgggagctcgctggacggcgccgccagccccgactcctacactgaagagcccgcccctaaacataccgctcggagcctccacccagcaatgttacccgcggccgatggggcgggtccccgctag

SEQ ID NO: 26564 - DNA, 996 bp, Artificial Sequence
  Description of Artificial Sequence: Synthetic coding sequence
atgaccgagcggccccccagcgaggccgcccggagcgacccccagttggaaggacgggatgcggccgaggcctcaatggccccaccacacttggttctgttgaatggcgttgcgaaggagacctctcgtgccgctgcggccgaaccccctgtcatcgaactgggtgcccgaggtggccccgggggaggacctgccgggggagggggggcagctcgagatctgaagggccgagacgcagcaacagctgaagccagacaccgagtgcctacaacagaattgtgccgtccacccgggcccgcacctgcccccgcccccgccagcgtcactgcggaacttcccggggacggtagaatggtgcagctgagcccccctgctctggccgcacctgctgcccccggaagggccctcctctacagtctgagtcagcctcttgcatcactcgggtccggcttctttggggaacctgacgctttcccaatgtttaccacgaacaaccgcgtgaaacgacgccctagtccgtacgagatggaaattacggacggcccccacactaaggtggtcaggagaattttcacgaattcccgcgaacgatggagacagcagaatgtgaacggcgcttttgccgagttgcgtaaactcatccctacccacccgcctgacaagaaactgagcaagaacgaaatcctgaggcttgccatgaagtacatcaactttctcgccaaactcctgaatgatcaagaagaagagggaacacaacgggcaaagacaggtaaggacccagtcgtcggggctggagggggggggggaggcggaggaggaggggcaccccctgacgacctgcttcaggacgtgctgtccccaaacagctcttgtggaagcagcttagacggcgctgcctcccccgatagttacactgaagaacccgcccctaaacatactgcccgtagcctgcatccagccatgcttccggcggccgatggggctggccctcgctag

SEQ ID NO: 26565 - DNA, 993 bp, Artificial Sequence
  Description of Artificial Sequence: Synthetic coding sequence
atggagcacctgggcccccaccacctgcaccccggccacgccgagcccatctcgttcgggatagaccaaatactcaattcccccgaccagggggggtgcatgggccctgccagcagactgcaggacggtgagtacggcttgggttgcttggtcggaggtgcctatacctacggaggcggaggttccgcagccgcaactggggccggtggcgccggggcctatggcactggcggtcccggggggccaggaggaccagccggcggcggcggtgcctgcagcatgggaccgcttaccggttcatataatgtgaacatggcgctcgcgggtgggccaggtcccggtgggggcggaggcagttccggaggtgccggcgctctctccgcagccggtgttattcgggtgccagctcatcgtcctctcgctggagctgtggcacatccacaacccctagccaccggattgcctacagtaccaagcgttccggccatgcccggcgtcaataatctcacaggactgacctttccctggatggaatctaatcgcagatacaccaaagatagattcactggccacccataccagaataggaccccacctaagaagaaaaaaccacgaacctccttcactcgcctccaaatttgcgaattagagaagcggttccatcgacagaaatacctggcttccgctgagcgagcggccctcgcaaaagccttaaagatgactgatgcacaggtcaaaacatggtttcaaaacagacgaaccaagtggagacggcagacagccgaggaacgcgaggccgaaagacagcaggcaaacaggatattattacaactccaacaagaggcatttcaaaaatcactcgcacaaccactgccagctgatccactctgcgtccataatagtagcctatttgccttgcaaaacctgcagccttggtcagacgacagtacaaaaatcaccagcgttacctccgtagcgtccgcttgcgagtag

SEQ ID NO: 26566 - DNA, 774 bp, Artificial Sequence
  Description of Artificial Sequence: Synthetic coding sequence
atggagcacctgggcccccaccacctgcaccccggccacgccgagccaatctctttcggcatagaccaaattcttaactcacctgaccagggaggttgtatgggcccagcttctcgcctgcaggacggcgaatacggtcttggttgcttggtgggcggggcatatacctatggaggcggaggatctgctgctgcgaccggagcagggggggctggagcctacggtaccggcggacccgggggccccggaggaccggccgggggcggtggggcatgcagcatgggtccgctaacaggcagctataacgtcaatatggccctggccggaggtcccgggcccggaggcggaggaggcagctcgggaggtgctggcgccctctccgccgcgggagtcatccgtgtacctgcacatcgccctttggccggcgccgttgctcacccccagcccttggccacaggacttccaactgttccctctgtcccggctatgccaggcgtcaacaatctcaccggactcacttttccttggatggaaagcaacagacgctacaccaaggaccgctttacagggcacccataccagaatcggactccacccaaaaaaaagaaacccagaacaagtttcacacggctgcagatatgtgaattagagaaaaggtttcaccgccaaaaatacctcgcaagtgcagaacgggcggctctggcaaaagctctgaagatgaccgacgcccaggttaaaacttggttccaaaacagacggacaaaatggcggtag

SEQ ID NO: 26567 - DNA, 345 bp, Artificial Sequence
  Description of Artificial Sequence: Synthetic coding sequence
atggccgagtgccccaccctgggcgaggccgtgaccgaccaccccgatcggctttgggcttgggagaaattcgtgtacctggacgaaaagcagcatgcatggcttccactgacaatagagataaaagacaggctgcaacttagagtcctcctgcgaagggaagacgtcgtgctaggcagacccatgacccctacccagatcggcccgtcactcctgccaattatgtggcagctgtatcccgacggccgctaccgctctagcgacagttccttctggcgcctggtctatcacatcaagatcgacggggtggaggacatgctcctggagttactgcctgacgattag

SEQ ID NO: 26568 - DNA, 345 bp, Artificial Sequence
  Description of Artificial Sequence: Synthetic coding sequence
atggccgagtgccccaccctgggcgaggccgtgaccgaccaccccgatcgcctctgggcttgggagaaattcgtctacctcgatgaaaaacaacacgcctggctccctctgacgatcgagattaaggaccgccttcagctccgcgtcttgctgcgcagggaggacgtggttctcggacgtcctatgactccaacgcagattgggcccagtctcctgccaattatgtggcagctgtatcctgacggacggtacagatcctcagactcttcattttggcgcctggtatatcacatcaaaattgatggagtggaggatatgttgctcgaacttctccctgacgactag

SEQ ID NO: 26569 - DNA, 345 bp, Artificial Sequence
  Description of Artificial Sequence: Synthetic coding sequence
atggccgagtgccccaccctgggcgaggccgtgaccgaccaccccgaccgcctctgggcttgggaaaaattcgtctacttggacgaaaagcagcatgcctggctcccactgacaatcgagattaaagatcggttacagctgcgcgtgctgctcaggcgtgaagatgtggtcctgggacgccccatgacaccgacccagatcggaccctctctgctccccattatgtggcagttataccctgacggtcggtaccggtcatcggattctagtttttggcgcctggtttaccatattaaaatcgatggcgtcgaggacatgcttcttgagttgctcccagatgattag

SEQ ID NO: 26570 - DNA, 345 bp, Artificial Sequence
  Description of Artificial Sequence: Synthetic coding sequence
atggccgagtgccccaccctgggcgaggccgtgaccgaccaccccgacagactgtgggcttgggagaagtttgtctatcttgatgagaaacagcatgcctggttacctctcactattgaaatcaaggatcgccttcagctacgagtgctgctacggagggaggatgtggttctaggaaggccaatgactccaacgcagatcgggccttctttgctccccattatgtggcaactatatccagatgggagataccggagctccgactccagtttctggaggctcgtgtaccacatcaaaatcgatggcgtggaagacatgctcctggaactgctaccagatgattag

SEQ ID NO: 26571 - DNA, 1407 bp, Artificial Sequence
  Description of Artificial Sequence: Synthetic coding sequence
atggacagcctggccagcctggtgctgtgcggcgtgagcctgctgctgtctggaaccgttgagggagctatggacttgattctcatcaatagtctccccctcgtctcagatgctgagacctccttgacctgcatagccagtgggtggaggccccacgaacctatcaccattggccgtgactttgaagctctgatgaatcagcatcaggaccccttggaggttacccaagacgtaacgcgtgagtgggccaagaaggttgtctggaaacgtgagaaggcgtcaaagattaacggggcctatttttgcgaaggcagggttaggggtgaggctattcggatacgaacaatgaaaatgcggcagcaggccagcttcctccccgccacactgacaatgacggtagacaagggagataatgtaaacatctctttcaaaaaggtgctgataaaggaagaggatgcagtgatctacaaaaatgggagcttcattcattctgtcccgcggcacgaagtgcctgatattttggaggtgcacctgccccatgctcaaccccaggatgccggtgtctactctgcccggtatatcggtggcaacctgtttacctcagccttcactagattgatcgtgcgtcggtgtgaagcacagaaatggggcccagaatgcaatcacctgtgcactgcatgtatgaataacggcgtctgtcatgaagacaccggtgaatgcatctgccccccagggtttatgggaagaacgtgcgagaaggcgtgcgaattgcataccttcggccgaacctgtaaggaacgatgttccggccaggaagggtgcaagagctacgttttttgtctccccgacccctacggatgcagctgtgccactggctggaagggcttacagtgtaatgaggggatccagcgcatgacaccaaagattgtggacttgcccgatcacatcgaagtgaattctggcaagtttaatcccatatgcaaagcctccggctggcctctgccaaccaacgaagagatgaccctggtcaagcctgatggaactgttcttcatccgaaggattttaatcacacagatcacttctctgttgcaattttcactatccaccggattctgcctcctgattccggggtctgggtgtgttccgtcaataccgtggctgggatggtggagaagccattcaacatctcagtgaaagtacttccgaagccgcttaacgccccgaatgtgatcgataccgggcacaatttcgccgtgataaatatttcttctgagccttactttggggacggtccaataaaatcgaagaagctgctgtataagcccgtcaaccattacgaagcctggcagcacatccaagtgtccatggagaaacagcgactgactaaggcaaactcagacatctag

SEQ ID NO: 26572 - DNA, 3375 bp, Artificial Sequence
  Description of Artificial Sequence: Synthetic coding sequence
atggacagcctggccagcctggtgctgtgcggcgtgagcctgctgcttagcggaactgtcgaaggcgccatggacctgatcctgataaactctctcccattagtatccgacgcagagacctcacttacatgtatcgccagcgggtggaggccccatgaacctatcaccattggtagagatttcgaggccctgatgaatcagcatcaggaccctcttgaggtaacgcaggatgtgactagggagtgggctaagaaagtcgtgtggaaaagagaaaaagcttcaaagatcaatggagcttacttctgtgaggggcgagtgcggggtgaagctatccgaattaggaccatgaagatgaggcagcaggcaagttttttaccagccactctgaccatgactgtggacaaaggggacaatgtaaacatatctttcaaaaaggtgctaataaaagaggaggacgctgtgatctataagaacggatcttttattcactccgtgccacggcacgaggtccccgacattctggaggtccatctcccccatgcacaaccccaggacgccggcgtgtatagcgcgagatacatcggtggcaatctctttacatcagcgtttaccaggctgatcgttcgccgatgcgaggcacagaaatggggccccgaatgcaatcatctgtgtacagcgtgcatgaataacggcgtttgccacgaagacacaggggagtgcatatgtcccccaggtttcatgggccgaacctgcgaaaaggcttgtgagctacacacgttcggaagaacatgcaaagaacgttgctccgggcaggaaggctgtaagagctacgtgttttgtcttcctgatccctacggttgcagttgcgcaacaggctggaaggggctgcagtgtaatgaggcctgccaccccgggttctacgggccagattgcaaattgagatgttcctgtaacaacggtgagatgtgcgaccggttccagggctgcctttgcagtccaggttggcaaggcctgcagtgcgagagagagggtattcaacgaatgacaccgaagatcgtcgatttgcccgaccacatcgaggtgaatagcggtaaattcaacccgatttgcaaagcctcaggctggccactgccaaccaatgaagagatgacgctggtgaaaccggatggtactgttctgcatccaaaagactttaatcatactgatcactttagcgtcgccatttttaccatacacagaatactaccacctgattctggggtgtgggtctgctccgtcaacacagtggccgggatggtggagaagccttttaatatttccgttaaagtgctaccaaaacccctcaatgcccccaacgtgatagacaccgggcataatttcgcggtcattaacattagctcagaaccctactttggggatggccctatcaagtcaaagaaactgttatataaacccgtgaaccattatgaagcttggcagcacatccaggtgacgaatgaaattgtaaccctaaactacctggaacccaggacagaatatgagctgtgtgttcaactagtgagacgcggtgaagggggggaggggcacccaggaccggtccgcagattcacaaccgcctctattgggttaccccctcctcgagggctgaatctgttacctaagtcacagaccactctcaatctgacatggcagcccattttcccgtcctcagaggacgatttttatgtggaggtcgaaagacgatctgtacaaaagagtgaccaacagaacatcaaggtgcccggtaatttgaccagcgtcctacttaataacttacaccctcgggagcagtatgtcgtgagagcgagagtgaataccaaagcccagggcgagtggtcggaggatctgacagcttggacgttaagcgacattctgccccctcagccagagaatattaagatttccaacatcactcactcttctgcagtgatcagttggaccattttagacggctattccatctcatccatcacaataaggtataaggtacaggggaaaaatgaggatcagcatgtcgatgtcaagattaagaatgccactattacccagtaccagctcaaaggactggaacccgagaccgcataccaagttgacatattcgccgaaaataacatcggctctagtaacccagcgttctcgcatgaactcgtcaccttaccggaaagccaagcaccggccgatttgggaggtggcaagatgctgcttattgctatcctgggctcagcaggcatgacctgcttgaccgtactgctggcttttttgataattctgcagttaaaacgtgccaacgtccagcgaaggatggcacaggcttttcaaaatgtgcgggaagaacccgccgtacagtttaattccggtactctggcactcaacaggaaagttaagaataatccagatccaactatatatccagtattggactggaatgatatcaagtttcaagacgtgataggggagggaaattttggccaggtgctcaaggcccgcatcaaaaaggatgggcttaggatggacgccgcgatcaaacggatgaaggaatacgcctccaaggatgatcaccgcgattttgccggtgagctggaagtgctttgcaaactggggcaccatcctaacattattaacctgctgggcgcctgtgaacaccgagggtatctatatcttgctatcgaatatgcaccacatgggaatctgctcgattttctccgaaaatcaagggtcctggagactgatccggccttcgcaatagccaatagcactgcctcaaccttgtcttctcaacagttgctccacttcgccgccgacgttgcaaggggcatggactatctgtcgcagaagcaatttattcatagagacctggccgcgcgcaatatccttgttggcgaaaactacgtggccaaaatcgcagattttgggttatcccgtggacaagaggtgtacgtgaaaaagacgatggggcgacttcctgtcaggtggatggctatagaatcactgaattactccgtatataccacaaattcagacgtgtggtcctacggcgtgctcctttgggagatcgtttcactgggcgggactccttattgtgggatgacttgtgccgaactctacgagaagctccctcaaggctaccgattggaaaagccactgaactgtgatgatgaagtctatgaccttatgcgacagtgctggagggaaaagccctacgagagaccttcctttgcccagatactcgtcagcctgaataggatgctggaggaacggaaaacctatgttaatacaacactctacgagaaattcacttacgcaggaatcgattgttctgccgaagaagccgcctag

SEQ ID NO: 26573 - DNA, 3246 bp, Artificial Sequence
  Description of Artificial Sequence: Synthetic coding sequence
atggacagcctggccagcctggtgctgtgcggcgtgagcctgctgctctccgggaccgtcgaaggcgcaatggatttaatcttaataaatagtctccctctggtctctgatgccgagacgtcgctgacctgtatcgcaagcggatggagaccccatgagcccataactattggccgggatttcgaagcgctgatgaatcaacatcaggatcccctcgaggtaactcaggacgttacgagagaatgggctaaaaaagttgtgtggaaacgggaaaaggcatccaagatcaacggggcctacttctgcgagggcagggtacgaggggaggccatacggattagaaccatgaagatgcggcaacaggctagttttttgcctgctacactaactatgactgtagataagggcgacaacgtcaatatttctttcaagaaagtgctgatcaaagaggaagacgccgtgatatacaagaacgggtcatttatacattctgtgcccaggcacgaagtacccgatatcttagaagtgcatttgccacatgcacagcctcaagatgcaggtgtgtatagcgccaggtatatcggaggtaacctattcaccagtgcctttaccagactgatcgtaaggcggtgcgaagcccagaaatggggtccagaatgtaatcacttgtgtacggcatgcatgaacaacggagtttgccacgaggacactggcgagtgcatatgcccacctggattcatggggcgcacgtgcgagaaagcctgtgagcttcatacgttcgggcggacatgtaaggaacgctgcagtggccaagaaggatgcaagtcctacgtcttctgtctacctgacccttacggttgcagttgcgcgaccggctggaagggcctgcagtgtaacgagggtattcagcggatgaccccaaaaattgtggacctgccggatcacatcgaagtgaacagcggcaaatttaatcccatttgtaaggcatccgggtggccattacccacaaacgaagagatgacccttgtcaagccagatggaacagtactacaccctaaggatttcaaccacaccgaccatttttctgtggcgatttttacgatccaccggatccttccaccagattccggagtctgggtgtgctccgtgaataccgtggccggtatggtcgagaagccgttcaacatcagtgttaaggtgttacccaagcctctcaatgctcccaacgtaattgacacagggcacaactttgccgtgattaatatcagcagtgagccctattttggtgatggccccattaagtccaagaaattattgtacaaaccagtgaaccactatgaagcctggcagcatatccaggtcacaaacgaaatcgtcacactcaattatctggaaccaaggactgaatacgagttatgtgttcagctggtaaggcggggtgaaggcggagagggacatcccggtcccgtaagacgcttcacaaccgccagtattgggttgcccccgccacgcggcctgaatctcctgccaaagtctcagacaaccttgaacctgacgtggcagcctattttccctagcagcgaagacgacttctacgtggaggttgaaagacgctctgtgcagaagtctgatcagcagaacatcaaggtgccgggcaatctaactagtgtgctgcttaataatctccacccccgagagcagtatgtcgttagagcaagagtgaacaccaaagcccagggggaatggagcgaggacctgactgcctggaccctatcagacatattgcctccccagcctgagaatattaaaatttcaaacattactcacagttcagccgtgatctcatggactatcctcgatggctattctatttcttcaattactattcgctataaagttcagggcaaaaatgaggaccagcatgtcgacgtgaagattaaaaacgccacaatcacacaataccagctcaagggtcttgaaccagagacagcctaccaggtggatatttttgctgagaataacatcgggtctagcaaccccgcattctctcacgaactggtgaccctgccggagagccaggctcccgcggatctcggaggcgggaagatgcttcttatcgctatattagggagcgctggtatgacatgcctgaccgtgctgttggcctttttaatcattctgcaacttaagagagccaatgtacaacggcggatggcccaggcttttcagaacgtgcgggaagagccagctgtgcagtttaatagcggtactctggcactgaatcgaaaggtgaaaaataaccccgatcctacgatataccctgtcttggattggaatgacatcaagttccaggatgtgattggcgaagggaattttggtcaggtcctcaaggccaggatcaagaaagacggtctgcgtatggatgctgccattaaaagaatgaaggaatatgcttctaaggacgaccaccgtgatttcgcgggagaactggaagtgctgtgcaagctagggcaccacccaaacattatcaacctgctgggggcatgcgaacataggggttatctgtacctggcaattgagtacgcacctcacgggaacctgctggactttttgcggaagtcacgggttctggagacagacccggcctttgcaatcgcaaattccaccgctagcaccctgtcgtcccagcagctccttcacttcgcagctgacgtagcgcgaggaatggattacctgtcccagaagcagttcatccatagagatctggcagcacgtaacatcctggttggcgagaattacgttgctaaaattgccgatttcggactgtcgagaggacaagaagtatacgtaaaaaaaactatggggcggctccccgtaagatggatggctatagagtccctgaactatagtgtgtacaccaccaactcagacgtctggtcttacggggtccttctctgggagatagtatcactgggcggtacgccctactgtggcatgacatgcgcagagctgtacgagaagttgcctcagggttacaggttggagaaacctctgaactgcgatgatgaggtctatgacctgatgagacaatgttggcgtgaaaagccctacgagcgcccatcgttcgctcaaattttggttagcctcaatcgcatgctggaggaacgcaaaacttacgttaacactactctttacgaaaagtttacatatgctggtattgattgctctgcagaagaggctgcctag

SEQ ID NO: 26574 - DNA, 3375 bp, Artificial Sequence
  Description of Artificial Sequence: Synthetic coding sequence
atggacagcctggccagcctggtgctgtgcggcgtgagcctgctgctgtctggaaccgtagagggcgctatggacctcatcttgattaacagcctcccactggtgtccgatgctgagacatcccttacctgcatcgctagtgggtggagaccacacgagcctatcacgatcgggcgtgacttcgaagctttgatgaatcagcatcaagatccgctggaagtgacacaggacgtgaccagggaatgggccaagaaagtggtgtggaaaagggagaaagcaagtaaaatcaatggtgcttatttctgcgaaggccgggtacgtggcgaggccatcaggattaggaccatgaaaatgcgccagcaagcgagttttctcccagccaccttaaccatgacagtcgacaaaggcgataacgtcaacatctcttttaagaaagtccttattaaagaagaggatgccgtgatttacaagaacgggagtttcatccactccgtgcctcgacacgaggttcctgatatcttggaggtccacttgccccacgcacaaccccaggatgccggggtgtattctgccaggtacatcgggggcaatctcttcaccagcgccttcacaagattaattgtccggcgatgcgaagcccaaaaatggggcccggaatgcaaccacctctgtaccgcctgtatgaacaatggcgtttgccacgaggacaccggcgagtgtatttgtccacctggtttcatgggccgaacttgtgaaaaggcctgcgaattacacactttcggacgaacttgcaaagagcggtgcagcggccaggaagggtgtaagtcatacgtgttttgtcttccggatccgtacggttgtagctgcgccactggatggaagggcctgcagtgcaacgaggcttgccacccaggcttctatggacctgactgtaaactgcggtgttcatgtaataatggagagatgtgcgatcgcttccagggttgtctgtgttcaccaggatggcagggcctccaatgtgaacgtgaagggatccagcgcatgacgccaaaaatagtggatctgcctgatcatatcgaggtgaacagcggaaaatttaatccaatctgcaaggcaagcggctggccattgcccacaaacgaagagatgacactggtgaagccagatggaacagtgctccacccgaaggatttcaaccataccgaccattttagtgttgctatcttcaccattcatcgcatcctgcctccagatagtggtgtgtgggtctgcagcgtgaataccgtggctggcatggtggagaaacccttcaatatttccgtaaaagtgctcccgaagccactaaacgcgcctaacgtgatcgacaccggacacaattttgccgtcattaatataagcagcgaaccttactttggagacgggccaattaagagtaaaaaactcctttacaagcccgttaaccattacgaagcttggcaacacattcaggtgactaatgagattgtgaccttgaattatctggagcccaggactgagtatgagctctgcgtgcagttggtgagacgcggtgaagggggcgagggtcatccaggacccgtgcggcgcttcactacagcgtctatcgggctgcccccaccccgaggactgaacctgctgcccaaatcccagaccacgctcaatctcacctggcaacccatctttcctagttctgaggacgatttctacgtagaagtcgaacgcagaagcgtgcaaaagtccgatcagcagaacatcaaggtgcctggaaacctgacttctgtgctgttgaacaaccttcatccccgtgagcagtacgtggtgagggctcgtgttaacactaaggcgcagggtgaatggagtgaggatcttaccgcttggaccctctcggatatcttacccccacagcctgagaacatcaaaatcagtaacataactcatagtagcgcagtaatttcctggacgattctggacggttattcaatcagcagcatcacaatccggtataaagtgcagggtaaaaacgaggaccagcacgttgacgtcaagatcaaaaacgccaccattacgcaataccagctgaaggggctcgaaccagagaccgcctatcaggtcgatattttcgcggaaaataatatcggatcttcaaatccggccttttcccacgaactcgtgaccctgcccgagtcccaggcaccagccgacctggggggcgggaaaatgttgttaatcgcaattttgggatccgcgggaatgacctgtctaaccgtgctgctggctttcctcattatactgcaactaaagcgggccaatgtacaacggcggatggcgcaggccttccaaaacgtgcgagaagaacccgcagtgcagtttaattccgggaccctcgcactcaaccggaaagtgaaaaacaatcctgacccaacaatttacccagtgctcgactggaatgatattaaattccaggatgtgatcggcgaaggcaatttcggacaagttctgaaagccaggatcaagaaagacggcttgaggatggatgccgcgattaaacgaatgaaggagtatgcgagcaaagatgaccatagggactttgccggagagctcgaagtgctgtgcaagctgggccaccatccaaacattatcaatctgttgggcgcatgcgagcatcggggatatttatatctagccatcgaatatgcacctcatgggaatctcttggatttccttcgaaaaagcagggtgctcgagacggaccctgccttcgcaattgccaactcaacggcctcaactctttcttctcagcagctgttacactttgccgccgacgtggctaggggaatggactacctctctcagaagcagttcattcatagggatttggccgcccgtaatatactcgtcggagaaaactatgtggccaagatcgcagactttggactgagtcgaggtcaggaggtgtatgtcaaaaagaccatgggccgccttcctgttcggtggatggctatcgagagtctcaattactccgtgtacacgaccaactcggacgtttggtcatatggggtgcttttatgggagatcgtgtcactcggggggacaccttattgtggcatgacttgcgccgaactgtacgagaaactgccacaagggtataggctcgaaaagccactgaactgcgatgacgaggtgtacgaccttatgcgacagtgctggcgagaaaagccatatgaaagaccctccttcgcgcagatcttggtttctttgaatcgcatgctggaggagcgcaagacatatgtcaacaccacattatacgagaaatttacttacgctggaatcgactgttccgctgaggaagccgcttag

SEQ ID NO: 26575 - DNA, 2931 bp, Artificial Sequence
  Description of Artificial Sequence: Synthetic coding sequence
atggacagcctggccagcctggtgctgtgcggcgtgagcctgctgctgtccgcctccttcttaccagccacattgaccatgaccgtcgataaaggtgacaatgtcaatatctccttcaaaaaagtgctgattaaggaggaagatgccgtcatctataagaacggttcgtttatccatagcgtgccaagacacgaagtgcctgatattctggaggttcacttgccccacgcacagccccaggacgcaggcgtttactccgcaagatatatcggtgggaatctgtttacaagcgccttcactcgtcttattgtgaggcgctgtgaggcacagaagtggggtccagaatgtaaccatttgtgcacagcctgtatgaataacggcgtgtgtcacgaggatactggggaatgcatctgcccccccggatttatgggccgaacatgtgagaaggcctgtgagctccatacttttggtaggacatgtaaggagcgttgcagtgggcaagagggctgtaagtcatatgttttttgcctgccagatccttacggctgctcctgcgctacagggtggaaaggactacagtgtaacgaaggcattcagcgcatgactccaaaaatagtggatctgccagatcacatcgaagtaaattccgggaagttcaatccaatctgcaaggcatccggctggccgttgcccacaaatgaggagatgactctggttaagcctgacggtactgtcttgcatcctaaggattttaaccacaccgatcacttttccgtggcgatctttactatccaccggatactccctcccgacagtggcgtgtgggtgtgctccgtcaacacagtagcgggcatggtagaaaagccctttaacatctctgtgaaggttctccctaagccgttgaacgccccgaacgtgattgataccggacacaattttgccgtcattaatatctcttcggagccctattttggtgacggcccaattaagtctaaaaaactgctatacaagcccgtgaatcattacgaagcttggcaacacatccaggttacaaacgagattgtgactttgaactacctggaaccacgcaccgaatacgaactttgtgtccagctagtgcgcagaggcgagggcggtgaggggcaccccggacctgtccggaggtttaccacagcctccatcggtctgccaccaccgcgcggtctgaacctgctgcctaagagtcaaacaaccctgaacttaacttggcagccgatcttcccgagttcagaggatgatttttatgtcgaagtggaacgccgcagcgtccagaagtctgatcagcagaatatcaaggtacctgggaatctgacgagcgtgctgctcaataacctccacccccgggagcagtatgtcgtccgggcgcgcgttaatacaaaggctcagggggaatggagcgaagatcttactgcatggactctgtccgatattctccctcctcagccggagaacatcaaaatatcaaacattacgcacagctcggcagtgatcagctggacaattctggacggatactcaatctctagtatcaccattcgctacaaggtccaggggaaaaacgaagatcagcacgtggacgttaaaattaagaacgccacgattactcagtatcagcttaaggggctggagcctgaaaccgcataccaagtggacatattcgctgagaacaacatcgggagttccaaccccgccttcagtcacgagctggtgaccttgcctgagtcacaagccccggccgacttgggaggaggaaagatgctgctgatcgcgatccttggcagcgccggtatgacatgtctgacagtgttactggccttcttgatcatcctccagctcaagcgcgccaacgtccagaggcgaatggcgcaggccttccagaaccgggaggaacctgctgtccagtttaattccggcaccttagcgctgaataggaaagtgaaaaacaaccctgatcctacgatctaccccgttctggattggaatgatataaagttccaggacgttatcggagaaggtaacttcggccaggtgctgaaagcaaggatcaagaaggacgggcttcggatggacgccgctatcaaacgcatgaaagagtatgcatcgaaggatgaccacagggacttcgcaggcgagttagaagtgctatgcaaactgggccaccaccctaacataataaacctgctgggtgcatgtgaacacagagggtatttgtatctcgccatcgaatacgcgccgcacggcaacttgttggacttcctcagaaagagcagggtactcgaaaccgaccctgctttcgcaatcgctaatagcaccgccagcacccttagttctcagcagctgctgcacttcgccgccgatgtggcaagaggcatggactaccttagtcaaaagcagtttattcacagggacctcgccgctagaaacattctggtgggcgagaattatgtggccaaaattgcagatttcggtctgagccggggccaagaggtctacgtgaaaaaaaccatgggtcgtctccctgtcagatggatggccatagaatccctcaattatagcgtctataccactaattctgatgtttggtcttatggtgtcctcctatgggaaatcgtctctctaggtgggaccccctattgtggaatgacgtgcgccgagttgtacgaaaaactgccacagggttaccgcctcgagaaaccccttaattgcgacgatgaagtctacgatctcatgcgacagtgttggcgggagaaaccctacgagagacccagcttcgcccagattctggtaagcttgaatagaatgctcgaggagagaaaaacttatgttaacactaccttgtacgagaagttcacatacgcaggcatcgattgtagtgctgaggaggctgcctag

SEQ ID NO: 26576 - DNA, 7884 bp, Artificial Sequence
  Description of Artificial Sequence: Synthetic coding sequence
atggagaagctgcacggccacgtgagcgcccaccccgacatcctgtctctcgaaaaccgctgcctggctatgttgcccgacctgcagccgctcgaaaaacttcatcagcatgtctctactcacagcgacatcctgtctctcaagaatcaatgcctggctacacttccagacctcaagaccatggagaagcctcacggctatgtcagtgctcatccagatatcctgtctctcgagaaccagtgtctagctaccctgtctgatctgaagactatggagaaaccacatggacacgtctctgctcaccctgacatcttgtctttggagaatagatgccttgccacactcagtagcctcaaaagtaccgtttcagcatctccgctgtttcagagcttacagatctctcatatgacgcaggcagacttataccgcgttaataattctaactgtctgctgagcgagcctcccagctggagggcccagcatttctcaaaaggtctggatctcagcacctgcccaatagccctaaaatccataagcgcaaccgaaacggcccaggaagccaccctcgggcgctggtttgattcagaggaaaagaagggcgctgagactcagatgccctcgtattctctaagcctaggggaggaagaggaggtggaggacctagccgttaagctgacaagtggcgatagcgaaagtcaccctgagcccaccgaccacgtacttcaagagaagaagatggcactgctgtcactgctttgcagcacgctggtgagcgaagtcaacatgaacaatacctctgacccaaccctggccgctatttttgagatttgtcgggagctagcacttctcgaacctgagtttatcttaaaggcctcactgtatgccagacagcaactgaacgtccggaatgtagcaaacaatatactggcaatcgccgctttccttccagcttgccgtcctcacttgagacggtatttttgcgcgatcgtgcagctcccctcagattggatccaagtcgccgaattgtaccaaagtttagctgaaggcgataagaacaagttggtgccccttcccgcctgcttgcgaaccgccatgacggacaagttcgcccagttcgatgagtaccagctcgcgaaatacaacccaagaaagcatagagccaagcggcaccctagacgccctccccggtctcccgggatggaaccaccatttagccacaggtgcttccctaggtacattggttttctgagagaggaacagcggaaattcgagaaggcaggggatacagtgtctgaaaaaaagaaccctccgcgcttcaccctgaagaagctggtgcagcgacttcacatacacaagccagctcagcatgtccaggcactccttgggtataggtatccgagtaatctccagttgttttctcgttcacgactgcccggaccttgggattcttctcgggctgggaaacgcatgaaacttagccgaccggagacttgggagagagagttgtcacttaggggtaataaggctagtgtctgggaggagcttatagaaaatggcaaactcccctttatggctatgttgagaaacctctgtaatctcctaagagtgggcatttcctcccgtcaccacgagctgatcttgcagagactgcaacacgcaaagagtgtgatccacagccgacagtttcctttcaggttcctgaacgcacacgacgcgatagacgctctggaggcccagctccgaaaccaggctctcccttttccgtcaaatatcacactgatgagaagaattctcacacgaaacgaaaaaaaccgcccacgtcggcggtttttgtgccacctttctcgccagcagctccggatggccatgagaatccctgtcctctacgagcaactgaaacgtgagaaacttcgagtgcataaagcaaggcaatggaagtacgacggtgagatgcttaaccgctaccggcaagctcttgagaccgccgtgaacctctctgtgaagcattctctgccactgctgccggggcgaacggtcctggtgtacctgaccgatgcaaatgccgatcggctgtgccccaaaagtaatcctcagggtccacctctcaattatgcactgctgttgataggaatgatgattaccagagcagagcaggtggatgttgtgctgtgcgggggtgataccctgaaaacagccgtcctgaaagcagaggaggggatacttaagaccgccatcaaactacaagcacaggtgcaggagttcgacgagaacgatggctggtctctgaatacattcgggaagtacctgctcagcctggcaggccagcgagtgcctgtcgatcgggtgatattgttggggcagtcgatggacgacggtatgataaatgtggcaaagcaactttattggcaaagagtcaatagtaaatgcctgtttgttggtatcctgctccgccgcgtgcagtacctcagcacggacctcaatcctaatgatgtcaccctgagcggttgcaccgatgcgattttaaagtttatcgccgagcatggtgctagtcatctgctggagcacgtcgggcaaatggataagatctttaagatcccacctccccctggaaagacaggtgtacagagcctaaggcctctggaggaggacactccctcgccattggcaccggtgagtcaacaggggtggcgcagtatccgactgtttattagtagtacattcagagacatgcacggagaaagagatctcctcttacgatccgtgctaccagccctgcaggcacgggcagctccacataggatttcattgcatggtatcgacctccgttggggcgtcaccgaggaagagaccagaagaaaccgccagctcgaagtttgtctgggcgaagtggagaatgcccagttgtttgtggggattttaggaagtagatatggatacatcccgccctcatacaaccttcccgatcaccctcattttcactgggcccagcagtacccaagtgggcgaagcgtcacagaaatggaagtgatgcaatttctgaatcgcaaccagcggctccagccttcagcccaggctttgatctattttagggattccagcttcctgagctcagtgccagatgcctggaagagcgatttcgtgtctgagtcagaagaagctgcacgccgtatttctgagctgaagtcttatctaagccgccaaaagggcatcacctgcagacggtatccatgcgaatggggcggggtggccgccggccgtccctacgtgggcggtctcgaagaatttggacagttagtgcttcaggatgtgtggaacatgatacagaagctataccttcagccgggtgctctgctcgaacagcccgttagcatacctgatgatgacctcgtccaggccacttttcaacagctgcagaagccaccctctccagcaaggccgagattactgcaggacaccgttcaacgtttgatgctcccccacggacgcctgtctttagtgacaggtcaatccggccagggcaagactgccttcctcgcctctctggtgagtgccctgcaggcaccggacggagccaaggtcgctagtctggtgtttttccacttttcaggagctcggcctgatcaaggcctggcactgacgctgctgcgtcggctctgtacatacttgcggggccagctcaaggagcctggcgccttgccctccacatatcggtccctggtgtgggaactgcaacaacgtctgctcccgaaatcagccgaaagcctgcatcctggccagactcaggtgcttattattgacggcgcagatcgcctcgttgaccagaatggacaattaattagtgactggataccaaagaaacttccccggtgcgtccacctcgttctctcggtgtcctccgacgcaggcctgggagagacactggagcagtctcagggagcgcacgtactcgctctcggacctctggaggcgtctgcccgagccagattggtccgggaggaacttgccctctatggtaaaagactggaagagtccccctttaataaccaaatgcgcttgctcctcgttaaaagggaatctggccgccctttatacttgcggttagtaaccgatcatttgaggctgtttaccctgtacgagcaggtgagcgaacggctgcggactttaccagccactgtccctctgctactgcagcacatccttagcacgctagaaaaagaacacggcccagacgtgctcccccaagctctgactgctctcgaagtcacccgctctggcttgacagtggaccagcttcatggggtgctctcagtgtggcggacccttccaaagggcaccaagagttgggaagaggctgttgccgcgggcaattctggcgacccctacccaatgggtccattcgcttgccttgtgcaaagtctccgctccctgctaggcgaagggccccttgagcgtccgggagcccgattgtgcctgccagatggcccactgcgcacagccgcaaagcgctgctacggtaagagaccaggcctggaagataccgctcatattctcatcgccgcacagctttggaaaacgtgcgacgctgatgccagcggaacgttcaggtcctgcccaccagaggccttgggcgacctgccttatcacctgcttcagtccggaaaccgcgggcttctcagtaagtttttaaccaacttgcacgtggtggcagcgcaccttgagctgggcttggtgtctaggctgttagaggctcacgcactgtacgcttcctctgtgcctaaagaagaacagaaacttccagaagcagacgtcgctgtatttcgtacctttctgcgccaacaagccagtatcctgagtcagtaccccagacttctgccccagcaggcagctaaccaaccgttagattcccctctgtgtcaccaagcctccttgcttagcaggcgttggcaccttcaacacactctgcgttggctgaacaagccccggaccatgaagaaccagcagtcctcctctctttcactggctgtcagcagttcaccgacggccgtggcgttcagcaccaacggccagagagccgcagttggaactgctaatggaacggtctacctccttgatctcagaacctggcaggaggagaagtccgtggtctccggttgcgatgggatcagcgcctgcctttttctctctgatgatactctgttccttactgcgttcgatggtttgctcgaactctgggacctgcagcatgggtgcagggtcctgcagacaaaagcacaccagtatcagattaccggatgttgcctgagtcccgattgcaggctgctggccaccgtctgcctgggagggtgtctgaagttgtgggacactgtgaggggtcagcttgctttccaacatacatatcctaagtccttgaactgtgtggccttccaccccgaggggcaggtcatagcaactggctcttgggcgggatcaatctctttcttccaggttgacgggttgaaagtgactaaagatcttggggccccaggggcatcaatccgaacgttggccttcaacgtgccaggtggcgttgtggccgtgggtcgcctggactcaatggtcgaattgtgggcctggcgagagggcgcacgcctggccgccttccctgctcatcatggcttcgtcgccgccgccctcttcctccacgccggttgccagctgttaacagccggggaagacgggaaggtgcaggtatggtctggaagcctaggacgccccagagggcacctgggttctttgtcactttcccccgcattgtcagttgccctgtcaccagatggagaccgggtggccgtgggctaccgggcagacggtatcaggatctacaaaattagctcaggatcccaaggcgctcagggccaagctctcgatgttgcggtaagcgctctggcatggctgagtccaaaggtgttggtctccggggccgaggatggtagcttgcagggctgggctcttaaggagtgctccctgcagtctctgtggcttctcagtcgctttcagaaacccgtactcggcctggctacatcacaggaactgctggctagtgccagcgaagacttcaccgtccagctgtggcctagacagctgctgacacgcccccataaggcagaggattttccgtgcggaacagagctgcgcggacatgagggaccagtgtcttgctgtagtttttccaccgacggaggcagcctagcaaccggcggcagggatcgctcactcctctgctgggatgtgcggacccccaaaacgcctgtcctgattcatagcttcccagcctgccatcgggactgggtgaccggctgtgcgtggaccaaggacaaccttctgatttcctgctctagcgacggaagcgtggggctgtgggacccagaaagtgggcaacgcctgggacagtttctcggccaccaaagtgcagtgtccgctgtcgcggccgtggaagaacacgtggtctccgtgtctagagatggcactctcaaggtttgggatcaccagggcgtcgaactaacctctatccctgcccactcagggcctatctcacattgtgctgcagctatggagcccagagcagccgggcagcctggctctgaactcctggttgtaactgtgggcttggatggcgcaacgcggctgtggcacccattactagtgtgccaaactcatacattactgggtcattcaggtcccgtaagggccgcagccgtatcagagactagcggcctcatgttgactgcttcagaggatggctcagtgagactgtggcaagtccccaaagaggccgacgatacctgcatccctaggagctcagctgccgtgacagctgttgcttgggccccggacggatctatggcagtcagtggcaatcaggctggtgaactgatcttgtggcaggaagcaaaggcagtggccaccgcgcaggctcctggtcacatcggggcactaatttggtcctctgcccatacattcttcgtgctgtccgcagacgagaagatctcagagtggcaggtgaagttgcgcaagggatccgccccaggcaacttgtccctgcatcttaatcgtatactacaagaagatcttggagtgctgacctccctcgattgggcgcctgatggtcatttcctcatcctggccaaggccgacctgaagctgctctgcatgaagcccggcgacgccccctccgagatctggtcatcctacactgagaatcccatgatactgagcactcacaaagagtatggtattttcgtgctgcagcctaaggatcctggggtgctcagcttcctcagacaaaaggagagcggggagtttgaagagagactgaatttcgacattaaccttgaaaatccatcccggacgctcatcagtatcacgcaggcgaaaccagagtccgaatcttcgtttctttgcgcctcctcagatggaattctgtggaaccttgccaagtgcagtccggagggcgagtggacaaccggaaatatgtggcaaaagaaggccaataccccagagactcagactccaggcacagatccctctacctgcagggaatcggacgcatccatggacagcgatgccagtatggactctgaacctacaccccacctgaaaacgcgacagaggcgcaagatccattctggcagtgtgacagcgttgcacgtgctcccggaattgttggtgacagccagcaaggatcgggatgttaaactttgggaaagaccttccatgcaactactcggtctttttagatgcgaaggttctgttagctgcctggagccatggctgggagccaacagtacattgcagctcgctgtcggcgatgttcagggtaatgtgtatttcctcaattgggagtag

SEQ ID NO: 26577 - DNA, 7860 bp, Artificial Sequence
  Description of Artificial Sequence: Synthetic coding sequence
atggagaagctgcacggccacgtgagcgcccaccccgacatcctgagcctggaaaataggtgcctggcgatgttgccagatcttcagcccctagaaaagcttcatcagcacgtctctacccactccgacatcctcagtttgaaaaatcaatgcctggccactttacctgacctgaaaacgatggagaagcctcacggctacgtgtccgcccatcctgacatcctttccctggaaaatcagtgtttggcaaccctgagcgatctcaagacaatggagaagccccatgggcatgtgtcggctcaccccgatatcctgtcactcgaaaaccggtgtttggccacattatcctctctcaagagtacggtgtccgcctcacctctgtttcagagcctacagatttcccacatgacccaagctgacctttatcgggtgaataacagcaattgcctcctgtccgagccaccgagctggagggcccagcatttttccaaaggactcgatctgtcaacttgtcccatcgcgctgaaatccattagcgcaaccgagacagctcaggaagccaccctgggccgatggttcgattcagaagagaaaaagggcgcagagacgcagatgccgagttacagcctttctctgggagaggaggaagaggtcgaagacctggccgtcaagctaacaagtggcgactctgagtctcatccagagccaaccgaccacgtgctccaagaaaagaagatggctctgctgagtcttctctgttccactttggtctctgaggttaacatgaacaacacatccgacccaactctcgctgccatctttgaaatttgcagagagctggcccttttggaacctgagttcatactaaaggcctccttgtacgcacgtcaacagctcaatgttagaaatgtggcgaacaatattcttgccatagctgcctttctgccagcttgtcgcccacacctgagacgctacttttgtgccatcgtgcagttaccatccgactggatccaggttgctgaactgtatcagagcttggcggaaggcgacaaaaataagttggtcccccttccagcgtgtctgcgcactgctatgacagataaattcgcccagtttgacgagtatcaacttgcaaagtacaaccctcgaaaacacagggcgaagcggcatcccaggagacctcctcgatctcctggaatggagcctcctttctctcatcgctgttttccaaggtatatcgggtttctgcgggaggaacagagaaagtttgaaaaagctggcgacaccgtaagcgagaaaaagaaccccccccgattcactttgaagaagttggtgcagcgtctccacatccacaaacccgcccagcatgtgcaagcgctcctcggctaccgatacccgagtaacctgcagctgttttccaggtctcgactgcccgggccatgggattccagtcgcgccggcaagaggatgaagctctctcgaccggagacatgggaacgggagctcagtcttcggggcaataaagcttctgtctgggaagagctgatagaaaacggaaaactaccctttatggctatgcttaggaatctctgtaacctcctccgcgtgggaatctccagtcgccatcatgagttaatcctgcagagactgcagcacgctaagtccgtgatacacagccggcagttcccgttcagatttctcaatgcgcacgatgccatcgacgcgttagaggcacagctacgcaaccaagccctgcctttcccgagtaatatcactttgatgcgcaggatccttacccgaaatgagaaaaaccgcccaagaagaaggttcctgtgtcacctaagtcggcagcagctacgcatggctatgaggatccctgtgctgtatgaacagcttaagagggagaagctgagggtgcataaggccagacaatggaaatacgacggtgagatgctcaaccggtatcgacaggcattggagacagctgtaaacctgagtgtgaagcactcgctgccattgttaccaggacggacagtgctagtttacttaaccgacgctaatgcggacaggttatgcccaaagagcaacccacaaggacctcctcttaattacgcgctgctcctgatcggtatgatgatcacacgggccgagcaggtggatgttgtgctctgcggtggagacactctaaagacggcagtcctgaaggccgaggaaggcattcttaagaccgccatcaagcttcaggctcaggtccaggaattcgacgagaacgatggctggtctctaaacactttcggcaagtacctgttaagtttggccggacaacgcgtgcccgtggacagggtgatcctactggggcagtctatggatgatggcatgattaacgtggcaaaacaactctattggcaacgggtcaatagtaaatgtcttttcgtgggcatcctacttagacgcgtccagtaccttagtactgaccttaaccccaacgacgttaccctatcaggctgcaccgatgccatcttgaagttcatcgccgaacacggggccagccatctactggagcacgtagggcagatggacaagatcttcaagatcccgccgcctccaggcaaaaccggcgtgcaatccctgcggccactcgaagaagacacgcccagtccgctggcccccgtctctcagcagggctggcgcagcataagattgttcatctcatctacatttcgcgacatgcacggcgagcgcgacctcctcttgagaagtgtcttaccagctcttcaggctcgtgccgcaccgcaccgaatatcactccatggcattgatctccgttggggcgtcaccgaggaagagacccgccgaaaccgccaattggaggtctgcctaggggaagtggagaacgcgcaattatttgtaggcatcctggggtcgagatatgggtatattcctccaagttacaatttgccagaccacccgcactttcactgggctcagcagtatccttctgggagatcagtgaccgaaatggaggtcatgcagttcctcaacaggaatcaacggctccaaccctccgcgcaagctctcatctacttcagggattcttctttcctatcttccgtacccgatgcctggaaaagcgactttgtgagtgaatccgaggaagcagcccgtcgcatctcagagctgaagtcttacctttccagacaaaaaggaattacgtgccgcagatatccatgtgaatggggtggtgtggcagccgggcggccctacgtaggaggcttagaggagtttggacaactggtgttgcaggacgtttggaatatgatacagaaactctatctgcagcccggagcgctactcgaacagcctgtgagcatcccagatgatgacctggtgcaggcgacatttcagcagttacagaaacctccgagccctgcaagacccaggctgttacaggacacagttcaaaggctgatgttgccacatgggcgcctctcattggttaccggccagagcggccagggaaaaacagctttccttgcatctctggtctcggcgctacaggctccggatggagctaaagtcgcgagtctcgtgttctttcatttctcaggtgcccgccctgaccaaggtctggcccttactctgctgcggaggctctgtacttacctgcggggccagctaaaggaacctggcgctttgccttcaacctaccggtcactggtctgggagcttcagcaacgtctgcttcccaaatctgcagagagcctgcaccctgggcagactcaagtcctgattatcgatggtgccgatcgcttagtcgatcagaacggtcagctgatttcagactggatccctaagaaactccctagatgtgtgcacctggttttgtctgtgtcctccgatgccggcttaggcgagactctagaacagagccaaggagcccatgtcctggcccttggccccctggaagcgtcggcccgggcacgcctggtaagggaggagctggcactgtacggaaaacggctggaagaaagccctttcaataaccagatgcggctgttactggttaaacgcgagagcggcaggcccctgtatctccgcctcgtgacagaccacctccgactgtttacactgtatgagcaggtgtctgagagattgcgcacgctgcccgctacggtgcccctgctcctccagcacatcctgagtactctggaaaaagaacatggcccagacgtactccctcaggccctgacagccctggaagtgactaggtccggactcactgtggatcagctccacggggtacttagcgtatggaggactctgccgaagggcactaagagttgggaagaagcagttgcagctggtaacagtggagacccctaccccatgggtccctttgcctgcctggtgcagagtctgagatcccttctcggcgagggtcctttggaacgccccggagctaggttgtgcttaccagacggacccctgcgtactgctgccaaacggtgctacggaaagagaccagggctagaagacacggcccacatactgatcgccgctcaactctggaagacctgcgacgccgacgcctccgggacgtttcgatcatgccccccagaagcgctgggtgaccttccgtaccacctgctgcagagtggtaatcggggcctcctgtccaagttcctgaccaacctgcatgttgtagcagctcacctggagctcggccttgtcagcaggctgttggaggctcacgctttgtacgcatcgtctgtcccgaaagaagaacaaaaactgcccgaagcagacgtcgcagtgtttcggacgttcctgagacagcaggcttctatactgagccaataccccaggcttctcccacaacaagcggccaaccaaccattggatagtcccctgtgtcaccaggcatccttgctttctagacgctggcacctgcagcacacactgcgctggctgaataaaccgcgaactatgaagaatcagcagagttcatcactttccctggccgtctcctcctcccctaccgccgtggcattcagtaccaacggacagcgagctgccgtagggactgccaatggaactgtgtatctgctggacttaagaacctggcaggaggagaaatctgttgtgtctggatgcgacggcattagcgcatgtttattcttaagtgacgacacccttttcctgacggcttttgacggcctgcttgagctgtgggatctccagcacggctgtcgggttcttcagactaaagcacatcaatatcagataaccggatgttgcctgtcacccgactgccggctgttagcaaccgtgtgcctaggaggctgccttaaactgtgggatacagtgagaggccagcttgcgttccaacatacttacccaaagtcccttaactgtgttgccttccatccggaggggcaggtaatagccactggaagttgggccggttcaatcagctttttccaggttgacggattaaaagttactaaagatttgggagctcccggggcctcaatcaggaccctggcctttaacgtacctggaggcgtggtagccgtcggtcggcttgatagtatggttgagctgtgggcatggcgcgagggagcacgtctggccgctttcccagctcaccatggcttcgtggcagcagccctctttttgcatgccggatgtcaactccttacagcaggggaagacgggaaagttcaggtgtggagcggttccctgggcaggcccagagggcatctcggatcattgtccctatcaccagctctgagtgtggcgctatctccggatggcgaccgggtagcagtggggtacagagccgacggaatacgaatttataaaatctcttccggaagtcaaggggcccagggacaggccttggatgtcgccgtaagtgcccttgcctggttgagtcctaaggtgttagtttctggagctgaggatggcagtctgcagggctgggctcttaaggaatgctcactgcagtccctatggctgttgtccagattccaaaagccagtcctcggattggccaccagccaggagctgctcgcatctgcttccgaagacttcacagtgcagctgtggcctcgccagcttttgacaagaccccataaagcagaagattttccttgtggcaccgagctgcggggacacgaagggcctgtgagttgctgttctttttcaacagatggcggttccctcgccacagggggtcgcgacaggtcactgctgtgctgggatgtcaggacccccaagacacccgtgttgatccactcatttccggcctgccacagggattgggtcacaggatgcgcatggaccaaagacaacctactgatcagttgctcaagcgacggatctgtcggactgtgggatcccgagtctggtcaacgactgggccaatttctgggacaccaaagcgctgtgtccgccgtggctgccgtggaagagcatgtggtaagtgtcagccgcgatggtaccctgaaagtgtgggatcatcagggtgtggagcttacaagcattccggctcactcagggcctattagtcattgtgctgccgccatggagcccagggcagctggtcaacctggctctgagttgcttgtcgtcactgtgggtctcgacggggcaactcgactatggcatcctttgcttgtgtgccagacccacacgctgcttgggcattctggcccagttcgggccgccgccgtttctgagacgagcggcctcatgctgaccgcctctgaagatgggtccgtgagactgtggcaggtgcccaaagaggccgacgatacttgcattcctcgctctagtgctgcagtcaccgccgtggcctgggcgccagatggctcaatggctgtgagtggaaaccaggctggggagttaatcttatggcaggaggctaaggccgtcgcaactgcccaggcgcccggacacatcggggccctcatttggagcagcgcacacactttctttgttctgagcgctgatgaaaaaatcagtgagtggcaggtgaaattgcggaagggctctgcacctgggaacctgagcctgcacctgaacaggatattgcaggaggatctgggtgtgctgacttctctcgattgggcccctgatggtcatttcctcatactggccaaggcggatctgaaactattatgtatgaaaccaggcgacgccccaagcgagatctggagcagttacacagaaaatccaatgatcctgagcacgcacaaggagtacggcattttcgtgctgcaacctaaggatccaggggtgcttagctttctcagacagaaggagtcaggagagtttgaggaacgccttaattttgatatcaacctcgaaaaccccagtcggactcttatcagcatcacccaggctaagcccgaatctgctctgatgggctcgtatgggacctggcccaatgccgcccagaaggaaaatgggccacaagtcacttgcggaagaaagaagaacacgccagaaacccagacccccggaaccgaccctagtacatgtagggaatccgatgcttcaatggatagtgacgcctcaatggatagcgagcccactccccacctgaaaacccgccaaaggcgaaagatccatagtggatcggtaaccgccttgcatgtcttacctgagctgctggtgaccgcatccaaggatcgggacgtgaagctctgggagaggccttccatgcagctgctgggcctgttccggtgtgaagggtccgtgtcgtgtctggagccctggcttggggccaattcaaccctacaactcgccgtcggggatgttcaaggcaacgtttattttcttaactgggaatag

SEQ ID NO: 26578 - DNA, 2031 bp, Artificial Sequence
  Description of Artificial Sequence: Synthetic coding sequence
atgaagaaccagcagagcagcagcctgagcctggccgtgagcagctcccctactgcagtcgcattctcaaccaatgggcagcgtgcggcggtcgggactgccaacggcacagtgtatttgttagatctaagaacgtggcaagaggagaaatcggtagtgtcaggctgcgatggcatttctgcttgcctgtttctgagcgatgatacgttgtttctgactgcctttgacggcctcctggagctgtgggatcttcagcatgggtgccgcgtgctacagaccaaggcccaccagtaccagataacaggctgttgcctgtccccagactgtcgtctattagctaccgtatgcctcggtggttgcttaaaattgtgggataccgtgcggggacagctcgcatttcagcacacatatcccaagagcttgaactgcgtggcctttcatccggagggccaggttatagccacagggtcctgggccggcagtatttcctttttccaggttgatgggctaaaggtgactaaggatctgggggccccaggggctagtattcggactcttgcattcaacgtacctggcggagtggtcgcggtcggacgtctggacagcatggtcgagctgtgggcctggcgcgagggtgcgagattggcagccttccccgcccatcacgggtttgtggcagctgccctctttttgcacgctggctgtcaacttctgaccgccggggaagacggaaaggttcaggtttggtcaggatccctgggccggcccagaggacatttgggctccttgagcctgagccctgcattgtcagtggcgctctctcctgacggcgacagagtggcagtgggataccgtgctgatggtatccggatatataagattagctcagggtcacagggcgcacaaggccaggcactagatgtagctgtgagtgctttggcttggttgagtcctaaagttctggtttcaggcgcagaggatggttctctgcagggatgggctctgaaggaatgcagccttcagtccctctggctcctgtcgagatttcagaagccggttcttggcctcgccacctcccaagagctgctggcaagcgcctcagaagacttcaccgttcagctgtggcctcgccagctgctgactaggccacataaagccgaagacttcccttgtgggaccgagttacgggggcacgagggacctgtgagttgttgcagcttctccaccgatgggggctccctcgccacggggggcagagacagatctctcctgtgttgggatgtccggactccaaaaaccccagtgttaattcatagctttcccgcatgtcacagggactgggtcactggttgtgcctggacaaaagacaatttactgattagctgctccagcgacggctccgtgggactgtgggaccccgagtccggacagcgcctgggccagttcctcgggcaccagtctgcagtgagcgctgtggctgcagtggaggagcatgtggtgagtgtaagcagagacgggacattgaaagtgtgggatcaccaaggcgtggagcttaccagcatcccagcccatagcggtccaataagtcactgtgcggcagctatggaacctcgggccgctgggcaacctggaagtgaattgctggttgtaacagtaggcctcgatggcgctaccaggctgtggcacccactgctggtgtgccaaacacacaccctgttgggccattctggcccagtgagagctgccgcggtatctgagacttccggactcatgttaacagcatctgaagacgggagtgtgagactgtggcaagtgccaaaagaggctgacgacacctgcatcccgcggtcctccgctgccgtgacggccgtcgcttgggctcccgacggatccatggcggtgagcggcaaccaggctggagagctgatcctgtggcaggaagctaaggccgttgccacagcgcagtcttcgccggaacctaacagcaccggcggtctgcgcggtgcagacaagagcggactgggctcttag

SEQ ID NO: 26579 - DNA, 501 bp, Artificial Sequence
  Description of Artificial Sequence: Synthetic coding sequence
atggagaagctgcacggccacgtgagcgcccaccccgacatcctgagtctggagaacagatgtctggcgatgctccccgaccttcagcccctggaaaagttgcatcaacacgtgtccactcactctgatatactctctctcaaaaatcagtgtttggcaaccctgccagatctaaaaacaatggagaagccgcacggatatgtctcggcacacccggacattctctcattggagaatcaatgcctggctactctctccgacctgaaaactatggaaaaaccacacggccacgtctctgcccacccagatatccttagtttggaaaatcggtgtctcgccaccctgtcttcgctgaaaagtactgtctccgccagcccactcttccagtccttgcagattagtcacatgacccaggccgatctgtatcgggtaaataatagcaattgtctgttgtctgaacctcctagctggagagctcagcacttcagcaagggcctgtag

SEQ ID NO: 26580 - DNA, 1260 bp, Artificial Sequence
  Description of Artificial Sequence: Synthetic coding sequence
atggccgaggacgtgagcagcgccgcccccagcccccggggctgcgcagatggtagagatgctgaccccacagaagaacagatggcagaaacagaaaggaatgatgaggagcagtttgaatgccaagagctactggaatgccaggtgcaagtgggcgccccggaagaagaggaagaagaagaagaagatgctgggcttgtggctgaggcagaagccgtggcagctggttggatgcttgattttctgtgcctcagcttatgtagggctttccgcgacggaaggtctgaggacttcagacgaaccaggaacagtgcagaagctattatacacgggctgagttctctcacagcttgccagcttcgcacaatttacatctgccaatttctcactcggattgccgccggcaaaactcttgacgcacagtttgaaaacgatgaacggattactcccctggagagcgccctgatgatctggggatcaattgagaaagaacacgataaattgcacgaagagatccagaatttgatcaagatccaggccatagccgtttgcatggagaatgggaatttcaaagaggctgaagaggtcttcgaaaggatatttggcgaccccaactctcacatgccgtttaaaagcaaactgctcatgatcatcagccagaaggatacctttcactcattctttcagcacttttcatacaaccatatgatggagaagatcaaatcctatgtcaactacgtcctgtcagagaaaagttctaccttcttgatgaaggctgccgccaaagtggttgaatctaaacgcacgagaactatcacatcgcaggataaacccagtggaaacgacgtggaaatggagactgaagccaatctggacaccaggaaacgatctcacaaaaatctctttttgtccaagttgcagcatggaactcaacaacaggacctgaacaagaaggagcgtcgggtcggaacaccgcagagcaccaaaaaaaagaaggaaagtaggcgcgctacagaatctcggatcccggtgtccaaatcacagcctgtcactcctgaaaaacaccgggccagaaagcgccaggcctggttgtgggaagaggacaaaaatctcaggtccggcgtacgcaagtatggtgaaggaaactggtccaaaattttgctccattacaagtttaacaatcgaacctccgtgatgcttaaagaccgatggcgaactatgaaaaagctgaagctgatttccagcgactccgaggactag

SEQ ID NO: 26581 - DNA, 1320 bp, Artificial Sequence
  Description of Artificial Sequence: Synthetic coding sequence
atggccgaggacgtgagcagcgccgcccccagcccccggggctgcgctgatggccgcgacgctgaccctacggaggaacagatggcggaaactgagcggaatgatgaagaacaattcgaatgtcaagaactgttggaatgccaggtacaggtgggcgcgcctgaagaggaggaggaggaggaggaggacgcaggtctggtggcagaggcagaggccgttgctgccggatggatgttagacttcctttgtctgagcctctgtagggcttttagggacggcaggtcggaggattttcggcgcacgaggaacagcgcagaggccatcatccatgggttgagcagcctgactgcctgccagctgaggacgatttatatctgtcagttcctaaccagaatagccgctgggaaaaccctcgatgcacagtttgaaaacgatgagagaatcacacctctggagtcagctcttatgatttggggtagcatagaaaaggaacatgacaagttgcatgaagaaatacaaaacttgattaaaatccaggcaattgccgtttgtatggagaatgggaacttcaaggaagcggaggaagtctttgagagaatatttggggacccaaacagccacatgccgtttaaatcaaagctgctgatgattattagtcagaaggacacttttcacagtttctttcagcacttttcatacaaccacatgatggagaagatcaagagctacgtaaactatgtcctttcagagaagtcatctacctttctcatgaaggcggcagctaaagtcgtggaaagcaaacgaacgcgtaccatcacaagccaggataaaccctccggcaacgatgttgagatggaaaccgaggccaacttggacactagaaaatcggtgagcgacaaacaaagcgccgtgaccgagagcagtgagggtaccgtgagtttattgcgatctcacaagaacctatttctgagtaagttgcaacatggtacacagcagcaggatctcaataagaaggagcgccgggttggaactcctcagtcaaccaaaaaaaagaaagagtctcgtagggctactgaatcacgtatacctgtctccaaatcccaacctgttactcctgagaaacaccgcgccagaaagcggcaggcgtggctctgggaagaagataaaaatctcagatcaggagtcagaaaatatggtgaaggcaattggtccaaaatcctccttcactacaagtttaataaccgcaccagtgtgatgcttaaagatcgatggcgaacaatgaaaaagctgaaactaataagctctgatagtgaagactag

SEQ ID NO: 26582 - DNA, 153 bp, Artificial Sequence
  Description of Artificial Sequence: Synthetic coding sequence
atcttcagcatcatccacggcctgagcagcctgaccgcctgccagctccgaaccatatatatatgtcagttcctcactaggattgcggccggtaagaccctcgatgcccaattcgaaaacgatgagcggatcacccccttggaaagcgcgtag

SEQ ID NO: 26583 - DNA, 1503 bp, Artificial Sequence
  Description of Artificial Sequence: Synthetic coding sequence
atggccggcggcggcggcagcagcgacggcagcggccgggccgccggccgccgggcatctcgttcatccggtcgggcccgccgcggcagacacgagcccggcctcggaggccctgcagagcggggcgcaggcgaggcccggttagaggaagctgttaatcgatgggttctgaaattttacttccatgaggccctgagagcgttccgaggaagcaggtacggcgactttcggcagatcagggatatcatgcaggccttgctcgtacggccgctgggtaaagagcatacggtgtctagactgcttagggtcatgcaatgtctgagccggatcgaagagggcgagaacctcgattgtagtttcgatatggaggccgaacttacccctctggaatctgccataaacgttctggaaatgattaaaaccgagttcaccctgactgaagccgtagtagagtcttccaggaagctggttaaggaggctgccgtaataatttgtataaagaataaagaatttgagaaagccagtaagatacttaaaaagcacatgtcaaaggatcctacaacacaaaagctccgaaacgatttattgaacatcatcagggagaagaatctcgctcaccctgttattcaaaacttctcgtatgagactttccagcagaaaatgctgcgattcctggagagccacctggatgatgctgaaccctacctcctgactatggctaagaaggcgcttaaaagtgagtccgcagcctcctcaactggtaaggaggataagcagccggcacccggaccagtggaaaagccaccaagggaaccagccagacagctccgcaatccccccaccacaatcggaatgatgacgttgaaagccgcattcaagaccctcagtggtgcacaggactccgaagccgcattcgctaagctagatcagaaggatctcgtgctgccgacccaggcccttcctgccagccccgccttgaaaaacaagcgcccgcgaaaggatgagaacgagagcagtgccccagccgacggagagggcggatccgagctccagccaaagaacaagagaatgaccatctctagacttgtgctggaggaggattcacagtcaacagaacccagcgccgggttaaacagctcccaagaagcagcctctgccccaccctctaaaccaaccgtgctgaaccagccactgccaggagagaagaatcctaaggtacctaagggcaaatggaattccagtaatggggtcgaagagaaggagacttgggtagaagaagacgaactgtttcaggtgcaggcagctcctgatgaagactctaccacaaacatcaccaaaaagcagaagtggaccgtggaggaatctgagtgggtcaaagccggtgtgcagaagtacggcgagggtaattgggcggcaatctccaaaaattatccctttgttaacaggacagctgtcatgattaaagatcggtggcgcaccatgaagcgtctaggaatgaactag

SEQ ID NO: 26584 - DNA, 1200 bp, Artificial Sequence
  Description of Artificial Sequence: Synthetic coding sequence
atggccgaggccatggacctgggcaaggaccccaacggccccacccactcaagtaccctcttcgtccgcgacgacgggtctagcatgtccttctacgtcagaccatcgccagccaagagacgcctcagtactttgatacttcacgggggaggcacggtctgtagggtgcaggagccaggcgcggtgctgctggctcaaccgggagaagccttggcggaagcctcaggagactttatttccacccagtatatactggactgtgtagaacgaaatgagcgcttggaactggaggcttataggttagggcctgctagcgccgccgataccggatctgaggctaaacccggcgccctcgccgagggagctgccgagcccgaaccccagcggcatgcggggcggattgcctttacggatgccgacgacgtggccattcttacctatgtgaaggaaaatgctcgctcaccttcatctgtaaccggcaacgccctctggaaagccatggaaaaaagttccctgacccaacactcttggcaatcgctgaaagatcgttaccttaaacacctgcgcgggcaggaacacaagtacctgctcggggatgctcccgtaagtccgtcaagtcagaaactgaaacggaaggcggaggaggatcctgaggctgcggacagcggagagccacagaacaagcgcaccccggacctccccgaagaggagtacgttaaagaagagatacaagaaaatgaagaggccgtgaaaaaaatgcttgtcgaagcaacacgcgaattcgaagaggtcgtcgttgacgagtcgccaccagactttgagatacatattactatgtgcgacgacgaccctccaactccagaggaggacagtgagacgcagcctgatgaagaggaggaggaagaggaagaaaaggtgagtcagccagaagttggagcggcaataaagattattcggcagctcatggagaagttcaacctggaccttagcacagttacacaagcctttttgaagaattctggcgagctcgaagcgactagtgcctttctagccagtgggcagagggccgacggctatcctatttggagtcgtcaagacgacatcgatctccaaaaggacgacgaggatacccgggaagccctggtaaagaaatttggagcgcagaacgtagcaagacgcattgaattcaggaaaaagtag

SEQ ID NO: 26585 - DNA, 12735 bp, Artificial Sequence
  Description of Artificial Sequence: Synthetic coding sequence
atgatgcccgcccagtacgccctgaccagcagcctggtgctgctggtgctcctttctacagcccgcgcaggccccttttccagccgcagcaatgtgactctgccagctcccagacctccccctcaaccaggaggacataccgttggggcaggggtcggctcccccagttcgcagttgtatgaacacaccgtggagggtggagagaagcaggtggtcttcactcacagaattaacctgccacctagcaccgggtgcggttgcccaccgggtacggagcctcctgtcctcgcgagtgaggtgcaagccctacgtgtgagattagagatccttgaggaactcgtcaagggcctgaaagagcagtgcacaggcggctgttgcccagcttctgcgcaggccggaaccggccagacagatgtgcggactctctgcagcctgcatggcgtgttcgacctatcaagatgcacctgctcttgcgaaccaggctggggtggacctacatgttcagaccctactgatgcagaaatccccccaagttctccaccttccgcgtcaggtagctgtcccgacgactgcaacgaccagggcagatgcgtgcgcggtaggtgtgtgtgtttccccgggtatacgggtccttcatgtgggtggccatcgtgccccggggattgtcagggacggggtcgttgcgtccagggtgtctgtgtgtgcagggcggggttttccgggcccgattgcagccagcggtcatgccccaggggatgtagccagaggggccgatgtgaaggcgggcgatgtgtttgcgatcctggctacaccggggatgactgtggtatgcggtcttgccccaggggctgtagccaaagaggcaggtgtgagaatggaagatgcgtgtgtaatcctggatacactggagaggattgtggcgtacggtcttgtccccgcggctgcagccagcgcgggcggtgcaaggatggcaggtgcgtatgtgaccctgggtacacaggcgaagactgtggcacccgatcatgtccgtgggattgtggcgagggcgggcgatgtgtggacgggcgatgcgtttgctggcccggttacacaggcgaggattgtagcacccgcacttgtcctcgcgactgtaggggtagggggagatgtgaagatggtgaatgcatttgcgatactggctactctggagatgattgcggcgtgcggtcctgccctggcgattgtaatcagaggggcagatgcgaggacggcaggtgtgtgtgttggcctggttatactggaactgattgtggctcaagagcgtgtcctagggattgtagaggtcggggtagatgcgagaatggggtatgcgtttgcaacgcaggatactcgggggaagactgtggcgttagaagctgtcctggcgactgcaggggccggggtcggtgtgaatctggacggtgtatgtgctggccaggatacaccggacgggactgtgggactagagcctgccccggggactgccgcggccgtggaaggtgtgtggatggacggtgcgtgtgcaatccaggcttcactggggaagactgcggaagccggcgttgccctggggactgccgaggtcatgggttgtgcgaggatggcgtttgcgtttgtgacgccggctattcaggggaggattgtagtacacggtcttgccctggtggatgtcgaggcaggggtcaatgtctcgacggtcggtgcgtttgtgaggacgggtactcgggcgaagattgtggtgtgcggcagtgccccaatgactgctcgcagcatggagtgtgtcaggacggcgtgtgtatttgttgggaaggatacgtttccgaggactgttcaatcagaacgtgtccaagtaactgtcatgggaggggtaggtgtgaggaaggcaggtgtctctgcgacccagggtacactgggcctacatgcgcgacccgaatgtgccccgcagactgcagagggcggggtcgatgtgtccaaggcgtgtgtttatgccacgtgggatatggaggagaggattgcggccaggaagagccgcctgctagtgcatgcccaggcggctgcggacctcgagaattgtgcagagcaggccaatgcgtttgcgtcgaaggatttcgcggacccgactgcgccattcaaacctgtccgggcgattgtcgaggccgaggtgaatgtcacgatggcagctgtgtctgtaaagatgggtacgccggggaagattgcggcgaagaggttccaaccatcgagggcatgaggatgcatctgctggaagaaaccacagtacgcacagagtggacacctgcccccggcccggtcgatgcttacgagatccagttcattccaaccacagagggtgcttctccaccattcacagcgagagtaccctcctctgcatccgcctatgatcagcggggcctggctcccggacaggaatatcaggtaacagtcagagctctcaggggcacctcttgggggctacctgctagcaaaactatcaccaccatgatcgacggtccgcaggatctcagagttgttgcagtgactcctactacgctagagctggggtggctgcgcccgcaggccgaagtggacagattcgtggtgtcttacgtgtcagcaggcaaccagagggtgcgattagaggtgccacccgaagctgatggcaccctgctgacggatctgatgcccggcgtggagtacgtggtgacagtcaccgccgaacgggggagggcagtttcttatcccgccagcgtgcgtgcgaacacgggcagcagccccctcggactgctcggcactacagacgaacctcctccatccggtccctccactacacaaggggcacaggcaccgttactccaacagaggcctcaggagctcggcgaactgagggttttggggcgcgatgaaaccggtcgtctgcgcgtggtttggaccgcccagcccgacactttcgcatattttcagctgcgcatgagagtccctgagggccccggcgcccatgaagaagtgctgcccggagatgttcgtcaggctctagtgcccccccctccccccggcacaccctacgaactgtcgctacacggagttcccccaggggggaagccatctgacccgatcatttatcagggtataatggataaggacgaagaaaagccgggcaaatcaagcggacctccccggctaggcgagttgaccgtgacagataggacctccgattctttactcttgagatggacagtgccagaaggtgaatttgatagcttcgtgatacaatacaaggacagggacggccagcctcaggtggtgccggtcgagggcccccaacggagcgcggtgatcactagtttggaccccggcaggaagtacaaatttgttttgtacggtttcgtcggaaaaaagcggcacggcccactggtagccgaggccaagattctcccacagagcgacccatcaccagggactcctccccaccttggaaatctgtgggtgaccgatccaacaccagatagccttcacctctcctggaccgtgcccgagggtcagttcgatacctttatggtgcaataccgggacagagatggacgcccacaggtggtcccggtggaggggcccgaacgcagtttcgtggtttcaagtctggatcctgaccacaagtatcgatttaccctctttgggatagctaataagaaacgctatggcccacttactgctgatggcaccacagctcccgagcggaaggaagaacccccgcgccctgagttcctggagcagccccttctgggcgagttgaccgtcactggcgtgactccagattctctgcgtctcagttggacagttgcacagggccccttcgattcctttatggttcagtataaggacgcccaaggccagccccaagccgtgccggtagccggcgacgaaaatgaggttacagtgcccgggcttgatcccgatagaaagtataagatgaacttgtatggacttcgcgggcggcagagagtgggcccagaaagtgtagtagcgaagacagctcctcaggaggacgtggatgagacgccgtctcctactgagctggggacagaggcaccggagtctcccgaggaacctctcttgggtgagctgaccgtcaccgggtcctccccggacagtctatccttattctggacggtgccccagggatcttttgacagcttcacagtgcaatataaagaccgagatgggaggccgcgtgccgtgcgggttggaggcaaggaatccgaagttaccgttggggggctggagcctggacacaagtataagatgcacctgtatggcctgcacgagggtcaaagggtggggccagtttctgccgttggagtgacagcaccccagcaggaggagacacctcccgcaactgaatcaccactggaaccacggctcggtgagctgacggtcacagacgtaacccctaactccgttggattatcctggacagtacccgaaggacagttcgacagcttcattgtccagtacaaggataaagacgggcaacctcaggtagtccccgtagccgcggatcagcgggaagtgactgtgtacaacctggaaccagaaaggaagtataaaatgaatatgtacggattgcacgatggacagcgcatgggtcccctgtcggtagtaattgtgactgccccactccctcctgctcccgccaccgaagcttctaaaccgcctttggaacccagactaggcgaattgaccgttactgacatcacaccagattcggttggattgtcttggaccgtgccagagggagaatttgatagtttcgtagtgcagtacaaggaccgcgacggccaaccacaggtggtgccagtcgccgctgatcagcgcgaggtgaccatccccgacctggaaccgtctagaaaatacaagtttctcctctttgggattcaggatggcaagcgtagaagcccagtgtccgtggaggcaaaaacagttgccagaggggacgcctcacccggggccccacctcggttgggtgaactctgggtcactgaccctacacccgattcgctgaggctgtcctggacagttccggaagggcagttcgattctttcgtggtccagtttaaggataaagacggccctcaggttgtcccggttgagggacacgaaaggtcagttactgttaccccactcgatgcaggcagaaagtatcgattcctcctgtacggactgctcgggaagaaacgacatggccccttgaccgccgacggcacaactgaggcaaggtccgccatggatgacaccggtactaaaaggcctccgaagccgcgtcttggcgaagagctgcaggtgaccactgtgacacagaactctgtcgggctgtcctggacggtgcctgaggggcaattcgatagttttgttgtgcaatataaggaccgggacggccagcctcaggttgtaccggtagagggaagcctacgtgaggtttcagtgcccggcctggaccccgctcatcggtacaagctcctgttgtacggtttgcaccatggaaagcgcgtgggaccgatctccgcagtggcaattaccgcgggccgggaagagaccgagacggaaacgacagctccaacgccacccgctcctgaaccccacctgggtgaactcaccgtagaagaagccactagccacaccttacatctgtcttggatggtcaccgagggggagttcgatagtttcgagattcagtatacggaccgcgacggtcagctgcagatggtacgaattggtggtgaccgcaatgacatcacactgtccgggctggagagcgaccacaggtatttagtgaccctgtacgggttctctgatggcaagcacgttggccccgttcacgtagaggccctcaccgtgcccgaggaagagaagccctctgaaccccctacagctacgccggagccaccaattaagcccagactgggggaattgaccgtgaccgacgccactccggacagcctctctctgtcttggaccgtcccggagggacagtttgaccatttcctggtgcagtacaggaacggtgacggtcagcctaaagccgtgagagtacccggccacgaggagggcgtgactatcagcggtctggagcccgaccacaagtataaaatgaacttgtatgggttccacggcggtcagagaatggggcctgtcagtgtggtcggtgtaactgctgcagaggaagaaacaccaagccctacagaacctagcatggaggctccggagcccgctgaggagcctctgctcggggagcttacggtgactggtagttcccctgattccctgtctctgtcatggaccgtacctcaggggagattcgattcattcactgtgcaatacaaggatagggatggtaggccgcaggtcgtgagagttggcggcgaagaaagtgaggttacagttgggggacttgaaccaggccgcaagtataaaatgcacttgtacgggctgcacgaaggacgtagggtcggcccagtgagtgccgtgggggttaccgcgcccgaggaagagagccccgacgctcctctggctaagcttcggctcggacagatgacagtccgagatattactagcgacagtctatcactgtcttggaccgtgccagaaggccagttcgatcactttctggtacagttcaagaatggcgatgggcaacccaaagcggttcgggtgcctgggcatgaggatggggttactatatcaggactggaacctgaccacaagtacaagatgaatctgtacgggttccacgggggccaacgggtgggcccagttagcgccgtgggcttaaccgcccccggcaaggatgaggaaatggcgcccgcctccactgagcctcctaccccagagcctcccattaagccccggctcgaggagctgaccgtaacagacgctactccggattccctgtctttgtcctggacagttcccgagggccagttcgaccatttcttggttcagtacaaaaacggcgatggacagccaaaggccactcgcgtcccaggacatgaggacagagttactatttcgggactcgaacccgacaacaaatataagatgaacctttacggctttcatggtggacaacgggttggtccagtgtccgccattggggtcacggctgcagaagaggagaccccttccccaaccgagcccagtatggaagccccagagcctccagaggaaccccttctgggagagttgactgtgaccggatctagcccagactcactgtccctgtcctggaccgtaccccaagggcggttcgattcattcaccgtgcagtataaagacagagacggaaggccgcaagtggtgcgcgtgggtggagaagagtctgaagtcaccgtgggtggactggagccgggccgcaagtataaaatgcatctatatggacttcatgagggcaggcgagtgggacctgtgtctacagtcggagtgacagcccctcaggaagacgtagatgagaccccctctccgactgagcccggaacagaagcacccgggcctccggaagaaccacttctgggcgaactcaccgtgacagggtcctcaccggactcacttagcctgagttggacagtgccgcaagggcgatttgattcctttacagtacagtataaagatagggacgggcgcccccaggcagttagggtgggagggcaggagtccaaagtaacggtacgcgggctggaacccggcaggaaatacaaaatgcacttatacggcttgcatgaagggcggcgtttaggacccgtctcagctgtcggcgtgaccgaggacgaggctgagacgacccaggccgtgcccactatgacgccggaaccccccattaaaccacggctgggggaactcacgatgacagacgccacacccgattccctgtcgttgtcttggactgtaccggaaggacaatttgaccatttcctggtgcaatataggaacggagatggacagccaaaggcggtccgagtgcctggccatgaggatggtgttacgatctccgggctcgagcctgatcataagtataaaatgaatctgtacggtttccatggtgggcagcgcgtcgggcctataagcgtgatcggtgtgaccgccgccgaggaagagactcctagtcctaccgaactgtccaccgaggcgccagagcctcctgaagaaccactactgggcgagcttaccgtaacagggtcatcaccagattcactctcactttcttggactatccctcaggggcacttcgattctttcacggtgcagtacaaggacagggacgggcgtccacaagttatgcgagtccgtggagaggaaagtgaagttactgtgggaggactggaacctggcagaaagtataaaatgcacctgtacggcctgcatgagggtagacgagttggacctgtgagtacagtgggtgttacagcaccggaagacgaggccgagaccacgcaggcggttccaacaaccacgccagagcctccgaataagcctcgactgggagagctgactgtgacagatgcgactccagacagtctctctctgagttggatggtgcccgaggggcaattcgaccactttctggtccagtacaggaatggggacggccagcccaaagtggtgcgtgtgcctggtcacgaggacggagtcacgatctcagggctggaaccagaccataagtataagatgaacctttatggattccatgggggccagcgcgtcgggcctatcagcgtaatcggtgtgactgctgcggaggaggagacccccgcccccacggagccctctaccgaagctcctgagccccccgaggagcctctgctcggcgaacttactgtgacagggagcagtcccgactcactgtctctgtcgtggacaattccacagggcaggttcgactcattcacagtgcaatacaaggatcgggacgggcgccctcaagtggtcagagtccgaggggaagaatcagaggtcaccgtgggcggactggagcctgggtgtaagtataaaatgcacctgtatggactgcatgagggacaacgggtgggaccagtttcagcagtcggcgtgaccgccccaaaggatgaggctgaaaccactcaggccgtgccgaccatgactcccgaaccgcccattaagcccaggctgggggaactgacagtaaccgacgctaccccagatagcctctcactgagctggatggtccccgaaggacagtttgaccactttctggtacagtatcgcaacggagatggacagccaaaggcagtgagagttccgggccatgaagacggcgtgaccatctcaggcctggagcccgaccacaagtacaagatgaacctgtatggatttcacggggggcagagagtggggcccgtttcggctattggagtgactgaagaggaaactccctccccaaccgaaccttccacagaagcccccgaagcccctgaagaacccttgctcggagaactgaccgtcaccgggtcctctccagactcactgtccctttcgtggaccgtaccacagggtcggttcgatagtttcacagtacagtacaaagatcgggatgggcagcctcaggtcgtgcgggtgaggggcgaggagtcggaggtgacagtggggggactcgaacccgggcggaaatacaaaatgcacctctacggcctccatgagggccagcgtgtgggtccggtctcgacggtgggcatcaccgccccattgccaacacctctccctgtcgaaccaaggctgggcgagctggcagtggccgcagtgacaagcgatagcgtaggactgtcttggactgtagctcagggtcctttcgattcatttctggtccagtacagggatgcacaagggcagccgcaggctgtgcccgtcagcggcgatctgagagccgtggccgtgagtggcctggatcctgcccgtaagtataagttcttattattcggcctacagaacggtaagcgccatggtcccgttcctgttgaggccagaacagcgccggacaccaagcctagccctcgcctgggagagctgaccgttaccgatgcaactccggactctgtcggcctgtcctggaccgttccggaaggcgaattcgacagctttgttgtacagtacaaagataaggacggccggctgcaggtggtgccagtagctgctaaccagagggaggtgaccgtacagggccttgagccttcgagaaagtacagatttctgttatacggcttgagcggcagaaaacgcttgggccctatctctgcggactccacgactgctcctctagagaaggagctgcctccccatttgggcgaattgaccgttgccgaagaaacttcctctagcctgcgtctgtcatggactgttgctcaagggccctttgatagcttcgtcgtgcagtacagggacaccgatgggcagccgagggccgtacctgttgcggccgatcagcgaaccgttactgtcgaggacctggaaccaggcaaaaagtacaagttcttgctctatgggctattaggaggcaagagactaggtcctgtgtctgcgttaggcatgacggctccagaggaggacactcccgccccggagctggcgcctgaagcccctgagccccccgaagagcctcgccttggtgtactcaccgtcactgatacaacacccgactctatgagactgtcttggtcagtggcccagggcccatttgacagtttcgtagtgcaatacgaggacaccaacggacagccccaggccttactggtggacggggaccagagcaagatcctgatctctggactcgagcctagcacaccctataggttcctgttgtacgggttgcatgagggcaagcgcctcggtccactgtcagcagaaggtacgacggggctggctccagcaggtcagacatcggaggaaagtcgtccacggctttcacaactttcagtgacagacgtaaccactagtagcctccggctgaactgggaggcccccccgggcgccttcgattcctttctactcaggtttggagttccctccccatccactctcgagccacaccctcggccgctcctgcagcgtgagttgatggtgccaggtacgagacactccgctgtgctgagggatctcagatctgggacactatattcattgacattatacggactcagagggccacacaaagcagacagtatccaaggaaccgctaggacactatcccctgtgcttgaaagtcccagagacctgcagttctctgaaattagggagacatctgctaaggtgaactggatgccccctccaagccgggccgacagtttcaaggtttcataccagttggctgacggcggcgagccccagtctgtccaagtggacggccaggcccgcactcagaagctgcagggtctcataccaggcgcaagatacgaagtgacagtcgtatccgtgaggggctttgaagagtctgaaccattgacaggatttctcactaccgtccccgacgggccaactcagctgagggcacttaatctgaccgaagggttcgccgtcctgcactggaaacccccacagaatccggttgatacctacgacgtgcaggtgacagccccaggggcacctccccttcaggcggaaacaccaggtagcgccgtggactatccattgcacgaccttgtgctgcacacaaattacactgctacagtcagaggcctccggggacctaacctgactagccccgccagtatcacattcactaccggcctcgaggcacctcgagaccttgaggctaaggaggtcacgccgaggacggcactcttgacgtggactgagccccccgtccgacctgctggttatttattatcattccataccccagggggccagaaccaggagatccttttgcctggaggaataacatctcatcagctattaggactcttcccctcaacttcatataacgcaaggctgcaggcgatgtggggtcaatcgcttctgccacccgtgtcaacaagttttacaactggcggcctcaggatcccctttcccagggactgcggtgaggagatgcagaacggggctggtgcgtcgcggacatccactatttttctgaatggcaaccgggaacgcccactcaatgtgttctgcgacatggaaaccgatggggggggctggcttgtgttccagcgccgcatggatggccagactgatttttggcgcgattgggaggactatgcacatgggttcggtaatattagtggcgagttttggttagggaatgaggcactgcattcactgactcaggccggagactacagtatgagagttgacctgcgcgccggcgatgaggccgtgttcgcccaatacgatagctttcacgtggacagcgcagccgagtattaccgactccatcttgaaggttatcacggaactgcaggggacagcatgtcctatcatagcggctcggtattcagcgcccgcgatagggatccaaactctctactcattagctgcgcagtgtcttacaggggggcgtggtggtaccgcaactgtcactacgccaaccttaacggcctttatggttccaccgtcgaccaccagggagttagctggtatcattggaagggattcgagttctccgtaccatttacagaaatgaagctgagaccaagaaatttccgatctcctgccggcggcggttag

SEQ ID NO: 26586 - DNA, 12729 bp, Artificial Sequence
  Description of Artificial Sequence: Synthetic coding sequence
atgatgcccgcccagtacgccctgaccagcagcctggtgctgctggtgttgctgtccaccgccagggcaggaccattttcttcacgcagcaacgtgacccttccggccccacggccgcccccccaacctggaggtcacaccgtcggagcgggggtaggctctccttcctcccagctatacgagcacaccgtggagggcggcgaaaagcaggtcgttttcacccaccgtataaatctgcccccatccacgggctgtggctgtcctcccggcaccgagccacctgtactagctagcgaggtgcaggcattgagggtgaggctggaaatccttgaagaactcgtgaaggggttgaaggagcaatgcaccggtggctgttgccctgcgagcgcccaggcaggaacgggccagaccgacgtgaggaccctgtgcagcctgcacggagtgttcgacctttcccgctgcacatgttcctgtgagccaggctggggcggaccaacatgttctgatcccacagacgcagagatcccaccaagtagccctccatctgcctccgggtcttgcccagatgattgtaacgatcaggggcgctgtgtgagggggagatgcgtttgttttccgggatacactgggcccagctgcggatggccttcttgccccggggactgccagggccggggtcggtgcgtacagggcgtctgcgtgtgtcgggccggcttctcagggccagactgcagtcaaaggagctgtcctcgcggctgttctcaaagaggaaggtgcgagggggggcgatgcgtatgtgatcctggttataccggcgatgattgtggcatgcgcagttgccctagaggttgctctcaaagaggccggtgcgaaaatggcagatgtgtatgcaaccctggctataccggagaggattgcggggtcaggtcgtgccctaggggatgcagccagcgtggcagatgtaaagatgggaggtgcgtctgcgaccccggctatacaggcgaggactgcgggacccggtcatgcccttgggattgcggcgaggggggtcgctgtgtggatggtcgttgtgtgtgctggccaggatacaccggtgaggattgctcaacgcgaacctgcccgagggactgtagaggccggggccgctgtgaagatggcgagtgtatttgcgacacaggttattcgggagacgattgcggggttcgatcttgccccggagattgtaaccagcgcgggcgctgtgaggacgggagatgcgtgtgctggcccggctatactgggacggactgcgggagcagagcatgtccgcgggactgtagaggaaggggccgctgcgagaacggagtctgcgtgtgcaacgctggctactctggagaagactgcggcgtgagaagctgtccaggggactgtcgcggaagaggacgatgtgagtccgggcgatgcatgtgttggccaggctatactggtcgagattgtggtactcgcgcctgtccaggtgattgcagaggtaggggacgctgtgtggatggaaggtgcgtatgtaacccaggtttcacaggagaggattgcgggtcgcgccggtgccccggcgattgtagagggcacggcctgtgtgaagatggggtgtgtgtctgcgacgctggatactctggtgaggactgcagcacacgctcttgcccagggggttgtaggggaagaggccaatgcctcgacggccgatgcgtctgcgaggacggctactctggagaagattgtggcgttcggcaatgccccaacgattgtagccaacatggcgtttgccaagacggcgtgtgtatctgttgggagggttatgtcagtgaggactgcagcatccgtacgtgccctagtaactgtcatggacgggggcgctgcgaggaagggcggtgcctatgtgatccaggctatactgggcctacttgtgccacgagaatgtgtcccgctgattgtcggggccgcggccgctgcgtccaaggcgtgtgtctgtgccatgtcggctatggaggtgaggactgtggtcaggaagaacccccagccagcgcatgtccaggtggatgtggcccaagggagctgtgccgtgctggccagtgcgtgtgcgttgagggattccggggcccagactgtgccattcagacatgccctggagactgtagggggagaggcgagtgccacgatggcagctgcgtgtgtaaggatggatacgccggtgaggattgcggagaggaggtccctactatcgaaggcatgcgtatgcacttactggaggagaccactgtgagaacagagtggaccccagccccaggccctgtcgacgcatatgaaatccagtttattccaactacagaaggcgcttctcccccattcacggccagggttccaagtagcgcctctgcctatgatcaaaggggacttgcacccgggcaagaatatcaggtgaccgtgagagctctaagaggaacgtcctggggtctccccgcttccaagaccatcaccaccatgattgacggtcctcaggacctgcgcgtggtggcagtgaccccgactaccctggagctgggctggctgcgaccccaagctgaagtggatagatttgtcgtgtcgtatgtgtccgccggcaatcaacgggttcgactggaagtccctcccgaagccgatgggacccttctaactgaccttatgccaggggtcgagtacgtggttacagtaacggccgaacgtggacgagccgtctcatacccagctagtgttcgagcaaatacaggctccagtcccctcggtctgctggggactactgacgaaccacctccctctggacccagtacgacgcaaggcgctcaggctcccttactgcagcaaaggccacaagaactaggggaacttagagtcttaggaagagatgagactggccgcctgcgcgtagtgtggactgcacaaccagacaccttcgcttacttccagcttcggatgagagtgccggaggggccgggcgcccacgaggaagtcctgccgggcgacgtacgccaggccctggtgcctcccccaccgccaggtaccccatatgagttgtccctgcatggcgtcccaccgggggggaagccctctgacccgatcatttaccaggggattatggacaaagatgaagagaagccaggcaaatcctcaggtcccccccgcctcggcgaactgaccgtcaccgaccgcacgtccgatagcctactactcaggtggaccgtcccagaaggcgagtttgactcctttgttatacagtataaggatagagacggccaaccccaggtagtacccgttgaggggcctcaacgcagtgccgtcatcacctctctggacccgggtagaaagtacaaattcgtgctatacggttttgtcgggaagaaacgacacggacctctggttgcggaagctaagattctgccccaatccgaccctagcccaggcacacctcctcacctcggcaatctctgggtgaccgacccaacacctgactctttgcacctgtcatggactgtccccgagggtcagtttgatacattcatggtgcagtaccgtgacagagatggccgcccccaagttgtaccggtcgaggggccagagagaagcttcgtagtatctagtctggatccagatcacaagtacaggttcaccttatttggcattgccaataagaaacggtacggcccccttaccgctgacggaaccactgcccctgaacggaaagaggagccccctcggccagagtttctcgaacaaccgctgttgggggaactgaccgtaacgggggtgacaccagatagccttagactgagttggacagtggcccagggcccattcgattcgtttatggttcaatacaaagacgctcaaggacagcctcaagccgtgcccgtagctggagacgaaaacgaggtcaccgtcccggggctggatccagaccgaaagtataaaatgaacctttacgggctgagagggcgccagcgggtcggccctgaaagcgtggtggcgaaaacagccccccaggaagatgtagatgaaactcccagccctactgaattagggaccgaggcacctgagtctcccgaggaaccacttcttggagagcttacggtcacagggtcttctcctgactcattatcccttttctggacggtgccacagggatcttttgacagtttcaccgtgcagtacaaagaccgggacgggcgtccaagagccgtcagggtcggggggaaggaatcagaggtgactgtgggcggcctggagcctggccacaagtacaaaatgcacctgtacggcttgcacgagggccaaagagtgggacctgtatccgcggtaggagtgacagcccctcagcaggaagaaacccccccagctacagagtcccctctggaaccccgtctcggagaactaaccgtgaccgatgttacccctaatagcgtggggctttcttggacagttccagagggacagtttgacagctttattgtgcaatacaaggataaggacggccaaccacaggtcgtgcccgttgccgccgatcagcgggaagttaccgtgtacaacttagaaccagaacggaaatacaaaatgaacatgtacgggctgcacgatgggcagagaatgggccctctttcagtcgtgatcgttacagcgcctctacctcctgctccagccactgaagcttccaagccccccctcgaacctcgactgggggaactgacagtgaccgacattactcctgattccgtgggactatcttggaccgtgccggaaggtgaattcgacagcttcgtcgtccagtataaggaccgcgatggccagccacaggtggtccctgtggctgccgatcaacgggaagtgactatcccggacctggaaccctcacgtaagtataaattcctcctgtttggcatccaagacggtaagcgacgaagccccgtcagtgtggaggcaaagaccgtggctcgcggcgatgcatcgccaggggcccccccaagactcggcgagctgtgggtaacagatccgaccccggactccttacggttgagttggaccgttcctgaaggccagtttgactcctttgtcgtgcagttcaaggataaagacggaccacaggtcgttcctgtggagggacacgagagaagtgtgactgttactccactggatgctggtcgcaaataccggttcttgctgtacggtttgctgggtaagaaaagacacggcccactgacggcagatgggacgaccgaggcaagatcggctatggacgacactggcactaaacggccacccaaaccaagacttggagaagaattacaggtaacaacagtaacccagaactcagttggcctgtcttggacagttccagaagggcagttcgattcattcgtcgttcagtataaggatcgtgacgggcagcctcaggtagttcccgtggaaggaagcctgcgtgaagtctctgtgcccggcctggatccggcccaccgatataagctgctgctgtacgggttacatcacggaaaacgggtgggccccatcagcgctgtggctattaccgccggcagggaggaaacagagactgagacgacggcaccaacccctccggctcccgagccccacctgggggagctgaccgtagaagaagctacgtctcacactctgcatctgtcctggatggtcaccgagggcgaattcgattcttttgaaattcagtataccgatagagatgggcagctgcagatggtgcgcattgggggagacaggaatgacattaccctctctgggttagagtccgaccaccgatatctggtgaccctgtacggcttttctgatggaaaacacgtggggccagtccatgtcgaagcactcaccgtgcccgaagaggaaaagccgtcagagcctcctacagcaaccccagaaccgccaatcaaacctaggctcggggaactcaccgtaaccgatgctaccccggatagcctgtcgttgagttggacagttcccgagggtcagttcgaccacttcctagtccagtaccgaaatggagacgggcagcccaaggcagttagggtaccaggtcacgaggagggcgtgacaatttctgggctcgagccagatcataagtacaagatgaatttatatgggtttcatggaggtcagagaatgggccccgtaagcgtggtgggggtcactgcagctgaggaggagaccccatccccaaccgaacctagcatggaagcccccgagccagctgaggagcccctcctcggcgaattaaccgtcacaggctccagcccagactccttaagcctaagctggaccgtaccccaggggcgttttgatagtttcacagtccagtacaaagatcgggatggccgcccccaggtagttcgcgtcggtggtgaggagtcagaagtgaccgtaggcggcctggagcccgggaggaagtacaagatgcatctttacggactccacgagggtcgaagagtcgggcccgtgagcgcagtgggcgtgaccgcccctgaagaagaaagccctgatgcccctcttgcgaaactgcgcctgggccaaatgacagtgcgcgatatcactagcgactctctcagtctgtcttggactgtacccgagggccagtttgaccatttcctggtgcagttcaagaacggggatggccaacctaaggcagtcagggtgccagggcatgaagacggggtcacaatatcaggattagagccagaccacaaatataagatgaacctgtacgggttccatggcggtcagagggtcggcccagtgtccgccgtgggcctaacggctccaggtaaggacgaggagatggctccagcctctacagagccacccactccagagccccccattaagcctcggctcgaggagctgactgttactgatgccactccagactccctgtcattgagctggactgttcctgagggccaatttgaccatttcctcgtgcagtataaaaatggcgacggacagccaaaggccacccgcgttcctgggcacgaggacagagttacaatatctgggctcgagccagataacaaatataagatgaatttgtatggctttcatgggggtcaaagggttgggcccgtttcagctatcggcgttaccgccgccgaagaggagactccatcccccactgagccttcaatggaggctcctgagcctccggaggaaccactgctcggggagctcacggtgaccggttcatcacctgactcactaagcctgtcgtggaccgtgccccagggtcgctttgatagctttacggtgcagtacaaagacagagacggtcgccctcaggttgtgagagtggggggggaagagtccgaagtcacggtaggtgggttagagccaggcaggaaatacaaaatgcacctctacgggttacacgagggcaggagggttggcccagtgtccacagtgggcgtgacggctcctcaggaggatgtggatgagaccccgtcacccactgaacccggcacagaagctcccggaccgccagaggagcctcttctgggagagcttactgtaactggaagtagcccagacagcctatctctttcctggacagtgccacagggccgcttcgatagtttcacagtgcagtacaaagacagggatggaagaccccaggccgtgcgcgtgggcggccaagaaagcaaagttactgtgaggggactggaacccggcagaaagtacaaaatgcacctctatggcctgcacgaggggcgaaggcttggcccggtgtccgccgttggggtcacagaggacgaagctgagacgacccaggccgtacccacaatgactcctgagccaccgatcaagccacgactgggcgaactgacaatgaccgacgcgacaccggactctctgagcctcagttggacggtgcccgagggccagttcgaccacttcttggtgcaataccggaatggcgatggtcagcctaaagcggtgagggtcccaggacacgaggatggcgtgacaattagtggactggaaccagaccataaatacaagatgaacttgtacggctttcatggggggcagcgagtggggccaattagtgttataggcgtgacggcggccgaggaggagacaccatctccaaccgagctgtcaacagaggcaccagagcccccagaagagcctctccttggcgagctgaccgttaccggaagcagccccgactcactgtctttgtcttggacgattccccagggtcacttcgattccttcacggtgcagtacaaagacagagacggccgcccacaagtcatgcgggtccggggagaagaatctgaagtgactgtggggggcctcgaacctgggcggaagtacaagatgcacttatacggcctacatgaaggccgaagagtcggaccagttagtacagtcggggtcacggaggacgaagctgaaactacacaggccgtgcccactactaccccagagccgccgaacaaaccccgtctgggggagctgactgttaccgacgctacacccgattcgttgtctttatcatggatggtccccgagggccagttcgatcatttcctggtgcagtacaggaacggtgacgggcaaccaaaggtggtgagggtccctggccatgaagatggcgtgaccattagcgggcttgaacctgaccataagtataagatgaacctgtatggctttcatggggggcagcgagtcggaccgatatctgtgattggagtgactgcagctgaggaggagactccggcgcccacagagccctcgacggaggcccccgaacccccagaagagcctctactgggcgaactgactgtaacagggtctagccccgacagtctgagcttgtcctggactatcccgcagggtcggttcgacagctttacagttcagtataaagaccgcgacggcagaccccaggtggtgagggttcgcggggaagaatctgaggtgactgttggcggtcttgaacctgggtgtaaatataagatgcacctctacgggctacacgaagggcagcgagtgggtcccgtgtctgcagtcggagttactgcccccaaagatgaagccgaaacaactcaggccgtccccacaatgactcctgaaccaccaataaaacccaggctgggtgagctgactgttaccgacgccacacccgacagtctcagtctgagttggatggttcctgagggacagttcgatcacttcctggttcagtacaggaacggcgatggccagcccaaggccgttcgcgtgccaggccacgaggatggcgtcaccatttccggtctcgagcctgaccataagtataaaatgaacctttatggctttcatgggggacagcgggtcgggccagtttcagccatcggagttactgaggaggaaactccttcccccactgagccgtccaccgaggctcctgaagctcccgaagaacctctgttgggcgagttgacagtcaccggtagttcccccgatagcctcagcctgagctggacggtaccccaaggcagattcgacagctttaccgtccagtacaaagatcgtgatggccagccacaggtagttcgagtgcgaggagaggagagcgaggtcaccgtgggcggactggagcccggtaggaagtacaagatgcatctgtatggactacatgaaggacaacgtgtcggcccagtgagcactgtcggcataaccgcacctcttcctacgccactgcccgtggagcctcgcctgggggaacttgccgtggccgcggttaccagcgacagcgtcggtctgtcttggacagtcgcacagggaccatttgactctttcctggtgcagtacagagacgcacagggccagccacaggccgttcctgtttccggcgacctcagagccgtggcggtgtctggactcgatcccgcacgaaaatataagttcctgctttttggcctgcagaacggaaagaggcatggacctgtccctgttgaggctaggacagcccctgatacaaagccatcgccccggctcggtgaattaaccgtgaccgacgccacccccgacagtgtaggccttagttggactgttccagagggagaattcgactcctttgttgtacaatataaagataaggatggacgcctccaggtagtacccgttgcagctaaccagcgcgaagtcaccgtgcagggcctggaaccatcacgcaagtatcggttccttctgtatgggctaagcgggcgcaaacggctgggccccataagcgctgactctaccaccgcacccctggagaaggagctgccccctcacctgggcgaacttacagtagctgaagagacatccagcagtctaaggttatcctggacggtggcccagggtccctttgattccttcgtagtgcaatatagagacaccgatggccaacccagagctgtgcccgtggctgcggaccagaggactgtgactgtggaagacctcgagcccggaaagaagtataagtttctgctttacgggcttctcggtggtaaaagattgggtcccgtgagcgcactggggatgaccgcacctgaggaggatacccccgcacctgagttagcgcccgaggcccctgagccaccagaggaaccaagactaggggtgctgaccgtcacagatacgaccccagacagcatgcgattgtcatggtcagtagcgcagggtccctttgactcatttgtggtgcaatatgaagacaccaacggtcagccacaggctttgttggtggacggagaccaatctaaaattctcatctccggacttgaacctagtaccccatacagattcttgctctatggactgcacgaagggaagcgactcggacctctgtccgctgaggggaccactggcctggcacccgccggccagacatcagaggagtcacgtcctcggctctcgcagctgagcgtgaccgacgtgactacctcttcacttaggctgaactgggaggcacctcccggcgctttcgatagcttcctgcttcgatttggagtgcctagccctagcaccctcgagcctcaccctcgcccacttctgcagcgcgagctgatggtgccaggaaccagacactctgctgtgttgcgggacctgaggtcaggaactctgtactctctcacactatacggacttcgcggacctcacaaggctgactctattcaaggcaccgcccggacgttgagccccgtcctggagtcaccacgcgatctgcagtttagcgagatccgcgaaactagcgccaaagtcaactggatgcccccccctagtagagcggatagttttaaagttagctaccagctagccgatggaggcgaacctcagtcagttcaggttgacggacaggccaggacccagaaattgcagggtttgataccgggtgcacgctacgaagtaacagtggtttccgttagggggtttgaagaaagtgagcctctcacaggtttcctgacaacagtgcccgacggaccaacccagctgagagccttgaatctgacagaggggttcgcggttctgcattggaaaccccctcagaacccggtggacacctatgacgtgcaagtcacagccccaggcgctccccctctgcaggcagaaacaccaggtagtgcagttgattacccactgcacgatctggtgctgcacaccaactatacagccacggttagaggcctgagggggcctaatcttacaagccccgccagtatcacctttactacagggcttgaggctccacgagacttagaagccaaggaggtgacacccagaacagcactgctcacttggacagaacccccagttcgaccggccggctacctgctgagttttcacaccccaggcggacaaaatcaagaaattttgctgccaggcggcatcacctcacaccagctgctgggactctttccttccacttcatacaacgcccgactccaggctatgtggggccagtctttgctgcctccagtgtctactagtttcaccaccggaggcctccgtatcccttttccacgcgactgcggagaggaaatgcagaacggcgccggtgcttccaggacttccaccatcttccttaatggaaaccgcgagaggccactcaatgtgttttgcgatatggaaacggatggcgggggatggctggtcttccagagacggatggatggccaaaccgacttttggcgagattgggaagactatgcacatggattcgggaatatcagcggcgaattctggctcggcaatgaggccttacactcccttactcaagcgggcgactactcaatgcgggtagatcttagagcaggggacgaggccgtgttcgcccagtatgactcctttcacgttgactcagctgccgaatactaccgcttgcatttggaggggtaccatggaaccgcaggcgatagtatgagctatcatagtggctcagtcttttcagcaagagacagggatccaaattctttgctgatatcatgcgcggtgtcttaccgcggggcctggtggtaccgtaactgccactacgccaacctcaacggtttgtacgggtcaacagtggaccaccagggcgtttcctggtaccattggaaggggtttgagttctccgtgccattcacagagatgaagctgagaccgcgcaatttccgctcacctgctggcggaggctag

SEQ ID NO: 26587 - DNA, 2022 bp, Artificial Sequence
  Description of Artificial Sequence: Synthetic coding sequence
atgcggctgagctggagcgtggcccagggccccttcgacagcttcgtggtgcagtacgaagatacaaatggacagccacaggcactcctcgttgacggagaccagtccaaaatcctcatttcaggactggagccaagtaccccataccgattcctcctttatggtctgcacgaggggaagcgactcgggcctctctctgccgaaggaacgaccggcctggcgcccgccggccaaacaagtgaggagagccgcccccggcttagccagctctctgtcacagacgtgactacgtcatcactgcggctgaactgggaggcgccgcctggcgctttcgattcctttctccttcggttcggcgtcccaagcccttccaccctggagccccatccacgtccccttctgcagcgggaactgatggtgccaggcacccgccatagcgcggtcctcagggaccttcgttctggcacactgtattccttgactctctacgggttgagagggccacataaggccgattctatacaggggacagccagaaccctgtccccagttcttgaaagcccccgggacctgcaatttagtgaaattcgagaaacaagcgccaaggttaactggatgcctcccccgtctagggcagattctttcaaagtgagttatcaactagccgatggcggtgaacctcagagcgtccaagtcgacggccaagccagaacacagaagctgcagggcttaatacccggtgcaaggtatgaagtgaccgttgtatcagtccgtgggttcgaggaatccgaacctctcaccgggttcctgacaaccgtgccagacgggcccacccaactgagagcattgaatctgaccgaaggatttgccgtgctgcattggaaacctcctcagaatcctgtggacacgtacgacgttcaggtgacggccccaggggcccctcccctgcaggccgagacaccaggatctgccgtagactatccccttcacgatttggtgctgcacaccaactacaccgcaacagtccgcggattgcggggccccaacctgacatctcccgcgtccattacatttacaacaggcctggaggcacctagagatcttgaagctaaagaagttaccccacgaacagctctgctgacatggaccgaacctcccgttaggcccgctggatacctgttatcctttcatactccggggggtcagaaccaggagatcctccttccagggggcattacatctcatcaactgctcgggctctttccttcaacatcatacaacgctcgactgcaggctatgtggggtcagagtcttttgcctccagtctcgactagctttactacaggcggactccgtattccgtttccgagggattgcggagaagaaatgcagaacggcgcgggcgcaagtcggacatccaccattttcctgaacggcaaccgggagcggccattgaacgtgttctgcgacatggagacagatggtggcggctggctggtcttccagcgacggatggatggccagactgatttctggcgggattgggaggattacgctcacggtttcggcaatatttccggtgagttctggctgggtaacgaggccctgcactcgcttactcaagccggcgattactcaatgcgcgtcgacctgagggctggggatgaagccgtgtttgctcaatatgacagctttcatgtcgattctgctgctgagtactatagattgcacttggagggctaccacgggacagcgggagactctatgagctaccactccggcagcgtgtttagcgctcgagatagggacccgaattctctgctcatctcttgcgctgtgtcctaccgaggagcctggtggtaccgtaattgccactatgcgaacctcaatggtctttatggctcaacagtggaccatcagggcgtgtcatggtatcattggaaaggttttgagttctcagtgccctttacagagatgaagttgcgcccccgaaatttccgctctccagccggaggtggctag

SEQ ID NO: 26588 - DNA, 954 bp, Artificial Sequence
  Description of Artificial Sequence: Synthetic coding sequence
atggccaagaacccccccgagaactgcgaggactgccacatcctgaatgcagaggcctttaaatcgaagaagatctgtaaatccttgaagatttgcggcttggtgtttggaatcctggccctcacacttatagtactgttttggggctcgaagcacttttggcccgaagtcccgaaaaaggcctatgatatggaacacaccttctatagcaatggcgaaaaaaaaaagatatatatggaaattgatcctgtgactaggaccgagatctttagaagtggtaacggcacggatgaaacactggaggtgcacgattttaagaacggatacaccgggatctatttcgttggcctccagaaatgtttcattaaaacgcagattaaagttatccctgaattttcggaaccggaggaggagatcgacgaaaacgaggagatcaccaccacgttcttcgagcagagcgttatatgggtgcccgcagagaaaccaatcgagaaccgcgatttcctgaaaaacagcaagatcctggagatctgcgataacgttaccatgtactggatcaatccgaccctcataagtgtcagcgagctgcaggatttcgaggaagagggtgaggatctccactttcccgccaacgagaagaaaggtatcgaacagaacgaacagtgggttgtgcctcaggtgaaagtggaaaaaacaaggcacgctaggcaggcttcagaagaagaactgcccattaatgactataccgagaacgggatcgagtttgaccctatgttggatgaaagaggttattgttgtatatattgccgaagaggtaatcggtattgcagacgcgtttgtgaaccactacttggttattatccctacccctattgctaccagggcggcagagtcatctgccgcgtgattatgccttgtaactggtgggttgccagaatgcttgggagagtctag

SEQ ID NO: 26589 - DNA, 1356 bp, Artificial Sequence
  Description of Artificial Sequence: Synthetic coding sequence
atggccacccccctggtggccggccccgccgccctgcggttcgccgcggcggccagctggcaggttgtaagggggaggtgtgtagagcattttccccgcgttctggagtttttgcggagtctgagagccgtggctccaggcctggttcgttataggcatcacgagagattatgcatgggcttaaaagccaaagtggtggtggaactgattctccaggggaggccctgggctcaagttcttaaggccctgaatcaccactttccagaatccggcccaatagtgcgggatccaaaagcgacgaaacaggacctgaggaagatcctggaggcccaggagaccttttaccagcaagtgaagcaactgtctgaggcacccgtggatctggcgtctaagctgcaagagctggagcaagagtacggggaacctttcctggctgctatggaaaagcttcttttcgagtatttatgccagctagagaaggctctgcctaccccgcaggcccagcagctccaggacgtgttgtcatggatgcagcccggcgtctctattaccagttccctagcatggcgccagtatggagtggacatgggctggttgctgccggaatgctctgtgacagattcggttaatctggccgagcctatggaacagaatccgccacagcaacagcggctcgccctgcacaacccgctacctaaagcaaaacccggaacccacctcccccaaggcccatctagtcgtactcacccagagcctctagcaggtagacacttcaacctggctccgctcggaagacgcagggttcaaagccagtgggcgtcaacacgaggggggcacaaggagcggcctaccgtaatgctgttccctttccggaatctgggttcccctacccaggtgatatccaagccagaatccaaagaggaacacgctatctatacagcagatctcgcgatgggaacacgtgcagcctctacaggaaagtcaaagtccccatgccagaccctcggtggccgggccctgaaggagaacccggtggatctgcctgcaacggagcaaaaggaaaattgtctggactgttacatggaccccctcagactctcactgcttcctcccagggcaagaaaacctgtgtgcccaccgtcactgtgcagcagtgtcataactatcggagatctggtgttagattcagatgaggaagagaatgggcagggggaagggaaagaaagccttgagaattaccagaagaccaaatttgatacgctcatccctaccctctgcgagtatctgccacccagcggtcacggcgccattcccgtgagtagttgcgactgtcgcgattctagtagaccactgtag

SEQ ID NO: 26590 - DNA, 1065 bp, Artificial Sequence
  Description of Artificial Sequence: Synthetic coding sequence
atggccacccccctggtggccggccccgccgccctgcggttcgccgccgccgcgagctggcaggttgttagaggaagatgcgttgagcattttcctagagtcttggaatttcttcgttctttacgcgccgtggcccccggacttgttagatataggcatcacgaacgcctgtgcatgggcctgaaagccaaggtggtggtcgagttgatacttcagggtaggccctgggcacaggtcctcaaagctcttaaccatcatttcccggagtcaggacctatcgtgagagatccaaaggcaaccaagcaagacctacggaagatcttggaggcccaagagaccttttatcagcaggtcaagcagcttagtgaagctccagtggacctggctagcaaactgcaggagcttgagcaggagtatggcgagccattccttgccgccatggagaagctgctgtttgaatacctctgtcagctggagaaagcactgcccactccccaggcccagcagttacaggacgtcctttcatggatgcagccaggggtgagtattacctcaagcctggcctggaggcagtacggtgtcgacatgggatggttgttgcccgaatgctcagtgaccgattccgtgaacctggctgaacccatggagcagaaccctccacagcaacagaggcttgctctccataaccccttacctaaagccaagcctggtacccatctgccacagggaccctcctcccgcacacatcccgaacccctggctgggaggcactttaaccttgccccattggggcgccgccgcgttcagagccagtgggcctcaactagagggggccataaggagagacccaccgtaatgttatttcccttccgaaacttaggttcccccactcaggttatcagtaagcccgaaagcaaggaggagcatgccatctatacagctgatctggcaatgggcacaagagcggcttccacaggtaaatctaaaagtccttgccagacactgggtggcagagcactgaaggaaaacccggtggacctgccagccactgaacagaaggagtag

SEQ ID NO: 26591 - DNA, 423 bp, Artificial Sequence
  Description of Artificial Sequence: Synthetic coding sequence
atggagcagaaccccccccagcagcagcggctggccctgcacaaccctttacctaaggccaaaccagggactcacctacctcagggccccagctctaggacccacccagagccactggccggtcgccatttcaacctggctcccttaggtagacgcagggtgcagagccagtgggcttccaccaggggaggtcacaaagagcggcctaccgtgatgttgtttccattcaggaacttaggaagtcctacacaggtaatcagtaagcccgaaagcaaagaagagcacgctatctacactgccgaccttgctatgggcacacgcgcggcctcaacaggcaaatcaaaatccccctgccagactctagggggccgagccttgaaggaaaatcccgttgatctgccagccaccgaacagaaggaatag

SEQ ID NO: 26592 - DNA, 1251 bp, Artificial Sequence
  Description of Artificial Sequence: Synthetic coding sequence
atggccacccccctggtggccggccccgccgccctgcggttcgccgcagcagccagctggcaggttgtcagaggaaggtgtgtggagcactttcctagagtgctcgagttcctgcggtcactgcgggctgtcgcgccaggccttgtcaggtaccgacaccacgaaaggctgtgtatgggcctcaaagccaaaaccaaacaggacctacggaagatcctggaagcccaggagacgttctatcagcaggttaagcagttatctgaggctccagtagacctcgcttccaagctccaggaactggaacaggaatacggcgaaccctttctcgcagcaatggaaaagcttttatttgagtatttgtgtcagctcgaaaaagccttgccgactccgcaggctcagcagttgcaagatgtgttaagctggatgcagcctggggtctccatcacctcgtctctcgcttggcggcaatatggagtggacatggggtggctgcttcctgaatgtagcgttaccgattcagtcaacctcgccgagccgatggaacagaaccctcctcaacagcagaggctggctttgcacaaccccctgccgaaggctaagcctggcacccatttgccccagggcccctcttctcgaacacaccccgagccgctcgccggacgacacttcaacctcgctccactgggacggcggcgggtgcagagccaatgggcctctaccagggggggtcacaaagaacgccccactgtgatgctttttccattcaggaatctgggctccccaactcaagtgatctcaaaacctgagtcgaaagaagaacatgccatttacaccgccgacttggctatggggaccagggccgcctccaccggcaagagtaaatctccttgtcaaactctcggagggcgagctttaaaggaaaacccggtagacctgcccgcaacagaacaaaaagagaattgcttagattgttatatggatccgttgcgcctctctttgctacccccgagggcccggaaacctgtctgtcccccatcactttgctccagcgtaatcacaatcggcgatctggtactggactccgatgaagaggagaatggccaaggggagggaaaggaatccctggaaaactatcaaaaaactaagtttgatactctgataccaacactttgtgagtacctgccaccgtctggccatggggccatacctgtgagcagttgcgattgcagagactcaagcagacccctatag

SEQ ID NO: 26593 - DNA, 3498 bp, Artificial Sequence
  Description of Artificial Sequence: Synthetic coding sequence
atggagcaggaccggaccaaccacgtggagggcaaccggctgagcccttttctcatcccttctcctcccatctgtcagaccgagcctctagcaacaaagctgcaaaacggaagcccgctaccagagcgcgcccatcccgaggtgaatggtgacaccaagtggcactccttcaagtcttattatggaatcccttgcatgaagggatcgcaaaactctcgggtaagtccagattttacacaggagagtcgcgggtacagcaaatgtcttcagaatggggggattaagaggacagtgtctgaaccctctctgtccggactactgcagattaagaaactaaagcaagatcagaaggctaatggagagcgtagaaactttggcgtgtctcaagaaagaaaccctggggagagttcacaacctaatgtgtctgacttgtccgacaaaaaggagtccgtgagttctgtcgcccaggaaaatgcagtcaaggacttcacctccttcagcacgcataactgtagcggccctgaaaaccctgagctgcagatactgaatgagcaagagggtaaaagcgcaaactatcatgacaagaacattgtgctgctgaaaaataaggctgtcctcatgccaaacggagctacagtatccgctagtagcgttgaacacacacacggcgaactattggaaaaaactctctctcagtactatcctgactgtgttagtatagctgtccagaaaacaaccagccatatcaatgcaataaattctcaagccaccaatgaattgtcgtgtgagatcacccacccctcacacactagtggacaaatcaattccgcccaaacgtcaaactcagagctcccaccgaagcctgcagccgtcgtgagcgaggcgtgcgatgccgacgatgcagacaatgccagcaaactggccgctatgttgaatacatgcagtttccagaagccagaacagttacagcagcagaaatcggtgttcgagatctgtccctcacctgcagaaaacaacatccagggcactactaaactagcaagcggggaagaattctgttccgggtcctcctcaaatctgcaggcaccgggcgggagttccgagagatatcttaaacagaatgaaatgaacggggcatattttaaacaaagcagcgtattcaccaaagattcgttttcagccaccaccactcctccccccccaagtcagctcctgctcagtccgcctccgcccctgccgcaagtgccgcagctcccctccgaaggcaagtctaccctcaacggtggcgtcctcgaagaacaccatcactacccaaatcaaagcaacactaccctccttcgggaagttaagatcgaaggtaagcccgaagcaccacccagccaaagtccaaacccatcaacgcacgtgtgcagcccaagtcccatgctgtccgaaagaccacagaataactgtgttaaccggaacgatatacagaccgctggtacaatgacggtccctttgtgtagcgagaaaacccgcccaatgagtgagcatctcaagcacaacccccccatctttgggtcctccggcgaactgcaagacaactgtcagcagttaatgaggaataaggaacaggaaattctgaagggtagagacaaagaacaaaccagagacctggtgcctcccacacaacactatctcaagcccggctggatcgagttaaaagctccaaggttccaccaggcagaatcccacctaaagagaaacgaagcttctctaccttctattttgcagtatcagcctaacctgtccaaccagatgacaagcaagcaatatactggcaactccaacatgcccggtggcttgccccggcaggcttacactcagaaaaccacccagctggaacacaagagccaaatgtatcaggtcgaaatgaatcaggggcagtcccagggaaccgtggatcagcacctacagttccagaagcctagccatcaagtgcacttttcgaaaaccgatcacttgcccaaggctcacgtgcaatctctgtgtgggaccaggttccatttccagcagagggccgatagccagacagagaagctcatgagccccgttttaaagcagcatctaaaccagcaggctagcgagactgagccctttagcaatagccacctcctacagcacaagccacataagcaggctgcgcaaacccagcccagccaatcttctcatctgcctcagaaccagcagcagcagcagaagctgcagattaagaacaaggaagaaattctgcaaacatttcctcatcctcagtctaataacgaccagcagcgggaaggctctttcttcgggcaaaccaaagtagaggaatgcttccatggagaaaaccaatatagcaagtccagcgaattcgagacacataatgttcaaatgggtttggaggaggtccagaacattaacagacgtaactctccctactcccagactatgaagagttccgcctgtaagatccaggttagctgttccaacaacacccatctcgtttctgaaaacaaagagcagactactcaccccgaactcttcgccggcaacaaaactcaaaacctgcatcatatgcagtattttcctaataacgtgatcccaaaacaagacctgttacatcgctgtttccaggagcaggaacagaagagccagcaggccagcgttcttcagggctataaaaaccggaaccaggacatgagtggccagcaggctgcccaactggctcagcagagatatttgatccataaccacgctaatgtcttccccgtacccgaccagggagggagccacacgcagacccctcctcaaaaggatactcaaaaacatgcagcgctcagatggcacctgttgcagaagcaagagcagcagcagactcagcagcctcagaccgagtcctgccactctcaaatgcaccgccctattaaagtggagcctggctgcaagccacatgcatgtatgcacacagctcccccggaaaacaaaacatggaaaaaagtgaccaagcaagagaaccccccggctagctgtgacaacgtacagcaaaaaagcatcatcgagactatggagcaacatctgaaacagtttcatgctaaaagtctgtttgaccataaggcactgaccttgaaatcccagaagcaggtgaaagtggagatgtcagggcccgttacagtgctgacccgccagaccactgctgcagaattggacagccacacacccgctctggagcagcagacaacttcctctgaaaagaccccaacaaaacggactgcagcctctgtcctgaacaactttatcgagagcccctccaaactgctggatactccaatcaagaacctgttggacacccctgtaaaaacccaatatgactttcccagctgtcggtgcgttggtaaatgccagaagtgtaccgagacgcatggtgtctacccagagctcgcaaacctgtcgagcgacatggggttcagcttttttttctag

SEQ ID NO: 26594 - DNA, 6009 bp, Artificial Sequence
  Description of Artificial Sequence: Synthetic coding sequence
atggagcaggaccggaccaaccacgtggagggcaaccggctgagccccttcctgatcccctccccacctatctgccagacagagcctctggctaccaaactgcagaacgggagtcctcttccagagcgtgcccatcccgaagttaacggggacacgaagtggcacagctttaagtcctactatggcatcccatgtatgaagggctcgcagaattctagggtctcacccgactttacccaggaatcaaggggctatagtaagtgcctgcaaaacggagggataaaacgcacggtatccgaaccttccttgagcgggttgctgcagattaagaagcttaagcaagatcaaaaagctaatggggagcgacggaactttggagtgtctcaggagagaaaccccggcgaaagcagtcaacccaacgtgagcgatctgtctgacaaaaaagaatcagtctcctcggttgcacaggaaaacgctgtcaaggattttactagtttcagcacccacaactgttctggacccgaaaacccggaactgcagattcttaacgaacaggagggtaaaagtgccaactatcatgataagaacattgttttactcaagaataaagctgtgctgatgccaaatggggccaccgtgtcagcgagttccgtcgagcatacacatggcgagctcctggagaaaactctcagtcagtactaccccgactgcgtcagcatcgccgtgcagaagaccaccagtcacataaatgctattaatagccaagccactaatgagctcagctgcgagataacccatcccagtcatacctctggacagattaactcagcccagacatccaacagcgagttgccgcccaagcctgctgccgtagtctccgaggcatgtgacgcggatgatgctgacaatgcatcgaaactagctgccatgctgaacacatgcagcttccagaaacctgagcagctgcagcagcagaaatcagtatttgagatttgcccttctcccgctgagaacaatattcagggcactaccaagctcgcctcaggcgaggagttttgcagcggatcttcctccaatctgcaagctcccggcggaagttctgaaagatacctgaagcagaacgaaatgaacggtgcttactttaaacaaagttccgtgttcaccaaggatagtttcagtgccaccaccaccccaccccctccatcacagctgttgctcagccccccccccccattgccacaggtacctcagttacctagcgagggtaaaagtaccctaaacggaggggtgctggaagaacatcaccactaccccaaccaaagcaacaccactctactgagagaggtgaaaattgagggtaagcccgaggcgccccctagccagtctcctaatcccagtactcatgtgtgctccccaagcccaatgctgtctgagagaccccagaacaactgtgtaaatcgcaacgacatacaaacggctggcactatgacagtgccactgtgttctgaaaagaccaggcccatgagcgagcacctgaagcacaaccccccaatttttgggtcttccggcgagcttcaggataattgccagcagctgatgagaaacaaagagcaggaaatcttaaagggccgagataaagagcaaacaagagacctggtacccccaacccagcattacttaaaacccgggtggatcgagttaaaggcccctagattccaccaggcagagagccacttgaaacggaatgaggcatccttaccttcaatcctacagtatcagcctaatctcagtaatcagatgacctccaagcaatacaccgggaactccaacatgccgggtggcctcccacgacaagcctatacacagaagactacccagctggagcacaagagtcagatgtaccaggtggagatgaatcaagggcagtcacagggaaccgtggaccagcacttacaatttcagaaaccaagccatcaggtacatttctcgaaaaccgaccatctgcccaaagcacacgtgcaaagcctgtgtggcacaaggtttcacttccagcaacgcgctgactcccagactgagaagttgatgtccccagtgctgaaacagcatcttaatcagcaggcaagcgagacagagccgttttctaactctcatctattgcagcataagcctcacaagcaagctgcccaaacgcaaccttcacaaagcagtcatttgcctcagaaccaacagcagcagcagaaattgcagattaagaataaggaggagattctgcaaacattcccacatccgcaatcaaacaacgaccagcagcgggagggaagcttttttggacaaaccaaagtggaagaatgcttccacggggagaatcagtatagtaagagttcagagttcgagacccacaacgtgcagatggggctcgaagaagttcagaatatcaaccgcagaaattcaccttatagccaaaccatgaaaagctcagcctgtaaaatacaggtgagttgcagcaacaatacacaccttgtgtctgaaaataaagaacagacgacacaccccgaactctttgcaggtaacaagacacaaaacctgcaccacatgcagtatttccccaacaatgtgatccccaaacaggatctgctgcaccggtgtttccaagaacaagagcagaagagccagcaggcctccgtcctccaaggatacaaaaatagaaatcaagacatgagcgggcagcaggctgctcagttggctcaacagcgctacctcatacacaaccacgctaacgtgtttcctgtgcccgaccagggagggtcccatacccaaaccccaccgcaaaaagacacgcagaagcacgctgccctgcgttggcatctcctgcagaagcaggaacagcaacagacccagcaaccgcagaccgagtcctgccattctcagatgcatagaccaataaaagtggaaccgggctgcaaaccgcacgcttgcatgcatacagccccgcccgaaaataaaacttggaagaaggttacaaagcaggaaaacccacccgcaagttgtgataatgttcagcagaaaagtatcatcgaaaccatggagcagcacctgaagcagtttcacgctaaatcactctttgaccataaagctctcactctgaaaagccagaagcaggtgaaggttgagatgagtggccccgtgacggtcctgacaagacagactacagcagctgagctggacagccacacgcccgccctcgaacaacagacaaccagtagtgagaagacgcctacgaagcgcactgccgccagcgtcctgaacaattttatcgagagcccaagcaaactgctggacacaccgatcaaaaacctactcgatactcctgtcaaaacacagtatgactttccatcctgcagatgtgtagagcagattatcgagaaagacgagggacccttttatactcacttaggtgccgggcctaacgtggcagctattagagaaattatggaggagaggtttggccagaaggggaaagctataaggatcgagagagtgatttacacggggaaggaaggtaagtccagtcagggttgcccaattgccaaatgggtcgtccgtagatcatcctctgaggagaagctgctttgtctggtgagggaacgggccggacacacttgcgaagctgcagtgattgttatcctgatccttgtgtgggagggcatccccctgtctttagcggataagctgtactccgagctgacagaaacattaagaaagtacggcaccctaaccaatcgaaggtgtgcccttaatgaggagaggacctgtgcttgtcagggcctggacccagagacctgtggcgcaagctttagtttcgggtgttcttggagtatgtactataacggttgcaagtttgcaagatccaaaattccccggaaatttaaactcttgggggatgatcccaaggaagaagagaagcttgaaagccacctgcaaaacctctcaaccctcatggcacctacatataagaagctggccccagacgcatacaataatcagatcgaatacgagcatcgagctcccgaatgtagactcgggttgaaggaaggcagacctttttcgggggtaacagcctgtctggacttctgcgcccacgcgcacagggatctccacaacatgcagaacggcagcaccctggtgtgcaccctgacgcgcgaggataaccgcgaattcggcggcaagcccgaggatgaacagctgcacgttctgccactgtacaaggtgtccgacgtggatgagtttgggagcgtggaagcccaggaagagaagaagcgcagtggagcaattcaggtcttgagctctttcaggagaaaggtcaggatgttggctgagcccgtcaaaacatgcaggcagcggaagctcgaggcgaagaaagctgccgctgagaagctgtctagcctggagaattcgtcgaacaagaacgagaaagagaagagtgccccttctagaacaaagcagactgagaatgcatctcaagcaaaacagcttgctgagttacttcgtctctctggcccggtgatgcagcagtcccagcagccccaaccactccagaagcaaccaccccagcctcaacagcagcagcgtccccagcagcagcaaccacaccacccccagactgaatccgtgaattcctatagtgctagtggatccaccaatccgtacatgcgaagacctaatcctgtctccccatatcctaactcctcccacaccagcgacatctacgggagtacctcccctatgaatttctactcgaccagcagccaggcagcaggatcctacttgaactcctccaaccccatgaacccatatcctgggttgctgaaccagaacactcagtatccctcctaccaatgtaacgggaatttgagcgtagacaattgtagtccttatcttgggtcctattcgccacagtcccaaccaatggatttgtataggtaccccagccaagacccactgtcgaaactcagtttgccacctatccatactttgtaccagccccgcttcggcaacagtcagtcatttacgtctaagtatttggggtacggaaatcagaacatgcagggggatggcttcagctcttgtacgattcgtccgaacgtacatcatgtcggaaaactgcctccttaccctacccacgagatggatggccatttcatgggtgccaccagtcgcctcccaccaaatctgtccaacccgaatatggattataagaacggtgagcatcattcgccatcccatatcatccataattacagcgctgctcccggcatgtttaacagttcactgcacgccctacatctccagaacaaagaaaacgacatgctgtctcacaccgctaatggcctcagtaagatgttaccggcactcaatcacgatagaactgcatgtgtgcagggaggcctgcacaaactctccgacgccaatggccaagagaaacagccccttgctttagtacagggagtggcatcaggtgccgaagacaacgatgaagtgtggtccgattccgagcagagttttctcgaccccgatattggcggagtggccgtagccccaacccacggcagtatccttattgagtgtgctaagagagaattgcatgccacaacccccctgaagaatcctaatcgcaatcaccctacacgaatttctttagttttttatcagcataaatccatgaacgagcctaagcacggcctcgccctgtgggaggccaagatggccgaaaaggcccgtgagaaagaggaggaatgcgaaaaatacggccccgattacgttccacagaaaagccatggcaaaaaggtaaaaagggagcctgccgagccacacgaaacaagcgagcccacctacctccgattcatcaagtccctggccgagaggacgatgtcagtgaccaccgatagcaccgtgacaacaagcccttatgcattcacccgagttaccggtccctataacaggtacatctag

SEQ ID NO: 26595 - DNA, 3498 bp, Artificial Sequence
  Description of Artificial Sequence: Synthetic coding sequence
atggagcaggaccggaccaaccacgtggagggcaaccggctgagcccattcctgataccaagcccacccatctgccagacagaacccctggcgacaaaactgcaaaacggaagtccgctacccgaacgagctcatccggaagtgaatggggacacgaagtggcattcattcaagtcctattacggcatcccatgtatgaaggggtcgcagaactcaagggtctccccagattttacacaggagtctaggggttactcgaagtgccttcagaacggaggaataaagcggaccgtatccgaaccatcactgtctggtttgctgcaaatcaaaaaactgaagcaagatcagaaagctaacggtgagagacggaactttggtgtgagccaagagcggaacccgggggagtcctctcagccaaacgtatctgatttatccgacaagaaggagagcgtgtctagcgttgctcaggagaacgcagtcaaggacttcacatcctttagcacacacaattgctccggtccagaaaatccagaattgcagatactcaacgaacaggaggggaaaagcgctaattatcacgacaaaaatattgtgttgctcaagaataaagctgtgctgatgcctaatggcgcaacagtttctgctagtagtgtggagcatacccacggagagcttcttgaaaagacccttagccagtactatcccgattgcgttagcatcgcggtccagaaaacaacttctcatatcaatgccatcaattcccaggctacaaatgagctgagctgcgagatcacacaccctagtcatacgtctggccagatcaactcagcccagacttccaacagcgagttgccacccaaaccagctgccgtggtctctgaggcttgtgatgccgatgatgcagacaacgcctctaaactcgccgccatgcttaacacatgctctttccagaaacccgagcaattgcagcagcaaaagtcggttttcgagatctgtccgtcccccgcagagaataacatccaaggcaccactaagctggcgtccggcgaggaattttgcagcgggtccagctctaatctgcaagcccccgggggttcctccgagcgctatttgaagcagaatgaaatgaacggcgcatactttaagcaatcatcagtttttaccaaggattctttcagcgcaaccaccactcctcctccccccagtcagctcctcctgtcaccccccccgcctctgccccaggtccctcagctgcctagtgagggaaaatcaaccctcaacggcggcgtcctggaggagcatcatcattaccccaaccagtctaatactaccttattgcgagaggtgaagatcgagggcaagcccgaagcacctcccagccaatccccaaacccatccacacatgtctgttctccatctccaatgctaagcgagcgaccccagaataattgtgtcaatcgaaatgacatacagaccgctggcacaatgacagtccccctgtgttcagagaaaacaagacccatgtctgaacatctaaagcacaatccacccatctttggatcttctggtgaactgcaggataattgtcagcagctcatgcggaataaggaacaggaaattctgaaaggtagggacaaggagcagacacgggatttggtacccccaacacagcactacttgaagcccgggtggatcgagctgaaggcaccacggttccatcaggccgagagccatctaaagagaaatgaagcaagtctgccctcaatcttacagtatcaacccaatctttctaatcaaatgaccagcaagcaatataccggtaattctaacatgcccggaggcctcccgcggcaggcctacacccagaagactacacagcttgagcacaagagccagatgtatcaagtcgagatgaaccagggccaatcgcagggcaccgtcgaccagcacctgcagttccaaaagccgtcccaccaggtgcacttctccaaaaccgaccatctccccaaggcccacgtgcagagcctgtgtggtacccgattccactttcagcagagagccgactcacagactgagaagctgatgtcacctgtgctgaaacaacatctcaaccagcaggccagtgagaccgagccctttagcaacagtcatcttctccaacacaaaccgcacaaacaggcagcccaaacccaacccagtcagagctctcatttgccccaaaaccaacagcagcagcagaagctgcagattaagaataaagaggagattctgcagacattccctcacccgcagagcaataacgaccagcagcgagaaggaagtttcttcgggcagaccaaggtggaggagtgctttcatggggagaaccagtactctaagagtagcgagtttgagacccacaacgtacagatggggctggaggaggtacagaatattaatcggaggaactctccctattcccagacaatgaagtcatccgcatgcaagattcaagtatcatgtagcaacaatacccacctggtatctgaaaataaggagcagaccacacaccccgagctctttgctggcaataagacccaaaacttgcatcacatgcaatatttccctaacaacgtgattcccaaacaggacttgcttcacaggtgctttcaggagcaggagcagaagagccagcaggcctctgtactacagggctacaagaacaggaatcaggatatgagtggccagcaggcggcccaactcgcacagcagcggtatctcattcataatcacgctaatgtgtttccagtaccagatcagggagggtcccatacgcagaccccaccccagaaagacactcagaaacacgcagccctccgatggcacctcctacaaaagcaggaacagcagcagacccaacagccgcaaaccgaatcttgtcactctcagatgcacaggcccataaaagtggagccaggttgtaaacctcatgcctgcatgcacactgcgcctccagagaacaagacctggaaaaaggttaccaaacaagagaacccccctgcctcctgtgataacgtgcagcagaagtccatcatcgagaccatggagcagcacctgaagcagtttcatgccaagagcctatttgatcataaggctttgacgttaaaaagccaaaagcaggtgaaagtcgaaatgagtggtccagtcaccgtgcttaccagacaaaccaccgccgctgagctagattctcacaccccagcactggagcagcagaccacctcctcagaaaagacgccgaccaagagaacggctgcctcagttctgaacaatttcatagaaagcccatcgaagctgctggacactccaatcaagaacttacttgacaccccggttaagacacagtatgatttcccatcttgtcggtgcgtgggaaagtgtcagaagtgtaccgagacccatggagtctaccccgaactggcaaatctctctagtgacatgggattctcattttttttctag

SEQ ID NO: 26596 - DNA, 333 bp, Artificial Sequence
  Description of Artificial Sequence: Synthetic coding sequence
atggagcaggaccggaccaaccacgtggagggcaaccggctgagcccattcctgatcccctctcctcctatctgtcaaacggagccactggctaccaagctgcagaatggcagtccactgcctgagcgcgcccaccccgaggtcaacggcgacactaaatggcactcattcaagagctactacggaattccttgtatgaagggatcacagaattccagggtgagtcctgatttcacacaggagagccgtggttacagcaagtgtctgcagaatggtgggatcaagagaactgtctctgaaccttctttgagtggactccttcagattaaatag

SEQ ID NO: 26597 - DNA, 1914 bp, Artificial Sequence
  Description of Artificial Sequence: Synthetic coding sequence
atggagcaggaccggaccaaccacgtggagggcaaccggctgagcccattcttaattccctcaccaccgatttgtcagacagagccgctagccaccaagctgcagaacgggtcccccctgcctgaaagagcacatcccgaggtcaatggagacacaaagtggcattcattcaaatcatactatgggatcccctgcatgaagggttcacaaaattctcgcgtgtctccagacttcacccaggaaagcaggggctactcaaaatgccttcagaacgggggaatcaaaaggaccgtttcagagccgagcctaagcggcctgttacagatcaagaagctaaaacaagatcagaaagcaaacggcgagcggaggaactttggggtgagtcaggagcgcaaccccggtgagtcctcacagccaaacgtatcagatctttccgacaagaaggagagtgttagtagtgttgcccaggaaaatgccgtaaaggactttacgagcttctccactcacaactgctcaggacccgaaaatcccgaactccagatattaaacgaacaagagggaaagtccgccaactatcatgataaaaacatcgttttgcttaaaaacaaagccgtcttgatgcccaatggagcgaccgtgtctgcctccagtgtggaacatacgcatggcgagttacttgagaagacccttagtcaatactatccggactgtgtatccatcgccgttcagaaaactacaagccacataaacgcgatcaatagccaggccaccaatgaactctcttgcgaaatcactcaccctagccatactagcggccagattaactctgcccaaacgtcaaactcagaactcccccccaagcccgccgcagtcgtgtccgaagcatgtgacgcagatgatgctgacaatgcgtccaaactcgcggcaatgttgaatacgtgttccttccaaaagcccgagcagctccagcagcaaaaaagtgtgtttgagatctgtccatcaccagcggaaaataacattcaaggaacaacaaaattagcatcaggtgaggaattctgttccgggtcttcttctaatctacaggccccaggcggctcttccgagaggtatctgaaacagaacgagatgaatggcgcctacttcaagcagtcctctgtgttcacgaaggactccttttcagccaccacaacacccccccctcccagtcagttgctgctgagcccacccccaccgctgccacaggtcccccaactgccctctgaaggaaagtcgactctcaatgggggcgtgctcgaggagcatcatcactaccctaatcagagtaacactaccctcctgcgggaagtcaagatcgagggaaaacctgaagcgccgccatctcaatctcccaacccttctacccacgtctgtagcccgtcacccatgttgtcagagcggccacagaataattgcgtcaacaggaatgatatccagaccgccggaactatgactgtgcccttgtgtagcgaaaagactcgcccgatgtctgagcatctcaagcacaatccacccatctttggctcaagtggagagttacaggataactgccagcagctcatgaggaacaaggaacaggagattcttaagggtcgcgacaaagagcagacccgcgacttggtacctcccacgcaacattacctgaagcctggttggatagagctgaaggctccacgctttcatcaggcagaatcgcacttgaagcggaacgaagctagcctcccatcaatcctacagtaccagcccaacctgagtaatcagatgacctctaagcagtacaccggcaatagcaacatgcctggtgggctccccagacaagcttacactcaaaagacaactcagctgtccactagccacaagtgtaccaagctcaagtag

SEQ ID NO: 26598 - DNA, 6009 bp, Artificial Sequence
  Description of Artificial Sequence: Synthetic coding sequence
atggagcaggaccggaccaaccacgtggagggcaaccggctgagcccgttcctcattccgtcccccccaatttgtcaaacagaacctctcgctacaaagttacagaatggctctcccctgccagagcgggcacaccccgaagtcaacggcgatacaaaatggcactctttcaagtcttattacggcataccgtgtatgaagggttcccagaatagccgcgtgtcacctgatttcacccaagaaagcaggggctattcaaagtgcctccaaaacggcggcatcaagcgcactgtgtccgagcccagcctgtccggactcctccagattaagaagctgaagcaggaccagaaggcaaatggagagcggaggaattttggagtctcacaggagagaaatccaggcgaaagcagtcagcccaacgtgtccgacctgtctgacaagaaagagagcgttagctctgttgcccaagagaatgccgtgaaagactttaccagcttcagcactcataactgcagtggtcccgagaaccccgagctgcaaatcctaaatgaacaagaaggaaagtccgcgaactaccatgacaaaaatatcgttctattgaagaacaaagccgtcctaatgccaaacggggccacagtaagtgcctcaagcgtggaacacactcacggcgagcttttagaaaaaaccctttcacaatactacccagattgcgtgtctatcgccgtccagaagaccacatctcatataaacgctattaattcccaagcaacaaatgagttgtcatgcgaaattacacacccaagccatacgagcggccagatcaatagcgcacagaccagtaactcggagctgccacccaaacctgcagccgttgtttcggaagcttgcgacgcagatgatgccgacaacgcctcgaagctggcagcaatgctgaatacttgtagcttccagaaaccagagcagctgcagcagcagaaatcggttttcgagatttgtccatctccagccgaaaacaacattcagggaacaacaaagctcgcaagtggagaggagttttgcagtggaagctcatccaatcttcaggctcctgggggctcttccgaaagatacctgaagcaaaatgagatgaatggggcatattttaagcagagcagcgtgtttacgaaggatagcttttctgcgaccacgacacccccacctccttcccaactattactgagtccccccccacccttgccccaggtgccacaactgccatctgaaggtaaaagcacactgaacggcggcgtgctggaggagcaccaccattatccgaaccaatcaaatactaccctgctgcgcgaagtgaagatcgagggaaaacccgaggctcccccatctcagtcgcccaatccgtcaacacatgtctgttccccatcacccatgctctccgaaagacctcagaacaattgcgtaaacagaaacgatatccagaccgctggaaccatgacagtacccctgtgttccgaaaaaacccgccccatgtctgagcacttgaagcacaatccccctatttttggcagttccggagagctccaggataactgccagcagctcatgagaaacaaagaacaggagattttaaaggggcgagacaaggagcagacgagagatcttgtgccacctacccagcactacctcaaacccggctggatcgagcttaaggcccctaggttccaccaagccgagtctcacctaaaacgaaatgaggcctcgttgccctcaatcctccaataccagcccaacctttctaatcagatgacatccaagcagtacacaggaaatagcaatatgcccggcggcttgcctcgccaggcgtacactcagaagacgacccagctcgaacacaaatctcaaatgtaccaggtggagatgaaccaggggcagagccaggggaccgtagaccagcatctgcagttccagaagccaagccaccaggtgcatttctccaagacggatcatctgcccaaggcccacgtccagtcactctgcggcactagatttcactttcagcaaagggccgatagccagaccgagaagctgatgtcccctgtgctgaagcaacatctaaatcaacaagcatcagagaccgaaccattctctaactcgcatctcctgcaacacaaaccacacaagcaggcggctcaaacccagccctcccagtctagccacttaccgcagaaccagcagcagcagcagaagctgcagattaaaaacaaggaagagatcctccaaacattcccacatccccagtctaataacgaccagcagagagagggctccttcttcggacaaaccaaagttgaagagtgtttccacggcgagaatcagtactctaagagtagcgagttcgaaacgcacaatgttcagatggggcttgaggaagttcagaacataaaccgaaggaacagcccctatagccagacaatgaaatccagtgcctgtaagatacaggtctcttgtagtaataacacacacctggtctccgaaaataaggagcagactactcatcctgagctcttcgcaggtaacaaaactcagaaccttcaccatatgcagtatttcccaaacaacgtcatacccaagcaggacctgctgcatagatgtttccaggagcaggaacagaaaagtcaacaagcgtccgtgctccaaggctacaaaaacaggaaccaggatatgagtggccaacaggccgcgcaattagctcagcagcgttatttgatacacaatcacgcaaacgtgtttccagtaccggatcagggaggcagccatacacagacccccccacaaaaagatactcagaagcacgcagctctgcggtggcatctcctccagaagcaggagcaacagcagacacagcagccacagaccgagagctgccactctcagatgcatcgccccatcaaggtggagcctggctgcaagccacatgcatgtatgcacaccgccccacctgagaacaagacatggaaaaaagtcacgaagcaggaaaacccccccgcctcctgtgacaacgtgcagcagaaatccataattgagaccatggaacagcatcttaagcagtttcacgcgaagtctcttttcgaccataaagcactcactctcaagtcccagaagcaggtcaaggtggagatgtcaggcccagttaccgtgctgaccagacaaacaaccgctgctgaactggatagccacactcctgccctcgagcaacagacaactagctccgaaaaaactcctacaaagcgcacagccgcctcagtactgaacaattttattgagtcacctagtaagctgctggacacccctataaagaacttgctcgacacccctgtgaagacacagtacgattttccttcctgtcgctgcgtcgagcagattattgaaaaagatgaggggccattttacactcacttaggtgcaggcccgaatgtcgcggccataagggaaataatggaagaacggttcggacagaagggtaaggccattcggattgaacgtgtcatatacactgggaaagaaggtaagtcctcccaggggtgcccaattgcaaagtgggttgttagaaggtcatcctcagaagagaaacttctgtgcctggtgagggaaagagctggccatacctgcgaggcggctgttatagtaattctgattttagtctgggaaggaatccctctatctctggccgacaagctctatagcgaattgaccgaaacactccgcaaatacggtacactgactaacaggagatgcgcgttgaacgaagagaggacttgtgcatgccagggtctcgaccccgagacttgtggcgcgtcgttcagctttggttgtagctggagcatgtactacaatggatgcaagtttgcccgatctaagatcccgaggaaatttaaactgctgggggacgaccccaaggaagaggagaagcttgagtcccacctgcagaacctatccactctgatggctcctacttataaaaagctcgctcctgacgcatacaacaatcagatagagtacgaacacagagctcccgaatgccggctgggacttaaagaggggaggccattcagcggagtgactgcttgcctggacttctgcgcccacgctcaccgtgatttgcataacatgcaaaatggttctaccttagtctgcactctgactcgggaggacaatcgggaatttggggggaaacccgaggatgagcaactgcatgtactccctctctataaggtcagcgatgtcgacgaatttggcagcgtagaggctcaggaggagaagaaaaggtctggtgcgatccaggtgttgtctagttttagacggaaggtacggatgctggccgagcctgtcaaaacttgtagacagcgcaaactggaggctaaaaaggcggccgctgagaagttgtcaagcctcgagaattccagcaacaagaacgaaaaagaaaaaagcgccccttctaggaccaagcagaccgaaaacgctagtcaggccaagcagttggcggaactactgcgactgtcgggacccgtgatgcagcagtcccagcagccccagcccctccagaagcagcctccgcagccccaacagcagcagcgtccacagcaacagcaaccacaccatccacagacagaatctgtcaactcctattcagcctccgggtccaccaatccatacatgaggcgtccaaaccctgtgagcccctatcctaattcttcccataccagcgacatttatgggtctacctccccgatgaatttctactctacgtcatcccaggccgccggctcatacttaaactcaagcaatcccatgaatccataccctggtctgctgaaccagaacacacagtaccctagttaccagtgtaatggtaacctgtctgtcgataactgtagtccatatctcggttcctacagccctcagtcgcagcctatggatctgtacaggtatccgtctcaggatcccctgtcaaaattgagtctgcctccaatccataccctgtaccagcccaggtttgggaatagccaatccttcacttccaaatatctggggtatggtaaccagaacatgcaaggtgacgggttttcatcctgtaccatccggcctaatgtgcatcatgtgggcaagctgcctccatacccaacccatgagatggatggccatttcatgggcgcaacttcccggctaccgccaaatcttagtaatccaaatatggattataagaatggagagcaccactctccatcccacataatccataattactccgctgcccccgggatgtttaactccagtctgcatgccctccatctgcagaacaaagaaaatgatatgctcagtcatactgcaaacggcctgtccaagatgttgccagcattgaaccacgataggaccgcatgcgtgcagggcggtcttcataaactaagcgatgcaaacgggcaggaaaagcagccactggccttggttcagggcgtggcaagtggcgccgaggacaacgatgaggtttggtcagattctgaacagtctttccttgacccagacatcggcggtgtggccgttgctccaacccatggttctatccttatcgaatgtgccaagagggaactgcatgctaccaccccattaaaaaacccgaataggaaccacccaactcggatatcacttgtcttctatcagcacaaaagcatgaacgagcccaagcacggcctcgccctctgggaagccaagatggccgagaaagctagggagaaggaggaggagtgtgaaaaatacgggcctgattatgtgccacagaagtcgcatggcaaaaaggtcaagcgcgaaccagccgaaccgcatgagacatctgaacccacatatctgcgctttataaagagcctggcagaacgaaccatgtctgttactaccgactctaccgtcacgacaagcccctatgcattcacaagggttaccggaccatacaatcgctacatctag

SEQ ID NO: 26599 - DNA, 3585 bp, Artificial Sequence
  Description of Artificial Sequence: Synthetic coding sequence
atggagcaggaccggaccaaccacgtggagggcaaccggctgagccccttcctgataccttctccacccatctgtcagacggagccgctggcaacaaagctgcaaaatggctcccccctgcctgagcgcgcccaccccgaagtgaatggcgacaccaagtggcactcattcaagtcctattacgggatcccctgcatgaagggatcacagaactcgcgcgttagtccagacttcacccaggagtccagggggtatagtaaatgtctgcagaacggcggtattaagagaacagtgtctgagccatccttaagcgggctactgcaaatcaaaaagctaaagcaggaccagaaggctaatggtgaacgcagaaattttggagtaagccaggagaggaaccctggagagtctagtcagcctaatgtgagtgatctgtcggataagaaggaatccgtgtcctccgtggcccaggaaaatgctgtgaaagacttcaccagcttctctacccacaactgttccggcccggaaaaccccgagctgcagattctcaacgaacaggagggtaagtccgccaactaccacgacaagaatatcgtcctcctcaagaacaaggcagttctcatgcccaatggggccacagtctctgctagctcggtggagcacacccatggggagttgcttgagaagacactgtcacagtactaccccgactgcgtgtcaatcgcagtacagaaaacaaccagccacattaacgctattaacagccaggctaccaatgagcttagctgtgagatcactcatccaagccacacctccggccagataaattcagcacagacatcgaacagtgagctgcctccaaaaccggctgcggtggtcagcgaagcctgcgacgcagatgacgccgacaacgcaagtaagctggcggccatgctaaatacatgtagttttcagaagcctgagcagctgcagcagcagaagtccgtctttgaaatctgccccagtcctgcggaaaacaacattcaggggaccaccaagctcgcgtctggggaagagttctgcagcggtagcagttccaacctccaagctccgggcggttcctctgagaggtatctgaaacaaaacgagatgaacggggcctatttcaagcagagttcagtgtttaccaaggactcctttagtgccaccactacgcctcctcccccctctcagctgctactaagtccccccccgccattgcctcaagtaccacaattgccaagtgaggggaaatctactcttaacggtggcgttctggaggagcatcatcattaccctaatcagtcgaacaccaccctgctaagagaggtgaaaattgagggcaagcccgaggctccaccttctcagtctccgaacccctctactcacgtgtgtagtccctcacctatgcttagcgagcgtccccaaaacaactgcgtgaaccgcaatgacatccagacagccggtactatgactgtaccactttgcagcgagaagactagacctatgagtgagcacttgaagcacaatccccctatctttggatcatcaggcgaactccaggataactgccagcagctgatgcgaaacaaggagcaagagattctcaaggggcgtgacaaagagcagactcgtgatctcgtgccccccacccagcattatctgaaaccagggtggattgaactgaaggcccccagatttcaccaggccgagtctcatctcaaacgaaacgaggcctctctgccatcgatcttgcagtaccagcctaacctgtcaaaccagatgacatccaagcaatatactggtaattccaacatgcccggtggcctgcctcgccaggcctatacccaaaaaaccacacaactcgagcacaaatcccagatgtaccaggtggagatgaatcagggtcagtctcaggggaccgtggaccagcatctccagttccagaagcccagtcatcaagttcactttagtaagactgaccatttacccaaagctcacgtccagtctctatgtgggacgcgctttcactttcagcagagggccgatagccagacagaaaagttgatgagtccagtgctgaagcaacacttaaatcagcaggcaagcgagaccgaaccattttctaattctcacttgcttcagcacaagcctcacaagcaggcagcccaaacccaaccatctcagtctagccacctgccacagaatcagcaacagcagcagaaactgcagattaagaacaaggaggagatactccagactttccctcatccacagagcaataacgaccagcagagggagggctcattttttggccagaccaaggtcgaagagtgttttcacggcgagaaccaatattccaaatcttctgagtttgagacccacaatgtccagatgggtctggaggaagttcaaaatatcaatcggcgcaattccccttacagtcaaacgatgaaaagctctgcctgtaagatccaggtgtcctgctcaaacaatactcacctggtgtctgagaataaagaacaaaccacgcatccagaattgttcgccggtaacaagacacagaacctgcatcacatgcagtactttccgaataacgtgatccctaaacaggacctattacatcggtgcttccaggagcaggaacagaagtctcagcaggcctcggtacttcagggttacaaaaataggaaccaggacatgtcagggcagcaggccgctcaacttgcccagcaacgctatctgattcataatcatgcgaacgtgtttcctgtccctgaccagggtggtagccatacgcagacacctcctcagaaggatactcagaaacacgccgctcttaggtggcatctgctccagaagcaggaacaacagcagactcagcagccacagactgaaagctgtcactctcagatgcatcgaccgatcaaggtggaaccaggatgcaaaccacacgcatgcatgcatacagccccgcccgaaaataaaacatggaagaaggttacgaaacaggagaatccgcccgcttcctgtgacaatgttcaacaaaaaagcataattgagacgatggagcagcatctgaagcagttccatgccaaatctttatttgatcataaggccctgacactgaagagccaaaagcaggtcaaagttgagatgtccggcccggtcaccgtattgactcggcagacgacagctgccgaactcgacagccacaccccagctctcgaacaacagacgacatcaagcgagaaaacccccactaagcgcaccgctgcaagtgtcctcaataactttattgagtcaccctcaaaattgctggatacccctataaaaaacctcttggatacaccagtaaagactcagtacgacttcccaagctgccgatgcgtcgggttggacaggcgagtcaagctcctcggtctgaaagaatccagtatcctggttaagaaagccaaagtgctgagggacgtgctgctcctgagcggctggttcgctgaagccgccgttaaaaggagttattgtgtctggtgcggaagtgaactggccactcctgtgcgccttcagtag

SEQ ID NO: 26600 - DNA, 6072 bp, Artificial Sequence
  Description of Artificial Sequence: Synthetic coding sequence
atgatccaggaggagcagatccagctggagggcagcctggtggacggaccagaggccagcctgatggagcaggacagaaccaaccacgttgaggggaacagactcagtccatttctgataccatcacctcccatttgccaaacggagcctctggcaactaagctgcagaacggctcacctcttcccgagcgagctcatccagaagtcaacggagacaccaagtggcactcattcaagtcttattacggcatcccttgcatgaaagggtcacagaattcgcgcgtgtcccctgattttactcaagagtctagagggtactccaagtgcctgcagaacggaggcatcaagagaactgtgtctgaacccagcctgagcgggctactccagattaaaaaactcaaacaggatcagaaggcgaatggagagagacggaacttcggggtcagccaggaaaggaatcccggcgagagctcccagccgaatgtgtccgacttatcggacaaaaaggagagtgttagctccgtagctcaagagaatgccgtcaaggactttacatctttttcaacccataactgctcgggaccagaaaacccagagctgcaaatattgaatgaacaagagggcaagtccgcgaactatcatgacaaaaacatcgtgctcctgaaaaacaaagctgttctaatgcccaacggagcaacagtgtcagcaagctctgttgagcacactcatggcgaactcctcgagaaaactctctcgcaatactacccagattgcgtctctatagccgtccagaaaactacaagccacattaatgcaatcaactcacaggctactaatgagctctcttgtgagatcacacaccctagccacacctccgggcaaataaacagcgcccagacgtcaaatagcgaactgccacccaagccagccgccgttgtatccgaggcctgtgacgcagatgatgctgacaatgccagcaagttggccgcaatgctaaatacttgcagcttccagaagcccgagcagctgcagcagcagaagagcgtgttcgagatttgtcctagtcccgccgagaataatattcagggcacaaccaaactggctagtggggaggaattctgctctgggtcaagctccaacctccaagcaccaggtggttcatcagagcgctaccttaagcagaacgaaatgaatggagcctactttaagcagtctagcgtattcaccaaggattccttttccgctacaacaactccaccacctccatcacagctgttactctcaccgcctcccccactcccccaggtgcctcagcttccgtccgaaggcaaaagtactcttaacgggggtgtccttgaggagcatcaccattaccccaaccaatcaaacaccacactcctacgggaagtgaagatcgagggcaagcctgaggctcctccttcccagagccctaacccctcaacccacgtttgtagtccctccccaatgttaagtgaacggccgcagaataactgcgtcaatcgcaacgatattcagactgccgggactatgactgttcccctctgtagtgagaaaacacggccgatgagtgagcatctcaaacataaccctcccatcttcggatcttccggagagctgcaagacaactgccagcagcttatgcggaacaaggagcaagaaattcttaagggacgggataaagaacaaaccagagacctggtgccccctacacagcactatctgaaacctggctggatcgaactgaaagctcctcgctttcatcaggctgaaagtcacttgaagaggaatgaggcctctctgcccagtatcctgcagtaccagcccaatctgtctaaccagatgacctcgaaacagtacacaggcaattctaacatgccgggcggactgcccagacaagcttatacacagaagacgacacagctggaacacaagtctcagatgtatcaggtggagatgaatcagggtcaatcacagggaacagtggaccagcacttgcagttccaaaagcccagtcaccaagtccatttttccaagacagatcatttaccaaaggctcatgtgcagtcgctttgcggcacgaggtttcacttccagcagcgtgccgactctcagactgagaagcttatgtcacctgttctgaagcagcaccttaaccaacaggcatctgagactgagccatttagtaactcccacttgcttcagcataaaccacataagcaagccgcacagacacaaccatctcagtcctcccacctgccacagaaccaacagcagcaacagaaattacaaataaaaaacaaagaagagatcttgcagacctttccccacccccaaagcaataacgatcagcagcgggagggcagctttttcggacagacaaaagtcgaagaatgcttccatggtgaaaatcagtattctaagagctcagagttcgagacccacaatgtgcaaatgggcctcgaagaagtccaaaatattaaccgccgcaactctccttacagtcagaccatgaagtcctctgcgtgcaaaatccaagttagctgttcgaacaatacacacctggtgtccgagaacaaggaacagacaactcatccagagctgttcgcgggcaacaagacacagaacctacaccacatgcagtacttccccaacaatgttatcccaaaacaagatcttctccatcgctgcttccaggaacaggagcagaagtcgcagcaagctagcgtcctccaggggtacaagaatcgaaaccaggatatgtccgggcagcaggctgcccaactggctcagcaacggtaccttattcacaaccatgccaacgtgttcccagtgccagatcagggaggcagtcacactcagactcctcctcagaaggatactcaaaaacacgctgctctgcggtggcatctgctgcagaaacaggaacagcagcaaacacaacaaccccagacagagtcctgtcatagccagatgcatagacctatcaaggtggagccaggctgcaagccgcatgcttgcatgcacactgcaccccccgagaataaaacctggaagaaggtcactaaacaggaaaatcctccagcctcttgcgacaacgtacagcagaaaagtatcatcgaaacaatggagcagcacctcaaacagttccatgccaaatcgctgttcgatcacaaagctctgactctcaaatcacagaaacaagtgaaagtggagatgagcggacccgtgacagtcctgactcgtcagacgaccgctgctgagctggattcccatacacccgcgctggaacagcagaccacaagctcggagaagacaccaacaaaaagaactgctgctagtgtcctgaataactttatcgagtcaccaagcaaactattggacacccccataaagaacttattggacactccagtcaagacgcagtatgatttcccgagctgccgctgcgtggagcagattatcgagaaagatgaaggcccgttctatacccatttgggcgcgggtcccaatgtcgcggcaatcagagagataatggaggagcgcttcggtcagaagggcaaggccatacggattgagcgtgttatttacaccggcaaggaaggcaaatcgagtcagggatgccccatagccaagtgggtggttcgccggagctcatccgaggagaagctgctgtgcctcgtgcgagagagagccgggcacacctgcgaggctgccgttatcgtgattttaattttagtatgggagggaattcccctaagcctcgcagacaagttgtattccgagctgactgagactcttaggaaatacgggactctaaccaacaggaggtgcgctttgaatgaggagcgtacctgtgcctgtcaggggctggacccagaaacgtgtggtgcctcattttcattcggctgtagctggtccatgtactacaatggttgcaagttcgcgcggtccaaaattccccggaaattcaagctgctgggagatgatcccaaagaggaagagaagcttgaatctcacttgcagaacctgtccaccttgatggccccgacctacaaaaagctggcacctgacgcttataataaccaaattgagtatgagcacagggccccagagtgccggttgggccttaaggagggccgcccattcagcggcgttacggcctgtctggacttctgcgcccatgcccacagggatttgcacaatatgcagaacgggtctacgctcgtgtgcacgctgacaagagaagataaccgcgaattcggtggaaagcccgaagatgagcagctgcacgtattaccactatataaggtgtccgatgtagatgagttcgggtccgtggaagcacaagaggagaagaaaagaagtggcgccattcaggtcctctcttccttcagacgaaaagtcaggatgctagcagagccagttaagacatgtaggcagcggaaactggaggcgaagaaggcagccgcggaaaagttaagttctttagagaatagctccaacaagaacgagaaagagaagtctgccccgtcccgcacaaagcagacagagaatgcctcccaggccaagcagctggctgaacttctgcggctgtcgggccctgtaatgcagcaatcgcagcagcctcagcccttgcaaaagcagccccctcagcctcagcagcagcagcgcccacagcagcagcaaccgcatcatccccaaaccgaaagcgtgaactcctattccgcctccggatccacaaatccatatatgcggcgacctaacccagtgtctccttatcctaattcgtcacatactagcgacatttatgggtctacatctcctatgaacttttattcaacatcctctcaagcagcaggcagctatctcaattccagtaacccaatgaacccataccccggtctgctcaaccaaaacacccagtatccgagctatcagtgcaacggaaacctttccgtcgacaactgctctccctatctgggcagttatagccctcaatcccagcccatggacctgtatcgctatccttcccaggaccctctgtcaaagctgtcattgcctcccattcataccctgtaccagccaaggtttggaaatagccaatcatttacctcaaagtaccttgggtatggaaaccagaacatgcaaggggacggttttagctcgtgcaccatccggcctaacgtgcaccacgtcggtaaattgccaccgtatccaacccacgaaatggatggccacttcatgggcgcgaccagcaggttgccgccaaatctgagcaacccaaacatggattataagaacggcgagcatcacagccctagccatatcatccacaattacagtgctgcacctggtatgtttaactcctctttacacgcgctgcatttgcagaataaagagaacgacatgctgtcacataccgcgaatggactgagcaagatgctccctgccctaaaccacgacaggactgcttgtgtgcaggggggtttacataagctcagcgatgccaatggtcaggaaaagcagccgctggccttggtgcagggggttgcaagcggagcagaggacaacgatgaggtgtggtcggattcagaacaaagctttctggaccccgacataggcggcgtggctgttgctcctacccacggttccatcctcatcgagtgtgccaagcgcgagctacacgcgaccacgcctttaaaaaacccaaatcgcaaccaccccacaaggataagcttggtcttctaccaacataaatcaatgaacgagcctaagcatggactagctctgtgggaagcaaagatggctgagaaagcgcgggaaaaagaggaagaatgcgaaaagtatggccccgactacgtgccacagaagtctcacgggaaaaaggtcaaacgggagccagcggagcctcacgagacttcagagcccacttacctgagattcattaaatcactcgcagaaagaacaatgtccgttaccacggactccacagtgacaacatctccttatgctttcacacgtgttaccggcccatataatcggtacatttag

SEQ ID NO: 26601 - DNA, 615 bp, Artificial Sequence
  Description of Artificial Sequence: Synthetic coding sequence
atggtgtgcggcggcttcgcctgcagcaagaactgcctgtgcgccttaaatctgctatacaccctggtgtcattattgctgatcggtattgcagcctggggaatcggttttgggctgataagctctctaagagttgtgggtgtggtgatcgccgtgggtattttcctgtttctgatcgcgctggtcggcttgattggcgccgtgaagcaccatcaagtgctgttatttttctacatgatcatcctcttactcgttttcatcgtgcaattctcagtttcatgcgcgtgcctggcgctgaaccaggagcagcaagggcagcttcttgaggtgggctggaacaacacagcctcagcccgaaacgatatacagcgcaatttgaactgctgtggattccggagcgtgaaccccaatgatacctgcttagcctcatgtgtgaaatctgatcatagctgctccccctgcgcgcctataataggagaatatgcaggggaagtactccgatttgtcggcgggatcggtttgttcttttccttcacggagattctgggcgtctggttaacctaccgataccgtaaccaaaaggatccccgcgctaacccctccgcgtttctctag

SEQ ID NO: 26602 - DNA, 738 bp, Artificial Sequence
  Description of Artificial Sequence: Synthetic coding sequence
atggccagccccagccggcggctgcagaccaagcccgtgatcacctgctttaaatcagtgctactcatctacacatttatcttctggattaccggtgtgatcctactcgccgtcggtatctgggggaaggtgtccttggagaattacttttctctcctgaatgaaaaggcaacaaatgtgccgttcgttctcatcgccacagggaccgttatcatcctgttgggcactttcggatgtttcgctacctgccgtgcatctgcttggatgttgaagctctacgcgatgttcttgacgctcgttttcctggtcgaacttgttgcagcaattgtgggttttgttttccgccacgaaatcaagaattccttcaagaataattacgaaaaggctctgaagcaatataacagtaccggtgattatcggagtcacgcggtcgataagattcagaataccttgcactgctgtggagtcacggactacagggattggaccgacaccaattattattctgagaaagggttcccaaaatcatgttgcaaactagaagactgcactcctcagagggatgctgacaaggtcaataacgaaggctgctttatcaaggtgatgaccatcatcgagtctgaaatgggagttgtggctgggatctcctttggcgttgcctgcttccaactgatcggaatattcctggcctattgtctttcaagggcaattaccaataaccagtacgagatagtgtag

SEQ ID NO: 26603 - DNA, 684 bp, Artificial Sequence
  Description of Artificial Sequence: Synthetic coding sequence
atggccagccccagccggcggctgcagaccaagcccgtgatcacctgtttcaaaagcgtgcttctgatctacacatttattttctggatcactggggtcattctgttggcggtcggtatttggggcaaagtgagcctagaaaactacttttcactgctgaacgagaaggcaactttcggttgtttcgccacttgtagagcctccgcttggatgttaaaactctacgcaatgttcctaacccttgtctttctagtcgagcttgtcgctgccattgtaggtttcgtattcagacatgagatcaaaaattcttttaaaaataactatgaaaaggccctgaagcagtacaattcaactggcgactatcgctctcacgccgtagataaaatacagaatacactgcactgctgtggtgtaaccgattaccgcgattggaccgatactaattactatagtgaaaaaggatttccgaagtcctgctgtaaactggaagactgtactccgcagagggacgccgacaaagtgaacaatgaggggtgttttatcaaggtcatgaccatcattgagtctgaaatgggagtggttgcaggaatttctttcggcgtggcttgcttccagctcattggaatatttctagcttactgtctttctcgggctatcaccaataaccaatacgaaatcgtttag

SEQ ID NO: 26604 - DNA, 669 bp, Artificial Sequence
  Description of Artificial Sequence: Synthetic coding sequence
atggagcggaagggcagcgccgccggcgccaagggcaaccccagccccccggccgcaggtgaaggccaaagaccccctcctcctctctgtgttccggggggcgggggaggtgccccggccagagggcaagtaggtgcagcggctgagcccgccgaattgatccgccgtgctcatgagttcaagagtcagggagcccaatgttacaaggataagaagttccgggaagctattggaaaataccatagggcactcctcgaactgaagggacttctcccaccgccgggcgagcgggagagggatagtaggccagcttcccctgccggggccctgaaacccgggcggctcagtgaggaacagtccaagactgtcgaggcaatcgaaattgactgttataatagtttggccgcctgtttgctccaggctgaacttgtcaactacgagcgagtgaaggaatactgcctgaaagtgctgaaaaaagaaggcgaaaatttcaaggccttgtatagatctggagtcgccttttaccacctgggagattatgacaaggctctgtactatttaaaggaagccaggactcaacagcctaccgatacaaatgtcattcggtacatacagctcaccgagatgaagctcagtaggtgcagccagagggaaaaagaagctatgtag

SEQ ID NO: 26605 - DNA, 258 bp, Artificial Sequence
  Description of Artificial Sequence: Synthetic coding sequence
atggtgaagcagatcgagagcaagaccgccttccaggaggccctggacgctgccggtgataagttggtcgtagttgacttttcagctacctggtgtggcccgtgtaaaatgataaaaccattttttcacgatgtagcatccgaatgtgaagtcaagtgcatgccgaccttccaatttttcaaaaagggacagaaggtgggcgagttttctggagccaacaaagaaaaattagaggctaccataaacgagctcgtttag

SEQ ID NO: 26606 - DNA, 318 bp, Artificial Sequence
  Description of Artificial Sequence: Synthetic coding sequence
atggtgaagcagatcgagagcaagaccgccttccaggaggccctggacgcggctggtgacaagctggtggtggtggacttctctgccacttggtgtggcccttgtaaaatgattaagcccttcttccactcgctcagcgagaaatatagcaacgtaatatttctggaggtcgatgtggatgattgtcaagatgttgcctctgagtgtgaagttaagtgtatgccaaccttccagtttttcaaaaaaggccaaaaagtgggggaattttccggcgcaaataaggagaagctggaggctacaataaatgagctggtatag

SEQ ID NO: 26607 - DNA, 1176 bp, Artificial Sequence
  Description of Artificial Sequence: Synthetic coding sequence
atggtgatgttcaagaagatcaagagcttcgaggtggtgttcaacgaccctgaaaaggtgtacggaagtggcgaaaaagtcgccggccgagtcatagtcgaggtgtgtgaggtgaccagggtcaaggctgtgcgaattctggcatgtggagtggccaaggttctatggatgcaaggctcccagcagtgtaagcagacctctgaatatctgcgctacgaggatacactgctgcttgaagaccagcccactggagagaacgaaatggtgattatgcgtcccggcaataaatacgagtacaagttcggctttgaactgcctcaggggcctctgggcacctctttcaaaggcaaatacggctgcgtagactattgggtgaaagcatttctcgacaggcctagtcagccaacacaggagactaagaaaaatttcgaggtcgtcgacctcgtggacgtcaatactcctgacttaatggcccctgtcagcgcaaagaaagaaaagaaagtcagctgtatgttcatcccagacgggcgggtttccgtgagcgcacgaatcgatcgaaaaggattctgcgagggagatgaaataagcatccatgcagacttcgagaacacatgcagccggatagttgtacctaaggccgcaatcgtcgctcgccatacttacttagctaatggtcagaccaaagtcctgacacaaaaacttagttccgttaggggcaatcacattataagtggtacatgcgcctcttggaggggcaaaagcctgcgcgtgcaaaaaatacgcccttcaattctcggatgtaacatccttcgggtggaatactcgctgctgatctacgtcagcgtcccgggctccaaaaaggtgattctggatctaccactggttattggatccaggtctgggctcagctcccgcacgagttccatggcttcacgcacctccagtgagatgtcctgggttgatttgaacatcccggataccccagaagcaccaccttgttacatggacgttatcccggaagaccaccggctcgaatcaccaactaccccacttcttgatgatatggacggcagccaggactccccaatctttatgtacgcccccgagtttaagtttatgcccccccccacttatactgaggtcgacccatgcattcttaacaacaacgtgcagtag

SEQ ID NO: 26608 - DNA, 1494 bp, Artificial Sequence
  Description of Artificial Sequence: Synthetic coding sequence
atgaacggccccgaggacctgcccaagagctacgactacgacctgatcatcatcggtggaggcagcggaggactggcggcagctaaggaggccgcccagtacggtaagaaggtaatggtccttgattttgtgacaccaacccctttagggacaagatggggactcggggggacctgtgtgaacgtggggtgcatccccaaaaaactgatgcaccaggccgcgctgctgggccaggccctgcaggattcccgaaactacggctggaaagtggaagagaccgttaagcacgattgggacagaatgatcgaagcagtgcagaatcatatcgggtcactgaattggggctatagggtagccctacgcgagaagaaggtcgtatatgaaaacgcatatgggcagtttataggcccacaccggatcaaggcaactaacaataaaggcaaagaaaagatttattccgcggagagattcctgatcgctacaggcgaaagacccagatacttgggaatcccaggcgacaaggaatattgtattagttcagacgacctctttagcctgccctattgtcccggtaagacactggttgttggggcaagctatgttgccttggagtgcgcaggatttctggccggcataggattggatgtcactgttatggtgagatccatcttgctccggggctttgatcaagacatggcgaataaaataggggagcatatggaggagcatggcataaaattcatccggcagttcgtgccaatcaaggtcgagcagatcgaggcaggcacacctggtagactgcgggtggtagcacagagcactaacagtgaggaaatcatagagggagagtataatactgttatgttggctattggccgggacgcttgtacgagaaaaataggcctggaaacggtgggggttaagatcaatgaaaagacaggtaagataccagtcaccgatgaagaacagactaatgtcccatacatttacgccattggtgacattctcgaggacaaagtcgaattaacacccgtggctatacaggcaggtagactgcttgcacagcgcctttacgcagggtcgaccgtcaaatgtgattacgagaacgtgccaaccactgtcttcacccctctggagtatggggcttgcggtttgagcgaggaaaaagctgttgaaaagtttggagaggaaaacatcgaggtctatcactcttacttctggcctctggagtggaccattccgagccgcgataacaacaaatgttatgcaaagataatttgcaacaccaaagataacgaacgcgtggtcggcttccacgtgctaggccctaatgcgggagaagtgacacaagggttcgctgccgccctgaagtgtgggctcactaaaaagcagcttgacagtacaattggtattcacccggtgtgcgccgaggtcttcacaactctttcagttaccaaaaggtctggagccagtatcttacaggcaggatgctag

SEQ ID NO: 26609 - DNA, 1746 bp, Artificial Sequence
  Description of Artificial Sequence: Synthetic coding sequence
atgcagcaggtgatgctgacctgcaagggcgtgaaccggggccacgcagtaccagctggcccagggaggaaaccccggccgagacgaagttcccgccttttagctggagagaaacatctgactaggtctgccctgttactttgccacaccgaggatggaagggcgttagaaggaaccctcagtgaattagctgcggagacagacctgccggttgtgttcgtgaagcaacgaaagatcggtggacatgggcctacactgaaagcttatcaggaggggcgcttgcagaaactcctgaagatgaatggtcccgaggacctccctaagtcctatgactacgacctcatcattataggaggcgggtccggtgggctcgctgccgcgaaggaagcagcccaatatggcaagaaagtgatggttctggattttgtgactccgacaccacttggcactcggtgggggttgggtggcacctgcgtgaatgtcggatgtatccctaaaaaactcatgcatcaagctgccttgttgggccaggccctgcaggacagtcgcaactacgggtggaaagtggaggagaccgtaaagcacgattgggaccggatgatcgaagctgttcagaatcatatcgggtcccttaactggggttatagagtcgctctcagagagaaaaaggtcgtgtacgagaatgcctatggccagtttataggcccacaccgcataaaggcaactaataacaagggtaaagaaaagatttacagcgcagaaagattcctgatagccacgggggagcgtccccgctacttgggcattccaggcgacaaggagtattgcatcagcagcgacgatttatttagcttaccatactgtcctggaaagacactagtcgtgggtgcttcatatgtggctctggagtgcgccgggtttctcgcaggaatcggattagacgtgaccgtgatggtgcggtcgatcctactgcgtggttttgaccaggatatggccaacaaaatcggtgagcatatggaagaacacggaatcaaatttattcgtcagtttgtgcccatcaaggttgaacagattgaagccggcacaccagggagacttcgggtggtggcacagagcaccaattcggaggaaatcattgaaggcgaatataataccgtcatgctagctatagggagggatgcatgcactcggaagatcgggttagagacagtgggcgtcaaaataaacgagaaaactgggaagatcccagtgacggacgaggagcagactaacgttccatacatctatgctatcggtgacattctggaagacaaggtcgagcttacgccagttgctatccaggctggtaggttacttgctcagcggttatatgctggatccaccgtaaagtgtgactacgagaacgttccaactaccgtgttcacacccctcgagtatggggcttgcggtctttcagaagagaaggcagtagaaaagtttggggaggaaaacatcgaagtatatcactcctatttctggcccctggagtggactataccctcccgtgacaacaacaagtgctatgctaaaatcatctgcaacaccaaggacaacgagagggttgtgggctttcacgtgcttggcccgaacgcaggggaagtaacccagggctttgccgcggccctgaaatgcggtctgacgaaaaaacaattagacagcactattggcatccatccagtttgcgccgagttttttagtttcatctag

SEQ ID NO: 26610 - DNA, 1650 bp, Artificial Sequence
  Description of Artificial Sequence: Synthetic coding sequence
atgagctgcgaggacggccgggccctggagggcaccctgagcgagctggcggccgaaaccgacttgccagttgtctttgtgaagcagagaaagatcggcggccacgggcctacactgaaagcttatcaggagggaagactccagaagctcctgaagatgaatgggcccgaggatctgcctaaatcttatgactacgaccttattattatcggcggtgggagcggtggactcgccgcggcgaaggaagccgctcagtatggcaaaaaagtgatggtgctcgatttcgtgacccctaccccgctcggaacaaggtgggggctaggcgggacttgcgtgaacgtcgggtgtatcccaaagaagctgatgcatcaggcggcgctgctgggacaggctttgcaggacagccgtaattacggatggaaggtagaagagaccgtgaaacatgactgggaccgcatgattgaagctgtacagaaccacatagggtcgctgaattggggttacagggtcgcccttagggagaagaaggtcgtgtacgaaaatgcctatggccagtttatagggccacaccgtatcaaagcaaccaataataagggaaaggagaagatctactcggctgagcgcttcctgattgcgaccggagagagaccccggtacctgggaataccaggtgataaggagtactgtattagctcggatgatttatttagccttccctattgtcccggcaagacacttgtagttggagccagctacgtagctctcgagtgcgctggctttctcgcaggaattgggttggatgtgacagtcatggtccgctctatcttgctccggggtttcgaccaggatatggccaataaaattggagaacacatggaagaacacgggatcaagtttattcggcagttcgtgcccatcaaggtcgaacagatcgaggccggcacacccggaagactgcgcgtggtagcacagtctactaactccgaagagattattgagggggaatacaacactgtcatgctggcgattgggcgcgatgcatgcaccaggaaaatcggtctggaaaccgtgggagtgaagattaacgagaaaacagggaagatacctgtcactgacgaggagcagaccaacgtgccttatatctacgccataggagacattctagaagataaggttgaactcaccccggtggcaatacaggcaggaaggctcctcgcacagagactttatgcaggcagtaccgtcaagtgtgattacgagaatgtgcctaccactgtatttacccctctggagtacggggcttgtgggctgagtgaagagaaggccgtggagaagttcggagaagaaaatattgaggtatatcattcctatttttggcccctcgagtggaccatcccatcaagggataataataagtgctatgcaaaaatcatatgtaacacaaaagacaatgaacgggttgtcggatttcacgtactgggacctaacgctggtgaagttacccagggattcgcagccgcactgaaatgcggtttgaccaagaaacaactcgacagtacaatcgggattcaccctgtttgtgctgaggtgttcacgactctgagtgtaactaaacgttctggcgccagcatcttgcaggctggctgttag

SEQ ID NO: 26611 - DNA, 1626 bp, Artificial Sequence
  Description of Artificial Sequence: Synthetic coding sequence
atgctgagccggctggtgctgaacagctgggcccaggccatcatccgaccaaggcctccaaaggtcctggggctgcaggtgactacattctctgaggcataccaggaggggcggctgcaaaaattacttaagatgaacggcccagaagatctgccaaaatcctacgactacgatttaattatcattgggggaggatccggaggactagccgccgccaaagaggccgctcagtacggcaaaaaagtgatggtgctagatttcgtgacccccactcccttaggaaccaggtggggtctgggagggacttgcgtgaatgtagggtgtattccgaagaaactcatgcaccaggcagccctcctgggccaggccctccaggatagcagaaactatggctggaaggtcgaggaaaccgtgaaacatgactgggatcgaatgatagaggccgtacagaatcacatagggtccttaaactggggctacagggtggctctgagagaaaagaaagtagtgtatgagaacgcttacggacagttcatcggtccacatcggattaaggccaccaataacaagggcaaggaaaagatttactctgcagagaggttcctgattgctacgggagaacggcccagatacttggggatccccggagacaaggagtactgcatttcctcagatgacctgttcagcctgccctactgccctggcaagaccttagttgtcggggcctcctacgtggcgctagagtgtgccggatttctcgccgggatcggcctggatgtcactgtgatggtccgcagtatcttactgcgaggctttgatcaggacatggctaacaaaataggcgagcatatggaggaacacggtatcaaattcatcagacagttcgtgccaattaaggtcgagcaaatagaagcagggacccctgggagactgcgcgtagtggcccagtccacaaattctgaggagataatagaaggagaatataacactgttatgttggcgattggcagagacgcatgcacccggaaaataggactggagaccgtcggagtcaagattaacgagaagaccggtaaaatcccagtcaccgacgaggaacaaaccaatgtaccttatatatacgccatcggggatattctcgaggataaagtggagctcacgcccgtggctatccaagcaggccgcctcctggcccagcgtttgtacgccgggagtaccgtcaaatgcgactacgagaacgtgccaacaaccgtgttcactcctctggagtatggagcctgtggcctgtccgaggaaaaagcggtggagaaattcggagaggaaaacattgaggtttaccatagctatttctggccattggagtggaccattccatccagagacaacaacaaatgctatgcaaagataatctgtaacacaaaggacaatgaaagggtcgtcgggttccacgtactggggccaaatgccggtgaggttactcaggggttcgccgcagcccttaagtgcgggcttacgaaaaagcagcttgactcaaccattggcatccaccctgtatgtgccgaggtgttcacgactctgtccgtcacaaagagaagtggtgcatctatactccaagctggttgctag

SEQ ID NO: 26612 - DNA, 1839 bp, Artificial Sequence
  Description of Artificial Sequence: Synthetic coding sequence
atgcccgtggacgactactggctgtgcctgcccgccagctgcgcccgccccttcgtgcaaacagtccgagtagttcagtcttgtccacactgctgttggttccctggggtgctgcctagtgtgcctgagccacttcgcatgcccgccatgttgcccaccgggagtcactcggctgtcctgcccccaagtcattgtagtaccgcccctccgtcaacctcccaagagccgtctagtagcgcagacccgaagctttgtttgagcccaccaacctctgattcaagacaggagcggaatgtccagttcggcctggcttatcaggagggacgcttacagaaactgctcaaaatgaatggcccagaggatcttcctaaatcttacgattacgatctcataatcatagggggaggctcagggggcctggctgccgctaaggaagctgctcagtacgggaagaaggtcatggtattggactttgttactcccacgcctctcggcactcgctgggggctgggggggacctgcgtgaacgtgggatgcattccaaagaagctgatgcatcaagctgcactgctcggccaggcccttcaggactccaggaactacggatggaaagttgaggagacagtgaagcacgactgggataggatgatcgaggccgtccaaaaccatatcgggagcctcaactggggttatagagttgctctgcgggaaaagaaagtggtgtacgaaaacgcctacgggcagtttataggaccccataggatcaaggcgacaaataacaagggcaaggaaaagatctattctgccgaacgctttctcatcgccacaggcgaaagaccaagatacctgggcatccccggagacaaggagtattgtatctcgtctgatgacctgtttagcctaccatattgtcctggcaagaccctggtagttggcgctagctacgtggcattagaatgtgcgggcttcctggcgggaatcggcttggatgtcactgtgatggtacgctcaattctcctgaggggcttcgatcaggacatggccaacaaaattggcgagcacatggaagagcacggaatcaaattcatccgtcagttcgtaccgatcaaggtggagcaaatcgaggccggtactcccggacggctgagggtggtggcgcagtcaacgaatagcgaagagatcatcgaaggagagtacaacaccgtgatgcttgccattggtagagatgcgtgtacaaggaagattggcctcgaaactgtgggcgtgaagattaacgagaagacaggtaagattccagtcactgacgaggagcaaacgaacgtgccctacatttatgcaatcggcgatatcctggaagataaggttgaactgacacccgtagctatccaggctgggcgtttactggctcaaagactgtacgcgggcagcacagtgaaatgcgactacgagaacgtacctaccaccgtctttacacccctggagtacggagcttgtggcctttccgaagagaaagccgtggaaaagttcggggaagagaacattgaggtttaccattcctacttctggcctctcgagtggacaattccctcgcgagacaacaataagtgttatgccaagattatctgcaatacgaaggacaacgagcgtgtagtgggattccatgtgttagggccaaatgccggcgaggttacacaggggttcgccgctgctctgaaatgcggcttgactaaaaagcagctggattctacaattgggatacatcccgtgtgcgccgaagttttcacaacgctctccgtcactaagcgttccggcgcctcaattcttcaggcaggatgttag

SEQ ID NO: 26613 - DNA, 1944 bp, Artificial Sequence
  Description of Artificial Sequence: Synthetic coding sequence
atgggctgcgccgagggcaaggccgtggccgccgccgcccccaccgagttgcagaccaaaggtaaaaatggagatggccgccggcggtccgccaaagaccaccaccctggaaagaccctgcccgagaacccagccgggttcactagcaccgccacagccgacagcagagccctgctccaggcctatattgacgggcattctgtagttatctttagccggtctacctgcactcggtgcactgaggtgaagaagttgttcaagtccctttgcgtgccctactttgttcttgagcttgatcagaccgaagacggacgtgcgctggagggtacgctctccgagctggctgccgaaacagatctgcccgtcgtctttgtgaagcagagaaagatcggtggccatggacccactttgaaagcttaccaagagggccgactgcagaagctcctaaagatgaacggtcccgaggacctacccaagtcgtatgactacgacttgattataattgggggcggatccggcggcctcgctgcagccaaagaggctgcccaatatgggaaaaaggtcatggtcctggactttgtaactcctaccccacttggtacacgctggggcctgggcggaacgtgcgtaaacgtcggatgtatccctaagaaactgatgcatcaggccgcgctgttagggcaagctctgcaggactcacgaaactatgggtggaaggtcgaggagaccgtcaaacacgactgggaccggatgattgaagcggtccagaatcacattgggtccctgaactggggttatcgggtcgcactaagggagaagaaagtggtttatgagaacgcatacggtcagttcataggtcctcataggatcaaggcaaccaacaataagggcaaggagaaaatctactctgcggaacgattcctaattgccactggcgagcggcccaggtatctcggaatcccaggcgataaagagtactgtatctcttctgatgacctcttttctctcccatactgccctggcaaaactctagtggtgggggctagctacgttgcccttgaatgtgccggatttctggccggaatcggccttgatgtcaccgtgatggtgaggtcaatcctactccggggatttgaccaggatatggctaacaagatcggagaacacatggaagagcatggcatcaaattcataaggcagtttgttcccattaaagtggagcaaatcgaagcagggactcccgggcgactccgtgtggttgcccagtcaacaaactctgaggaaattatagaaggtgaatataacacagtcatgcttgccatcggcagagatgcgtgcaccaggaaaataggcctcgaaacagtgggggtgaaaattaacgaaaaaactggaaagatccccgtaacagatgaggagcagactaatgttccatacatttatgctatcggagacattctggaagacaaggtggaactcacccccgtggctattcaggcgggacgtcttcttgcgcagcgtctctacgccggctctacagtgaaatgcgactatgagaacgtcccaaccactgtatttaccccgctggaatacggagcatgcggactctccgaagagaaggcagtggagaaattcggggaggagaacatcgaggtgtaccactcatacttttggcctctggagtggaccatcccatcgagagacaataacaaatgctatgctaagatcatttgtaacactaaggacaacgagcgcgtggtgggctttcacgtgctgggccccaatgctggagaggttacccagggattcgccgcagctctcaaatgcggtttgacaaaaaaacagcttgactctaccattggtatccaccccgtgtgcgcagaggtattcaccacattgtcggtcacaaagcgatcaggcgcatcaatcctgcaggccggttgctag

SEQ ID NO: 26614 - DNA, 1500 bp, Artificial Sequence
  Description of Artificial Sequence: Synthetic coding sequence
atgaacggccccgaggacctgcccaagagctacgactacgacctgattattatcgggggtggatccggggggctggccgccgcaaaagaagctgctcagtacgggaagaaagtgatggtgctggacttcgtgacacccaccccactgggcacccgttggggcctaggtggtacctgcgtaaatgtgggctgtattcctaagaaattgatgcaccaagccgcgttactcgggcaggctctgcaggattcacggaattacggatggaaggtggaggaaaccgttaaacacgattgggaccgaatgattgaagctgtgcaaaaccacatcggcagcctgaattggggctaccgggtcgccctaagggagaagaaagtagtttacgaaaatgcttacggtcagttcattggacctcaccgaatcaaagccaccaataataagggcaaagagaaaatctattctgcagagaggtttctcatcgccacaggtgaaaggccccgctacctggggattccgggcgataaggaatactgtatctcctctgatgatttgttctcccttccatattgcccaggtaagaccctggtggtaggggcgagctatgtggcacttgagtgcgccggatttctggccggcatcggtctggacgttacggtgatggtacggtctattttactgcggggctttgatcaggacatggcaaataaaatcggcgagcatatggaggagcatggtattaaattcatccgccagtttgtgcctattaaggttgagcagattgaggccggaaccccaggcaggctgcgggtcgtagcacaaagcaccaactctgaagaaatcatcgagggcgaatataacaccgtcatgctggctattggaagggacgcctgcactagaaagattggccttgaaaccgtgggcgtgaaaataaacgagaaaacgggcaaaatcccggtgaccgacgaggagcagaccaacgtaccatacatctatgcaatcggtgatattctggaagacaaggttgaacttaccccagtggcaatccaggcagggcggctcctagctcaacgcctatacgccggcagcactgtcaagtgcgattatgagaacgtgccaacaactgtgttcaccccactcgaatacggcgcctgcgggctgagcgaagaaaaagccgttgagaagtttggggaagaaaacattgaagtctaccacagttatttttggccactggaatggacaatcccttcccgtgataacaacaaatgctacgctaaaattatatgcaatactaaagacaacgaaagagtggtggggttccatgtactcggccctaatgctggagaagtcactcaaggttttgccgctgcgctgaagtgcgggcttaccaagaaacagctggatagcacgatcggtattcaccccgtgtgtgccgaggtcttcaccaccctgagtgtgacaaaaaggtcaggtgctagcatcctccaggcaggatgtugaggttag

SEQ ID NO: 26615 - DNA, 1500 bp, Artificial Sequence
  Description of Artificial Sequence: Synthetic coding sequence
atgaacggccccgaggacctgcccaagagctacgactacgacctgataattatcggtggaggctccggcggcctagctgccgcaaaggaagcagcacagtatggcaagaaagtcatggtgttggacttcgttacgcctacgcccttaggtactcggtggggactgggggggacgtgcgttaacgttgggtgtattcctaagaagctaatgcatcaggctgccctgctgggccaagcccttcaggactctagaaactatggttggaaagttgaagagaccgtcaagcacgactgggatcgtatgattgaggccgtgcagaatcacatcggatcactgaattggggctaccgcgtagcactcagggagaagaaggttgtgtatgaaaacgcttacgggcagttcattggtccccatagaattaaagccaccaacaacaaagggaaggaaaaaatttactccgccgagcgtttcctgatcgctaccggggagcggccccggtatctggggatccccggcgataaggaatattgcatttcatccgatgatctgttcagtctcccatactgcccaggaaaaactcttgtggtcggtgcatcatacgtggccctggagtgcgcgggctttctagcagggatcgggttagacgtgaccgtgatggttcgttcaatattgctccgaggttttgaccaagacatggccaacaagattggagagcatatggaggagcacggaattaagttcatccgccagttcgtcccaatcaaggtggagcagatcgaggcgggcacacccgggagactccgagtggtggcgcagtcaactaactcggaggaaatcatcgaaggcgaatacaacactgttatgctggcaatcggccgcgacgcttgcactaggaaaatcggtctcgagacagtaggcgttaagattaacgagaaaacaggaaagattcctgtgacagatgaggagcagaccaatgtgccctacatatacgctattggcgacattctggaggacaaggttgagctcacccctgtggcaattcaagccggacgacttctggcccagcgcctgtatgctggctccactgtcaagtgtgactatgagaacgtgcctaccacggtgttcacccccctcgaatacggcgcttgcgggctatcggaggagaaggcagtagaaaagtttggcgaggaaaacattgaagtgtatcactcatatttctggccattagaatggacaattccctcaagagacaataacaaatgttacgcaaagatcatctgcaacaccaaagataatgagcgggtcgttggcttccacgttctaggtccgaatgctggcgaggtgacacagggtttcgccgccgccctgaaatgcggccttacaaaaaagcaactggatagtaccattggaattcaccctgtctgcgccgaggtgtttacaactctgagtgtcaccaagaggtcgggcgcttctatcctccaggcaggctgcugaggctag

SEQ ID NO: 26616 - DNA, 1950 bp, Artificial Sequence
  Description of Artificial Sequence: Synthetic coding sequence
atgggctgcgccgagggcaaggccgtggccgccgccgcccccaccgagctgcagactaaaggcaaaaacggtgacggacgtcggcgaagtgccaaggatcaccatcccggtaagaccttgcctgagaatcctgccggatttacgtccacagccaccgcagactctcgggctctcctgcaagcctatatcgacggccactcagtggtgatcttcagcagatcaacctgcacacgctgcacagaggtgaagaagctatttaaatctctatgcgtcccctatttcgtgctcgagctggatcaaacagaggatgggcgcgctctcgagggtaccctatctgagcttgccgctgaaaccgacctgcctgtggtgttcgtgaaacaaaggaagatcggtggccacgggcccactcttaaagcttaccaggagggcagactccagaagttgttgaaaatgaacggccctgaggatctgcctaagtcttacgactacgacctcattattataggcggaggctcaggggggctcgccgccgctaaggaggccgctcaatacggaaaaaaagtgatggtgctggactttgtcacccctacgcctctgggcacacggtgggggctcggaggcacatgtgtcaacgttggttgcattccaaaaaagcttatgcaccaagccgccctgctgggtcaagctcttcaggatagcagaaattatggttggaaggtagaggagacagtgaagcacgattgggaccggatgatcgaagcagtgcagaaccacataggctctctgaattggggttaccgcgtagctttgagggaaaaaaaggtggtatacgagaacgcctacggccagtttatcgggccccatcgaattaaagctacaaacaacaagggaaaagaaaaaatctacagcgcggaacggttcctgatcgccacaggggaacggccccgatacctaggtatccctggagacaaagaatactgcatttcttccgatgatttgttctctctaccgtattgtcctgggaagactctggtcgtgggcgctagctatgtggccctggagtgcgcagggttcctggctggaattggcctcgatgtgacagttatggtgagaagtattctgttgaggggatttgaccaggacatggccaataaaatcggcgagcatatggaggagcacggtatcaagttcataagacaattcgtcccgattaaggtggagcaaatagaagcgggcacaccagggagactccgcgttgtagcgcagtcaaccaactccgaagagatcatcgagggagaatacaataccgttatgctggcgataggaagagatgcctgcactcgcaaaatcggcctggaaaccgtgggggtcaagatcaacgagaagactgggaaaattcccgtgaccgacgaagaacagaccaatgtgccatacatatacgctatcggcgatatacttgaagacaaggtggagctgactcctgtcgcaatacaggctggtaggctgctcgctcagcggctttacgcggggtcaaccgtaaagtgcgactatgagaatgtccctacaacagtctttacaccactggaatacggggcctgcgggctgagcgaggagaaggccgttgagaagtttggcgaagagaatattgaagtgtaccacagctacttctggccactagagtggacaatcccgtcgagagacaacaacaagtgttacgccaagatcatctgtaacactaaggataatgagcgagttgtgggttttcacgtcttgggacccaatgccggggaggttacccaaggattcgcagcagcactcaagtgcggcctcacgaagaagcagcttgatagcaccatcggtatccacccagtttgcgcagaggtcttcacgaccttgtccgttaccaagcgatccggcgcatcaattctccaggccggatgtugaggttag

SEQ ID NO: 26617 - DNA, 213 bp, Artificial Sequence
  Description of Artificial Sequence: Synthetic coding sequence
atgaacggccccgaggacctgcccaagagctacgactacgacctgatcataatcggcgggggaagcggtggcttagcggccgccaaagaggccgctcaatacggtaaaaaggtcatggtcctcgattttgtaaccccaacgcctctgggaacccgctggggtctgggcgggacctgcgttaatgtggggtgtatcccgaagaagttgatgtag

SEQ ID NO: 26618 - DNA, 1632 bp, Artificial Sequence
  Description of Artificial Sequence: Synthetic coding sequence
atgctgagccggctggtgctgaacagctgggcccaggccatcatcaggccaagaccaccaaaagtgctaggcctgcaggtgacaacattcagcgaagcctaccaggagggtcgtctgcaaaagctccttaagatgaacgggcccgaggacctgcccaagagttatgattacgacttgatcatcataggcggcggaagcggagggctggcagccgctaaggaggccgcacagtacggcaaaaaggttatggtgctggatttcgtgaccccaacgcctctgggcactcgatggggtcttggcggtacgtgcgtaaacgtgggctgtattccgaagaagctgatgcaccaggccgctctgctgggacaagccctgcaggatagtcggaattacggatggaaagtagaggagactgttaagcatgattgggatcgaatgattgaggcggtgcaaaatcatattgggagtcttaactggggatatagagtggcccttcgcgagaagaaggtcgtgtatgagaacgcttacggccagttcataggaccacaccgcattaaggcgaccaacaacaaagggaaagagaagatctattcagctgagcgatttctgatcgctactggagaacgaccccggtatttgggtatccccggcgataaggagtactgcatttcctccgacgacctgttctctctcccatactgtcccggaaagacccttgtggtgggtgccagctatgtcgccctagagtgcgcaggattccttgcgggcatagggctggacgtaactgttatggtacgctctatactgctccgcggctttgatcaagacatggctaataagatcggagaacatatggaggaacacgggattaaattcatacgccagttcgtgccaattaaagtggagcaaatagaggctgggactcccgggaggctgcgcgttgttgcccagtcaacaaactctgaagaaatcatagagggggaatacaacacggtgatgctggccatcgggcgcgatgcctgtactcgtaagatcgggctggagaccgttggcgtgaagattaacgagaagacaggaaagattccggtcaccgacgaagaacagactaatgtgccttacatctatgccatcggagatatcctcgaagataaggtggagttgacccccgtagctattcaggccgggcgactactggcccagcgtttatacgctgggagcacggtgaaatgcgattacgaaaacgtgcccacaactgttttcacccccctggaatacggcgcatgcgggctgtctgaagagaaagccgtggaaaagttcggagaagaaaacattgaggtttatcatagttatttctggccgctcgagtggacaataccgagcagggataacaacaaatgttatgctaagattatctgcaatacaaaggacaacgagcgagtggtgggctttcacgtgcttggaccgaacgccggagaagtcacccaggggttcgccgccgcactaaaatgtggtctgacaaagaagcaacttgattccactatcggaattcatccagtatgtgctgaagtttttaccacactgtcagtgaccaagaggtccggggcctccatcctgcaggcgggctgtugaggatag

SEQ ID NO: 26619 - DNA, 315 bp, Artificial Sequence
  Description of Artificial Sequence: Synthetic coding sequence
atgaacggccccgaggacctgcccaagagctacgactacgacctgataataatcgggggcgggtccggaggcctcgcggcggccaaggaagctgctcagtatgggaaaaaagtgatggtgctcgacttcgttacccccactccattaggaacaaggtgggggctgggcggtacctgtgtcaacgtgggatgcatcccgaagaaactaatgcaccaggcagctctgctggggcaggctttgcaggattcccgaaattacggctggaaggtggaagagacagtgaaacacgattgggacagaatgatcgaagcttag

SEQ ID NO: 26620 - DNA, 1656 bp, Artificial Sequence
  Description of Artificial Sequence: Synthetic coding sequence
atgagctgcgaggacggccgggccctggagggcaccctgagcgagctcgctgcggaaacggatctgcccgtggtgttcgtcaagcaacgcaagatagggggccacgggccaactcttaaagcataccaggagggaaggctacagaaactgcttaagatgaacggcccagaggatctccctaaaagctatgactacgacctgattataatcggcggcggatcaggcggccttgcagccgcgaaggaagctgcccagtacgggaaaaaggtgatggtccttgactttgttactcccacccctcttgggactagatggggtcttggtgggacttgcgttaacgttggttgtatccctaagaaactgatgcatcaggcagcattgctgggacaggcactgcaagattcacgaaactatggttggaaggttgaggaaaccgtcaaacacgactgggaccggatgattgaggcggttcaaaatcatatcgggagcctcaattggggctaccgggtcgccctgcgggagaaaaaagtagtgtacgagaacgcttatggacagttcatcggtccgcaccgcatcaaagccacaaataataaggggaaagagaagatctacagtgccgaaagatttctgatcgccacgggagaacggccacgctatttaggtattcccggcgacaaggagtattgcatctcgagcgacgacctgttctccttgccatactgtcccggaaagacgctcgttgtcggtgcgtcatatgtcgcactggagtgcgctggattcttggctggtatcggcctggatgttacagttatggtcagatcaatcctcctcagggggttcgatcaggatatggcgaacaaaattggggagcatatggaggagcatggcatcaaattcatcagacagttcgtccccatcaaggtcgaacagatcgaggccggcacacccggacgtttacgcgtcgttgctcaatctacaaactcagaagagatcattgagggcgagtacaacaccgtcatgcttgccatcgggcgcgatgcttgcaccaggaagatcggcctcgagaccgtgggggttaagatcaatgagaagacaggcaagattcccgtgaccgacgaagaacagacgaatgtcccatacatttatgcaatcggcgacattcttgaagataaggtcgagctgacgccagtagcaattcaggcagggaggctcctggctcagagattatatgctgggtcgactgtaaaatgtgactatgaaaacgtgcccactacagtgtttacccccctcgagtacggcgcatgcggcctgagtgaggagaaagccgtggagaagtttggtgaagaaaacatagaagtgtatcactcatacttctggcctttggaatggacaattccatctagggataacaataagtgttatgctaaaattatttgcaataccaaagacaatgaacgcgtcgtgggctttcacgtgcttggacccaacgccggagaggttactcaagggttcgcggccgcactgaagtgcgggctgaccaagaaacagctggactcaactattggcatccatcccgtctgtgctgaagtgttcactacattgtccgtcaccaaacgaagcggagcgtccattctgcaggcaggttgcugaggatag

SEQ ID NO: 26621 - DNA, 1707 bp, Artificial Sequence
  Description of Artificial Sequence: Synthetic coding sequence
atgcccgccatgctgcccaccggcagccacagcgccgtgctgcccccaagtcactgcagcaccgcgccgccttcgacatcgcaagagccaagcagttcggccgatccaaaactttgtttgagcccccctacatctgatagcaggcaggaacgtaacgtgcagtttggactggcataccaggaaggtaggcttcaaaagttattgaagatgaacggacctgaagacctgcctaagagctatgattacgatcttatcattattggcggcgggtcaggaggcttggccgcagcgaaggaggccgcccaatatggcaagaaagtcatggtcttggacttcgttacaccaactcctctgggaaccaggtggggcctcggcggtacctgcgtaaatgtcggctgcattcctaagaagctgatgcaccaggcagcacttctcggacaggccctgcaggattctcgtaattatggttggaaggtggaagagacggtcaaacacgactgggaccgaatgatcgaggctgtccagaaccacattggaagcttgaactggggctatcgggtggcattgcgggagaaaaaggtggtgtatgaaaacgcttatggccaatttattggaccccaccggatcaaggcaaccaacaataaggggaaggagaaaatatacagcgcagaaaggtttttgatcgccactggagaaagaccccggtatctgggaattcccggcgacaaggagtattgtattagttccgacgaccttttctccctgccctactgtcccggcaaaacactggttgtgggagcctcatacgtggcactggagtgcgccggattcttggccggaatagggctggatgtcacggttatggtgaggtctatcctgctgcggggtttcgaccaggacatggccaacaaaataggggagcacatggaggagcatggaataaagttcattcgacagttcgtacccatcaaagtggagcagatagaggccggcacgccaggcagattacgggtggtggcccaatctactaacagcgaggaaattatcgaaggagagtacaataccgtaatgctagctattggccgggacgcatgtaccagaaagataggactggaaaccgtgggcgtaaagattaacgagaagacaggtaaaatcccagtgactgacgaggaacaaacaaacgtcccttatatctatgcaattggtgatattctcgaagacaaggtggagcttaccccagttgctatccaggccggtcgcctgctggcccagcgtctgtacgccggctccaccgttaagtgcgattacgaaaatgtgccgacaacagtgttcacacccctcgagtatggagcctgtgggttgtcagaggagaaagccgttgagaaattcggggaggagaacatcgaggtgtaccacagttacttttggcctctggaatggaccattccatcaagggacaataacaagtgctatgcaaagatcatatgcaacaccaaagacaatgagagagtagtaggattccacgtcctgggtcctaacgccggagaggtcacccagggcttcgctgcggccctcaaatgcggcctgacaaaaaagcagctcgattctaccataggcatacacccggtgtgtgcggaggtgttcaccacactgtccgtcacgaaacgctcgggggcctctatcttgcaagcaggttgcugaggctag

SEQ ID NO: 26622 - DNA, 528 bp, Artificial Sequence
  Description of Artificial Sequence: Synthetic coding sequence
atgaacggccccgaggacctgcccaagagctacgactacgacctgattatcatcggcggcggatccggaggcttagctgcagccaaggaagcagcccagtacgggaagaaagtgatggtactagattttgtaacccccacccctcttggtaccagatgggggctgggtggaacatgcgtgaacgtcggctgtattcccaaaaaactcatgcaccaggcagcactgttaggccaggccctgcaggattcaagaaattacggctggaaggtggaagagacggtgaaacacgattgggatcgaatgatcgaggccgtgcaaaatcatatcgggagtttaaactggggttacagagtggccctgcgggagaagaaggtagtctatgaaaatgcatacggacagtttattggacctcatcgcatcaaagccacaaacaataagggcaaggagaaaatttattcggccgagcgcttccttatcgcaacaggcgagcggccacgctacctggggataccaggagacaaggaatag

SEQ ID NO: 26623 - DNA, 162 bp, Artificial Sequence
  Description of Artificial Sequence: Synthetic coding sequence
atgaacggccccgaggacctgcccaagagctacgactacgacctgattatcattggtggcggcagcggcgggcttgcggcagccaaggaagcggcacagtacggcaagaaggtgatggtgctcgacttcgtcaccccaacccccctgggcacccgctggtag

SEQ ID NO: 26624 - DNA, 219 bp, Artificial Sequence
  Description of Artificial Sequence: Synthetic coding sequence
atgaacggccccgaggacctgcccaagagctacgactacgacctgattataattggaggggggtctggcggactggccgccgccaaggaagccgctcagtacgggaaaaaggtgatggtgctagacttcgtcacaccaaccccacttggaacccgttggggcctgggaggcacctgtgtaaacgtcggctgcattcctaaaaagcttatgcaccagtag

SEQ ID NO: 26625 - DNA, 420 bp, Artificial Sequence
  Description of Artificial Sequence: Synthetic coding sequence
atgctgagccggctggtgctgaacagctgggcccaggccatcatccggcctcgcccgcctaaagttttaggactccaggttaccacattctcagaagcatatcaggagggccggttgcagaagcttctaaagatgaacgggccggaggacctgcctaaaagctacgactacgacctgatcatcattgggggcggttccggcggcctggccgccgccaaagaggcggcccaatacggtaaaaaagtgatggtgttggattttgtgacccctacccccttgggcacacgttgggggttggggggaacctgtgtcaacgtggggtgtattccaaagaagttgatgcatcaggcagccctcctcggccaagcactgcaggactcccggaattacggatggaaggtcgaagagactggtatgtag

SEQ ID NO: 26626 - DNA, 1380 bp, Artificial Sequence
  Description of Artificial Sequence: Synthetic coding sequence
atggtgctggacttcgtgacccccacccccctgggcacccggtggggactgggcgggacttgcgtcaatgtgggctgtatccctaaaaagttgatgcatcaggcggcactgctcgggcaggcattgcaggattcccggaactatggctggaaggtggaggaaacagtgaagcacgattgggacaggatgatcgaagccgtccaaaaccacatcggttccctgaattgggggtacagagttgctctccgcgaaaaaaaggtagtgtatgagaacgcctacggccaatttatcggtccacaccgaattaaagctaccaacaacaagggtaaggagaaaatttactcggccgagaggttcctgattgctacgggtgaaaggcctaggtacctgggtatccccggcgacaaagagtactgcataagctccgacgatcttttctccctaccgtattgtcccggcaaaacccttgttgtgggagcttcctacgtcgccctggagtgtgcgggctttttggcaggaattggcctagacgtaacagtaatggtgcgcagtatcctcctgcggggcttcgaccaggatatggccaacaagattggcgagcatatggaggagcacgggatcaagttcattcgacagttcgtgcctatcaaggtggaacagatcgaggctggcacccccggcagactgcgcgtggtggcccagtccacaaacagcgaggagatcattgaaggtgaatataatacagtcatgctggccattggcagggatgcttgcaccaggaagattggcctcgaaactgtcggggtgaagattaatgagaaaacaggcaagattcctgtgactgatgaagaacagaccaatgtgccttacatctatgccatcggagatatcctggaggacaaggtggaacttacacctgtcgctattcaggctggccggttattagctcagcggctgtatgcagggtcaactgtgaaatgcgattatgagaacgtgccgacaacggtgtttactcctctcgagtatggagcctgtggcctctccgaagagaaggcagtggaaaagtttggggaagagaatattgaggtatatcacagttacttttggccgctcgagtggacaattccttctagggataacaacaagtgctacgccaagattatctgcaatactaaggacaatgagcgagtcgtgggctttcatgtcttaggacctaacgcgggggaggtgacacagggctttgctgcagccttaaaatgtggacttacaaaaaaacagctcgacagtaccatcggcattcacccagtttgtgccgaggtctttactactctctcggtgaccaaacgcagtggcgcctcgatactgcaagctggatgctag

SEQ ID NO: 26627 - DNA, 1644 bp, Artificial Sequence
  Description of Artificial Sequence: Synthetic coding sequence
atggaggacggccgggccctggagggcaccctgagcgagctggccgccgagactgacctgcccgttgtctttgtcaagcagcgcaagataggaggacacggccccactctgaaagcctatcaggagggaagactccagaaactgctgaagatgaatgggcccgaggacctccccaagagctatgactatgacttaatcatcatcggagggggctcaggcggccttgcagccgccaaggaggctgcacagtacggaaagaaggttatggttctcgacttcgtcacccccactccgttgggcactcggtggggattgggaggaacctgtgtgaacgtgggctgcatacccaagaagctcatgcaccaagctgcccttctgggacaggcacttcaggactcccgaaattacggttggaaggtggaggaaactgtgaaacatgattgggacaggatgattgaggccgtacagaaccacattggcagcctaaattgggggtaccgagtggctctaagagaaaagaaagtagtgtacgagaacgcatacggtcagttcatcggccctcatcgaatcaaagccacaaacaacaagggtaaggagaagatttattccgccgaacgcttccttatcgccaccggggagcggcctagatacttaggcatcccaggtgacaaggagtattgcatcagctcagacgatctttttagtctgccttattgccctggcaagacattggtggtgggggcctcctacgtcgcactagagtgcgcaggatttcttgccggcatcggtctcgatgtgactgttatggttcgttcgatcttattgaggggatttgaccaggatatggcgaacaagattggagagcacatggaagaacacggcatcaaatttataaggcaattcgttccaattaaggttgagcaaattgaagccggtactcccgggcgtctgagagtagtcgcccaatccaccaactccgaggagatcatcgagggggaatataatactgtcatgctggccattggtagggacgcgtgcacaaggaagatagggctggaaacggttggagttaagatcaacgaaaaaacaggaaagatccccgtgaccgatgaggaacagactaacgtcccgtacatctacgccattggtgacatactggaagacaaggtggaactgaccccagttgccattcaggccgggaggctgctcgcccagaggctatacgctgggtccactgtgaagtgtgactacgagaacgttccgaccactgtgttcaccccgctggagtatggcgcatgtggtttgtccgaagagaaggctgtcgagaaatttggcgaagaaaacatcgaagtttaccattcttacttttggccactagaatggaccatcccatccagagataataacaagtgttatgctaagattatttgtaatacgaaggataacgagcgagtggtcgggtttcacgtgctagggcccaacgctggggaggtcacacagggattcgccgctgctctaaaatgtggcttgaccaaaaaacagctggattccacgatcgggattcacccggtgtgcgccgaagtatttacaaccttaagcgtcaccaaaaggagtggcgccagtatcctgcaggctgggtgttag

SEQ ID NO: 26628 - DNA, 945 bp, Artificial Sequence
  Description of Artificial Sequence: Synthetic coding sequence
atgggcagccaggccctgccccccggccccatgcagaccctgatcttcttcgatatggaggccacgggcctgccattttctcaacccaaagtcactgagttgtgtcttttagccgtgcatcgatgtgctttagagtccccgccaacatcacagggcccacctccaacagtccccccccctcccagggtggtggataaattatcactctgcgtggcccccggtaaggcatgctctcccgccgcctccgaaatcacaggactgagcaccgctgtgctcgctgcccatggccggcagtgttttgacgataacctggctaacctcctgcttgcctttcttaggcgccaacctcagccttggtgcctggtggcgcataatggagatcgctacgactttccgctcctgcaggccgagctcgcgatgcttggacttacgtcggctctggatggagccttttgcgttgactctattactgccctgaaggctctggaacgagcttcttccccctccgaacatggaccccgcaagtcatattcacttgggtcaatctatactagactgtatggccagtctccccccgattcccacacagcggagggagatgtgctggcgttgctgtccatctgtcagtggcgaccacaggctctcctacggtgggtggatgcccatgctagacctttcggcacaatcagaccaatgtatggcgtgaccgcctctgcccgaactaaacctcgacccagcgctgttacaacaaccgcccacctggcaacaacacggaatacttctccctcattaggcgagtcaagagggaccaaagacctgccacccgtgaaagacccgggcgctctatctcgggagggactactggctccactgggtctgctggctatcctcaccctggctgtcgctaccctgtatggactatctcttgctactcctggagaatag

SEQ ID NO: 26629 - DNA, 1110 bp, Artificial Sequence
  Description of Artificial Sequence: Synthetic coding sequence
atgggccccggcgcccggcggcagggccggatcgtgcagggccggccagaaatgtgtttttgccccccaccaacgccgttgcctcctctgagaattctcacccttggaacccatactcccacaccttgcagcagcccgggcagcgccgcgggaacctacccaactatgggcagccaggccctgccccccggtccaatgcagaccctcatctttttcgatatggaagctactggccttccattctcccagcccaaagtgacagaactctgtctgctggccgtgcataggtgcgccttggagtcccctcccaccagccagggccccccaccaactgtgccaccaccgccgcgcgttgtggataaactgagcctgtgcgtggcgcctggcaaagcctgcagtccagcggcctcagaaataacaggactcagtacagcggttctggcagcccatggcaggcagtgctttgacgataacctggcaaatcttcttttagcttttctgcgtagacagcctcagccgtggtgcctggtggctcacaacggcgatcggtacgactttcccctcttgcaagccgagttggccatgctggggttaacctccgctctagatggagcgttctgtgtcgattccattactgcactcaaggctctggagcgcgctagcagtccttctgagcatggtccaagaaaaagttattctctgggatctatttatacgcgactctatggtcagtcgccacccgattcacatacggcagagggcgatgtactcgctctgttgtcaatctgccagtggagaccccaagccttgctaaggtgggtggatgcccatgcacgcccctttgggaccattcgaccaatgtacggcgtgactgcctcagccagaactaaaccccgaccatccgccgtcacaaccaccgcccacctggccacgaccaggaacactagcccctctctgggggagtcccggggcacaaaggatttaccccccgttaaagatcccggtgccctctcccgtgaaggcttgctggcccctctgggactcctcgccattctgacattggccgtcgctacactctatggactctctttagctacgcctggagagtag

SEQ ID NO: 26630 - DNA, 528 bp, Artificial Sequence
  Description of Artificial Sequence: Synthetic coding sequence
atgctgggcctgaccagcgccctggacggcgccttctgcgtggactcaattaccgcactcaaagctctagagagggcatcctccccgtctgagcatggaccaaggaaaagctattctttagggtcaatatatacaagactgtatgggcagtcccccccggactcccacactgcggagggcgatgtgctagcccttctcagtatctgccagtggaggccacaagccctgctgaggtgggtagacgcccatgctagaccattcggaaccatccggcctatgtatggagtcacagcaagcgccagaacgaagccccgtccctctgccgtaaccaccactgcccacctggctactacgagaaacacaagccctagcctcggtgagtcccgaggaacaaaggacttgcctccagtgaaagatcctggagccctttcccgagaggggctgctggctcctctaggattattagccattctaacattggcagttgctaccttgtacggactgagtctcgctacgccaggggagtag

SEQ ID NO: 26631 - DNA, 945 bp, Artificial Sequence
  Description of Artificial Sequence: Synthetic coding sequence
atgggcagccaggccctgccccccggccccatgcagaccctgatctttttcgacatggaggccaccgggttaccattcagccaacctaaagtcaccgagctttgtttgctggcagtgcatagatgcgccttggagtcccccccaacaagtcaagggccccctccaactgttcctccgccccctagagtagtagacaaactcagcctttgcgtggcacctggaaaagcctgctcgccggctgcaagcgaaataacggggctgagcacagcagtgctcgcggctcatgggcgacaatgtttcgatgacaacctcgcaaatttactgctggctttcctacgcaggcagcctcagccatggtgccttgttgcccacaatggtgacaggtatgacttcccactattgcaggccgagttggcaatgttggggttaaccagtgcattagacggggctttctgcgtcgattcaattacagccctgaaggctttagaaagagccagctcacccagcgagcatggcccaagaaagtcgtacagcttgggaagtatctacactcgcctgtacggccagtcccctcccgacagccatacagctgaaggagacgtgctggcgctactctctatctgccaatggcggccacaagcgctcttgagatgggtggatgcacacgccaggcccttcggcaccatccgccctatgtatggtgtgacagctagcgcccggaccaaaccccgcccatcagcagtaactactacagcccacctggccacaacccgaaatacaagcccctctttaggcgagtcccgcggtaccaaagatctacccccggttaaggatcctggtgctttgtctcgcgaagggcttctagccccattaggactactggctatccttaccttggctgtggccaccctgtacgggctctctcttgcaactccaggagagtag

SEQ ID NO: 26632 - DNA, 915 bp, Artificial Sequence
  Description of Artificial Sequence: Synthetic coding sequence
atgcagaccctgatcttcttcgacatggaggccaccggcctgcccttttcccagcccaaggtcactgagctttgtctcctggcagtgcacagatgcgccctcgagagcccaccaacaagtcaaggacccccacccaccgtcccaccccccccccgagtggtggacaaactctcattgtgtgtggctcccgggaaggcctgttctccagccgcttctgagattacaggactgtctacggcagttctagccgcccacggccgacaatgtttcgacgataatctggccaacctgttgctggcatttctcaggagacaaccgcagccatggtgcttggtcgctcataatggagataggtacgattttcccctgctccaagccgagctggcgatgctcggccttacttccgcccttgatggggcattctgtgtagatagtatcaccgccttaaaagcactggagcgagcctcatcaccttctgaacatggtcccagaaagtcttatagcttgggctccatttacactcggctttacggccagtcacctccagacagtcacactgccgaaggggatgttctggcattgcttagcatttgccagtggcgtccccaggccttgctccgttgggtagatgctcatgcccgccccttcggaacaattcgcccaatgtatggcgtgacggcttccgctcggacgaagcctcgaccttcagcagtcacgaccacggcgcacctggccacaacgcggaacacctctccaagcctgggtgagagtcgcgggacaaaggatctgccccccgttaaggatccaggagccttgagccgagaggggctgctggcacctcttggtttgctcgcaatcctgacgctagctgtggctacactgtatgggttaagcttagccacacccggggagtag

SEQ ID NO: 26633 - DNA, 528 bp, Artificial Sequence
  Description of Artificial Sequence: Synthetic coding sequence
atgctgggcctgaccagcgccctggacggcgccttctgcgtggactccatcaccgctctgaaggccctcgagagagcaagctctccgagcgagcatggcccacgaaagagctactcccttggcagcatctacacgaggttatatggacagtctccgccagattctcacactgctgagggcgacgttctggccctgctatcaatttgccagtggagaccgcaagctcttctcaggtgggttgatgcgcacgcccgccccttcggcactatccggcctatgtacggggttacagcctctgcgagaacgaagccgagaccgtctgccgtgacaacaactgcacatctagccacaaccaggaatacgtcccccagtctgggagaaagccgcggaactaaggatctgcctcctgtaaaagaccctggagctctcagcagagaaggcctactggcacctctcggattgctagctatcctgaccctggccgtggcaactttgtacggcctgtccttggctacaccaggagaatag

SEQ ID NO: 26634 - DNA, 3513 bp, Artificial Sequence
  Description of Artificial Sequence: Synthetic coding sequence
atgggcctggcctggggcctgggcgtgctgttcctgatgcacgtgtgtggaacaaatcggatccccgaatccggcggcgataactcggtgttcgatatcttcgaactgacaggagccgcgcgcaaggggtcgggcagaaggttagtcaaggggcccgacccatctagccccgcgtttcgtatcgaggacgcgaacttgatacctcccgtgcctgatgataaattccaggacctggtggatgcggtcagggcagagaagggcttcctgctattagcatctctgcgccagatgaagaagactcgggggaccttattggcactggaaaggaaggatcacagcgggcaagtgttctctgtggtaagtaacggtaaagctgggactctcgatctgtcactcaccgtccaggggaagcagcacgtcgtttcagtggaagaagcactcctggcaactgggcagtggaagtcaatcacactgttcgtgcaagaagaccgtgcacaattgtacatcgattgtgagaagatggaaaatgcagagctcgatgtgcccatccagtcggtttttactcgggacctggcatcaatcgcacggctccgcatcgccaagggtggagtgaacgataacttccagggggtccttcagaacgtgcggtttgtttttgggaccactcccgaggacatcctcaggaataagggctgctccagctctacctcagtcctgctgaccctggataacaatgttgtgaacggctcctctccagcaattcgtaccaactacatagggcataagaccaaagacctccaggccatatgtggaatttcctgcgacgaactgtctagtatggtgcttgaattgagaggcctcagaaccattgtaacaaccttacaggacagtattaggaaggtgaccgaggaaaacaaagagctagccaatgagctgcgtagaccccccctatgctaccataatggcgtgcagtatcggaacaacgaggaatggacagtggactcatgcacagagtgccattgtcaaaactccgtcaccatttgtaagaaagttagctgccccatcatgccctgctccaacgccacagttccagacggtgaatgctgtccccgatgctggcccagtgactcagcagatgatggatggtccccttggagcgagtggacaagttgctcaactagttgtgggaacgggatccaacagcgcggcaggagctgtgatagtcttaataacaggtgcgagggttcctcagtccagacgcgtacttgccatatacaggaatgcgataagaggttcaaacaagatggaggctggagtcattggtcgccatggtcaagttgcagcgtcacttgtggcgacggagtcatcaccagaatccgcctgtgcaattccccatccccacagatgaacggcaaaccttgcgagggcgaggcccgggagacaaaggcgtgtaagaaggacgcctgtccaatcaacggaggatgggggccctggagcccctgggatatctgttccgtgacatgcggcggaggcgtacaaaagagaagccgcttgtgtaataatcctaccccgcagttcggcggcaaagactgcgttggtgacgtgacagagaatcagatttgtaacaagcaggactgccccattgatggttgcctgtctaacccctgcttcgccggcgtgaaatgtactagttaccccgacggatcatggaaatgtggggcatgcccccccgggtactctggcaacggtatccagtgcactgacgttgacgagtgtaaagaggtcccggacgcctgtttcaaccacaacggggagcatagatgcgagaacacggatcccggctataactgcctgccatgcccaccaaggttcacaggctctcagccatttgggcagggagttgagcatgccacagccaacaaacaagtctgtaaacctagaaacccatgtactgatggaacccatgattgcaacaaaaacgcaaaatgtaactatttgggtcattatagtgatcctatgtaccggtgtgagtgtaaacccgggtatgcaggtaatggaattatttgtggcgaggacacagatctcgacggctggccgaatgagaacttggtttgcgtggccaatgctacgtaccactgtaaaaaagacaattgccccaacctccctaactccgggcaggaggattatgataaagatgggatcggcgacgcatgcgatgatgatgacgataacgacaagatccctgatgacagagataattgtccctttcattacaatccagctcagtacgattacgatcgcgatgatgtcggtgacaggtgtgacaattgtccttacaatcataatcccgatcaggccgacactgataacaatggggagggtgacgcctgcgcagcagatattgacggggacggtatactgaatgagcgcgataactgtcagtacgtctacaatgtggatcagagagacactgacatggacggcgtcggagaccagtgcgacaattgtcccctcgagcataatccagatcaactggacagcgactccgacagaattggggacacgtgtgataacaaccaagatatcgatgaggatgggcatcagaacaacctagacaattgcccttacgtaccaaatgctaaccaggctgaccatgataaagatggaaaaggcgacgcctgcgatcatgacgacgacaacgatggaatccccgacgacaaagataattgcaggctggttccaaacccagaccagaaggattcagacggcgacggcagaggagacgcgtgtaaggacgatttcgatcatgactccgttcctgacatcgacgatatctgtcccgaaaatgtggacatatctgaaacggacttccgccgcttccagatgatcccgctggacccaaaggggacctcccagaatgatcccaattgggtcgtcagacaccaaggtaaagaactggtccagacagtgaattgtgaccctggcctggccgtgggatacgacgagtttaacgctgtggactttagcggcacctttttcattaatacagaacgagatgatgactacgccggcttcgtttttggataccaaagcagtagccgcttttacgtggtgatgtggaagcaggtcacacagtcctactgggatactaacccaacacgggcccaaggatattccggtctgtccgtaaaagtggtgaattcgaccaccggaccaggcgagcacttgagaaatgccctctggcacaccggcaatactcccggtcaggtgcgcacgctgtggcacgatcctcggcacatagggtggaaggacttcacggcttaccggtggcggttatctcatcggcctaagacaggttttattagggttgtgatgtacgagggaaagaagattatggcagattcgggacctatctacgataagacctatgccggtgggcgactgggtctgtttgtcttcagtcaggaaatggtgttcttttcggatctcaaatacgagtgtcgcgacccctag

SEQ ID NO: 26635 - DNA, 285 bp, Artificial Sequence
  Description of Artificial Sequence: Synthetic coding sequence
atgggcctggcctggggcctgggcgtgctgttcctgatgcacgtgtgtggtactaaccggatccctgagtccgggggcgacaattcggtgtttgacatctttgagctgacgggagcagcacgcaagggaagcgggcggagattggtcaaggggcccgacccatcttcccctgccttccggatcgaagacgccaatctaattcctccagtaccagacgacaaattccaggacttggtcgatgcagtgagggccgagaaaggtttccttctgttagcgagcctgtag

SEQ ID NO: 26636 - DNA, 501 bp, Artificial Sequence
  Description of Artificial Sequence: Synthetic coding sequence
atggccgccggcaacgtggtgctggtgcccctggtgaccgtggagatggccagttctgcgcagatgctaatgtcggctaaaaagtgtttgatgcccgcaagcacaaccatggaaagtaccggagtcaggactcgcaccccagccactacagcatgtcctgccccccatgcaagtcctgcccacagtcccagcgcccgcgtgtcaaacatgccccgacctactaaccgctgtgcttctccaattccactctgtctctgtcaccgagccgggtgttactgtgaagcgatctccgagcaatggacgcaaaagcacttccaggcttgtcagcggagagaggactcactggagttggccaacaaaactacgttgacaagctccttcaggaatactgggagcagaggacagtccacaaaggggagggcccatacccgcgatgattgtatgaaaaagatttggagaaactgttatatgtttgggacaaaatcatttagtggagattag

SEQ ID NO: 26637 - DNA, 3519 bp, Artificial Sequence
  Description of Artificial Sequence: Synthetic coding sequence
atggtgtggcggctggtgctgctggccctgtgggtgtggcccagcactcaggctggacatcaggacaaggatacaaccttcgaccttttttcgatttccaacatcaatagaaagactattggagctaagcagttccgcggcccggaccccggtgtgcccgcctatagattcgtgagattcgactacatacctcccgtcaatgcagacgacctctcaaaaatcacaaagataatgaggcagaaagagggattttttctgactgcacagctgaagcaggatggaaagagtcgtgggacactgctcgctctcgagggcccaggactctctcagcgacagttcgaaattgtatccaacggacctgccgatactttggaccttacatattggatcgacggaaccagacacgtcgtttcgttggaagacgtcggactggcagatagccaatggaaaaacgttaccgtgcaggtggctggagaaacatatagtctccatgtgggttgcgacctaattgatagtttcgccttggacgagcccttctatgagcacctgcaagctgagaaatccagaatgtatgtcgccaagggatcagccagagagtcgcatttccgggggttactccagaacgtccacctggtgttcgaaaactctgtggaagatatcctctcaaagaaggggtgccagcaggggcaaggggccgagatcaacgctatttccgaaaatactgagactctgcgcttaggcccgcatgtcacgactgaatatgtgggacccagtagcgagcggcggcccgaagtctgcgaacggagttgcgaagaactgggcaatatggttcaggaactctccggactacatgtccttgtgaatcagctgtctgagaacctaaagcgggtcagcaatgacaatcagtttctgtgggagctgatcggtgggcctcctaagacacgcaacatgagcgcttgttggcaagatggccgatttttcgccgaaaacgagacctgggtagtggattcctgtaccacatgcacgtgcaagaaatttaagactatttgccaccagatcacttgtcccccagcaacatgtgcctcaccctctttcgtggagggagagtgctgtcctagttgcctgcactccgtcgacggtgaagaaggatggagtccatgggccgagtggacacagtgctccgtaacctgcgggagcggaactcagcagcgcggacgatcgtgtgatgtcactagtaacacttgtctcggcccatctattcagactcgggcgtgctcattgagcaagtgcgacacaagaatacgtcaggatggaggatggtcgcattggtctccctggtctagctgcagtgttacatgcggcgtggggaatattacacggatcaggctctgtaacagccccgttccacagatgggggggaagaactgcaaaggcagcggcagagaaacgaaggcatgccagggagccccatgcccgattgacgggcgttggtctccctggagcccttggagtgcgtgtacggtcacctgtgctggggggattcgcgagagaaccagagtgtgcaacagcccagagccgcagtacgggggcaaagcctgcgttggtgatgtgcaggaaaggcagatgtgcaataaaaggtcttgtcctgtggacggctgcctgtcaaacccctgtttccccggagcccagtgcagcagttttcccgatggcagctggtcatgtggaagctgccccgtggggtttcttggcaatggcactcactgcgaggaccttgacgaatgtgccctagtgcctgacatatgcttctccacctctaaggttccacgctgcgtgaacacccagcccgggtttcattgcttgccctgcccaccacggtaccgaggtaatcaacccgttggggtaggcctggaagctgctaagacagaaaagcaagtttgtgagccggagaatccttgtaaagataagactcataattgtcacaagcacgccgaatgtatctacctgggccacttctccgatcctatgtacaagtgcgagtgccagactgggtacgcaggggatggtctgatttgcggagaggacagtgacttggatggatggcctaatttgaatctagtctgtgccacgaatgccacataccattgtattaaggataactgtccccacctgcccaacagcggacaagaagatttcgataaggacggaatcggagacgcctgcgacgatgatgatgataacgatggggttacagatgaaaaggataattgccagctcctgtttaatccaaggcaagcagactacgataaagacgaggtcggcgacaggtgtgataactgcccatatgttcacaacccagctcagatcgatactgataacaacggtgagggcgatgcctgctctgtggacatcgacggagacgatgtctttaatgaaagggataactgtccctatgtctataacacggatcaacgagacacggacggtgatggcgtgggcgatcactgcgacaattgccccttggtccataatcctgaccagaccgacgtggacaatgatctggtgggggaccaatgcgacaacaatgaagacattgacgatgacggacaccagaacaaccaggataactgtccatacatctccaacgcaaatcaggctgaccacgaccgggacggccaaggcgacgcctgcgatccggatgacgataacgacggtgtgcccgatgaccgggacaactgcaggctggtcttcaaccccgaccaggaggacctggatggcgacgggcgtggcgatatctgtaaagacgattttgacaacgataacattcctgatattgacgacgtgtgtccggagaacaacgccatctcggagaccgattttagaaactttcaaatggtcccgctcgacccaaaaggcacaacccagattgaccctaattgggtgattcggcaccagggtaaggagctggtgcagaccgccaattctgaccctggaatcgctgtaggattcgacgagttcggaagcgttgacttttctggaaccttctacgtgaacaccgatagagacgacgactacgccggctttgtttttgggtaccagagctcctcccgcttctacgtcgttatgtggaagcaggtgacccagacctactgggaggaccagcccacgcgggcgtacggttactctggggttagtttaaaagttgtgaattcaactacgggcacgggcgagcacctgaggaatgccttgtggcatacgggaaacacccctggccaagtgcgaaccctctggcacgatcctagaaatattggatggaaggactacaccgcctaccgatggcatctgactcacaggcctaagacgggttatatacgggtgctagtgcacgaagggaaacaagtcatggctgacagcgggcccatctacgaccagacgtatgctgggggcaggctgggtctgttcgtgttcagtcaagaaatggtgtactttagcgaccttaagtacgagtgcagagatatttag

SEQ ID NO: 26638 - DNA, 1293 bp, Artificial Sequence
  Description of Artificial Sequence: Synthetic coding sequence
gacgacgacaacgacggcgtgaccgacgagaaggacaactgccagctgctcttcaacccccgccaagccgattatgataaggatgaggtgggagataggtgtgataattgcccttacgtgcacaatcccgcacagattgacactgataacaatggtgaaggcgacgcatgctcggtggacatcgacggtgatgacgtgtttaacgagagagacaattgtccatacgtttacaacactgatcagcgagacactgacggtgacggcgtcggcgatcattgcgataactgcccgttagtacacaatcctgatcagaccgatgttgataacgatcttgtaggagaccaatgcgacaataacgaggatatagatgacgatgggcatcagaacaaccaggataactgcccgtacatttcgaacgccaaccaggccgatcacgatcgggacgggcaaggggatgcctgtgatccagacgatgacaatgatggggtgcctgacgatcgcgacaattgcaggctggtgttcaatcctgaccaagaggaccttgacggggatgggcgcggagacatctgtaaagacgacttcgacaacgataatattccagatattgatgacgtgtgtcctgaaaataatgctatctcagagactgattttagaaacttccagatggtccctctagatcctaaagggaccacacagatcgatcctaattgggtaatccgtcaccaaggtaaagagctcgttcagacggccaacagcgacccagggatcgcagtgggcttcgacgagtttggctccgttgatttctctggcactttttacgtgaatacagatagggatgacgactacgccggatttgtgttcggctatcaatcttcaagccgattctacgttgtcatgtggaagcaagtgacccaaacctattgggaagatcagccaacaagagcttacggatatagtggcgtgtccctgaaagtggtaaattccactacgggcaccggagagcacctgcgcaatgccctgtggcacaccggcaatactccagggcaggttcgcaccctctggcacgaccctcgcaacattgggtggaaggattataccgcttaccgctggcatctcacccaccgccccaaaaccgggtatatccgcgtgctagtgcacgagggcaaacaggtgatggcagattctgggccgatatacgaccagacctatgcagggggtaggctgggcctcttcgtgttctcccaagagatggtctatttttccgatcttaagtatgaatgtcgagtgatctag

SEQ ID NO: 26639 - DNA, 252 bp, Artificial Sequence
  Description of Artificial Sequence: Synthetic coding sequence
atggtgtggcggctggtgctgctggccctgtgggtgtggcccagcactcaagccggccaccaagacaaagacacgacctttgacctgttctctataagcaacatcaataggaaaactattggtgcaaaacagttcagagggccggacccaggggttccagcttatcgttttgtcaggtttgattatataccacctgtaaatgccgatgacctaagtaaaattaccaagattatgcgccagaaagagggttag

SEQ ID NO: 26640 - DNA, 1449 bp, Artificial Sequence
  Description of Artificial Sequence: Synthetic coding sequence
atggccgccctgatgacccccggcaccggcgccccccccgcccccggcgactttagcggggagggttctcaggggcttccagacccgagtccagaacccaaacagctcccagagctcattcggatgaagagagacggcgggcggctgagtgaagctgatatccgcggattcgtggctgcagtggtgaacggaagtgcacagggggctcagatcggagctatgctgatggcgatcagacttcggggcatggaccttgaagaaactagcgtgctcacccaggcgcttgcccagagcggacagcagctggagtggcccgaagcttggcggcagcagctggtcgacaagcacagtacaggtggagtcggagacaaggtgtccctggtgctggctccggccctcgccgcttgcggctgcaaggttccaatgatcagcggccggggtttgggccacaccggaggaaccttggataaactagaatcgattccaggatttaatgtaatccagtctcccgagcagatgcaggtgttgctagaccaggccggttgttgtatagtcggccagagtgaacagctggtcccagccgacggaattctctatgccgctagagatgttactgccacagtggactccctgcccctcatcaccgcaagcatcctctccaaaaagctcgttgaggggttatccgctctcgtggtggatgtcaagttcggaggggcagctgtgttcccaaatcaggagcaggcccgagaacttgccaaaaccctggtgggtgtaggggcgagcttgggcttgagagttgcagcagcccttactgccatggataagcccctcggtcggtgtgtgggccatgccttggaggttgaggaggcccttttgtgtatggacggggccgggccccctgatcttagggacctggttacaacgctcggaggtgccttgctctggctctctggccatgccggaacgcaagctcagggtgccgccagagtcgcagccgcattggatgacgggagcgctctgggtcgctttgagagaatgctggctgcccagggcgtggatcctggactggctcgggcactgtgttccggttccccagccgaaagacggcagttgctccctcgcgcccgcgagcaggaggaacttctggctccagcggacggcacagtggaactggtacgcgctctacccctggccctggtactgcatgagctgggggcaggacggtctagagcaggggagcctttgcgtctgggagtcggtgctgaattgctcgtggacgtgggacaaaggctaagacgcggcacgccttggctacgggtccatagggacggtccagcgctgagcggcccccagagcagggccttacaggaagcgttggtgctgtcagatcgagctcccttcgccgccccctcaccatttgctgagctcgtcctgccaccgcagcagtag

SEQ ID NO: 26641 - DNA, 1449 bp, Artificial Sequence
  Description of Artificial Sequence: Synthetic coding sequence
atggccgccctgatgacccccggcaccggcgccccccccgcccccggcgatttttccggcgaggggtcccagggactcccggaccccagtcccgagccaaagcaacttccggagctcattcggatgaaacgggacggcgggaggttgtctgaggccgacatccgcgggttcgttgcggccgtggtgaatggttcggcacaaggcgcccagattggagccatgctcatggccatacgtctgcgcggcatggatttagaagagacttcggtgcttacgcaagctctggctcagagtgggcagcagcttgagtggccagaggcctggcgacagcagctggtcgacaagcacagcacaggaggcgttggggataaggtgagtctggttctagcacctgctctagcagcatgcgggtgcaaggtgccgatgatctccggccgcggactcggacatacgggtggaacccttgacaagctcgaatccattcctggatttaatgtcatacagtctccagaacaaatgcaagtactcctggaccaggcaggatgctgtatcgtcggacagtctgagcaacttgtcccggccgacggcatattgtacgcagcgcgcgacgtcactgccactgtagactctctaccactgatcactgcatctatcctgagcaaaaagctagtcgaagggttaagtgccctggtcgtagacgttaaattcgggggcgccgcggtatttcctaaccaggagcaggcccgcgaactcgcaaagaccctcgtaggagttggcgcctctctaggtctaagggtggcggctgctctgactgccatggataagccgctggggaggtgcgttggccatgccctcgaggtggaggaggcgctgctttgtatggacggtgcagggccccccgatctgcgggatttggtcactacactaggaggcgccctcttgtggttgtccggtcatgcgggcactcaggcccagggtgcagctagggtagctgcagcactggatgacgggagcgcactggggcgcttcgagcggatgctggctgcccagggagtcgaccccggacttgcccgagcactctgttcagggagtcccgccgaaagaagacaactgctgcctcgggcacgtgagcaagaggaactgctggcacccgcagacgggacagtcgagcttgtaagagctttgccattggctctggtgctgcacgaactcggagctggcagatctagagccggagagcctctccgcttgggcgtgggggcagagctgctggtggacgtcgggcagcgcctcagacgcgggactccttggctgagggtgcaccgcgatgggcctgcattgtcagggccccagagtagagccctccaggaggctttggtactctccgacagagccccgtttgctgcgccgtccccattcgccgagctcgtgttgcctccccagcagtag

SEQ ID NO: 26642 - DNA, 1449 bp, Artificial Sequence
  Description of Artificial Sequence: Synthetic coding sequence
atggccgccctgatgacccccggcaccggcgccccccccgcccccggtgattttagtggcgaaggcagccaaggcttgcccgaccctagccccgagccgaaacaactcccggagctgattcgcatgaaaagagatggaggcaggctatcagaagccgatatccggggtttcgtggccgccgtggtgaacggctctgcccagggcgcccaaatcggtgccatgttaatggcaattcgtctacgcgggatggaccttgaagagacttctgtgttaacccaagcactagcacaaagcggccagcagttggagtggcccgaggcctggagacagcaactggttgataaacattcaactggaggtgttggcgacaaggtgagccttgtcctggccccagcactggcggcttgcggttgtaaagtgcctatgatctctggacggggcttgggccacaccggcggtacgttggataaactggaatcaatacccgggttcaacgtcattcagtcaccagaacagatgcaagtattactcgaccaagcagggtgctgcattgtcggccagagcgagcagctagttccagccgatggaattctgtacgccgcaagggatgtgaccgctaccgtcgactccctgccactgattacagcatctatcctttcaaaaaagctcgtggagggactgtccgcactggttgtggatgttaaatttggcggagcagccgtgtttccaaatcaggaacaggcccgggaactcgcaaagaccttggtaggcgtcggggccagtcttggcctgcgcgtcgctgctgccctcaccgccatggacaaaccgctcggccggtgtgtgggtcacgccctcgaggtcgaggaggcattgctctgcatggatggcgctggaccgccggatctccgcgatctggtgaccaccttaggcggcgcattgctatggcttagcggacacgctggcacacaggcccaaggggcagccagagttgcggcggccctggacgatggttccgcattgggcagatttgagcgcatgctggcagcacagggcgtggacccagggttagcccgggcattgtgtagcgggagccccgccgaaagaagacagttgcttcccagggcgcgagagcaggaagagctcctggccccagccgacgggactgtcgaattggtgcgtgctcttcccctggctctcgtcttacacgaactcggggcaggccggagccgagccggagaaccactgagactcggcgtcggagctgaactactggtagatgtgggacaaaggttgaggagaggcacaccctggttgagggtacatcgggatggacccgccctttccggcccccagtcacgcgctttacaagaggccctggttctcagcgacagagcccctttcgccgccccctctcccttcgcggagctcgtcctgcccccccagcagtag

SEQ ID NO: 26643 - DNA, 1233 bp, Artificial Sequence
  Description of Artificial Sequence: Synthetic coding sequence
atggaggccgagaacgccggcagctacagcctgcagcaggcccaggccttctatacgtttccctttcagcagcttatggccgaagcccccaatatggctgtagtgaacgaacagcagatgcctgaagaagttcccgcaccagcccctgcccaggaacctgtgcaggaggccccaaaagggaggaagcgtaagccccgcaccaccgaacctaagcagcctgtagagcctaaaaaacccgtcgagtccaaaaaaagtggaaagagtgccaagtccaaagaaaaacaggaaaagatcacggatacctttaaggtcaaacggaaagtggataggttcaacggcgtttcagaagccgagctcttgactaagacacttcccgacattctcacatttaatcttgacattgtcatcattggcatcaatcctggcctcatggcagcctataaggggcaccactatcccggtccaggaaaccacttttggaagtgcctattcatgtccggcttaagcgaggtgcagctgaatcacatggatgaccatacacttccaggtaaatacggcataggttttactaacatggtcgaaagaaccactcctggctccaaggatctcagctctaaagagttccgggaaggaggcagaattctggtgcagaaattgcagaaatatcagcctcgcatcgccgtgtttaatgggaagtgcatctacgaaatcttcagcaaggaggtctttggagtcaaggtgaagaacttggagtttgggttgcagccgcataagatccccgacaccgaaacgttgtgctatgttatgccgtccagtagcgcaagatgcgcacagttccctcgagcgcaagataaggttcactattatatcaagctgaaggatctccgagatcaactgaaggggatagagaggaatatggacgtacaagaagttcagtataccttcgaccttcagctcgctcaagaagatgcgaagaaaatggccgtgaaggaggaaaaatacgatcctgggtacgaagccgcatacggtggagcatatggcgaaaatccgtgcagtagcgagccctgtgggtttagcagcaacggtttaattgaatcagttgagttgaggggggagtcagccttttcaggcatcccaaacggtcagtggatgacccagtcctttaccgatcagatcccctctttcagtaaccattgtggaactcaagagcaggaggaagagtcccacgcctag

SEQ ID NO: 26644 - DNA, 621 bp, Artificial Sequence
  Description of Artificial Sequence: Synthetic coding sequence
atgatcaccctgtaccagggcagcatggtgctggacctgcccacctggtggaaagggcctaggcctgccgcaaagatttccccaggcatttatgaaatcttttctaaggaggtcttcggtgtcaaagtgaagaacctggagttcgggttacagcctcacaagatccccgacacagagaccctatgctatgtgatgccctctagtagtgctaggtgtgcccaatttccccgcgcacaggataaggtacactactacattaaacttaaagatctgcgggatcagctaaagggaatagaacgtaatatggacgtgcaggaggtgcagtataccttcgatctccagctagcccaggaagacgccaagaagatggccgtcaaagaggagaagtatgatcctggctacgaagccgcttatgggggggcatacggcgagaacccctgctcgtccgagccttgtggtttcagctccaatggcctgatagagagcgtcgaactgcggggcgaatccgcttttagtggtattcccaacggccagtggatgactcaatccttcactgaccagattccctctttttcaaaccactgcggcactcaggagcaggaagaagagagtcatgcttag

SEQ ID NO: 26645 - DNA, 3294 bp, Artificial Sequence
  Description of Artificial Sequence: Synthetic coding sequence
atgagcagctgccggagcctgtgctgcggcgacatcagccagagcgcagtgttgtttctgtgtcaggggactttggctatgctggactggcaaaacgggtctatgggaagaagcggtgaagcactcctgctcgacaccgcccacgtgctctttacactgtcttctcagattaaggagcccacccttgagatgttcctgtcaagaatcctggcgagctggacaaatagtgcgatccaggtactagagtcctcatccccctctttaacggatagtctgaatgggaactcctccatcgtcggaagattgctcgagtacgtgtatactcactgggagcaccccctggacgccctcagacatcagactaagatcatgtttaagaacctgcttcagatgcacaggcttacagtggagggggctgacttcgttcctgaccccttctttgtggaacttactgaatcccttctgaggctggaatggcatattaaaggtaaatacacttgcctcggctgcctcgtggaatgcataggagtcgagcacatcctcgctatagataaaaccatcccatcccagatcctggaagtgatgggtgatcaaagcctagtgccctacgcaagcgatctgctggagaccatgttcagaaaccataaatcacatctcaagtcccagactgcagaatcaagctggatagaccaatggcacgagacttgggtttcacctttgctgtttatcctgtgtgaagggaatctggaccaaaaaagttatgtgatcgattattatctgcctaaactgctgtcctattccccggaatctttgcagtacatggtcaagatcctccagacatctattgacgccaagaccggtcaggaacagagttttccttcactgggttcgtgtaactctcggggagcgctgggggccctcatggcctgtttgcggattgcacgtgcccatggccacctgcagagtgcaacagacacatgggagaacctggtctctgatgcaaggatcaagcaagggctgattcaccagcactgccaggtgcgcatcgacacactagggctgctgtgtgagtcaaatcgctcaaccgagatcgtgagtatggaggagatgcaatggattcagtttttcatcacatataatctcaactcacagtccccgggggtgagacagcaaatctgctcactcttgaaaaaactgttctgtcgcattcaagaatctagccaggtgttgtacaaactggagcagtctaaatctaagcgggagcctgaaaatgagttgacgaagcagcatccaagtgtctcgttgcaacagtataagaactttatgagctctatctgcaacagcctcttcgaggctctcttcccggggtcgagctatagcacaaggtttagcgctctcactatcctgggatctatcgcagaagtgtttcacgttccggagggccgcatttacaccgtgtatcaactcagtcatgatattgacgtggggaggttccagactctgatggagtgttttacatcaacctttgaggacgttaagatattggctttcgatctgctgatgaaactgagtaaaactgcagtgcacttccaggacagtggaaagttgcagggcctgtttcaagcagccctggaactgagtacaagcacaaagccctatgactgtgtgacagcgagctaccttctcaacttcttgatctggcaagatgcgctgccctcctccctctcggcatacttaacacagcaggtcgcgtgtgataatggagatcggccggccgctgtggtggagagaaatacactcatggtgataaaatgtctcatggagaatctagaggaggaggtttcacaggcagagaacagcttattgcaggccgcagcggcattcccaatgtacgggcgggtacactgcatcacgggcgccctccagaagttaagcctgaattcacttcagctggtgtctgaatggcgtcctgttgtggaaaagttgctgttgatgtcctatcgccttagcacagtggtgagtccagtcatccagtccagtagccctgaaggacttattccaatggacacagatagcgagtcagcctccagattgcagatgatcctgaatgaaatccagccaagggataccaatgactattttaaccaggcaaagattctcaaggaacatgattccttcgatatgaaggaccttaacgcaagtgttgtaaatatagacacctccactgagattaaaggaaaggaggtgaaaacttgcgacgtaaccgcccagatggtgctggtgtgctgttggcgaagtatgaaagaggttgcacttctcctgggaatgctatgccagcttctccccatgcagcccgttccggaaagcagcgatggcctgttgactgtcgagcaggtcaaagagatcggagattattttaaacagcacttattgcagagtcgccacagaggtgcgtttgagctcgcttatacagggtttgtgaagctgacagaggttctgaatagatgccctaacgtcagtctgcagaaactcccagagcaatggctgtggtccgtgctggaggagatcaaatgcagtgacccatctagcaagttgtgcgccacccggcgctctgccggcatcccgttctacattcaggccctccttgcgtcagagcctaagaaggggcgaatggatctgctgaagattaccatgaaggaactgatttctctggccgggccgacagatgacatccagagtacagtaccacaggttcacgccctgaatattctacgggccttgttccgagatacaaggcttggcgaaaatatcatcccttacgtggcagatggagccaaagcagctatattaggctttacaagccctgtgtgggccgtgcgcaacagcagtaccctcctcttcagtgcactaatcacacgtatttttggggttaagcgcgccaaggacgagcactcaaaaaccaaccgaatgactggacgcgaattcttctcaaggttccccgagttataccctttcctcttgaaacagctggaaaccgtcgctaatacagtggattctgatatgggggaacccaatcgccacccatcaatgttcttactcctcctggttcttgagcggctctacgcatccccaatggacggcacatcttctgcgctcagcatgggaccttttgtgccatttattatgcgcgtgctcctctgttgcccaggttggagcgctgtagcgcggagccagcttaccgcaacctctacctcatgggtgcaggccattctccttccccagccccccgagtag

SEQ ID NO: 26646 - DNA, 5643 bp, Artificial Sequence
  Description of Artificial Sequence: Synthetic coding sequence
atgggcgtgaagaagaagaaggagatgcaggtggccgccctgaccatatgccaccaggacttggaaacactcaagagtttcgccgacgttgagggcaaaaaccttgcatcactcctccttcactgtgtccagctgacggacggcgtgtcccagattcattacattaagcaaattgtgccactgctcgaaaaggctgataagaatggaatgtgtgatcctacaattcagagctgtctggacattttagcgggtatctatctctctctgtcacttaagaatcccttgaaaaaggtcctagcttctagcctgaattccctgcccgactttttccttcctgaggctatgcaccgtttcacaagccggttgcaagaagagcttaatacaactgacctatactcttacaggaaggttacggacaatatctcatcatgcatggagaacttcaatctcggcagagccagcgtcaataacctcttgaagaacgtgctgcactttctgcagaagtcactcatagagatattagaggagaatagaaagtgtgctggcaaccatataattcaaactcaactaatgaatgatctcctggtaggcattagggtgagcatgatgctcgtccagaaagtgcaggacttccagggaaatctgtggaagacttccgactcccctatctggcaaaacatgtgcgggctgctctctattttcacgaaggtgctcagcgatgatgatttgctgcaaacggtgcagtcaacctccggtctagcgatcattctgtttattaagaccatgtttcatccatccgagaaaatccctcaccttattagttcagtgctactcaggagtgtggattgtacaagcgtgcctgagtggttcatgtccagctgcaggagtctctgctgtggggatatatcacagagtgccgtactttttctatgccaaggaacgctggccatgctggattggcagaacggatctatggggcgctctggagaggctttactactagacacagcacacgtattgttcaccctttccagccaaattaaggagcctactctggagatgtttctgagtcgaatcctcgcttcgtggactaattccgcgattcaggtgctcgagagtagctccccctctctgaccgatagtttgaacggcaacagcagtatcgtgggtcgtttgttggaatacgtatacacgcattgggaacaccccctagatgctttgcgccatcagaccaagatcatgtttaaaaacctcttgcaaatgcatcgccttacagttgagggtgccgactttgtccctgacccgttctttgtggaattaacggaatccctcctgcgtttagagtggcatattaaaggcaaatacacttgcttgggatgtctcgtagagtgcatcggcgtggaacacattcttgccatcgacaaaactatcccaagccaaatactcgaagtcatgggggatcagtcacttgtgccttacgcttcagacctccttgaaaccatgttcagaaaccacaagagtcatttgaagagtcagacagccgaaagctcttggattgatcaatggcacgaaacttgggtgtcaccgctcttgtttatcctatgcgagggtaacctggaccagaaaagctatgttattgattactacttgcctaagctcttatcctattctccagaaagcctgcagtatatggtaaagatcctgcagaccagcatcgacgcaaagaccggccaggaacaaagcttcccatccctgggctcctgcaacagcagaggggcactcggcgctctaatggcctgcctcagaattgctagagcacacggacacctgcagtcagcaaccgatacatgggagaacctagttagcgatgcccgtattaaacagggcttaattcatcagcactgccaagtgcggatcgatacactcggcctcctgtgcgaatctaatcgctccaccgagattgtgtccatggaggaaatgcagtggatccagttcttcattacatataacttaaactcccagagcccgggggtgcgtcagcagatctgcagcctgctaaagaagaaactcttctgtcggatacaagagtcatctcaggtgctgtacaagctggagcagagcaaaagcaaaagagagcccgagaatgagttgacaaagcagcatccatctgtgtctctacaacagtacaaaaattttatgtctagcatctgcaacagtttatttgaggccctgtttcctggcagctcctactccacccgctttagcgcgctcaccatcctggggtcaattgcggaagtgtttcatgtcccggagggacggatctatacggtttatcagctgtcccacgacattgacgtaggacggttccagaccttaatggagtgtttcaccagcaccttcgaggacgtgaagattctagcattcgatctgttgatgaagctttcgaaaacagctgtgcattttcaagactccggcaaactccagggtctgtttcaagcagcactggagctgtctacctcaacaaagccctacgattgcgtcacagcctcttacctcctcaacttcctcatctggcaggatgccctgccctcttccctgagtgcctatctcacacaacaggtcgcctgcgacaatggagatcgtccagcagccgtggtcgagagaaacaccttaatggttatcaagtgtttaatggagaacctggaagaggaggtgtctcaagcggaaaattccctgctccaagccgccgccgcatttccgatgtatggacgcgtgcactgcattacaggagctctgcagaaattgagcttgaatagtttgcagctagttagtgagtggaggcccgtggtcgagaagctgctgctcatgtcttatagattatctacagtggttagtcccgtaattcagagtagctcacctgaggggttaattcccatggatactgacagtgaaagcgcgtcccgtctgcagatgatactgaatgagattcagcctagagatactaatgattactttaatcaagccaagatcctcaaggaacacgacagctttgatatgaaggatttaaacgcctccgtcgtgaatatcgacacctctactgagattaaaggaaaagaagtaaagacttgtgacgtgactgcacagatggtccttgtgtgttgctggcgctctatgaaagaagtggccttacttctgggcatgctgtgccagctgctgccaatgcagcctgtgcccgagtcatctgatgggttactcacggtcgagcaggttaaggagataggagactactttaaacagcacctgctccagtctcgtcatagaggcgcgttcgaactggcttatacgggatttgtgaaacttactgaggtactgaatcggtgccctaatgtatctctgcagaagttgccagagcagtggctgtggtccgtgctcgaagaaattaagtgttccgacccttcctcaaagctatgtgccacccgaagatccgctgggatccccttttacatacaggctctgctcgctagcgaaccgaagaagggcaggatggacctcctcaaaattaccatgaaggaactcatctcgttggccgggcccaccgacgacatacagagtacagttccccaggtgcatgccttgaatatactgcgcgccctctttcgagatacccgccttggggagaacataataccttacgtggccgacggtgccaaagcggcgatcttaggattcacctcaccagtttgggccgtgagaaacagcagtaccttattgtttagcgctctaattaccaggatattcggagtgaaaagggccaaggacgaacactctaaaaccaacaggtgtggccactctcccgtttatcactcccgggagatggccgctagagcactggtaccatttgtgatgattgaccatattcccaatactattaggactctgctaagcactctgccttcatgcacagaccagtgttttcgtcagaaccatatacacggcacacttttacaggtctttcacctcctgcaggcgtacagcgactctaagcatggaacaaatagcgactttcagcacgaactgactgacatcacggtctgtactaaagcaaagctttggctggctaaaagacagaacccgtgtttggtgactcgcgccgtatatatcgatatcctgttcttgctgacatgctgtctcaatcggagcgccaaggacaaccagcctgtgttggagagtctgggattttgggaggaagtgcgcggtatcatatccgggagcgaactgattactggatttccctgggccttcaaggtccccggccttcctcagtatttgcagagccttactagacttgcaattgccgctgtatgggcagccgcagcaaagagcggcgagcgggagaccaatgtgccgatttcctttagccaactcctggaatctgcttttcccgaagtaagatcactgactctggaggcccttttggaaaagttccttgctgctgccagcgggctaggggagaagggagttcctcctctactttgtaacatgggtgagaaattcctcctgcttgctatgaaagagaatcaccccgagtgtttctgcaagattctcaaaatcctgcactgcatggacccaggcgagtggctgccccaaacagaacattgtgtgcacctaactccaaaggagtttttgatctggacaatggacattgcctcaaacgagcgctccgagattcaatccgttgctcttagactggcttccaaagtgatttctcaccatatgcagacatgtgttgagaaccgagagctcattgccgctgagcttaaacagtgggttcaattagtcatcctatcctgtgaggatcatctgccgactgaaagcagactcgcagtcgtggaagtgctgacatcaaccaccccactctttctcactaacccgcaccctatcctggagctgcaggatactctggccctttggaaatgtgtgcttaccttgctgcagagcgaagagcaagctgtgagagacgctgctacagagactgtgacaacggcaatgagccaggagaacacatgtcagtccactgagtttgccttctgtcaagtcgatgcctccatagctctggcgctcgcattggccgtcctgtgcgacttgttacaacagtgggaccagttagccccaggattgcccatcctactgggatggcttctgggagagtccgacgacttagttgcttgcgtggagtccatgcaccaggtcgaggaggactatttgtttgagaaggctgaggtcaatttctgggccgaaacattgatttttgttaagtatctatgtaaacacttgttctgtctgctgtcgaagtcaggctggcggcccccaagccctgagatgctctgccatctccagcgaatggtgtcagagcagtgtcatctgcttagccagtttttccgagaactaccaccagccgctgaattcgttaagaccgtcgagtttacacgtctacgaatccaggaagagagaaccttagcctgcttgaggctgcttgcattcctagagggaaaggaaggagaagatacgctcgtgctctccgtgtgggactcgtacgcagagtccagacagctcacgctgccacgcaccgaggccgcctgctag

SEQ ID NO: 26647 - DNA, 5862 bp, Artificial Sequence
  Description of Artificial Sequence: Synthetic coding sequence
atgggcgtgaagaagaagaaggagatgcaggtggccgccctgaccatctgtcatcaggatctcgagacactcaaatctttcgccgacgtggaggggaaaaacctagctagtctgctgctgcactgcgtccagctgacggacggtgtgtcccagatccattacattaaacaaatcgttcccctgctggagaaagccgataaaaatggtatgtgtgatcctaccattcagtcttgcctggatatactcgcggggatctacctttccctgagcttaaaaaacccactgaaaaaggtgctggcgagctccttgaatagcctccccgactttttcctgccagaggcaatgcatagatttactagtcggcttcaagaagagctcaatactacagacctctacagttaccgaaaagtgaccgacaacatctcatcctgtatggaaaattttaacctcggaagggcaagtgttaataacctgctcaaaaacgtgttgcattttcttcagaagtccctgatagagatcctcgaggagaataggaagtgcgctgggaaccatataattcaaacgcagcttatgaatgaccttctcgttggcatacgcgtatccatgatgctggtccagaaggtccaggattttcagggaaatctgtggaaaacttctgactcacccatttggcagaatatgtgtggacttctgtccatttttactaaagtgctgagcgacgatgatctccttcagaccgtacagtccacatccggtctcgctatcatacttttcataaaaactatgttccatccctctgagaagatcccccacttaatctcaagtgttttgcttcgatctgtggattgcaccagcgtacctgagtggttcatgtcctcttgtaggagcttatgctgtggggacatctctcagtccgcggtgttgttcctttgccagggaactctggcaatgctggattggcaaaacggctcgatgggaaggagcggagaggcactgctgctggacacagcccatgtgctgttcactctaagttcacagataaaagaaccgacattggagatgtttctgagcagaatccttgctagctggacaaactctgccattcaggtgctggagtcctcctccccatcactgacggactccctgaacggcaactcttccatagttggaagactgctcgaatacgtttacacacattgggagcatccactcgacgctctgcgccaccagaccaaaatcatgtttaagaacttgttgcagatgcatcgccttaccgtagagggcgcggatttcgtaccagacccgttctttgtcgaattgaccgaaagccttctgcgtctggagtggcacataaaggggaagtacacttgtctcggctgtttagtggagtgcattggcgtggaacatattctggcaattgacaaaaccattcctagccagatcctagaggtcatgggcgaccaatctcttgttccttatgcgtccgatcttttggagaccatgtttcgaaaccacaagagccatctgaagtcgcagaccgccgagagttcatggattgatcaatggcacgaaacctgggtctctccactcctttttatattgtgtgagggcaacctcgaccaaaagtcctatgtcattgattactacctcccaaagcttctctcctacagccctgagtccctccagtatatggttaagattcttcagacctcaatcgacgccaagaccgggcaggagcagtcttttcctagccttggatcctgtaattcgcggggcgcgcttggagctctaatggcctgccttaggatcgccagagcgcacggacatctgcaaagcgctacagatacatgggaaaacttagtgtccgatgcccgcatcaaacaggggcttatccatcagcactgtcaagtgcgtatagataccctggggcttctctgtgagagcaatcggtccacagaaatcgtgagcatggaggaaatgcagtggatccagttttttattacatacaatttgaatagccagagtccaggagtgcgtcaacaaatatgcagcctactcaaaaaactgttttgcaggattcaggaaagcagccaagttttgtacaaactggaacaatctaagtccaagcgagagcctgagaacgaactcacgaagcagcaccctagcgtgagcctgcaacagtacaaaaactttatgtccagcatttgtaacagtctcttcgaagctctgtttccaggatcaagttacagcacacggttctccgccctcacgatcctgggatccatcgctgaggtctttcatgtgcccgaaggaaggatttatacggtataccaactgtctcatgacatcgacgttgggaggtttcaaactttaatggagtgcttcacatctacattcgaggatgtgaagatcttagcttttgacttgttgatgaagttgtctaagaccgctgttcacttccaggactccggtaagctccaggggctgttccaggccgctctcgagctctctacttcgacaaaaccatatgattgtgttaccgcatcctacctgttgaacttcctcatctggcaagatgcactgccctccagcctttcggcatacctgacacagcaagttgcttgcgataacggcgatcggcctgccgctgtggttgagcggaatactttgatggtgattaagtgtcttatggagaacttggaggaagaggtatcccaggccgagaattctctcctgcaggccgctgccgcttttcccatgtacggccgcgttcactgcataactggtgccttgcagaagctgtccctaaacagtctgcaactggtcagcgagtggcgccctgtcgtcgaaaaactgctcttaatgtcctatagactgtctactgtcgtgagcccagtgatacagtccagcagcccagaggggctcatcccaatggatacggactctgagtcagcaagccgcctgcagatgattcttaacgaaatccagcctagggatactaacgattatttcaaccaggcaaaaatcctgaaggaacacgactcgttcgatatgaaagatctcaacgcgagcgtagtgaatatcgacaccagcacggagatcaagggcaaggaggtcaaaacctgtgatgtgacagctcagatggtcttagtgtgctgctggcgctctatgaaggaagtggctctgttactgggcatgttatgtcagctgctcccaatgcagcctgtccccgagagttctgatgggttgctgacagttgaacaggtcaaggagatcggagattacttcaaacagcacctgctgcaatctaggcacagaggggctttcgagctcgcttacaccggctttgttaagttgactgaagtgctcaaccgatgccctaatgtttcactacagaaactgcccgaacagtggttatggagcgtcctagaagagattaagtgctccgatccatcctccaaactgtgcgctacaaggcgtagcgccgggattccattttatattcaagctctgttggcttcagagcctaagaagggtcggatggatctattgaagattacaatgaaagaactcatctcactcgcaggacctaccgatgatattcagtccaccgttccacaagtccatgccctaaatattctgagagcacttttcagagatacgaggcttggtgaaaatattataccatatgtggctgacggcgctaaggctgcgattttaggcttcacctcaccagtctgggcggtgcggaatagctcaactcttctcttctccgcactcatcacacgtatcttcggtgtgaagcgggctaaggatgagcattctaaaactaacagaatgacaggcagggagttctttagccggtttccagaactgtatccgtttctgctgaaacaattggagaccgtggccaacaccgtggattcagatatgggcgagcctaatagacatccctcaatgtttctgttattgctggtgttggagagactgtatgcctcccctatggatggcacctcttctgccttatccatgggaccctttgtgccattcattatgagatgtggccatagtcctgtctaccattcccgcgagatggccgcaagagcactggtacctttcgtcatgatcgaccacattcccaacactatacgcacattgctgtccaccttgccatcctgcacagaccagtgttttaggcaaaatcacatccacggaacactgttacaggtgttccatctgctgcaagcctacagcgattcgaaacatggaacgaattcggacttccaacacgaacttacggacattaccgtctgcactaaagccaagctctggttagccaagcggcagaacccatgtttggtgacccgggcggtgtacatcgacatacttttcctgcttacttgctgtcttaacaggtctgctaaagataaccagccagtcctggaatcgctgggattctgggaggaagtgcgaggaatcatctccggtagcgaactgatcaccgggttcccttgggctttcaaagtacccgggctgccccaatacctgcagtcattgacacggctagctattgcagccgtctgggcagccgcagctaagtcaggggaacgcgagacaaacgttccaatctccttttctcagctgttggagagtgcttttccagaggtgcggagtctcactctggaggctctgctggagaagtttctggccgcagcttccggacttggcgagaaaggggtgccccctctgctgtgtaatatgggggaaaagttcctcctcctggccatgaaagagaaccatccggagtgcttttgcaaaatcttgaagatactgcactgcatggatcccggcgagtggctgccacagaccgagcattgcgtgcacttgactccaaaagaattcttaatatggaccatggacattgccagtaatgagcgcagtgagatccagagcgtggccctcaggctggcctctaaagtgattagccatcatatgcagacctgcgtagaaaatagggaactgattgctgctgagctcaagcaatgggtccaacttgtgatcttgtcgtgcgaggaccacctgccaacagaaagtcggctcgcggtcgtagaggtgcttacttcaacaacccctctcttcctaacgaatcctcatcctatcctcgagctgcaggataccctggccctttggaaatgcgtcctaactctgctacagtcggaagagcaggcggtccgcgacgccgcgaccgagaccgtgacaacagcgatgtctcaggagaacacttgccaatcgacagagttcgcattctgccaagttgacgcctctattgcactcgccctggccttggccgtgctttgcgatctgctgcagcagtgggaccagctggcccctgggcttcctattctgctaggatggttgctgggagaaagtgacgatttggttgcttgtgtggaaagtatgcaccaggttgaggaggactacttgttcgaaaaggccgaggtcaacttttgggccgagactctgatcttcgtcaagtatctgtgcaagcatctgttttgtttgttgtcaaaatccggatggcggcccccatctccagagatgttatgccacctacagcggatggtgagtgagcagtgccacttgctgtcgcagtttttccgggagctgcctccagcagccgagtttgtgaagaccgtcgaatttactcgcctccgaattcaggaagaaagaaccctggcttgtctacggctcttggcatttctcgaagggaaagaaggcgaggacacactggtgctgagtgtctgggattcttatgccgaatctcggcaactgaccttgcctagaaccgaagcagcttgttag

SEQ ID NO: 26648 - DNA, 5862 bp, Artificial Sequence
  Description of Artificial Sequence: Synthetic coding sequence
atgggcgtgaagaagaagaaggagatgcaggtggccgccctgaccatttgtcatcaagacctggagactttgaaatcatttgcagatgtcgaaggcaaaaacctcgccagcctgctgctccactgcgttcagctcactgacggagttagtcagatccactatatcaagcaaatcgtacccctactagaaaaggctgacaaaaatggaatgtgcgaccccacgatccaaagttgtctggatatccttgccggcatctacctgtctctcagtttgaaaaacccactcaaaaaagtgctcgcatcctctttaaatagcctacccgatttttttttgccggaggctatgcacaggttcacttcaagactgcaggaagagcttaatacaactgatctgtatagttatcgaaaggtgactgacaacatatcttcctgtatggagaatttcaatctggggagagcctcggtaaacaaccttctaaagaatgtgcttcactttctgcagaagtccttgatagaaattctggaagagaaccggaaatgcgccgggaatcatatcattcagacacagctgatgaacgaccttctggtaggcatcagagtctccatgatgctagtccagaaagtacaggatttccaggggaacctttggaagacatcggactccccgatatggcagaacatgtgcgggttactgagtatattcaccaaagtcctgtccgatgacgacctgctgcagactgtccagtcaacaagtggcctcgcgatcatacttttcattaaaacgatgttccaccccagcgaaaagattccccacctaatatcttctgtcctcctgagatctgtggattgcacatcagttcccgagtggttcatgagttcttgtcggagcctgtgttgcggtgacatttctcagtccgcagtgttgttcctgtgccagggcacactggccatgctggattggcagaacggcagcatgggtcggtccggagaagccctgctcctagatacagctcacgtgctctttacactatcctctcagatcaaggaacccactctagagatgttcctgtctaggatattggcctcttggaccaactctgcaattcaggtcttggagtcctcgtccccttctcttaccgattccctgaacggaaatagtagcattgtgggacggctcctcgagtatgtgtacacacactgggaacatcctcttgatgccctcaggcaccagaccaagattatgttcaagaatctgctgcagatgcataggctcacagtggagggagccgattttgtacccgatcctttcttcgtcgaacttacggaatccttattgcgtttggagtggcacattaaggggaaatatacctgcctaggctgcctggtggaatgcatcggtgtcgagcatatcctggcaatagataaaacgatcccgagccagattttggaagtaatgggagaccagtctttagtgccctacgcctcagatcttcttgagacaatgttccggaatcataagtcccacctcaaatcccaaaccgctgagagctcctggatcgaccagtggcacgaaacctgggtctctccactgcttttcattctctgtgaaggtaacctggatcagaagtcatacgtgattgattactacctgcccaagctgctcagttactccccagagtctttgcaatacatggtaaagatcctgcagacctctatcgacgcaaagactggtcaggaacagagcttcccgagcctgggctcatgtaatagtagaggagctctgggtgccctcatggcatgccttcgcatcgcgagagcccacgggcacttacagagtgcaacagatacatgggagaacttagtctccgacgcaagaatcaaacagggactcatccatcagcactgtcaggttcggatcgacactcttggtttactgtgcgagtccaatcggagcacagagattgtatctatggaggaaatgcagtggatccagttcttcatcacttacaacttgaactcccaatcccccggcgtcagacagcagatctgctcattacttaagaaactgttctgccggattcaggaatcatcacaagtgctgtacaagttagagcagtccaagtctaagagagagcctgaaaacgagctcactaaacagcacccttcagtgagcctacagcagtacaaaaactttatgtcatcaatctgtaatagcctttttgaagcgctgtttccaggatcctcttatagcacacgcttttccgctctgactatcttggggtccattgccgaagtgtttcacgtccctgagggtcggatatatacagtgtaccagctctcccatgatattgatgtggggcggttccagacactgatggaatgtttcacctcgacattcgaggacgtgaagattcttgctttcgatctgttaatgaagcttagcaagactgcagtccatttccaggactcaggaaaactgcaagggttgtttcaggctgccctcgaactgtcaacttctacgaagccttacgactgcgtcactgcttcttacttgctgaacttcttgatttggcaggacgccctgccgtcctctctctctgcgtatctcacccagcaagtggcttgtgacaacggggaccgcccagctgcagtggtggaaagaaacaccctcatggtgataaaatgtctgatggaaaatctcgaggaggaggtcagtcaggcagagaacagcttactgcaggccgcagcggccttcccaatgtacgggcgcgtgcattgcatcacaggagcactgcagaagttgagcttgaatagcttacaacttgtctctgagtggcgtcccgttgtagaaaaactactcctcatgtcatatcgactgtccaccgtcgtgtctcccgtgattcagagcagctcacccgagggactgataccgatggacaccgacagcgagagtgccagcagacttcagatgatcctgaatgaaattcagccacgagatacgaacgactacttcaatcaggctaagattctgaaggagcatgactcttttgatatgaaggatctgaatgcatcggtggtgaacatcgacacaagtaccgagatcaaaggaaaggaggtgaaaacctgtgacgtcacagcacaaatggtgctggtgtgctgttggagatccatgaaagaagttgcgctcttgcttggaatgctgtgccagctgctaccgatgcaaccagtgcctgaatctagtgatgggctgctaactgtcgaacaggtaaaggagattggcgattacttcaagcagcatctcttgcagtccagacaccgaggagccttcgaactggcttacacaggttttgtgaaactgacagaggtgctgaacaggtgtccgaatgtgagcttgcagaaattacctgaacagtggttgtggtccgtactggaggaaattaaatgttctgatccatctagcaagttgtgcgccactcgcagatctgctggaatccctttttatatccaggctctactagctagcgagcccaagaaaggtcgcatggatcttctcaaaattaccatgaaagaactcatatccctcgccggcccaacagacgatatccagtccactgtgccgcaggtacacgccttgaacatcctcagggcgctctttcgcgatactcgcttgggcgaaaatatcatcccttacgtggccgacggtgcaaaagctgccatactggggttcacaagcccggtgtgggctgttcgaaattcgtcaacgctactcttcagcgcactcatcacgagaattttcggggtgaagcgcgcaaaagacgagcactccaagaccaaccggatgacagggcgcgagttcttctctcggtttcctgagctgtatccatttctgctcaaacaattagagaccgttgctaacaccgtcgattcagacatgggagagccgaatcgccatccatctatgttcctccttttactcgtgctggagcggctttacgcttcccccatggacggcactagctcagccttgtctatgggccctttcgtaccgttcatcatgcgctgcgggcattcccccgtgtatcactctcgtgaaatggctgctagagctctggtgcccttcgtaatgatcgatcatatccccaacactatcaggacattgctgtcaacactccccagctgcacagatcagtgctttcgtcagaaccatatccacgggacactcctgcaggtgttccacctgctgcaggcttatagcgactctaaacatggcactaattctgacttccagcacgagctgacggatatcactgtgtgtacaaaggcaaaactatggctcgcaaaaaggcaaaatccatgtcttgtgaccagggccgtctacatcgatatcttatttctgctgacatgttgcctcaatagatctgcgaaagacaaccagccagtgctcgaaagcttgggcttctgggaggaagtcagggggataattagtggatccgagttaattacagggttcccttgggcatttaaggtgcccggtttgccacagtatttgcagagcctgacaaggttagccatagccgccgtgtgggccgccgccgctaaatcgggagagagggaaactaacgtacctatctccttttcacagctcctggagtctgcattccccgaggttaggtccttaacgctggaggcgctactggaaaagttcttggcagccgccagcggcctcggagagaaaggcgtgccacccctattgtgcaatatgggtgaaaaattccttcttctggctatgaaggagaatcaccccgaatgtttctgcaagattctcaagattctgcattgcatggaccccggagagtggctcccgcagactgagcactgtgtccatctgaccccaaaggaatttctgatctggacaatggacatcgcctccaacgaaagatcagaaatccagagtgtggccttacgcctcgcctccaaagtgatctctcatcatatgcaaacctgcgtggagaacagggaacttatcgctgctgaactcaagcagtgggttcagctggtgatcttgagttgtgaggaccacctgccgactgaatcaagactggctgtcgtagaggtgcttacctccacgaccccactgtttctcactaatcctcatcctatactggagctccaggatacccttgctctgtggaaatgtgtgctcacgctcttacagtcagaggaacaggccgttcgggatgcggcaaccgaaacagttaccactgccatgtcacaggagaatacatgccagagcacagaatttgcattctgtcaagtggacgcatccattgctctcgccctagccctggctgtgttgtgtgacttgctgcagcagtgggatcaattagcccccggcctgccaattctcctgggctggcttttgggcgagagtgacgatcttgtcgcctgcgtggagagcatgcaccaagtggaagaggactaccttttcgagaaggcagaggttaatttctgggctgaaacattaattttcgtgaagtatctgtgtaagcacctcttctgtttattgtcaaagtccggttggcgccctccgtcgccagagatgctgtgccacctccagcggatggtgagcgagcagtgtcacctactctcacaattttttcgcgagctgccccccgctgctgagttcgtaaagaccgttgagttcacccgactgaggatccaagaggagagaaccctggcatgtctgagacttctggcatttttggaaggtaaagagggcgaggataccttggtcctcagcgtgtgggattcatacgctgagtcccgtcaactcactttaccgaggaccgaggctgcttgttag

SEQ ID NO: 26649 - DNA, 4905 bp, Artificial Sequence
  Description of Artificial Sequence: Synthetic coding sequence
atgagcagctgccggagcctgtgctgcggcgacatcagccagagcgcagtgctcttcctatgtcagggaaccttagctatgctcgactggcaaaacggttctatggggcgcagtggcgaagccctcttactcgacactgcccatgttctgtttacattgagttcccagattaaggagcctactctggaaatgttcctgtccagaatccttgcctcctggactaactcagctatccaggtacttgagtcctcctctccctctttgactgacagcttgaatggaaacagttcaatcgtcggccgcttattggagtatgtgtacacacactgggaacaccctcttgatgcccttaggcaccaaaccaagattatgttcaagaaccttctgcagatgcacaggctcaccgtcgagggcgcagactttgtccccgaccctttttttgtcgagctcacagagagccttcttagattggagtggcatatcaaaggcaaatacacatgcctgggctgtctggttgaatgcattggcgtggagcacattctcgccatcgataaaactatacctagccagatcctcgaggtcatgggcgatcagagcctcgtgccctatgctagcgacctcctggagaccatgtttcgcaaccacaaaagccacctcaagtctcagaccgctgaatccagctggattgaccagtggcacgagacgtgggtgagccctcttctgtttatcctgtgtgaagggaacctggaccagaaaagctatgtcatcgattactacctacctaagctcttgtcttactctccagagagtttacaatatatggtgaaaatcctgcagaccagcatcgatgcaaaaacaggccaggaacagagcttccccagtctcgggagttgcaattctaggggggctctcggcgccctgatggcctgtttgaggatagcgcgcgcccacggacaccttcaatccgccaccgacacatgggaaaacttggtttcagatgcccgaatcaagcagggtctcattcaccagcattgccaagtacgcatagacacattgggtctgttgtgcgagagcaacaggagtacggagattgtgagtatggaggagatgcaatggatccaatttttcatcacatacaatcttaatagtcaatcccctggggtgcggcaacagatttgctccctcctcaagaaattattctgccgtatccaggaatcctcacaagtgttgtacaagcttgaacagagcaaaagtaagagagaacctgaaaacgagttgacaaagcagcatccttccgttagtctgcagcaatataagaatttcatgagctcaatctgtaattccctgttcgaggccctctttcctggatccagttattcaacccgcttttccgctcttaccatattgggtagcattgctgaggtcttccacgtccccgagggacgtatatacaccgtttaccagttatctcatgacatcgacgtcggaaggttccagactctcatggaatgctttacttccacgttcgaagatgttaagatcctcgccttcgatctgctgatgaagctgtcaaagacggctgtccacttccaggactccgggaaactacagggcctgtttcaagccgcactggagctgtcaacctctaccaagccgtatgactgcgtgactgcctcctatctgctgaatttcctaatttggcaagatgccctgccctcttcactttccgcctacctgacacaacaggtggcgtgcgataacggcgacagacctgctgctgtggtggagaggaacacactgatggtgatcaaatgtctgatggaaaacctggaagaagaagtcagccaagctgagaactctctgctgcaggctgccgccgctttccccatgtatggccgagtacactgtattacaggggcccttcagaagctcagcctgaactctctacagctagtgtctgagtggagaccggtggtcgaaaaattgctgctcatgtcctacagactgtcgacagtggtgtcccccgtgatccagtccagtagccccgaggggctcatacccatggacactgattccgagtctgcttcaaggctccagatgattctcaacgagattcagccccgtgataccaatgactacttcaaccaggcaaagattctgaaagaacacgattccttcgatatgaaggatctgaacgcttcagtggtgaatattgacacgtcgaccgagattaaaggcaaggaggtgaaaacctgcgatgttacagcccaaatggttcttgtgtgctgctggcggtctatgaaagaggttgcccttctgttagggatgctatgccaactgctgccaatgcagcctgtgcccgagtcttccgatggtctgctaactgtagagcaggtcaaagagatcggcgactacttcaaacagcatctgctgcagtctcgccataggggagcattcgaactggcctacactgggttcgttaaacttactgaagtgcttaaccgttgcccaaatgtgtcgctacaaaaacttcctgagcaatggctgtggagcgtgctggaggagattaaatgcagcgaccccagttcgaagctgtgcgccacgagaagaagtgcaggcatcccattctatatccaggctctgctggcaagtgaacctaagaaaggacgcatggatctgctgaaaatcacgatgaaggaattgatttcactcgcaggccccactgacgatattcagtccaccgtgccacaggtacatgccttgaacatcctgcgggcactgtttcgggataccagacttggcgagaacatcattccgtacgtggcagacggggcaaaagcggccatactgggcttcacttcccccgtgtgggcttcacagatgacagggagagaattcttttctcgatttcccgaattgtatcctttcttactgaagcaattggagactgttgcgaacacggtggactccgacatgggcgaacctaatagacacccttctatgttcttgctgttactggtgctcgaaaggctgtatgcaagtcccatggacggtaccagttcagccttgtccatgggcccttttgtgccctttattatgcgttgcggacactcacctgtgtaccactctcgcgaaatggccgctcgcgcactggtaccttttgtgatgatagaccacattcccaacaccattagaaccttgctgtccactctgccatcgtgcaccgaccagtgttttcgccagaaccacattcatggaacactgctccaggtgttccacctactgcaagcatacagcgactccaaacacggcactaacagcgattttcagcatgagctgactgacattacagtttgcacaaaggccaagctgtggttggccaagcgccagaacccgtgtctggtgacccgggcggtgtacatagacatcttgtttctactcacatgttgtctgaataggtctgccaaggacaatcagcctgtgctggaatccctgggattttgggaagaagtgcgagggatcatttctggatccgagctgattacggggtttccttgggcattcaaagtgcctggcctcccccagtatttgcaatcccttactagacttgcgatcgccgccgtgtgggccgctgccgccaaaagcggtgagcgggagaccaatgtgccaatctccttttctcagttgctggagtctgcttttccagaggtcagatctttgactttggaagcactgttagaaaagtttctcgccgctgcctcgggtttgggggaaaaaggagtaccaccactcttatgcaatatgggcgaaaaatttctgctcttggctatgaaggagaatcatcccgagtgtttttgtaagattctgaaaatcctccactgcatggatcccggggagtggcttcctcagaccgagcactgtgtccaccttacacccaaagaattcttaatttggacaatggacatcgcctccaacgagcgcagcgagattcagagcgtggccctccgtctggcttccaaagtgatatcacaccacatgcagacctgcgttgagaaccgagaactcatagccgccgagctaaagcaatgggtccagctagtgattttatcgtgtgaggaccatctgccaactgagagccgcctggctgtggtggaggtcctcacgagcactaccccactgttcttaaccaatcctcatcccatccttgagctgcaagacaccctagctctgtggaaatgtgtgcttaccctgctgcagagtgaggagcaggcagtgagagacgcggccaccgagaccgtgacgacggccatgagccaggagaacacatgccagtcaaccgaatttgctttttgtcaagttgatgcaagtatcgcgctcgcactcgctttggctgtgttgtgcgacctgttgcagcaatgggaccagttagcccccggtctgccaatactcctgggatggctgttgggggagtcagatgacttggtggcgtgcgtcgaaagtatgcatcaggtggaagaagattacctctttgagaaagccgaggttaatttttgggccgagactctgatctttgtgaaatacctttgtaaacatctcttttgtctgcttagtaagtccggatggaggcctcctagcccagaaatgctgtgccatttacaacggatggtgtccgagcagtgccatctgctgagccagtttttccgagagctgccacctgcagcggagtttgtaaagacggtcgaatttacaaggctgaggatccaggaggagcgaactttggcctgtttgaggttactggcttttctggaagggaaagagggcgaggatacactggtgctgagcgtttgggatagctacgccgaatcacgccaactcacactgccgcgcactgaggccgcctgctag

SEQ ID NO: 26650 - DNA, 2685 bp, Artificial Sequence
  Description of Artificial Sequence: Synthetic coding sequence
atgggcgtgaagaagaagaaggagatgcaggtggccgccctgaccatctgtcaccaagacctggaaacactcaaaagcttcgcagatgtagaagggaaaaatcttgccagcctcttactccattgtgttcaactaaccgacggcgtgagccagatccattatatcaaacagattgtgccgctactcgagaaggctgacaagaacggaatgtgcgatccgactatacagagctgcctggatattctggcagggatttacctcagcctatcccttaagaaccccttaaagaaagtgctggcaagtagcctgaacagcctgcccgactttttcctgcccgaggccatgcacagatttacatcaaggctgcaggaggaactgaatactaccgatctgtactcctatagaaaagtcaccgataacatcagcagttgtatggagaacttcaatttgggaagggcctccgtgaacaatctgctgaagaatgtactgcatttccttcaaaagagcttgatcgaaattctcgaggaaaaccgcaaatgtgctggtaaccacattatccaaacccaactgatgaacgacctcttggtgggcattagagtttctatgatgctggtgcagaaggtgcaggactttcagggcaatttgtggaagaccagcgactcacccatctggcagaacatgtgcggtttactctcaatctttaccaaagttctttcagacgatgatctactgcaaacagtccaatcaacaagtggcctggcaatcatcctgttcatcaagaccatgttccacccaagtgaaaagatccctcacttgatctcaagcgtcttgctgagatccgtagactgtacatctgtccccgaatggtttatgtctagctgccgctccctctgctgtggagatattagtcagagcgccgtcctgttcctctgtcagggcactctggcaatgctcgattggcagaacgggagcatgggaagatctggggaggctctgctgctggatactgcacatgtgctgtttaccttgagcagccaaatcaaggaacctacattagagatgttcctctctaggatactggcttcgtggaccaactctgctatccaggtcctcgagtcttctagcccctctctgacagactcccttaacggaaacagcagtatcgttggacggctgctggaatacgtctacacacactgggaacaccctctggacgccctaagacatcagactaaaatcatgtttaagaacctgctccaaatgcacagattaactgtggaaggtgccgacttcgtgcccgatcccttctttgtggaactgactgaaagcctgctgcgactggaatggcatattaagggcaagtatacctgcctagggtgcttggtcgagtgcatcggcgtggaacacattctggctatcgacaagacgataccttctcaaatcctcgaggtcatgggagaccagagcttggtgccttatgcgagtgaccttctggagacaatgttccgcaatcacaaaagtcacctcaagtcgcagaccgcagagtcaagctggatcgatcagtggcatgagacttgggtctctccactgctattcattctatgcgagggcaacctggatcaaaagtcctacgtgattgactactacctgccaaagctcctcagctatagccctgagtccctgcagtacatggtaaagattctgcagacatcaatcgacgcgaaaaccgggcaggaacagagcttcccttcattagggtcttgtaactcgaggggggccctgggcgccttgatggcatgtttgagaatcgctcgagcccatggacacctccagtccgccacagatacatgggagaacctggtgtctgatgccaggatcaaacaggggctcatccaccaacactgtcaggtgaggattgacaccttgggattgttgtgcgaatccaatagaagtaccgaaatcgtctctatggaagagatgcagtggatacagtttttcatcacttacaacctcaactcgcagagccctggggtccgacaacagatctgttcactgctgaaaaaactgttctgccgcattcaagagtccagtcaggttctttacaaattagaacagagtaaatcgaaacgtgagcccgaaaacgagctgacaaagcagcacccttccgtctccttgcaacaatacaagaattttatgtccagtatttgcaattctcttttcgaggcactgttcccaggatcgagctactctacaagattcagtgcccttacgatactggggtccatagcggaggtcttccacgtaccagagggcagaatttatacggtgtatcaactgagccacgatatcgacgttggcagattccagacactcatggaatgcttcacaagcaccttcgaggatgttaagatactggcctttgatctgctgatgaaactaagcaaaacagcagtccacttccaggattcaggcaagttacaaggcctgttccaggccgcactcgaactgtccactagtactaaaccctacgactgcgtgacggcctcttatttactgaattttcttatttggcaggatgcccttcctagtagcctgtcagcctacctgacgcagcaggtcgcctgtgacaacggagatcgaccggccgcagttgtggagcggaacacactcatggggctttattag

SEQ ID NO: 26651 - DNA, 2268 bp, Artificial Sequence
  Description of Artificial Sequence: Synthetic coding sequence
atgagcggcaccaacctggacggcaacgacgagttcgacgagcagttgaggatgcaagaactttacggtgatggtaaagacggcgacacacagactgatgctggaggggagccagacagtttgggtcagcaacctacggacactccctacgagtgggatctggataaaaaagcgtggttcccgaagattactgaggatttcattgctacataccaagctaactacggcttctccaatgatggggcttcctcttcgacggctaacgtcgaggatgtacacgcgaggactgccgaggaaccacctcaagaaaaggctcctgagcccacagatgccaggaaaaagggagaaaagcggaaagccgagtccgggtggttccacgtggaagaagatcgcaatactaatgtgtacgtctctggtttacctcctgatatcaccgtggacgagtttatccaacttatgtctaaattcgggatcatcatgcgggatccacagactgaggaatttaaggtgaagctgtataaggacaatcagggaaacctgaaaggcgacggcctctgttgttacctgaagcgagagtcagtggaactggcactgaagttactagacgaagatgagatcagaggttacaagctgcacgtcgaagtagccaaattccaactgaagggggagtacgacgcatcgaaaaagaaaaagaaatgtaaggactacaagaagaaactctccatgcagcagaagcagctggattggcgccctgaaaggagagccggtcccagcaggatgcgacacgagcgcgtggtaattatcaagaacatgttccacccaatggacttcgaggacgatcccctggtgctaaatgagatcagggaggaccttcgtgtggagtgtagcaagttcggccagattcgtaaactcttattgtttgatagacacccagacggggtggcaagtgtctccttcagagaccctgaggaagctgattactgtattcagactctagatggccgctggttcgggggccgccaaatcactgcccaggcctgggacggcacaactgattaccaggtggaggagacttctcgagaacgcgaggagcgcctgagggggtgggaagcatttttgaacgctccagaggcaaaccgcggcctgcgcagatccgactcagtttctgcttctgagcgagccggtccttcccgagctagacatttttcggaacacccatctacaagtaaaatgaatgcccaggagacagccacggggatggcatttgaggagcctatcgacgaaaagaagttcgaaaagaccgaagacggcggagaattcgaggagggcgcaagcgagaataacgcgaaggagtcttccccagaaaaagaggccgaagagggatgccctgaaaaggagagtgaggagggctgccccaaacgcgggtttgaaggaagctgctcccaaaaggaaagcgaagaagggaaccccgtaagaggatcggaggaggatagccccaaaaaagaaagcaaaaagaaaacactgaagaatgattgtgaggagaacgggctggcaaaagagagcgaagatgacctgaacaaggagtccgaagaggaggtcggacctaccaaagaatcagaggaggatgatagtgaaaaagagtctgacgaggattgttctgagaaacagtctgaggacgggtctgaacgggagttcgaagagaacgggctcgagaaagacctcgacgaggaggggtcagagaaggagctgcacgaaaatgtgttggacaaggaactcgaggagaatgacagcgaaaattctgagttcgaggatgatgggagcgagaaagtgctggatgaagaaggctcagagcgggaattcgatgaggatagcgatgaaaaggaggaagaagaggatacatatgagaaggtattcgacgacgaatctgacgagaaagaagatgaggaatacgctgacgagaagggactggaggccgcggacaaaaaggccgaagagggtgatgccgatgaaaaactttttgaggaaagtgatgataaggaggatgaggacgcagacggaaaagaagtggaggatgccgatgaaaagctgtttgaagacgacgattcaaacgagaaactgttcgatgaggaggaagactcttcagaaaagctgttcgatgacagcgatgaaagaggaacactgggaggctttgggagtgtggaggaagggcccttatcaaccggatccagctttattctttcgtccgacgatgatgatgatgatatttag

SEQ ID NO: 26652 - DNA, 432 bp, Artificial Sequence
  Description of Artificial Sequence: Synthetic coding sequence
atgaccaagatgtacaagggcttccaggccctgggcgacgccgccgacatcaggtttgtgtatacccctgcaatggaatcagtgtgcggctacttccaccgctctcacaaccgcagtgaggagtttctgatagcaggtaagctccaagacggactcctgcacattaccacatgttcatttgtggcaccatggaacagtttgagtcttgctcagcgccgcggatttaccaagacatatactgtcggctgtgaggaatgtaccgtgtttccttgtctgtctattccttgtaaactccagagcggaacccattgtctctggactgatcaactcctgcagggatcagaaaagggcttccagagccggcaccttgcgtgcctgccccgcgagccaggcctgtgtacttggcagagcctaaggtcccagatcgcttag

SEQ ID NO: 26653 - DNA, 786 bp, Artificial Sequence
  Description of Artificial Sequence: Synthetic coding sequence
atgcccctgaccagcggcagcagcaccccccccccctggcgggtgagcgccgatacctccaccggaccaactacagctgctcggtcctttagccttctcgttaggcaccgaccacgcgcgctgtgtcacacgaaccagagcttagggcgtggcctcgctacaacacgagggagaggctccgacggaaacggccccactggcaatggcgatcacccgaatttttccctgtctgaaggccgggccttcggatctctggccgctcagcccattactagctgtttgagcgtccccgcgccacccttttcactgggtaagctccaagatggtctgctgcacataacaacctgtagcttcgtggccccgtggaattccttaagcctggctcagagaagaggatttactaagacatataccgtgggctgtgaggagtgtaccgtttcagcatggactctaacatccaacggccggtcttttcctggcccctttccaaagagctgggcctgctttctcctgcccctggcaatcctctgcccttgcggttgtagtccgactcttagagcagtgcctgatctgtcctgttacttccctaaacccgaaactgctccacttcagattctggctgccccattcccctgtgttcagtatcgggtgattacgtgcccaagcctcgtgcccctgatcctgccttgcgattattcagtgatccctttgccagtgcccgagccaccgggcctttttttgggatcacctgagtgtagtccccggacccagtccgctgtgccctag

SEQ ID NO: 26654 - DNA, 291 bp, Artificial Sequence
  Description of Artificial Sequence: Synthetic coding sequence
atgcccgtgtacagcgcctggcccgccgagcccaccatggcccccttcgaacccttggctagtggcatcttactgttgctatggttgatagccccctcacgggcctgtacttgtgtcccaccccatcctcagaccgctttttgtaattccgacttagtgatcagggctaaattcgtgggcacccccgaggtgaatcagactaccctgtaccagcgatatgagatcaagatgaccaagatgtataaaggttttcaggctctcggtgacgcagcagatattagattcgtttag

SEQ ID NO: 26655 - DNA, 498 bp, Artificial Sequence
  Description of Artificial Sequence: Synthetic coding sequence
tgaccccgggccctgtgccacaccaaccagagcctgggccggggcctggcgaccacacggggaaggggctccgacggcaatgggccaactgggaatggggaccatccaaattttagcctgagtgagggccgggcgttcggctcgcttgccgcgcagcccattacgtcctgtctgagtgtgcccgcccccccttttagcttaggcaaactccaggatggcttgcttcatattaccacctgtagtttcgtagccccttggaactccctctctttggcccagcgcagaggatttaccaaaacgtacaccgtgggatgcgaggagtgtacagtgttcccttgcttgagtattccttgtaagctgcagagcggaacgcactgtctgtggaccgatcagctcctgcaaggtagtgaaaaggggttccagtctcgtcacctcgcttgcctgccccgggagcccggtctctgtacctggcagagcctgaggagccaaatcgcttag

SEQ ID NO: 26656 - DNA, 411 bp, Artificial Sequence
  Description of Artificial Sequence: Synthetic coding sequence
atggcccccttcgagcccctggccagcggcatcctgctgctgctgtggctcatcgctccctccagagcatgtacatgcgttccgcctcatccacagacagctttctgcaactctgacttggtgatcagggccaagttcgttggaacacctgaagtgaatcagacgaccctatatcagagatatgagatcaaaatgacaaagatgtacaaagggttccaggcccttggcgacgcagccgacataaggtttgtttacaccccagccatggagtctgtgtgtgggtactttcacagatcccataaccgctcagaagaattcctgatcgccggagaggccccatccccgcgcccggttccccatcagccggttcctggggctcgcccaagtaatcatgagggagcaagactgtag

SEQ ID NO: 26657 - DNA, 663 bp, Artificial Sequence
  Description of Artificial Sequence: Synthetic coding sequence
atgggcgccgccgcccggaccctgcggctggccctgggcctgctgctgctcgccacactgttgcggcccgcagatgcctgttcctgcagtcccgtccaccctcagcaggctttttgtaatgctgatgttgtgataagggccaaagctgttagtgagaaagaggtagatagcgggaacgacatctatggcaatcctattaagcgcattcagtatgagataaagcagataaagatgttcaagggcccagaaaaggacatcgaatttatttacaccgccccttcgtctgccgtttgtggcgtgtcactggatgtgggggggaagaaagagtacctgattgccggcaaagcagagggtgatggaaagatgcacatcaccttgtgcgacttcattgtgccgtgggataccttgagcaccacacagaagaaatcccttaatcatcgctaccagatggggtgcgagtgcaagatcactagatgccctatgattccatgctatatatcatctcctgatgaatgtctgtggatggattgggtaacagagaagaacattaatggacaccaggctaagttcttcgcttgcattaagaggtcggatggttcctgtgcctggtataggggtgccgctccgcccaagcaggaatttctcgatatcgaagatccctag

SEQ ID NO: 26658 - DNA, 432 bp, Artificial Sequence
  Description of Artificial Sequence: Synthetic coding sequence
atgttcaagggccccgagaaggacatcgagttcatctacaccgcccccagttcagcagtgtgcggtgtttctctggatgtaggaggtaagaaggagtacctgatcgctggcaaggctgagggcgacgggaagatgcacattaccctatgcgattttattgttccctgggatacccttagcactacacagaaaaagtctctgaaccacagataccagatgggctgcgagtgcaagattaccaggtgtcctatgataccttgttacatttctagcccagacgagtgtctttggatggactgggtaactgaaaagaatatcaatgggcaccaagccaagttcttcgcgtgcatcaagcggagtgatgggagctgcgcatggtacagaggtgcggctccccccaaacaggagttcttagacattgaggatccttag

SEQ ID NO: 26659 - DNA, 636 bp, Artificial Sequence
  Description of Artificial Sequence: Synthetic coding sequence
atgaccccctggctgggcctgatcgtgctgctgggcagctggagcttaggggattggggcgccgaagcttgtacatgctcaccgtcacatccacaggatgctttttgtaatagtgatatagtaatcagggcgaaggttgttggcaagaagctcgtcaaggaaggcccattcggtacactggtgtacaccatcaaacaaatgaaaatgtacaggggctttactaaaatgccgcatgtgcagtatattcacactgaagcttcagagtcactttgcggactcaagctggaggttaacaaataccagtacctgctgaccgggagagtgtatgatgggaagatgtataccgggctgtgcaacttcgtggagagatgggaccaactgaccctgagccagagaaaagggctcaactacaggtaccacttgggttgcaattgtaagattaagtcctgttactacctgccttgctttgtaacaagcaagaatgagtgtctgtggaccgacatgctgtcgaatttcggctatcctgggtaccagtccaagcactacgcgtgcatccgtcagaagggcggctactgctcttggtacaggggatgggctccacccgataaatctataattaacgcaacagacccatag

SEQ ID NO: 26660 - DNA, 438 bp, Artificial Sequence
  Description of Artificial Sequence: Synthetic coding sequence
atgaagatgtaccggggcttcaccaagatgccccacgtgcagtacatacacacggaagcttctgagtccctctgcggcctgaagctagaagtgaacaagtatcagtatctgctgacgggcagagtctacgatggcaagatgtatactggactgtgcaactttgtggagagatgggatcagttaacactcagtcaacggaaaggcctgaactataggtatcatctcggttgcaactgcaagatcaagtcatgctattacctaccttgttttgttacatctaagaacgaatgcctatggacggacatgctgagcaactttggctaccccgggtaccagtctaagcattatgcatgcatccgccagaaaggcggatattgctcttggtacaggggatgggccccacccgataagtcaatcatcaacgcaaccgacccatag

SEQ ID NO: 26661 - DNA, 675 bp, Artificial Sequence
  Description of Artificial Sequence: Synthetic coding sequence
atgcccggcagcccccggcccgcccccagctgggtgctgctgctgagattgctggccctcctacgacctcctggacttggcgaggcttgtagctgtgccccagcacatcctcagcagcacatctgtcacagcgccctggtgatccgggccaaaatctcttctgagaaggtcgtgccagcttccgcggatccagccgatacggaaaaaatgttacggtacgagatcaaacagataaagatgtttaagggatttgagaaggtcaaggacgtccagtacatttacaccccttttgatagctctctttgcggagttaaactggaggcaaatagccagaaacagtacctacttacaggccaggtgctttcagacggaaaggtgtttatccatctctgcaactacatagagccttgggaggatttgagtctggtgcagcgggaatccctcaatcatcactaccacctgaactgtggatgccagattactacctgttacaccgtgccctgcacaattagcgctcctaacgaatgcctctggacagactggcttttagagagaaaactgtatggttaccaggcacagcactacgtctgcatgaagcacgtcgatgggacctgctcctggtatcggggccacctcccactccgcaaggagttcgtagatattgtacagccatag

SEQ ID NO: 26662 - DNA, 1164 bp, Artificial Sequence
  Description of Artificial Sequence: Synthetic coding sequence
atggtgcactgcagctgcgtgctgttccggaagtacggcaacttcattgataaacttcgcctgtttactcgcggcggttcaggcggaatgggatatccacggctcggaggagaaggcggcaaggggggcgacgtttgggtagtcgcacagaaccgaatgacccttaagcagctgaaagatcggtaccctagaaagagatttgttgccggcgtgggtgccaactccaaaatctctgcccttaaaggttccaagggcaaggattgtgaaattcctgttcccgttggtataagcgtaactgacgagaacggtaagatcattggcgaattaaataaagaaaatgaccggattctggtcgcccaggggggattgggaggtaagctgcttaccaattttctccctctgaaaggacagaaacgtatcatacatctggatttgaagctgatcgccgacgttgggctggttggctttcctaacgcaggcaaatccagccttctttcctgtgttagccatgcaaagcccgccattgccgactatgctttcactaccctgaaacccgagctgggcaagatcatgtattccgatttcaagcagatttccgtggcagacttgccaggcctcattgaaggggcgcacatgaacaaagggatggggcataagttcctgaagcacattgagcgcactcggcaacttttatttgtggtggacatttcagggttccagctctcttcccacactcagtaccgaacggcttttgaaaccattattcttttgactaaggaactggagctatacaaggaagagctgcaaactaaacctgcgctgttagccgtgaataagatggacctcccagacgctcaggacaaattccatgagttaatgagccagctgcagaacccgaaagacttcttacacttattcgaaaagaacatgattccggagagaacagtggaattccagcacatcatcccaatttccgcagtgaccggagagggaatcgaagagctcaagaattgtatcaggaagtctctggacgaacaagcaaaccaggaaaacgacgcactgcacaagaagcagctcttaaatttgtggatttccgacaccatgtccagtaccgagccccccagcaaacatgccgtcaccaccagtaaaatggacatcatttag

SEQ ID NO: 26663 - DNA, 375 bp, Artificial Sequence
  Description of Artificial Sequence: Synthetic coding sequence
atggaccccgcccggcccctgggcctgagcatcctgctgctgttccttacagaggccgccttgggtgatgccgcacaagagccaaccggtaacaacgccgagatctgcttgctgccattggactatggaccatgtagggcattgctactgcgctattattatgatcgttatacccagtcctgccgtcaattcttatatggtggctgcgagggtaatgctaacaacttctatacttgggaagcctgtgacgacgcttgctggcgcatcgaaaaggtccccaaactctcaagtatgacaagtctgaagaaaaagaagaagatgcctaagctgcgattcgcatctcgtatcaggaaaatacgcaagaagcagttttag

SEQ ID NO: 26664 - DNA, 1506 bp, Artificial Sequence
  Description of Artificial Sequence: Synthetic coding sequence
atggccgccgccagcgtgaccccccccggcagcctggagctgctgcagcctggctttagcaaaaccctcctaggaacaaaactcgaggccaaatatctgtgttccgcgtgccgcaacgtgttgagacgcccttttcaggctcaatgtggccatagatattgttccttctgtcttgccagtatcctgtcctctggccctcaaaactgtgccgcttgtgttcacgaagggatctatgaagaagggatcagcatcctggagagcagttctgctttcccagataacgcagcccgaagggaggtggagtccctccccgccgtgtgtcccagcgacgggtgcacatggaagggcactctgaaggagtatgaaagctgccatgagggacgctgccccctgatgctcactgagtgtccagcttgtaaggggctagtccggttgggagagaaggaacgacatttggagcacgagtgcccagagcggtcgttgtcctgcagacactgccgagccccatgctgcggggccgacgtcaaggcccatcacgaggtttgccccaagtttccgttgacctgcgatggctgtggtaaaaaaaagatcccgcgggagaaattccaagaccacgtcaagacctgcggcaagtgtcgggtgccttgtaggtttcatgctatcggatgtcttgagacagtggaaggtgagaaacagcaagaacacgaggtgcagtggttgcgtgaacatctggcgatgctgctcagttctgtgctggaagccaaacctcttctgggcgaccagagccacgccggcagcgaacttctccagaggtgtgagagtctggaaaagaagacagctacgttcgaaaatattgtctgcgtcctaaaccgtgaggtcgaaagagttgcaatgactgctgaggcatgcagtagacagcatcgcctggaccaggataaaatcgaggccctctccagtaaggtgcagcaactcgaaagaagcatcggtctcaaagacctggccatggccgacctggaacagaaagtattggagatggaagccagcacctacgatggggtgttcatatggaagatttctgactttgcccgtaagcgtcaagaggccgtagcaggacgaattcctgccatcttctccccagcgttctacacatccaggtatggctacaaaatgtgtttgaggatttatctgaacggcgacggaacaggccggggtacccacctctctctgttcttcgtggtgatgaaaggtcctaacgacgcccttttacggtggcctttcaatcagaaagtgacattgatgctgctggaccagaataatcgcgaacacgtaattgacgcgtttagacccgacgttacttccagctcctttcagagacccgtaaacgatatgaacatcgcatctggctgccctcttttctgccctgtcagcaagatggaggccaaaaacagctacgtacgggacgacgcaatcttcatcaaagctattgtggacctgacaggcctctag

SEQ ID NO: 26665 - DNA, 1662 bp, Artificial Sequence
  Description of Artificial Sequence: Synthetic coding sequence
atggccgccgccagcgtgaccccccccggcagcctggagctgctgcaacctggattctcaaagacacttctgggcaccaagctcgaggccaagtacttgtgctctgcttgccgaaacgtcctgcggcgaccgtttcaggcccaatgcgggcaccgctactgcagcttctgcctcgcatcgatcctgtctagcggacctcagaactgcgctgcttgcgtacacgaggggatctacgaagaggggatttctattctggagtcctcttctgcctttccagataacgcagctagaagggaggttgaaagcttgccagcagtttgccccagtgatgggtgcacctggaagggcactctgaaagaatatgaagtgaagatgcctgcttgtggaatggtcaccgaagcccctgcggtcgggtctcggccccgctcgcctagctcctacgatctggttctgcatgtgccgcttacgggcgccgaggcctgcctgatgtccgtggaggaagaaaccgagctgctgttacgctcctgccatgaaggcagatgccccctaatgctcactgagtgtccggcctgtaagggtttagtaaggctaggagagaaggaacgacatcttgaacatgaatgccctgaacgatcacttagttgtcgacattgccgggcaccctgctgtggcgcagacgttaaagcgcaccacgaggtttgtcccaagttccctctgacttgtgatggctgcggaaagaaaaagattcctcgagagaagtttcaagatcacgtgaagacctgcggcaagtgccgcgtcccttgcagattccacgctatcggatgtctggaaaccgtggaaggggaaaaacagcaggaacacgaggtgcagtggctacgggaacacctcgccatgttactgagctccgtgctggaagctaagcccctcttgggcgatcagtctcatgccggcagtgagctgttacagcgctgcgagtcattggagaaaaagaccgcaactttcgagaatattgtttgtgtgctcaacagggaggtcgaaagagtggcgatgaccgcggaggcatgttccagacagcacagactggatcaggacaaaatcgaggcactgtcttctaaggtccagcagctggaacgatcaataggactgaaagatttggcaatggcggatctcgagcagaaagtgctggagatggaagccagcacgtacgacggcgttttcatttggaagattagtgattttgcccggaagaggcaggaagccgtggcaggccgcattcccgcaattttttcacccgccttctatacgagcagatacgggtacaaaatgtgcttaagaatttacctcaacggcgacggtacggggagagggacccatttgagtttgttttttgtggtgatgaaaggccccaacgacgctctattgagatggccttttaatcagaaggtgacgctgatgctcctcgaccagaacaaccgggaacatgtaatcgacgcttttcggccggacgtgacgtctagcagttttcaacgaccggttaatgatatgaacatcgccagcggatgcccgctattttgccccgtgtccaaaatggaggcgaaaaattcctacgtccgcgacgacgcgatttttatcaaggccattgttgacctgactgggctgtag

SEQ ID NO: 26666 - DNA, 1269 bp, Artificial Sequence
  Description of Artificial Sequence: Synthetic coding sequence
atggccgccgccagcgtgaccccccccggcagcctggagctgctgcagccaggcttctctaagactctgctcgggactaagttggaggcaaaatacctgtgtagcgcttgccgcaatgtcctgaggcgacctttccaggctcaatgtgggcacagatactgtagcttctgcctcgcaagtatcctttcttcgggacctcagaactgcgcagcctgtgtccacgagggaatttacgaggagggaatttccattttagaatcttccagcgcctttcccgataacgctgcccgtcgcgaagttgaatccctcccagcggtatgtcccagcgatggttgcacatggaagggaaccctgaaagaatatgaggtcaagatgccagcttgtgggatggtcactgaagccccagccgtgggctcaaggccacggagcccctcctcatatgatctggttctacatgtgcctctgacgggtgcagaggcttgtctgatgtcggtggaagaggagaccgagcttctgctcagaagttgccatgaaggacggtgtccccttatgcttacagaatgtcctgcctgcaagggcctcgtccgcctgggggaaaaagaacgtcacttggagcatgaatgtcctgaaagatcactctcttgtaggcactgcagggcgccatgttgcggcgcggatgtcaagcgtttggaccaggacaaaattgaggcactctcttccaaggtgcagcagctggagaggtctattggactgaaagatttggcgatggccgatctggaacaaaaggtacttgagatggaggcctcaacctatgatggagttttcatctggaaaatatcagatttcgcacgcaaacgccaggaagccgttgcaggacgaattcctgccatcttctctcctgctttctatacctctcgctacgggtataaaatgtgcttgcgcatctacctaaatggcgacggaactggcaggggaactcacttgagcctgttttttgttgtgatgaagggaccaaacgacgccttgctgcgttggcctttcaatcagaaagttaccctcatgttactcgaccaaaacaaccgggaacacgtgattgatgcgttccggccggatgttacttcttcatcatttcagagacccgtaaacgatatgaatatcgcttctggatgccccctattctgccccgtctccaagatggaagcaaaaaacagttacgtgagagatgacgcaatttttataaaggccatcgtggatctcactggtctgtag

SEQ ID NO: 26667 - DNA, 366 bp, Artificial Sequence
  Description of Artificial Sequence: Synthetic coding sequence
atggccgccgccagcgtgaccccccccggcagcctggagctgctgcaaccgggtttcagcaagacactcttgggtaccaagctagaggccaagtatttgtgctctgcatgcagaaatgtcttgaggagaccttttcaagcccagtgcggacaccgttactgctccttctgtctggcctccattctctcctctggcccacagaactgcgcggcctgtgtgcacgaaggtatttacgaagaaggcatttccattttggagagttcttcagcgtttcctgacaacgccgccaggagggaagttgaatcgttaccagcagtatgcccctctgatgggtgtacctggaaaggcactctcaaagagtattag

SEQ ID NO: 26668 - DNA, 519 bp, Artificial Sequence
  Description of Artificial Sequence: Synthetic coding sequence
atggccgccgccagcgtgaccccccccggcagcctggagctgctgcaacctggattcagtaaaaccctgcttgggacaaagttagaagctaagtacctgtgctcggcttgtcggaacgtgttgcggagaccatttcaggctcaatgcgggcaccgttactgttccttctgcctcgccagcatcctaagttccggcccacagaactgtgcagcatgtgtgcacgaggggatttacgaagagggtatcagtattctcgagtcaagctccgcttttccagataatgcagcccggcgagaagtggaaagccttccagctgtctgtccgagtgatggctgtacatggaagggtacattaaaggaatatgagtcttgccatgaaggtcgctgcccattgatgcttaccgagtgccctgcctgcaaggggctagtacgtctgggcgagaaggaaagacatttggagcacgaatgcccagaaagaagcctgtcgtgtcggcattgtagggctccttgctgcggctag

SEQ ID NO: 26669 - DNA, 582 bp, Artificial Sequence
  Description of Artificial Sequence: Synthetic coding sequence
atggccgccgccagcgtgaccccccccggcagcctggagctgctgcaacccggctttagcaaaaccctacttgggacaaaactggaagcaaagtatctctgcagcgcgtgtcggaacgtcctgcgccgcccatttcaagcacagtgcgggcaccggtattgctccttttgtttggcttccatcctaagcagcgggccccagaactgcgctgcttgtgtccatgagggaatttatgaagagggcatcagcattctcgagtcatcttctgccttccccgacaacgctgcccgtcgcgaggtcgagtctctgccagctgtttgtcccagcgatggttgcacatggaaaggaaccttaaaggagtacgagtcatgccacgagggcaggtgtcctctgatgcttaccgagtgcccagcttgcaaaggcttggtcaggttaggcgagaaggagcggcatctagagcacgagtgtcccgagcggtcgctcagttgtagacactgccgcgctccttgctgtggggccgatgtgaaggcacatcatgaagtctgtccgaagtttcctttaacgtgtgacgggtgtgggtag

SEQ ID NO: 26670 - DNA, 1503 bp, Artificial Sequence
  Description of Artificial Sequence: Synthetic coding sequence
gtggccggccgggccctgagcagcggccgggccgccaccgtgggcgcacttttcgcaggggtcacggccctcatggcagccgcatcagtgacaccccctggcagcctagagctgcttcagccaggcttttcaaagacacttctcggcactaagttagaggccaaatacctgtgttccgcctgtcggaacgtgctccgaagaccgttccaggcacagtgtgggcaccgttattgttctttctgcctggcgagcatcctaagtagtggcccccaaaattgcgccgcttgtgttcacgaaggcatatacgaagagggcatcagcatccttgagtcttcttccgccttcccagataacgctgcacggcgggaggtagagagcctgcctgcagtgtgtccttcagatggatgcacatggaagggaacactgaaagagtacgaaagttgccatgaggggcgctgcccactgatgctgaccgagtgtcctgcatgcaagggcctcgttagactcggggaaaaggagaggcatctagagcatgagtgcccggagagatcgctgagttgccggcactgccgggccccttgctgcggtgccgacgtcaaattccaagaccacgtgaagacatgtggcaaatgccgtgttccctgccgttttcatgctattggatgcttagagactgtggagggagagaagcaacaagagcatgaagtgcaatggctcagggaacacctggccatgctgctaagtagtgtcctggaggcaaagccgttactgggtgaccaatcacatgccggctccgaactgctgcagagatgcgagagcctggaaaaaaagaccgccacttttgaaaacatcgtatgtgttctgaaccgggaagtagagcgcgttgctatgacagccgaggcatgctctagacagcaccgcctggaccaagacaaaatagaagcgctctctagcaaagtccaacaactcgagagaagcattgggctgaaggatttggccatggccgaccttgaacaaaaggttttggaaatggaggccagcacttatgacggggtatttatatggaagatctccgatttcgccaggaagagacaggaggcagtggcaggcagaatcccggccattttctcccccgccttctacacctctaggtacggttacaagatgtgtcttcggatctatctgaatggcgacgggaccggccgtggcactcacctgagtctctttttcgtcgtaatgaagggacccaatgacgctttacttcggtggccctttaatcagaaggtcacgctgatgctgttggatcagaacaatcgggaacatgttatcgacgcttttcgaccggacgttacctcaagcagctttcagcgacctgtgaacgacatgaatatcgcttccgggtgtcccctgttctgccctgtgagtaaaatggaagccaagaatagttatgttagagacgacgcaatctttattaaggccatcgtggatctgactggattgtag

SEQ ID NO: 26671 - DNA, 1506 bp, Artificial Sequence
  Description of Artificial Sequence: Synthetic coding sequence
atggccgccgccagcgtgaccccccccggcagcctggagctgctgcagcctgggtttagcaagacgctgcttggcactaagttagaagccaagtatctctgctccgcctgtcgtaacgtattaaggcgacctttccaggctcaatgtggccaccgatactgtagtttctgtctagccagtatcctgtcaagcgggccccagaactgcgcagcttgtgtccacgaaggcatatatgaggaaggcatctctatcctggaaagctcctccgcgttccccgataatgccgctcgaagggaggttgagtcattgccagcggtttgtccaagtgatggatgtacctggaaggggaccttgaaggaatatgaaagctgtcatgaaggtcgctgccccctgatgctcacagagtgcccggcctgtaaaggtctggtgcgcctgggcgaaaaagagagacatctggaacacgaatgccctgaacgatccctgtcatgccggcactgcagggctccctgttgcggggccgacgtgaaggctcatcatgaggtctgcccaaagttccccctgacgtgcgacggatgcggtaagaagaagataccaagggagaaattccaagaccatgtcaaaacatgcggaaaatgtcgcgttccctgtagattccatgcaattggatgcctggagacggtagagggcgagaagcagcaagaacatgaagtccagtggttacgggaacatctggcaatgctgctgagctcagtgcttgaagccaagccactattgggcgatcagtcccatgctgggtctgagcttctgcaaagatgtgaatccctggaaaaaaagacagctacttttgaaaatatagtatgcgtgttaaatcgcgaggtggaacgcgtggccatgaccgctgaggcgtgctcacgccagcatcgtctggatcaggacaagatcgaagcactcagttcaaaggttcaacagctcgaacgcagcatcggtctgaaggaccttgccatggcagatctggaacaaaaagtcctggagatggaggctagcacatacgatggggtgtttatatggaaaatatcagacttcgcacgcaaaagacaggaagccgtggctggccggattccagctatctttagtcctgcgttttacacaagccgttacgggtacaagatgtgtttgaggatctacctgaatggagatgggaccggccgcggcacacacctttctctgtttttcgtcgtgatgaagggtcccaacgacgccctgctccgctggcccttcaatcaaaaagtgacgctgatgctgctcgatcaaaacaacagggaacatgttattgacgcattccgccccgatgtaacttcctctagcttccagcgtcctgtgaacgacatgaacattgcttccggctgtcccctgttttgccctgtctccaagatggaggcaaagaattcatacgtgcgcgacgacgctatttttataaaagctatagttgatctgaccggattatag

SEQ ID NO: 26672 - DNA, 1632 bp, Artificial Sequence
  Description of Artificial Sequence: Synthetic coding sequence
atggagagcagcaagaagatggacagccccggcgccctgcagaccaatcccccactcaagctccatacagatcgatccgccggcacccctgtgttcgtgccagaacaggggggttacaaggagaaattcgtcaagactgtggaggacaaatacaagtgcgagaagtgtcaccttgtgctgtgctcacccaaacaaacagaatgcggacatcgcttctgcgaaagttgcatggcagccctcttgtcgagctcaagtcccaaatgcaccgcttgccaggaaagtattgtgaaagacaaagtgtttaaagacaactgctgtaagcgggaaatcctcgccctgcagatttattgtcgcaatgagagtcgcggatgtgccgagcaactgatgctgggtcacctcctcgtgcatttaaagaatgactgccactttgaggaacttccgtgcgtgagacccgactgtaaggaaaaggtcctgaggaaagatttgcgcgaccatgttgagaaggcttgcaagtacagggaagccacctgctcacattgcaagtctcaggtacccatgatcgctctgcaaaagcatgaagataccgactgtccctgtgtggtcgtgagttgtccacacaagtgttctgtccagaccctcttacggagcgaagggaccaaccaacagatcaaagcccacgaggcttcttcagcagtgcaacacgtaaatctgttgaaagagtggtcaaattccctagagaaaaaggtttcactgcttcagaacgaaagcgtagagaagaataaatccattcagtccctgcataatcagatatgctcctttgaaattgagattgagcggcagaaggaaatgctgcggaataatgagtcaaagattctccacctccaacgtgtgatcgattcgcaggcagaaaagctcaaagagctggacaaagagatacgtccgttccgtcagaactgggaggaagctgactccatgaagtcctctgtggagtcactgcaaaatagagtgacagagcttgagagcgtggacaaatctgctggccaggtggcacgcaatacaggcctattagagtcacagctctctagacatgatcaaatgctgagcgtgcacgacatccgcctggctgacatggacctgcgttttcaggtactggagaccgcctcctacaacggggtgctcatatggaagattcgcgattacaagcgtaggaagcaagaggccgtgatgggtaagactttgtcgttgtactctcaacctttctatactggatacttcggatacaaaatgtgtgctagagtgtacttgaatggggatggaatgggtaaaggaacgcatctgtctttgttcttcgtcatcatgcgaggtgaatacgatgcactgctcccatggccattcaagcagaaggtgaccctaatgttgatggaccaaggcagttctcgaaggcacctgggagacgcgtttaagcctgatccgaactcaagttcctttaagaaacccaccggggaaatgaacattgcttccgggtgtccagtgttcgtggcccaaacggttctggaaaatggtacctacatcaaagacgataccatttttataaaagtgattgtcgacacaagcgatcttcccgacccgtag

SEQ ID NO: 26673 - DNA, 1632 bp, Artificial Sequence
  Description of Artificial Sequence: Synthetic coding sequence
atggagagcagcaagaagatggacagccccggcgccctgcagaccaatcccccccttaaactgcacactgacagatctgctggcacaccagtgttcgtacctgagcagggtgggtacaaggagaagtttgttaagactgtagaggataagtataaatgcgaaaagtgccacctggtactgtgtagcccgaagcagaccgaatgtggacatagattctgtgagtcctgcatggcagccttgctcagttcaagttctccaaagtgcaccgcatgccaggagtctatagtgaaggacaaggtcttcaaggataattgttgcaagcgggaaatcctggccttgcaaatttactgcagaaacgaatcacgcggatgcgctgagcagctgatgctgggtcatttactggtgcacctgaagaacgattgccatttcgaagagctgccatgcgtgcggccagattgcaaggaaaaagttctgaggaaagacctccgggaccacgtggaaaaagcctgcaagtacagggaggctacctgttcacattgtaagagtcaggtccctatgatcgccctgcaaaaacacgaggacacagactgcccctgcgtcgtggtttcttgcccccacaaatgctcagtgcagactctcctgaggtccgagggaacgaaccagcagatcaaagcacatgaggcaagctccgctgtgcagcatgtgaacctcctgaaggagtggtctaactcgctcgagaagaaagtgtcacttctgcagaacgaaagcgtggaaaaaaataaatccatacagagtctacacaaccagatttgttcattcgagatagaaatcgaacgccagaaggagatgttgcggaataacgaatccaagattctccacctgcagagagtgatagattcccaggcagaaaaactaaaggagctagacaaggaaatcagaccttttagacaaaattgggaagaagctgatagtatgaagtccagcgtggaatctctgcagaatcgcgtgacggagctggaaagcgtcgacaagtctgctggacaggtcgctcgcaatacaggcctgctagagtcgcaactgtcgagacacgaccagatgttaagtgtgcatgacatcaggctggccgacatggatctgcggtttcaggtactggaaacagccagctataatggcgtactgatttggaaaataagggattacaaaagaagaaaacaggaagccgtcatgggcaagaccttgtcactgtactcacagcctttttatacaggctattttggttataagatgtgcgcccgcgtatacttgaatggcgacggcatgggtaaagggacccacctcagtttgttttttgtcattatgcggggcgagtatgatgcattgttgccctggcccttcaaacagaaggtgaccctgatgcttatggatcagggaagcagcaggagacatcttggagacgctttcaagccagatcctaatagcagctcattcaaaaaaccaactggggagatgaacattgctagtggctgccccgtgtttgtcgcacaaacagttctagaaaatggcacatacataaaggacgacaccatctttattaaggttatcgtggatacatctgatctgcccgacccgtag

SEQ ID NO: 26674 - DNA, 1707 bp, Artificial Sequence
  Description of Artificial Sequence: Synthetic coding sequence
atggagagcagcaagaagatggacagccccggcgccctgcagaccaaccctcctctgaaactgcatactgatagatcagccggcacccctgtgttcgtacccgaacagggtggctataaggagaagttcgtaaaaactgtggaggataagtataaatgtgagaaatgtcaccttgtcctctgtagccctaagcaaaccgaatgtggccaccgcttctgcgaaagttgcatggctgctctcctatcttcctcaagccctaagtgcaccgcctgccaggagagtattgtcaaggacaaggtatttaaggacaactgctgcaaacgggagatcctcgcccttcagatttactgtcggaatgaatcccgtgggtgcgctgagcagctgatgttgggccacttgcttgtacacttaaaaaacgattgtcatttcgaagaactcccttgtgtgaggcctgactgcaaggagaaagttctgcggaaggacttgcgggaccacgtcgagaaggcatgcaaatatcgtgaagcaacgtgtagccactgtaagtcccaggtacctatgatcgccttgcagaagcacgaggatacagattgtccttgtgtggtagtttcttgtccacacaaatgctctgttcaaaccctcttgcgcagcgaattatctgcccatttgtctgagtgcgtcaatgccccaagtacctgtagttttaaacggtacggttgtgtgttccaaggcaccaaccagcagattaaggcccacgaggcaagttctgccgttcaacacgtgaatcttctcaaggagtggtcaaactccctcgaaaagaaggtaagtctcctgcaaaacgagtccgttgaaaagaacaagtctatccaatctctgcataaccagatctgctctttcgagattgagatcgagcgccaaaaagagatgttacggaacaatgaaagtaagatcttgcatcttcagcgggtgatcgactcacaggctgaaaagctgaaagagctcgacaaggaaatccgcccattcagacagaattgggaagaggcagacagcatgaaatcatcggttgagtccttacagaatcgcgtgactgagctcgaatctgtcgataaaagcgcggggcaggtcgcaaggaataccggccttttggaatctcagctcagccggcacgaccagatgttgtccgtgcatgatatacgcctcgcagatatggatcttaggttccaggtccttgagactgccagctacaatggagtcctcatctggaaaattcgagactacaagaggcgaaaacaggaagcagtcatgggcaagacactgtccctctacagtcagccattttacaccggctacttcggatacaaaatgtgcgcccgggtgtacctgaacggggacggcatggggaagggaactcatctcagcctattcttcgttatcatgaggggtgaatacgatgccctgctgccgtggcctttcaaacaaaaagtgaccctcatgttgatggatcagggatcctcccgcaggcacttgggagatgccttcaaacctgaccctaattcaagcagttttaaaaagcctaccggtgaaatgaatattgcctccggctgcccggtcttcgtggcgcagacagtgctggagaatggcacctacatcaaggatgatactatattcatcaaggtaattgttgacaccagtgacttacctgacccatag

SEQ ID NO: 26675 - DNA, 1458 bp, Artificial Sequence
  Description of Artificial Sequence: Synthetic coding sequence
atggagagcagcaagaagatggacagccccggcgccctgcagaccaacccgcccctgaagttgcataccgaccgcagcgctgggactcccgtctttgttcctgagcaaggcggttacaaagagaagttcgtcaaaacagtggaggataaatataagtgcgaaaagtgtcacttagtgctatgttcccccaaacaaactgaatgcggccacagattctgtgagtcctgcatggccgccctattgagttctagctctccaaagtgcaccgcctgccaggaatcaatcgtgaaggacaaggtcttcaaagacaattgttgtaagagagaaatactagccctgcagatttactgccgaaatgagtcccgcggctgcgccgagcagctgatgctcggacatttactggtgcatttgaagaacgactgtcatttcgaagaactgccttgcgtgcgccccgattgtaaagaaaaggtgcttaggaaagatctgcgtgaccatgtggaaaaggcttgcaagtatcgggaagccacttgctctcactgtaaatcgcaggtccccatgatcgcgctgcaggtttcactgctgcagaatgaaagcgtagagaaaaataaaagcattcagtctctccataatcagatttgcagctttgagatcgagatagagagacaaaaggaaatgctgaggaataacgaatctaagatactgcatttgcagcgagtcattgatagtcaggctgagaaactgaaggaactggataaggaaattcggcctttccgccagaattgggaagaagccgattcaatgaaaagttccgttgagagccttcagaatcgcgtgacagagttagaatctgttgacaaatctgcagggcaggtggctcgtaacaccgggttactggaaagtcagctgtctagacacgatcagatgctctcagtgcacgacatccggctagcagacatggatctgcgttttcaggtgcttgagaccgcgtcgtataacggtgtgctgatctggaagatcagagactacaagcgccgaaaacaggaggccgttatgggaaaaacactgagcctatacagccagccattttacactgggtatttcggctacaaaatgtgcgctcgcgtatacctgaacggcgacggcatggggaagggcacacatctcagtttgttctttgtcatcatgcggggcgaatatgatgctcttctgccctggcccttcaaacagaaggtcacactaatgctgatggaccaaggtagtagtaggcggcacctgggcgacgccttcaaacccgacccaaattccagctcttttaagaaaccgaccggggaaatgaatatagcttccggttgccctgtgttcgtcgcccagaccgtattagagaatggtacctatattaaggacgatactatcttcattaaagttatcgtagatacttctgacctcccagacccctag

SEQ ID NO: 26676 - DNA, 1707 bp, Artificial Sequence
  Description of Artificial Sequence: Synthetic coding sequence
atggagagcagcaagaagatggacagccccggcgccctgcagaccaatccccccctcaaattacatactgatcggtctgctgggacaccggtattcgttccagagcagggaggatataaagaaaaattcgtcaaaaccgtggaagataagtataaatgcgagaagtgtcatctggtgttgtgctctccaaagcagactgaatgcggccaccggttctgcgaatcatgcatggccgcattactcagctcctccagcccaaaatgcaccgcgtgccaggagtctattgtcaaggataaggtctttaaggacaactgttgtaagcgcgaaatactcgcgctccagatctactgtcgtaacgagtcccggggatgcgcagaacaactaatgcttggccatctgctagtgcacttgaagaatgattgccacttcgaggagttgccctgtgtacgtcccgattgcaaagaaaaagtactccgaaaggatttacgtgaccacgtagagaaggcttgcaaataccgagaagcaacatgcagccattgcaagtctcaggttcccatgattgccttgcaaaagcacgaggacacagactgtccttgtgtggtggtaagttgtccacacaaatgttcggtgcagaccctgcttcgttcagaactatctgctcaccttagcgaatgtgtaaacgcacctagcacatgctccttcaaacgctatggctgcgtcttccaaggaacaaatcagcagatcaaggcacacgaggcctcatctgccgtccaacacgtgaatctgctgaaggagtggagcaactcacttgagaaaaaggtatcactgctgcaaaatgaatcagttgaaaaaaacaagagtattcagtcccttcacaatcagatatgctcgtttgagattgagattgaaaggcagaaggaaatgctccgcaacaatgaatctaagattctacatttacagcgtgtaattgactctcaagctgagaagctcaaggaactggacaaggagatacgaccatttaggcaaaactgggaggaagcagattcgatgaagtcaagcgtcgagtcattgcagaatcgcgtgactgagctggagtctgtcgataaaagcgccggccaggtggctcggaatactggcctgctggaatctcagctgagccgccatgaccaaatgttgtctgttcacgacataaggctggccgatatggacttacgctttcaagtgctggaaacagcctcttacaacggagtgctcatttggaaaatccgcgactacaaacgtcgtaagcaggaagctgttatggggaagactctatctctgtactcccagcctttctatactggatattttggctacaagatgtgcgccagggtctacctcaacggagatggtatggggaagggtactcacctgtcattattttttgtgattatgcgcggcgagtatgacgccctcctgccctggccttttaaacagaaagttacactgatgttgatggatcaggggagttcacggcggcatctgggtgatgcgttcaagcccgacccgaattcaagcagctttaagaaaccgacaggcgagatgaacatcgcttcaggctgcccggtgtttgtcgctcaaaccgtgttggaaaacgggacctacataaaagatgacacaatcttcatcaaggtaatcgtagacacaagcgacctgccagacccttag

SEQ ID NO: 26677 - DNA, 285 bp, Artificial Sequence
  Description of Artificial Sequence: Synthetic coding sequence
atggagagcagcaagaagatggacagccccggcgccctgcagaccaatcctccactgaagctacacacagaccgcagcgccggtacgccagttttcgtgcccgagcagggcggctacaaagaaaagtttgtgaaaaccgttgaggataagtataagtgcgaaaaatgtcaccttgttctgtgttctccaaagcagacagagtgcggtcacagattctgcgagtcttgtatggcagcattgctgtcttcctctagcccaaagtgcactgcatgccaggagtcatag

SEQ ID NO: 26678 - DNA, 939 bp, Artificial Sequence
  Description of Artificial Sequence: Synthetic coding sequence
atggccgccggccagaacggccacgaggagtgggtgggcagcgcctatctcttcgttgaaagctcattggacaaagtcgtcctctctgatgcctatgctcatcctcagcaaaaggtggctgtgtaccgggcactacaggcggctctcgccgagagcgggggctccccagacgttctccagatgttgaagattcaccgtagcgatccccagctcattgtccaactgagattttgtggacgccagccctgtggccggtttttacgcgcttacagagagggcgctcttagagctgccctgcagagaagcctcgccgccgccctggcccaacactccgtgcctcttcagctagaactgcgagcaggagctgagaggctggatgcccttcttgcggacgaggagagatgcctgtcctgtatcctggcccaacagcccgacagactgcgagacgaggagctagccgaattagaggacgcgctcagaaacctgaagtgcggttcaggagctcgcgggggggacggcgaggtagcctctgcccctctgcaaccaccagtgcccagcctgagcgaggtcaagccccccccaccgcctccccccgcacagacattccttttccaaggccaacccgttgtgaataggccactgtctctgaaggaccagcagacattcgcacggtcagtgggactcaagtggagaaaggtcggccgctccctccagaggggatgtcgggcactgcgggaccccgccctggacagcttagcatacgagtatgaacgggaaggcctgtacgagcaggcgtttcagcttttgcggcggtttgtgcaagccgagggacggcgggctaccctgcagaggctggtggaggctctcgaggaaaacgagctgacaagcctagccgaggacctcctgggcctgaccgatccaaatggcggtttggcctag

SEQ ID NO: 26679 - DNA, 825 bp, Artificial Sequence
  Description of Artificial Sequence: Synthetic coding sequence
atggccaccaccgtgagcacccagcggggccccgtgtacatcggcgagctgcctcaggactttctcaggattactccgactcaacagcagagacaggtgcagctggacgcccaggctgctcaacagctgcaatacggcggcgctgttgggaccgttgggcgcctcaatatcactgtcgttcaggctaagttggccaaaaactatggaatgactcgaatggatccatattgtaggctaaggcttggctatgctgtgtacgagaccccaactgctcacaacggcgccaaaaaccccagatggaataaggtgatccactgcaccgtcccccctggggtggacagcttctatctggagatctttgatgagagagccttctcaatggatgaccgaatcgcctggactcacattacgattcccgagagtctgagacaaggcaaagtggaggataagtggtattctctgagtgggcgtcagggcgacgacaaggaaggcatgatcaatctggtgatgtcgtacgctcttttgcctgcggccatggttatgcccccccagcccgttgttctgatgcccaccgtttatcaacagggggtcggctacgtgccaataaccggaatgcctgccgtgtgctccccgggaatggtacccgttgccctacccccagctgcagtgaacgcccagcccagatgcagcgaggaggatctcaaagccatccaagacatgttccccaacatggatcaggaggtcatccgctctgtgttggaagcccagcgcggaaacaaggatgcagccataaactctcttcttcagatgggtgaagagccttag

SEQ ID NO: 26680 - DNA, 1059 bp, Artificial Sequence
  Description of Artificial Sequence: Synthetic coding sequence
cagctgagccccagccaggcccccgccggcgcccaggaggtggccagacgggttaccgtaggatctgcctcacacggcggaagacgttctactatggcaacgactgtgagcactcagagaggtccggtgtacatcggagaactcccacaggattttctccgaatcacgcccacacagcagcaacgacaggtgcaactggacgcccaggctgctcagcagttacagtacgggggcgccgtaggcacagtcggaaggctcaatataactgtcgttcaggcaaaattagccaagaattacggaatgacacggatggacccgtattgtcggctgcggttgggttatgccgtttacgaaactccaacagcacacaacggcgcgaaaaacccaagatggaacaaggtgattcattgcaccgtaccaccaggggtggacagcttctacttggaaatatttgacgagcgggcgttttctatggatgatcgcattgcttggacacacattacaatcccagagtcccttaggcagggcaaggtagaggacaagtggtactccctctccgggcgccagggggacgataaggagggtatgatcaacctcgtaatgagctacgctcttcttcccgccgcaatggtcatgccccctcagcctgtggtcctcatgcctaccgtctatcaacagggggtgggctacgtcccaattaccggaatgccggccgtgtgttccccagggatggtcccggttgccctgccacctgccgccgttaatgctcagcccaggtgctctgaagaagacctaaaagcgatccaggatatgttccctaatatggaccaggaggtaatccggtccgtcctcgaggcacagcgagggaacaaggacgcagcgatcccttcccacctggtcctgggtgggctttccgcacttagctgcccctgggatgtccggctgagtttcagttgcaggagcggaaaatgtagctgctgtagagaacagctccttcttccagggtgttggaggtggtggtcggcttttcgcttccactcctggcacttcgtgatgtag

SEQ ID NO: 26681 - DNA, 675 bp, Artificial Sequence
  Description of Artificial Sequence: Synthetic coding sequence
atggccaccaccgtgagcacccagcggggccccgccaagctggccaagaattacgggatgacacgcatggacccttactgccgcctcagacttggctacgctgtatatgagacccctactgcacacaacggggctaaaaatcctagatggaacaaagtgatccactgtactgtacctccgggcgtcgacagtttctacttggagatcttcgacgaacgcgctttctcaatggatgacagaattgcctggacacacataacaattccagagagcctgaggcaaggcaaggtagaagacaagtggtacagtctgtcaggacggcagggggatgataaagagggaatgattaatcttgtgatgtcttatgccctgcttccagctgccatggtgatgccgccacagcctgtggtactgatgccaacagtctatcaacagggtgtgggctacgtgccaattacaggaatgcctgctgtttgcagtccaggcatggtgcccgtcgcactacctccggctgcagtgaacgcgcaacccagatgttccgaagaagacctgaaagctatccaagacatgttccctaacatggaccaagaagtgatcagaagcgttctggaggcgcagagaggcaacaaggatgccgccattaactcccttcttcagatgggtgaggagccgtag

SEQ ID NO: 26682 - DNA, 768 bp, Artificial Sequence
  Description of Artificial Sequence: Synthetic coding sequence
atggccagcagcaccagcctgcccgcccccggcagccggcccaagaagcctcttggaaagatggccgactggtttcggcagaccctgctcaaaaaaccaaagaaacggccaaattcccctgaatccacctcatcagatgcttctcaaccaacatcgcaagactcaccgctgcccccttcgctgtctagcgtgacatctcccagtttaccgcccacgcatgccagtgactcgggctcttcacggtggagtaaagattatgacgtgtgtgtttgtcattctgaggaggatctcgttgcagctcaggatttagtctcatatctcgaggggtctactgcgtcactgagatgctttttgcaactgcgcgacgctacgcccggaggtgctatcgtgagtgaactttgccaagccttatcctcttcacattgcagagtcttacttataacccctggctttttacaggacccatggtgcaagtatcagatgctccaggctctaacggaggccccaggtgcagaggggtgtaccatccctcttctgagcggactgtcccgtgccgcctatcctcccgaattgaggttcatgtactacgtcgacggccgtggccctgatggtggctttagacaggtcaaagaagccgtaatgaggtccaaccaggtgctcaagcatctgctgtatcacggcacccccgaaattggagtcaagctggagaccgaaaatccctgtcgggcgagtgactcccataagtgtgacaaaaggtatcgagagtag

SEQ ID NO: 26683 - DNA, 708 bp, Artificial Sequence
  Description of Artificial Sequence: Synthetic coding sequence
atggccagcagcaccagcctgcccgcccccggcagccggcccaagaaacctctggggaaaatggctgattggttccgtcaaaccctgctgaaaaaacctaagaaaaggccgaactcccctgagtccacctcctctgatgcttcgcagccgacaagtcaggatagcccactcccaccctccttatcatcagtcacttctcccagcctcccccccactcacgcaagtgattcgggatcctcccggtggagtaaggactatgatgtctgtgtgtgtcactctgaagaagacctagtggcagcccaggacctggtttcttatctcgagggcagcacagctagcttgcgctgctttctgcaactgcgagacgccactccgggtggcgctattgtctctgagctgtgccaggctctgtcatctagtcactgcagggttttgctaatcacgccagggtttctgcaggatccatggtgcaaatatcaaatgctgcaggcacttacagaagcccccggcgcagagggctgtaccatccccctcctgtcagggctgtctagagcagcctacccccccgaactgcgattcatgtattacgtggacggaagggggccagatgggggttttcgccaggtgaaggaggccgttatgcggtgtaagctgctccaggaaggagagggagagagagattccgcgaccgtgagcgacctactatag

SEQ ID NO: 26684 - DNA, 666 bp, Artificial Sequence
  Description of Artificial Sequence: Synthetic coding sequence
atggccagcagcaccagcctgcccgcccccggcagccggcccaagaagcccttaggcaagatggcagactggttccgacaaacactcctgaagaagcccaaaaaaaggcctaattctcctgaaagcacgtccagcgacgcgtcacaaccaacctcacaagatagtcccctgcctccgtctttgagctcggtgactagtccttcgctgccacctacacatgctagtgacagcggcagctctagatggagtaaagattacgacgtgtgtgtctgccatagtgaggaggacctggtcgccgcccaggacctcgtctcctatctagagggatccaccgcttctcttaggtgcttcctgcaacttcgtgacgcaactccgggaggggcaatcgtgtccgaattgtgccaggcactttcctcatcacattgtcgagtgttgctgatcaccccaggcttcttgcaggatccatggtgcaaataccagatgctgcaggccctcacagaagctcccggagccgaggggtgcaccatcccccttctgagcggtctgtccagagccgcataccctcccgaactccgttttatgtattatgtcgacggtcgggggccagacggcggatttcgccaagttaaggaagcggtgatgcgatacttacagactctgtcctag

SEQ ID NO: 26685 - DNA, 666 bp, Artificial Sequence
  Description of Artificial Sequence: Synthetic coding sequence
atggccagcagcaccagcctgcccgcccccggcagccggcccaagaagccactcgggaagatggcagattggtttaggcagactctacttaagaagcccaagaaacggcctaattctcccgagtccacttcctccgacgcttctcaaccaacatcccaggatagccccctgcccccatccctgtcgtctgttacaagcccaagtctgcctccaacccatgcgtcggatagtggatcctcacgctggagcaaagattatgatgtgtgtgtttgtcactctgaggaagatctcgtggccgcccaggacctggtctcttatctggagggctccactgcttccctaagatgcttcctacagttgcgcgatgccaccccaggcggggcaatcgtgtccgagctgtgccaagcactgtcctcttcacactgcagagtcctcctgataactcccggattccttcaggacccttggtgcaagtatcaaatgctgcaggcattgactgaagcaccaggcgcggagggttgcactattccactcctttctgggctgagcagggcagcttatccaccagagctcaggttcatgtactacgtcgatgggcgcgggcccgacggtggttttcgtcaagtcaaagaggcagtgatgcggtatctccaaactctgagctag

SEQ ID NO: 26686 - DNA, 666 bp, Artificial Sequence
  Description of Artificial Sequence: Synthetic coding sequence
atggccagcagcaccagcctgcccgcccccggcagccggcccaagaagcccctggggaagatggccgattggtttcggcaaacactcctgaaaaaaccgaaaaagcggccgaactcccctgaaagcacttctagcgatgcaagtcaacctacatcacaagatagtcccctgccaccatccctgagctccgtgacaagtccatccctcccccccacccacgccagtgactccggctcctctaggtggtctaaagactacgacgtctgcgtctgtcattcagaggaggatctagtggccgctcaggatcttgtgagttacctagaggggtccacagctagcctgcgctgtttcttacagttaagggacgctacgcctgggggggcgattgtgtccgagctctgccaagctctcagtagctcccattgccgcgtgctattaataacgccagggtttctgcaggatccctggtgtaagtaccaaatgttacaagcattgactgaagcaccaggggcagagggctgcaccatcccgctgctatctggactgtccagagccgcctaccctccagagctgcgcttcatgtactacgttgacggtcgggggcctgacgggggttttcgacaagtcaaagaagcggtcatgagatacctgcagaccttaagctag

SEQ ID NO: 26687 - DNA, 2520 bp, Artificial Sequence
  Description of Artificial Sequence: Synthetic coding sequence
atgatgagcgccagccggctggccggcaccctgatccccgccatggcattcctttcctgcgtgcgccccgagtcatgggaaccttgtgtggaggtcgtgccaaatatcacctatcagtgtatggaactgaacttttataaaattcccgataacctgcctttctcaactaaaaacttggacttgtcttttaatcctcttaggcatctaggctcgtactcctttttctctttccccgagctgcaagttctagatcttagccgatgcgagattcaaaccattgaagatggggcataccagtcactctcccacctgtctactctcatccttactgggaatccaatccaaagcctagctctgggggctttctccggtcttagttccctgcagaaattggtcgccgtggagacaaatttggcctccttggagaacttccccatcgggcacttgaagacattgaaggaactgaacgtcgcccacaatctaattcagtcctttaagctgcctgagtatttttcaaatcttactaatctcgagcacttggatttgagctccaacaagatccagtccatctattgtacggaccttagagtcctacatcaaatgccgctgctgaacctgtccctggacctctctcttaatcccatgaacttcatacaacctggggctttcaaagaaatccgactccacaaactgaccttgagaaataatttcgacagtctaaacgtgatgaagacctgcatccaagggctggctggccttgaggtccatagactggttcttggcgagtttcggaacgaaggcaatctggagaagttcgataagtccgcactagaggggctgtgtaatctaacaatcgaggagttcagacttgcataccttgattactacttagatgatattattgacctcttcaattgtttgactaatgtttcatcttttagcctggttagcgtgactattgaaagagtgaaggacttcagctataatttcggctggcaacaccttgagctggtcaattgtaagttcggacaattccctactttaaagctgaaaagcctgaagcgcctgacctttacttctaacaagggcgggaatgcattcagcgaagtcgatcttccgtcgctagaatttctcgacctttcccgtaatgggctgagttttaaagggtgttgttctcagtccgattttgggaccacgtcattgaagtatctggatttgagcttcaacggcgtgatcaccatgagtagtaattttctggggcttgagcagctcgaacacctcgatttccagcactctaacctaaagcagatgagtgagttttccgtattcctgagcctccggaatctgatttacctcgatatatcgcacactcatacccgagtggcctttaatggcatcttcaatggtctctcgtctttggaagtcctgaagatggccggaaacagctttcaggagaacttcctgcctgacatctttaccgagctaagaaacttaaccttcctagacttatcccagtgtcaactggagcagctgtcccccacagcttttaattcactgtcttctctccaagttcttaatatgagccataacaacttcttcagtctcgacacatttccatacaagtgcctaaactccctgcaggtccttgattacagcctgaatcacataatgacctccaagaagcaggaacttcaacactttcccagcagcctggcgtttcttaacctgacacaaaatgactttgcttgtacatgcgagcaccaatcgttcctccagtggataaaggaccagagacagctacttgttgaagtggaaaggatggagtgtgcaaccccaagtgacaaacaagggatgcccgtcctcagcttgaatattacttgccagatgaataaaaccatcattggagtaagtgtgcttagtgtgctggttgtaagcgtcgtggctgtgctggtctataaattttactttcatttgatgctgcttgcgggctgtatcaagtacgggcggggcgaaaacatctacgatgcctttgtgatttacagctctcaggacgaagattgggttaggaacgagctggtcaagaacttagaagaaggtgtgcctcctttccaactgtgcttacactatagggatttcatcccgggcgtggccattgcagcaaatattatccacgaaggcttccataaatcccgcaaggtgatcgtcgttgttagccaacactttatccagtcccgctggtgcatctttgaatatgaaatagctcagacgtggcaatttttgagttcacgagccgggatcatctttatcgtcttgcagaaggtcgaaaaaacactcttaaggcaacaggtggaactgtaccggctactgtcacggaatacgtacctagagtgggaggacagcgtgctgggtaggcatattttttggaggcgactgcgtaaagctttgctagacggtaaaagctggaatcccgaaggcaccgtcggcaccggatgcaattggcaggaggcaacaagcatctag

SEQ ID NO: 26688 - DNA, 2400 bp, Artificial Sequence
  Description of Artificial Sequence: Synthetic coding sequence
atggagctgaacttctacaagatccccgacaacctgcccttcagcactaaaaatctcgacctatctttcaaccctctcaggcatctgggcagctattctttcttcagttttccagagttacaggtcctggaccttagtagatgcgagattcagacgatagaagatggtgcatatcagtctctgagccacctgtcaacactgatactcacaggcaatccaatccagtccttggccctgggagccttctccggtctatcctctctccaaaagctggtggcggtggagactaacctggcttcactggaaaacttcccaattggccatcttaaaacattaaaagaactgaatgtcgcacacaacctgatccaatccttcaagcttccagaatactttagtaacttgacgaatttagaacacctggacctgagctcgaacaaaatacagtcaatttactgcaccgacttaagggttctgcatcagatgcccctactaaatttgtccctggacctatctctcaatccaatgaatttcatccaacccggggccttcaaggaaatccgtttgcacaagttaacccttaggaacaactttgatagccttaatgtgatgaagacctgtattcaaggactagcgggattggaagtccaccgactggttcttggggagttccggaatgagggcaacctcgagaagtttgataagtccgctttagagggcctctgcaacttgaccattgaggaattccggctggcctacctcgattattacctggatgacattattgacctgtttaattgcttgaccaacgtttcgtcctttagcctcgtaagtgtcacaattgagagggtcaaagactttagctataactttggctggcagcatcttgaactggtgaattgcaaatttggacagttcccaacactgaaacttaaaagtcttaagagattgacctttacgtccaataaagggggaaacgccttctccgaggtggacctgcccagcctggagtttttggatttgtcaaggaacgggctgtcattcaaagggtgttgctctcagagtgatttcgggaccacgtccctgaaatacctcgatctgtccttcaacggggtcataacgatgtcgtcaaactttttgggtttagaacagttggagcatctggatttccagcacagtaatcttaagcaaatgagcgagttcagcgtgttcctttctcttcgcaacctcatctacctggacatcagtcatacccacactcgagtcgcatttaacgggatcttcaacggactttcatccttggaggtgctaaagatggcaggcaattcttttcaggagaatttcctgcctgacatcttcactgagctcagaaacttgacattcctggatttgtcgcagtgtcaactggaacagctgagccctaccgcatttaattccctgtcgtccttacaggtacttaacatgagtcacaacaactttttctctcttgatacatttccctacaaatgcctcaattccctgcaggtgctggattactcactcaaccacattatgacatctaaaaaacaagagctccagcacttcccttcctctctggccttcctgaatctcacacaaaacgacttcgcatgcacttgcgagcatcagagttttctccagtggattaaggaccaaagacagctgcttgttgaagtggagcgtatggagtgcgcgaccccatcagacaagcaaggcatgcccgttctcagtctaaacattacgtgtcagatgaacaagactattataggagtctctgtgctcagcgtgctagttgtgagtgtggtagccgtattagtgtacaaattttactttcacttgatgctactagccggctgcattaaatatggcaggggcgagaatatctacgatgcatttgttatctattcctcgcaagatgaggattgggttcggaacgagctggttaagaatctggaagagggagtccctccattccaattgtgcctccattatagggacttcataccaggggtggccattgcagctaacattatacatgagggctttcataagagtcgaaaagtcatcgtcgttgtttcccaacactttatccagtcgagatggtgtattttcgaatatgagattgcccaaacgtggcaattcctttcttcccgagccgggatcatttttattgtccttcagaaagtcgagaagactctcctcagacagcaagtcgaactttataggcttttgtcccggaatacatatttggagtgggaggactccgtactcggtagacacattttctggcggcggctccggaaggcactgttggatggaaagtcctggaacccggaagggactgtaggaaccgggtgtaactggcaagaggctaccagcatttag

SEQ ID NO: 26689 - DNA, 2577 bp, Artificial Sequence
  Description of Artificial Sequence: Synthetic coding sequence
atgggcgaccacctggacctgctgctgggcgtggtgctgatggccggccccgtgttcggcattccttcgtgtagcttcgacggcaggattgcgttctacagattctgcaacctcactcaagtaccgcaggtcctgaatacaacggaacggctgctgttgtcttttaactacatccggacggtgacagcaagtagttttcctttcttggaacagctccagctgctagagcttggcagccaatacacaccactaacaatcgacaaagaagcttttcgcaatctgcctaacctgagaatcctcgatctgggctccagcaaaatttattttcttcatcctgacgccttccaggggttattccacctgtttgagctacgactgtatttctgtggactgtcagatgcggtgcttaaagacggctacttccgcaatttgaaagctctgactcggttggacctgtcaaagaaccagatcaggagcctatacctgcacccatcctttggaaagcttaattccttaaaatccatagacttttcctccaaccagattttcttggtctgtgagcacgagctggaacccctgcaggggaagaccctatcatttttcagtctggctgccaactcactatacagcagggtctccgtcgactggggcaaatgcatgaaccctttccgcaatatggtccttgaaattctcgatgtctctggcaacgggtggaccgtagacatcacgggcaacttcagcaacgccatttcaaagtctcaggctttcagcttgatcctggcacaccatattatgggggccggcttcggcttccataatatcaaggatccggatcagaacacattcgcaggcctggcacggtcaagtgtgcggcacttggatctgtcacacggctttgtattctctctcaactcaagggtatttgagaccctgaaagacctgaaggtcttaaatctagcatataataagattaataaaattgcggatgaggctttttatggcctggacaacctgcaagtccttaatcttagctacaatctgctgggagaactgtattcctcaaacttttacggtttgcccaaggtggcgtatatagatcttcagaaaaatcacattgccatcatacaggatcaaacttttaagttcctagagaaactgcagactttggacttacgcgataacgccctgactacaattcacttcatccccagcatccccgacatatttctgtcaggcaacaaactggtcactttgccgaagattaacctgactgcgaacttgattcacctgagtgagaacagactagagaacctggacatcctttactttttgctaagggtcccccacctgcagattttgattctgaatcagaatagatttagcagctgttccggtgatcagacgccttctgaaaatccttccctagagcagctttttttgggcgagaacatgctgcagctggcgtgggaaacagaactgtgctgggatgtatttgaagggctctcgcacctgcaggtcttgtacctgaaccataactatctgaatagtttgccaccaggagtgtttagtcaccttactgccctaagaggtctgtcactgaactctaataggctgactgtgttgtcccacaatgatctcccagctaatctcgagatcctcgacatatctagaaaccagttactggcccccaatcctgatgtcttcgtgagcctatccgtgctggacatcactcataataagtttatatgcgagtgcgaactgagcacattcattaattggttgaaccacactaacgtgaccattgccggcccgccagcagacatttactgcgtgtatccggatagcttcagcggagttagcttgttcagcttgagcacagaaggctgcgacgaggaagaggtactgaaatcccttaaattctccctattcatcgtatgcaccgtcaccctgacactgttccttatgaccattctgaccgtcacaaaattcagaggcttctgcttcatctgttacaaaactgcccagagactcgttttcaaggaccatccacagggaactgaacccgatatgtacaagtatgatgcatacctgtgtttctcctccaaggatttcacttgggtgcagaacgccttgctgaaacatctcgatactcagtactcagatcaaaatcgatttaatttatgtttcgaagagcgagactttgtgcctggcgaaaatcggattgcgaacatccaagacgccatctggaactcgcggaaaattgtttgtttagtgtcgcgtcacttcctccgagacggatggtgcttggaggcatttagctatgcccaaggacggtgccttagtgatctgaactcggccttaataatggtggtggtaggatcgctgagccagtaccaactgatgaagcaccagagcattcgaggattcgtgcagaagcagcagtacctgcgatggcccgaagacttccaagatgtgggatggtttctgcacaaacttagtcagcagatccttaagaaagaaaaggagaagaagaaagacaacaacattccgttacagaccgttgctacgatctcgtag

SEQ ID NO: 26690 - DNA, 2577 bp, Artificial Sequence
  Description of Artificial Sequence: Synthetic coding sequence
atgggcgaccacctggacctgctgctgggcgtggtgctgatggccggacctgtttttggcatcccttcatgtagtttcgacggaaggatcgctttctataggttttgcaatctgactcaagttcctcaggttctgaacaccacagaaaggctcctgctgtcgttcaactacatcagaactgtaaccgcatccagcttcccctttctggagcaactacagttactcgaattgggctcccagtacacccccctcaccatcgacaaagaggcctttagaaacttgccgaatttgcgaattctggatcttggaagcagcaagatttacttcctgcacccggatgcctttcagggccttttccacctcttcgagctgcgtctgtacttttgcggactgtccgacgccgtcctgaaagatggatacttccggaatctgaaggctcttacgaggttggacttatctaaaaatcagattaggtccctgtatctgcacccaagttttggcaaactgaatagcctcaaatcaattgacttttctagcaatcaaatcttcttagtgtgtgagcatgaactcgaacctctccaaggcaagaccctgagcttctttagcctggctgctaattctctttactcaagggtcagcgtcgattgggggaaatgtatgaacccatttaggaatatggttttggaaatcctggacgtctctggcaacgggtggactgttgatattacagggaacttttcaaatgccatctcaaagtcacaagccttttcccttatcctcgctcaccatattatgggcgccgggttcggattccataatatcaaggacccggatcagaacacatttgccggcttggcccgtagcagcgttagacatctcgacttgagtcacggctttgttttctcacttaacagcagggtgttcgagaccctcaaagacctgaaagtgctgaacctcgcctacaataagatcaataagatagccgacgaagcattctatggtctggacaacttgcaggtcttgaatttatcatacaacctgctgggggaattgtactcctccaacttctacggactcccaaaagtggcttacatcgacttgcagaagaatcatattgcgattatccaggaccagacgttcaagtttttagagaaactacagaccctcgatctgcgcgataacgccttgaccacgatacattttattccttctatccccgatattttcctgtctggcaacaaactggtgacactgcctaagatcaacctgactgcaaacctgatccatctctctgagaatcgcctggagaatctggatattctctattttcttctgcgggtgcctcacctccaaatcttgatccttaatcagaaccggttctccagctgcagtggggaccagacccccagcgagaacccctctctcgagcagttgttccttggagaaaacatgttgcaattagcatgggagacagaattgtgctgggacgtattcgagggactttctcacctccaggtgctgtatctaaatcacaattatttgaacagccttcctcctggtgtgttctctcatttaacagcccttcgagggctttcccttaattctaatcggctcacggttttgtcacacaacgacctgccagctaatctcgagatcctggatattagtaggaatcaactgcttgcccctaatcctgatgttttcgtttccctctctgtgctcgatataacccacaacaagtttatctgcgaatgcgagctttctacttttataaattggctcaatcatactaatgtcaccattgctgggcctcccgccgacatctactgcgtttaccctgacagtttttcaggcgtctcacttttctctctgtctacggaaggatgtgatgaggaggaagttcttaagagtttgaaattcagtctattcatcgtgtgcacagtgacactgactctgtttctcatgactattttaaccgtcactaagttccgggggttttgtttcatttgctacaagactgcccagcgcctcgtctttaaggaccatccacagggtaccgagcccgatatgtacaaatacgacgcgtacctttgcttctcaagcaaagacttcacttgggttcaaaatgcactgctaaaacatctggacacacagtacagtgaccagaatcggttcaatttgtgcttcgaggaacgggatttcgtgccgggagaaaatagaatcgccaatattcaggacgccatttggaacagcaggaagattgtctgcctggtgagccgccacttcctgagagatggctggtgtctggaggcattctcctacgcccaggggaggtgcctgagcgacctgaacagcgcgttgatcatggtggtggtcggctctctcagtcagtatcaattgatgaagcaccagagtatcaggggcttcgtgcaaaagcagcagtacctcaggtggcccgaagactttcaggatgttggatggtttttgcataagctaagtcaacagatccttaaaaaagagaaagaaaaaaagaaggacaataacattccactgcagaccgttgcaaccattagctag

SEQ ID NO: 26691 - DNA, 66 bp, Artificial Sequence
  Description of Artificial Sequence: Synthetic coding sequence
atgggcgaccacctggacctgctgctgggcgtggtgctgatggccggcccagtgtttgggatttag

SEQ ID NO: 26692 - DNA, 2577 bp, Artificial Sequence
  Description of Artificial Sequence: Synthetic coding sequence
atgggcgaccacctggacctgctgctgggcgtggtgctgatggccggtcccgtgttcggcataccttcatgcagcttcgacggtcgaatcgccttttaccgattttgtaaccttactcaggtgccccaggtgctaaatacaacggagaggttgctgttgtccttcaactacattagaacagtgaccgccagcagcttcccatttctcgagcagctccagctgttggaactgggtagccaatatactcctctcaccattgacaaagaagccttccgcaatctaccaaatctgcggatcctcgacctcggcagctccaaaatttacttcctccacccagatgcatttcaggggctgtttcatctgtttgagcttcgcctctacttctgcggtctgagcgatgctgtacttaaagacgggtactttcggaatctaaaggctttgactagactcgatctctctaagaatcagatccgtagcctgtacttgcaccctagcttcggcaaactcaatagccttaaaagcatcgacttctccagcaatcagattttcctggtgtgtgagcacgagttggaacccctgcagggaaagacactgtcctttttttccttggcagctaacagtctgtatagtcgcgtctctgtggactggggcaaatgcatgaaccctttccgaaatatggttctggagatattggatgtgagcggcaatggctggaccgttgacatcaccggcaacttctccaacgctatttccaagagccaagcatttagcctgatactggctcaccacatcatgggcgcgggctttggctttcacaatattaaggacccagatcaaaacacttttgccgggttggcgaggagttccgtgaggcatcttgatctgtcacacggttttgtcttttccctgaactcaagagtctttgaaaccttaaaggacctcaaggtgctgaaccttgcttataacaagatcaataagatagccgacgaggccttctacggcttggacaatctccaagtcttaaacctctcctacaacctccttggagagctgtattcttcaaacttttacggactgcctaaagtcgcttatatcgatttgcaaaagaatcacatcgccatcatccaggatcaaaccttcaaatttctcgagaaactgcagacgttggacctgcgggacaacgccctgacgacaattcacttcatcccctccatccccgatatcttcttgtctggcaataagctggttaccctgccaaagatcaacctaacggcaaacctgatacacctcagtgagaaccggctggagaaccttgatattctttatttcctgctccgggtaccacacctgcaaatccttatcttaaatcagaatcggtttagcagttgtagcggggaccagaccccttcagagaatccatccctggagcagctgttcctgggcgaaaatatgctgcagcttgcatgggagacggaactctgctgggatgtgtttgagggcttaagtcaccttcaggtcttatatctcaatcataactatcttaatagcttgccccccggagtgtttagccacctcaccgcccttaggggcctttccctgaactctaaccgccttactgtcctgtcccacaatgatttacccgccaatctcgagatcttagatattagtcggaaccagctgttagcaccaaaccccgatgtctttgtttctttgagtgtcctggacatcacacataacaaatttatctgcgagtgcgagctttctacattcatcaattggcttaatcacactaacgtaactatcgctggaccaccggcagacatttattgtgtctaccctgactcctttagtggagtgagcctattcagtctgtcaaccgagggatgcgacgaggaagaggtacttaagtctctcaaattctccctgtttatcgtgtgtaccgtgaccctcactttgttcctgatgactatattgaccgtcaccaaattcagggggttctgtttcatctgttataagacagctcaaaggttggtgtttaaagaccacccacaaggtactgagccagatatgtataagtatgatgcttatttgtgcttctcctctaaagattttacctgggtccagaatgctctgttgaagcacctggatacccagtattcagaccagaatcgcttcaatctttgctttgaagaacgcgacttcgtgcccggggagaataggattgccaacattcaggatgctatatggaactctaggaagatcgtttgcctggtgtctcgccacttcctcagagatggatggtgtctggaagcgttctcctacgctcaaggtcggtgtttatcagacctcaattctgccctcatcatggttgtagtcggaagcttgtcacagtaccagctgatgaagcaccagagcattcgaggctttgtgcaaaagcaacagtacctgcgctggcccgaagatttccaggacgtggggtggttcctgcacaaactgtctcagcagatcctgaaaaaagagaaagaaaagaaaaaagataataacatccctctgcaaacagtggcgaccatctcctag

SEQ ID NO: 26693 - DNA, 4836 bp, Artificial Sequence
  Description of Artificial Sequence: Synthetic coding sequence
caggtgagccccagccaccccgtgaacgagaacatgcaggtgaacaaaattaaaaaaaatgaggatgcaaagaagcgcttatcggtggagagaatctaccagaaaaagacacagctggagcatattcttcttcggcctgatacttacataggatcagttgagcttgtgacacagcagatgtgggtctacgacgaggacgtgggcatcaattatcgtgaggtgacctttgttcctggcctttataaaatttttgatgaaatcctggtgaacgctgctgacaacaagcaaagggatcccaaaatgtcctgtattcgagtcacgatagatccagagaataaccttattagcatctggaataacggaaagggaatccccgtagtggaacataaggttgagaaaatgtatgtaccagctcttatttttggccagctccttaccagcagcaattatgatgacgatgagaaaaaggtcacaggtggccgaaatggctatggggcgaaactgtgcaacatattttctaccaaatttaccgtggagaccgcctcccgagagtacaaaaaaatgtttaagcagacctggatggacaatatgggccgcgccggggaaatggagttgaagccattcaatggtgaggattatacgtgtatcacctttcaacccgatttgtctaagtttaagatgcaatcactggataaggatatagtggccttaatggtgaggcgagcttatgacatcgcaggctcaacaaaggacgtgaaagtctttctaaacgggaacaagttgcccgtgaaggggtttcggagttatgtagacatgtacctgaaggacaagctcgatgagaccggcaatagtcttaaggtcatccacgagcaagtcaaccacagatgggaggtctgcctgacgatgtcagagaaaggatttcagcaaatctcatttgtcaattctattgctacctccaagggcggcaggcacgtggactacgtcgcagatcagattgtgacaaaattggttgacgtggtgaagaaaaaaaataagggtggcgtggcagtgaaggctcaccagcgtctggaatgcagcggaaccattagcgctcattgtaaccttcgccttctcggattctctgactccctggcgtccgccagcagggttgcagagattacggacatgcatcatcatatccagctgatttttgtgttcctgattgagatgggcttttatcatgtcggccaagccgggctggaactcctggcctccctggatccacccagcagcgcctcctgtgtatcccattgcacccagcttttcgtgtccaacttcatctatctgtttctgatattcctgagaagatctttcacttttgtgacccaagcgggtgtgcagtgcactattagcccaacgtcctcttccgtactggctcagttcttcgagtccttcctcttcgtggctatcggctgtggaattgtggagagtattcttaattgggtaaagtttaaagcacaggtgcaacttaacaagaagtgcagtgctgtgaagcataaccggatcaagggcattccgaagttagacgatgccaacgatgctgggggcagaaatagcactgagtgtactctgatcctgacagagggcgacagtgccaagacccttgcagtgagcgggctgggcgtagtgggcagagataagtatggcgttttccctctgcgaggaaaaatcctgaatgtgcgcgaggcttcgcacaagcagattatggaaaacgcagagattaacaacatcatcaagatcgttggactgcagtataagaagaattatgaagacgaggattctctgaaaacactcagatatggcaaaattatgattatgacagatcaggatcaagatgggtcacatatcaagggccttctaatcaactttatccaccacaattggcctagcctgctccgacaccgctttctagaggagtttattacccctatcgtgaaggtttcaaagaataagcaggaaatggccttttatagcctgcctgagttcgaggaatggaagagctcaacgcctaaccacaaaaagtggaaggtgaagtattacaagggtctgggcacaagcacctccaaggaagccaaagaatatttcgcagatatgaaaagacaccgtatccagtttaagtacagtggtccagaagacgacgcagcaatctccctggcattttctaagaaacaaattgacgatagaaaggaatggttgacgaacttcatggaggaccgccgccagcgtaaactgctgggcttgcccgaagattatctatacggccagaccactacttacctgacctacaacgattttatcaataaggaactgattctattctcgaactcagacaatgagagatcaattccttctatggtagatggcctgaagcctggacagcgtaaagtgctgtttacatgttttaaacgaaacgacaaacgcgaagtcaaggttgctcagttagctggctccgtagctgagatgagcagctaccatcacggagagatgtccttgatgatgaccattatcaaccttgcgcagaattttgttggttctaacaatctgaatctactgcaaccgatcggacagttcggaaccagattacacggaggcaaagatagtgctagtccacgctatatcttcacaatgttgtcctctttagcccgcctgctattccccccgaaggacgatcacactctgaaattcctttatgacgataaccaacgggtcgaacctgaatggtatataccaataattccaatggtccttatcaatggcgccgaaggaattggaacgggctggtcctgcaagattccaaactttgatgttcgcgaaatagtcaataatattagaagactaatggacggtgaggagccacttccaatgctcccgagctacaagaattttaagggtaccattgaggagttagccccaaaccaatacgtcattagcggagaagtggccatacttaattcaacaactatcgagatctcggaactgcctgttcgcacttggactcagacctacaaggaacaggtcctggagcccatgcttaacggaaccgagaaaacccctcccctgatcacagactatcgcgagtatcataccgataccactgtgaagttcgttgtcaagatgactgaggagaaattagctgaggccgaacgcgtcggactccataaagtattcaaactgcagacatctctaacgtgtaactcgatggtgctctttgaccacgtgggctgcctcaagaagtacgacaccgtacttgacatcctgcgtgatttcttcgagttgaggctgaagtattacggtctgcggaaagaatggttgctgggaatgctgggtgctgaatccgcaaagttaaataaccaggcccgcttcatccttgaaaaaattgacggtaagatcatcatcgaaaacaaaccaaaaaaggaactcatcaaagtgcttatccaacggggctatgactccgatccggtgaaagcctggaaggaagctcagcagaaggtgccagacgaggaagagaacgaggagagtgacaacgaaaaggagacggaaaagagcgatagcgtaacagactctggccccaccttcaactatctgcttgacatgcccctctggtacctgactaaggaaaagaaagatgaactatgccgattgagaaatgagaaagagcaggaactcgatacactgaagcgcaagagtccatccgatctatggaaagaggatttagcaacgttcattgaggaactggaagctgtcgaggccaaggaaaaacaggacgaacaggtcggcctgccaggaaagggtggcaaggcaaagggcaaaaaaacgcagatggccgaggtgttgccatccccgcggggacaacgggtgatcccacggattaccattgaaatgaaagccgaggccgagaagaaaaataagaagaaaataaaaaacgagaataccgaagggtcccctcaagaggacggcgtcgagctggaaggcctgaagcagcgactcgaaaagaaacagaagcgcgagccaggtacaaaaacaaaaaagcaaacaactttggcttttaaacctattaaaaagggaaaaaagcgcaacccgtggtcagattccgagtctgaccgctcttccgatgaatctaattttgacgttccgccccgtgagacggagccaaggagagcagccactaagacaaaattcaccatggacctggactccgacgaggatttctccgacttcgacgaaaagacagatgatgaagactttgtgccaagcgacgcaagcccacctaagaccaaaacttctccaaagcttagcaacaaagagctgaagccgcaaaaatccgtggtgagtgatttggaggccgatgacgtcaaagggtcagttcccctgtctagttccccacccgctacccactttccagacgagaccgaaataaccaacccagtccctaaaaagaacgtgactgtcaagaagaccgcagccaaatctcagagttccacctcgaccacgggggcaaaaaaacgcgcggcgcctaagggcaccaaacgcgatcccgcccttaactctggtgtcagccagaaacccgatcccgctaagacgaaaaaccgccgcaagagaaagccctcaaccagcgatgacagcgattctaacttcgaaaagatagtcagcaaggccgtcaccagtaaaaagtctaagggggagagtgatgattttcatatggattttgacagtgccgtcgcccccagagcgaagagtgtacgggccaagaaacctataaaatacctcgaagagagtgatgaagatgacctattctag

SEQ ID NO: 26694 - DNA, 4665 bp, Artificial Sequence
  Description of Artificial Sequence: Synthetic coding sequence
caggtgagccccagccaccccgtgaacgagaacatgcaggtgaacaagatcaagaaaaatgaagacgccaagaagagactttctgtggaacgcatctaccagaagaaaacgcaactggagcacatcctgctgcgtccggatacctacataggcagtgtggaattagtgacacagcagatgtgggtgtacgacgaggacgtgggtataaattatcgcgaggttacatttgtccccggcctgtataaaatttttgacgaaatactggtgaacgccgcggataataagcagagggacccaaagatgtcatgcattagagtcacaattgaccctgaaaataacttaatcagcatctggaacaatggtaagggaattccagtggtcgagcataaggtggaaaagatgtatgttccagcccttattttcgggcaactgctgacctcctcaaactacgatgatgacgaaaagaaagtaacaggcggcaggaacggatatggcgccaaactgtgcaacatttttagcacaaaatttaccgtggagacagcgagtcgcgagtataagaagatgttcaagcagacatggatggacaatatgggccgggccggggaaatggagttgaaacccttcaacggcgaggattacacttgcattacttttcagcctgatttatccaaattcaaaatgcagagtctcgacaaagacatcgtagctcttatggttcggagggcttacgatattgcgggctccaccaaagacgtgaaggtcttcctgaacggcaacaaactgccggtgaaggggttccgctcctatgtcgacatgtacctgaaggacaagctcgacgaaaccggcaattcacttaaagtaatccacgaacaggtaaaccatcgctgggaagtgtgcctgactatgtctgaaaagggctttcagcaaatctccttcgttaacagcatcgccacatccaaagggggccgccacgtagattacgtggctgaccagatcgtcacaaagcttgtagatgttgtaaagaaaaaaaataaggggggcgtcgcggtgaaagcccaccaagtgaagaatcatatgtggatctttgttaacgccctgatcgagaaccccacattcgactctcagacaaaggagaatatgacactgcagcctaaatcttttgggagtacttgtcagctgtccgagaagttcataaaagcggcccatttatactccagattccttattgatcctttcttcccaaacatgatccccaatatgaacttattccaggctatcggatgcggaatagtagagagtatcctgaattgggtaaaattcaaggctcaggtgcagctgaataaaaaatgcagcgccgtgaagcacaaccgcattaagggaattcctaaactagacgacgcaaacgacgctggaggtaggaatagcacagagtgtacactgatcttaaccgagggagactctgctaaaacgttggctgtttctgggctgggagtcgtgggacgtgacaagtacggcgtgttcccattacgggggaaaatcctgaatgtgagggaagcttcccacaaacagattatggagaacgccgagattaataacatcattaaaatagtcggcctgcagtacaaaaagaattacgaagacgaggactcactcaaaaccctgcggtacgggaaaattatgattatgacagatcaggaccaggatggatctcatatcaagggactgctaatcaattttatccatcacaactggccttctctacttagacaccgatttctcgaggagttcatcaccccaatagtgaaggtctctaagaataaacaggagatggctttctacagccttcccgagttcgaagagtggaaaagctcgacccctaatcataagaaatggaaggtgaaatactataagggcctcggaacttccacaagtaaagaagccaaggaatacttcgctgacatgaagcgacatcgcattcagtttaaatactcagggcccgaggacgacgcggccatatcactggcattctccaaaaaacaaattgacgaccgcaaagaatggctcactaacttcatggaggatcgcaggcagagaaaactgctcggactccccgaagattacctctatgggcaaacaacaacttacctgacatataacgactttatcaataaagaactcatcctgtttagcaactccgacaatgagcgtagcataccctctatggtagatggactgaaacccggacaacggaaagttctattcacgtgttttaagagaaacgataaacgggaggtgaaggtcgcccaactggcgggctccgttgccgaaatgagctcgtatcaccatggcgaaatgtctctaatgatgacaattattaatcttgctcaaaattttgtcggttccaacaaccttaatctgctccagcctatcggccagtttgggacccgcctgcatggcggcaaggactccgcaagccccagatacattttcaccatgctttcttcattggctaggctgctcttcccacccaaagacgaccacactctgaaattcctgtacgatgataaccagagggtcgaacccgagtggtatattcctattatccccatggtgctcattaacggcgcagaaggcatcggaaccggatggtcttgtaagatcccaaatttcgatgtacgcgagatcgttaacaatattcgaaggctgatggacggggaagagccgttgcccatgctcccatcttacaagaattttaaagggactatcgaggagctcgctccgaatcagtacgttatttctggcgaggttgccatcctcaatagcaccaccatcgaaatctcagagctacctgttcgaacctggacacagacctacaaggaacaggtgttagaaccgatgctgaatggtactgagaaaactcctcccctaataactgactatcgggagtatcacactgacactacagtcaagtttgtggtcaaaatgacagaagagaaactcgccgaggctgagagagtggggctacataaggtcttcaaactgcagacttctcttacatgtaactcaatggttttattcgaccacgtggggtgtctaaaaaaatatgacactgtgctcgacatcttgagggatttctttgagctgcgccttaagtattatggtcttcggaaggagtggttgcttgggatgctcggcgcggagtctgcaaagcttaataaccaagcccgcttcattttggagaagattgatgggaaaatcatcatagaaaacaagcccaagaaggagctgataaaggtgcttatccagcgcggctatgactccgatcccgtcaaagcctggaaggaagcccagcagaaagtgcctgacgaggaggaaaacgaggagagcgataacgagaaggaaactgagaaaagcgactccgtcactgactctggtcccacatttaactatttgttggacatgcctctctggtatctgacgaaagagaagaaagacgagctgtgccggcttcgcaacgaaaaggagcaagagcttgatacgctgaagcgaaagagcccctccgacctgtggaaggaggatctggctacttttatcgaagagttggaagctgtcgaagcaaaggaaaagcaggatgagcaggtcgggctgcctggtaaagggggcaaagcgaaaggcaagaagacccaaatggccgaagtcttgccctcccccagaggacagagagtcatcccgagaattactatcgaaatgaaggccgaggctgaaaagaaaaacaagaaaaagattaaaaacgaaaacacagaaggcagcccacaggaggacggcgtggagttagaagggctcaagcaaaggcttgagaagaaacaaaaaagggaacccggcaccaagacaaagaagcagactaccttagcctttaagcccattaaaaaaggcaagaaacgcaatccatggagcgacagcgaatcggatcgttcaagtgatgaaagcaatttcgacgtgcctcctcgagagaccgagcctaggagagccgcaaccaaaaccaagttcacaatggaccttgatagtgacgaagacttttctgactttgacgagaagactgatgacgaagactttgtaccttccgacgcctccccccccaagacaaagacctccccgaaactgagtaacaaggagcttaaaccccagaaatccgtcgtgtcagacctcgaggccgacgacgtcaagggtagtgtgcccctgtcctcgagtccccccgccacacacttcccagacgaaaccgaaattacaaaccctgtacctaagaaaaacgtgacagtgaagaagacagccgcaaaatctcagagctccacgagcactaccggcgccaagaaacgcgccgctcctaagggaaccaagcgtgatcccgcactgaactccggcgtgagtcagaaaccagacccagccaaaaccaaaaatagacgaaagcgcaagccctctactagcgatgatagtgattccaattttgagaagatcgtctctaaagcggttacctccaaaaaaagcaagggagaatccgacgactttcacatggattttgacagtgccgtggccccgcgtgccaaatcagtgagggccaaaaagccaattaagtacctggaagaatccgatgaggacgacctcttctag

SEQ ID NO: 26695 - DNA, 4707 bp, Artificial Sequence
  Description of Artificial Sequence: Synthetic coding sequence
atggaggtgagccccctgcagcccgtgaacgagaacatgcaggtgaacaagataaagaagaatgaggatgccaaaaagaggctaagcgtggagagaatttaccagaagaaaacccagctggaacatattcttctacgcccggatacatatattgggagcgtagagcttgtaacccaacaaatgtgggtatacgacgaggatgtggggatcaactatcgtgaggttaccttcgtgcccggattgtataaaatctttgacgagatcctcgtgaacgccgcagataacaagcagcgggacccaaagatgtcatgtatccgcgtcaccatcgacccagagaacaacctaatttccatttggaacaatgggaaggggattccagttgtggagcacaaagtggagaagatgtacgtgcccgctttaattttcggccagctgctgaccagctcaaactacgacgatgacgagaagaaagtaacaggaggccgtaacggctatggggcgaaactgtgcaatatcttttcgaccaagttcaccgtagagaccgctagcagggagtataaaaaaatgtttaagcaggctatcacctggatggacaatatgggcagggctggagaaatggagctcaaaccattcaatggggaggattatacctgtataacctttcagcccgatctgtctaaatttaagatgcagtctctggacaaagacatcgtggctcttatggtaagaagggcttacgatatcgcgggatctacaaaagacgtaaaagtctttttgaatgggaacaagctcccagtgaaggggtttcgtagttatgtcgacatgtatttaaaagacaagctcgacgaaacaggtaactcactcaaggtcatccacgagcaggttaaccaccgatgggaggtctgtctgactatgagcgagaagggatttcaacaaatctcatttgttaattccatcgctacctctaaagtgatcctgtttttgaattacatgatctatttgtatatttacgtttttctgctgtttttgatctacaaagtggacctgaacatagggttggcctattttacgggcgggcgccacgttgactacgtggccgatcaaattgtgacgaagctagtggatgtcgttaaaaagaaaaataagggaggtgtcgctgtcaaagcccaccaggttaagaaccatatgtggatcttcgtcaatgcgttgattgagaatcctacttttgatagtcagaccaaggaaaacatgaccctacagcctaaatccttcggaagcacttgtcagctgagcgaaaaatttatcaaagcggccatcggatgcggcatcgtagaatccatcctgaactgggtgaaattcaaagctcaggttcagttgaacaagaagtgcagtgcagtcaaacacaacaggattaaaggcatccctaagctggatgacgccaatgacgctggaggacggaattccactgagtgcactctcatcctgacggagggggactccgcgaagacccttgccgtgtctggcttaggtgttgtagggagggataaatatggcgtgttcccccttcgaggcaaaatacttaatgttagagaggcatcgcacaagcagatcatggagaatgctgagatcaataacattatcaaaattgttggactgcagtataaaaagaactatgaggatgaggattccctgaagaccctccgttatggcaagattatgatcatgaccgaccaggaccaggatgggagccacataaagggcctgctgatcaactttattcatcacaactggccgtcactactccgtcatagattcttagaggagtttataacaccaatcgttaaagtgtcaaagaataagcaggagatggctttttattcactgccagaattcgaagaatggaagtctagcaccccaaaccacaagaaatggaaggtaaagtactacaaagggctcggaacttccacctccaaggaagcaaaagaatattttgcagatatgaagcgacaccgtatccagttcaaatattccggacccgaggacgatgccgccatttctctggctttttccaaaaagcagattgatgatcggaaggaatggttgacaaatttcatggaggaccgacgccagaggaaacttctgggactgcctgaagactacttatacggtcagacaacaacttacctgacctataatgactttattaacaaagagctgatactgttttccaatagcgacaatgagaggtcaattccgtctatggttgatggtctgaaacctggccagcgcaaagtactgttcacgtgtttcaaacgcaacgataagcgagaggtcaaggtggcacagctcgcaggcagcgtggcagagatgagcagttatcatcatggtgagatgtcattgatgatgactattatcaaccttgcccaaaatttcgtcggatcaaataacttgaaccttttgcagccgattggccaattcggtacccggttacacgggggcaaggatagtgccagtcctaggtacatcttcacgatgctgtcaagcttggcccggcttctgttcccccctaaggatgatcacaccttgaagtttttgtacgacgataaccagcgggtggaacccgaatggtatatcccgattattccgatggtgctaattaacggggcggagggcataggcaccggatggagttgtaagatccccaacttcgatgtgcgagagatcgtcaataatattcggagactcatggacggagaggaaccactgcccatgttgcctagttacaaaaatttcaagggaactatagaggaattggcgcctaaccagtatgttatatctggcgaggtggcaatactgaactctacaaccatcgaaatctccgagctgccggtgcgtacctggacacagacctacaaggagcaagtacttgaaccaatgttgaacggcactgagaaaacacccccccttataacagattaccgtgagtaccacactgacacaacggtcaagtttgtcgttaagatgaccgaagagaagttagctgaagccgaacgcgtgggactccacaaggtttttaagttgcagacatcactgacctgtaatagcatggttctctttgatcatgtcggatgcctgaaaaaatacgatacagtgctggacattctgcgggactttttcgagctgcggctaaaatactacggtctgcgtaaagaatggctcttgggtatgttaggtgctgagtccgccaagttaaataatcaggcccgtttcattctcgagaaaatcgatggcaaaattataattgagaataaaccaaaaaaagaacttattaaggtcctgatccagcgaggctacgattcagatccggtgaaggcctggaaagaggcacagcagaaggttccagacgaggaggagaatgaggaatccgacaacgaaaaagagactgagaagagcgattcggtgactgactcgggacccacattcaattatctcctggacatgccattatggtatctgaccaaagagaagaaggacgagctgtgcaggctgagaaacgaaaaagagcaggagctggacacactgaagaggaaatcgccatccgatctatggaaggaagacctagccactttcattgaggaactggaagctgtggaagccaaggaaaagcaagacgagcaggtgggcctcccaggtaagggtgggaaagcaaagggtaagaagacccagatggcagaggtcctcccctccccaagaggacagagggttattccccgaatcacaattgagatgaaagccgaagctgagaagaagaataagaagaaaatcaagaacgagaatacagagggatctccacaagaggatggagtagagctcgaaggactaaagcagcgcctagagaaaaagcaaaaaagggagcctgggacaaagactaagaagcagacaacactcgcttttaaacccatcaaaaaaggcaaaaaacggaacccctggtcagatagcgaaagtgacaggtcatccgatgagagcaattttgatgtgccacctcgagagaccgaaccccgccgagccgccactaaaaccaagtttactatggacctggactctgatgaggatttctcagacttcgatgagaagacagacgacgaggattttgttcctagcgacgcttccccccctaaaaccaaaacatccccaaagcagaactgtaataaggagttaaaacctcagaagtccgtcgtctctgacctcgaggctgacgacgtaaaggggtcagtcccccttagcagcagccctccggcaacacatttccccgacgagacagagatcactaatcccgtgcctaagaagaacgtcaccgttaaaaaaacggctgccaaaagccagagtagcacaagcaccaccggcgctaagaagcgcgccgcccctaagggaactaaaagagaccctgctctcaatagcggggtctctcagaaacctgacccagctaaaactaagaaccgaagaaaacgcaaaccatctacctcagacgactctgactccaattttgaaaaaattgtcagcaaggcagtgacctccaagaagagtaaaggggaatcagatgattttcatatggatttcgactctgcagtggcccccagagcaaaaagtgtgcgcgctaaaaaaccaatcaaatacctggaagaatcagatgaggacgatctcttctag

SEQ ID NO: 26696 - DNA, 4596 bp, Artificial Sequence
  Description of Artificial Sequence: Synthetic coding sequence
atggaggtgagccccctgcagcccgtgaacgagaacatgcaggtgaacaagatcaagaagaatgaagacgcaaagaaacggctgtcagtagaaaggatttaccaaaagaaaactcagctggagcacattttgctgaggcctgatacatacattgggtcagtagagctggttacccaacagatgtgggtttacgacgaggatgtgggaataaactatcgggaggtcacattcgtgccgggtctgtacaagatctttgatgagattctggttaatgccgcagataataaacagagagacccaaagatgtcatgtattcgggttactatcgacccagaaaacaacctcatttctatttggaacaatggtaaggggattccagtggtggagcataaggtggagaagatgtatgtgcccgccttgatatttggtcaattactgacatcctcaaactatgacgacgacgagaagaaggtgaccggcggccgcaatggatatggagccaaattgtgtaacatttttagcaccaagtttactgtggagaccgcctccagagagtacaagaagatgtttaagcaaacatggatggacaacatgggaagagcgggtgagatggaattgaagccattcaacggggaggattacacctgtattacttttcagccggatctgtcaaagtttaaaatgcagagtctcgacaaggacatcgtggctctcatggtacgcagggcctatgacatcgcagggtctactaaagatgtcaaagtgtttctcaatggcaataagcttcctgtgaagggttttaggtcttacgttgacatgtacctcaaagacaagcttgacgagactggaaattctctcaaggtgatccacgaacaagtcaaccaccgctgggaggtctgcctaactatgtcagaaaagggtttccagcagatctcttttgtgaatagtatcgcgacgagtaagggaggccggcacgtggactatgttgctgatcaaatcgttaccaagctggtggatgtagtcaaaaagaaaaacaaggggggcgtggccgttaaggcacaccaggtgaagaatcatatgtggatcttcgttaacgcattgattgagaatcccacgtttgactctcagacgaaagagaacatgacactccagcctaagtcttttggttcaacctgccaactcagcgagaaattcataaaggcggcaattgggtgcggtatcgttgagagtatacttaattgggtgaagttcaaggctcaggtacaacttaacaagaaatgtagtgccgtgaagcataataggatcaagggaattcccaaactggacgatgccaacgacgctggcggacgcaacagtacagagtgcaccttgatactcacggagggggacagtgctaagacactcgctgtgtcaggattaggagtggtcgggcgggacaagtatggtgtttttcctttacgtggcaagattttgaatgtcagggaagcctctcataagcagatcatggaaaatgcggaaatcaacaacattattaaaatcgtggggctccagtataagaagaactacgaagacgaggactctttgaaaaccttgcgctatggaaagattatgattatgacggatcaagatcaggacgggtcccacatcaaggggctgttgattaattttatccaccacaattggcccagtctgcttcggcacagattcctcgaggaattcattacacctatagtgaaggtgtcaaagaataagcaagaaatggcattttacagcctgccagagttcgaggagtggaaaagtagtacccccaatcataaaaagtggaaagtgaagtattataagggcctgggtaccagtacttccaaagaggccaaggaatactttgccgatatgaaacggcacaggatacagtttaaatacagtgggccagaagatgatgcagctataagcctagccttctcaaagaaacagatcgacgatcgtaaagaatggctgacaaatttcatggaggaccgtaggcagaggaaactactggggcttcctgaggattatctctacggccagaccacaacttatctgacatacaacgactttatcaacaaggaactaatcctgttcagtaattcagacaacgagaggtctatcccttcaatggttgatggtctcaaacctggacaacgcaaagtcttgttcacctgcttcaagagaaatgacaaacgcgaagtaaaggtggcccagctggccggcagcgttgccgagatgtcttcctaccaccatggagaaatgagtctgatgatgacaattatcaatctcgcgcagaatttcgtggggtccaacaacctcaatctgctgcagccaattggacagtttggcacccgtctccacggagggaaggactctgctagcccccgatatatcttcaccatgctgagttctctggccagactactcttccctccgaaagacgaccataccttgaaatttctgtatgatgataaccaacgagtggagccggaatggtacattccgattatcccaatggtgctgatcaatggagcagagggtataggcactggatggtcttgcaagattcccaacttcgatgtcagggagatcgttaataacattcgcagactcatggacggggaggaaccactccctatgcttcctagttataaaaacttcaagggcaccatagaggaactagcaccgaatcagtatgtcatctcaggagaggtcgcgattctgaacagcacaactatcgagattagcgaattacccgtacgcacttggactcagacctacaaggaacaggtgttggagccgatgctgaatgggaccgagaagacacccccattgatcaccgactatagagagtatcacaccgacactaccgtgaagttcgtggtgaaaatgaccgaggaaaagctggcagaagcagagagggttggactgcataaggtgttcaaactccaaacttcgctcacctgcaacagcatggtgctgtttgatcacgttggttgtcttaagaaatatgacaccgtgctcgatattctgcgcgacttctttgaactgcggctcaagtattatggtctcagaaaagagtggttgcttggtatgttaggcgccgaatctgctaaacttaacaaccaggcacgttttatcttggaaaagatcgacggcaagattattatcgaaaacaaaccgaagaaggagctaattaaggtccttatacagcggggatatgacagcgatccagtgaaggcctggaaagaggctcagcagaaggttccagatgaggaggaaaacgaggagtctgacaacgaaaaagaaactgaaaaaagtgacagcgtgactgacagtggacccaccttcaattacttgttagacatgccgctgtggtacctgacaaaggagaaaaaggacgaactatgtagacttcgaaacgagaaagagcaagagctggacaccctcaagcgcaaatccccttccgacttgtggaaggaagacttagctactttcattgaggagcttgaggccgttgaggccaaagaaaaacaggatgaacaagttggactgccgggaaagggtggcaaggctaaaggaaaaaagactcagatggccgaggtgctgccatccccgcgtgggcagcgggtcattcctagaatcacgatcgaaatgaaagcagaggcagaaaagaagaacaaaaaaaaaattaaaaacgagaacaccgaaggtagtccgcaggaagacggcgtggaactggagggtctcaaacagcgactagagaagaagcagaaaagagagcccgggaccaagaccaagaagcagaccacattggctttcaaaccgattaaaaaagggaagaagcgcaatccctggagcgacagcgagtccgacagatcttccgatgaaagcaactttgacgtgccaccccgggaaactgagccgcggcgggcggcaactaagacaaaattcactatggatttggactcggatgaggatttctccgatttcgatgagaagacagatgatgaggactttgtcccctctgatgctagtccgccaaaaactaaaaccagccccaaacttagcaataaggaactcaagccccagaaatcagttgtatccgacctcgaagccgatgacgtcaaggggagcgtgccactgagtagtagtccccccgccactcacttcccggatgaaacagagataaccaacccagtgcctaaaaaaaacgtcacagtgaaaaagaccgccgcaaaaagccagagttccacaagtactaccggagctaaaaagagagccgcccccaagggtaccaagagagaccctgctttgaacagcggcgtgtctcagaagccagatccggccaaaacaaagaacagacggaagaggaagccaagcacatctgatgattctgatagcaatttcgagaagatcgtatctaaggctgtaaccagcaagaaaagcaaaggtgaatccgacgattttcacatggattttgactctgctgtggcccccagggcgaagagtgttcgggccaagaaacccatcaaatatctggaagaaagcgacgaggacgacctcttctag

SEQ ID NO: 26697 - DNA, 4881 bp, Artificial Sequence
  Description of Artificial Sequence: Synthetic coding sequence
atggccaagagcggcggctgcggcgccggcgccggcgtgggcggcgggaatggagcactgacttgggttaccctcttcgaccagaataacgcagctaaaaaagaggagagcgagaccgccaacaaaaatgattccagcaaaaagttgtctgtggaacgtgtataccaaaagaaaacacagctcgaacatatcttgctcagacccgacacctacattggaagcgtagagccattgacccagttcatgtgggtgtacgacgaagatgtcggtatgaattgtcgagaggtcacctttgtgccaggcctgtataagatctttgacgagattctagttaatgccgctgacaacaagcaacgtgacaagaatatgacctgtattaaggtgtccatcgacccggagtcaaacatcatcagtatatggaataatggtaagggtattcctgtggttgaacacaaggtggaaaaggtttacgtccctgccctgatttttgggcagttacttacatcaagcaattatgatgacgacgaaaagaaggttacaggcgggcggaatggctacggagccaagctctgcaatattttttcaaccaagttcacagttgaaaccgcatgtaaagagtacaaacatagttttaaacagacctggatgaacaacatgatgaaaacatctgaagccaaaattaaacacttcgacggcgaggattatacctgtattaccttccagcctgacctgtctaagttcaagatggagaagctcgacaaggatatcgttgccctgatgacacgtcgtgcctatgatctggccggatcctgtagaggcgttaaggtgatgttcaacggtaaaaagctgccggtgaatggattcagatcctacgttgacctctacgttaaggacaagttggatgaaactggagtcgcattgaaggtgatacacgaactagcaaacgagcgatgggatgtttgtctcacgctgtcagagaagggttttcagcaaatatcctttgttaactccatcgccaccacaaagggaggcaggcacgtggattacgtggtggatcaggttgtcggtaaacttattgaggtcgtcaaaaagaagaataaagctggggtgtctgtgaaaccctttcaggtcaagaaccacatctgggtgttcatcaattgcctgattgagaacccaaccttcgacagtcagaccaaagagaatatgaccctgcagccaaagagctttggctctaagtgccaactgtctgagaagtttttcaaagccgcaagtaactgtggaattgtggaaagcattctgaattgggtgaaattcaaggcgcaaactcagctcaacaagaagtgtagttccgtcaagtattcaaaaataaagggaattcccaagcttgacgatgccaacgatgcagggggaaagcatagcctcgagtgtacgttgatcctcaccgagggagacagcgccaagtcactggctgttagcggcctgggcgttattggaagggatagatatggcgtgttcccacttcgagggaaaatcttgaacgtgagagaggctagccataagcagataatggagaacgcggagattaacaatatcatcaaaatcgtggggctgcagtacaagaaatcctatgacgacgccgaaagtctgaagactctccgttacggtaagattatgattatgactgatcaggaccaggatggatcccatatcaagggcctgctcatcaactttattcaccacaattggccatcactcctcaagcacgggtttcttgaggagtttatcactccaatcgttaaagcatcaaaaaataagcaggagctgagcttctactctatccctgagtttgacgaatggaagaagcacattgagaatcagaaggcctggaagattaaatactacaaaggactcggaaccagcacagctaaagaggccaaggagtatttcgccgacatggaaaggcatcgcattctcttccggtatgctggccctgaggacgatgcggctattacactggctttcagtaagaagaagattgatgataggaaggagtggctgaccaactttatggaggatagacgtcagcgtcgcctgcatggtctccctgaacagtttctctacggcacggccactaagcatctgacatacaatgacttcattaacaaggagcttatcctattttccaacagtgacaacgagagaagtattccttctcttgtggatggattcaaaccaggccaacggaaggttctgttcacctgcttcaagcggaacgataaaagggaggtcaaggtggcccaactcgcaggctcggtggctgaaatgagtgcgtaccaccatggcgaacaggccttgatgatgacgatagttaaccttgcccagaacttcgtcggctccaataatattaacctactccaacccataggtcagttcggtacgcggctccatggtggcaaagacgccgccagtccgcgatatatttttaccatgctctcgaccctggctcgtctgctgtttcctgctgttgatgacaacctgctgaagtttttgtatgacgacaatcagcgggttgaacctgagtggtacatcccaatcatccctatggtgctgatcaacggcgccgaaggcatcgggaccggctgggcctgcaaacttccaaactacgacgctagggaaatcgtcaataatgttcgtcggatgctggatggattggatccgcatcccatgctgcctaactataaaaattttaagggcaccattcaggaacttgggcagaaccagtatgccgtgtccggcgagatttttgtagtcgaccgcaatacagttgagatcacagaactaccggttcgcacttggacccaagtctataaagagcaggttttagagcccatgctgaacggaacagacaagacccctgcactgatctccgattataaagagtaccacactgacaccactgtgaaatttgtggtgaagatgactgaggaaaaattagcgcaggctgaagctgcgggacttcacaaggtctttaaactgcagacgactctgacatgcaattctatggtcctcttcgatcatatgggttgtcttaaaaagtatgagacggtgcaggacatccttaaagagttcttcgacttgcggttaagctactacggtttacgcaaggaatggctcgtgggaatgctgggcgccgagtctacaaaattaaacaatcaggctcgattcatcctggaaaaaattcagggcaaaatcaccattgaaaaccggtcaaagaaggacctgattcaaatgctggtgcagcgcggttatgagtccgatcccgtcaaagcatggaaggaggcacaggagaaagccgccgaggaggatgagacacagaatcagcatgatgattcttcttcagattcagggacccccagcggccctgactttaactatattctaaatatgagcctgtggtcgctaactaaggagaaagtcgaggaactcattaagcagcgcgacgccaagggtcgcgaagtcaatgacctaaaacgtaagtctccttctgacctctggaaggaggatctcgctgcgttcgtggaagagttggacaaggtcgaaagccaggaaagagaagacgtgctggcgggcatgagtggaaaagccataaaaggaaaggtaggaaaacctaaagtcaaaaagttacagcttgaggaaaccatgccaagtccatatggtaggcggattattcctgaaatcactgcaatgaaagctgacgcgagtaagaagctgcttaaaaaaaaaaagggtgatctcgacaccgctgcagtgaaagtggaattcgatgaggagttcagtggagctcctgtggagggggccggggaggaggctctcacacccagcgttccaataaacaaaggtccaaagccaaaaagagagaagaaagagcctgggacgagggttagaaaaacaccaaccagcagcggcaagccctcagccaagaaagtaaagaaaagaaatccctggtcagatgacgagtcgaagtccgaaagtgatctggaagaaaccgaacctgtcgtgatcccccgagactctttgttgcgcagggctgctgctgaaagacccaaatacactttcgacttcagcgaggaagaggacgatgatgcagatgatgacgacgatgataacaatgacttggaagagctgaaggtgaaagctagtcccattactaacgacggtgaggacgagtttgtaccctccgatggactcgataaggacgagtataccttctcccctgggaaatctaaagcgacccccgagaaaagcctgcatgataagaagagtcaggatttcggaaacttgttttcctttccgtcctactcacaaaaatctgaagatgatagtgcgaagtttgatagcaatgaggaggacagcgccagcgtgttcagtccgtcctttggattaaagcaaacagacaaggtgccatcaaaaacagtcgccgctaaaaaaggcaagccttcctcagatacagtgcctaaacctaagagagcacctaagcagaaaaaggtcgttgaagcagttaatagcgacagcgatagtgaattcgggatccccaaaaaaaccacgacccctaagggcaagggtcgaggggccaagaaaagaaaggcatcaggcagtgaaaacgaaggcgattacaaccccgggagaaaaacatccaagacgacatctaagaagcccaagaaaacttctttcgatcaggactcagacgtggatattttcccctctgactttcctactgaacccccgtctctcccaagaacaggccgggctcgtaaagaagttaaatatttcgctgagtccgatgaggaggaagacgacgtagacttcgctatgtttaactag

SEQ ID NO: 26698 - DNA, 3453 bp, Artificial Sequence
  Description of Artificial Sequence: Synthetic coding sequence
atggccaagagcggcggctgcggcgccggcgccggcgtgggcggcggtaacggcgctctgacctgggtgaacaatgcggcgaagaaagaggaaagtgaaactgctaacaaaaacgacagtagtaagaagctgagtgtggaaagagtatatcagaagaagacacaactagaacatatcttacttcggcctgatacatatattggttctgtggagcctcttactcagtttatgtgggtttatgacgaggatgtggggatgaattgtagggaagtgacctttgtgcctggcctatacaagattttcgacgaaatcctcgtgaacgctgccgacaacaaacagagagacaaaaacatgacttgtataaaagtgtcaatcgatccagagtcgaatatcatttccatctggaataatggaaaagggatccctgtggtggaacataaagtggagaaagtttacgtcccggccctgatattcggccagctccttacaagcagtaattacgatgacgatgaaaagaaagtgactggcggcagaaacggatatggggctaagttgtgtaacatattcagcaccaagttcacagtggagacagcctgcaaggagtacaaacattcatttaaacagacatggatgaacaacatgatgaagacttccgaagccaaaattaagcactttgatggcgaagattacacatgtataacctttcagcccgacctatccaaatttaagatggaaaaactggataaagacattgtggcattgatgacacggagagcatatgacctcgccggcagctgccgtggtgtgaaggtgatgtttaacgggaagaaactccctgtaaacggcttcaggtcgtatgtcgatctctatgttaaagataagctagacgaaacaggcgtggccttgaaagtgatacacgagttagccaacgaacgatgggacgtctgcttaaccctcagcgaaaagggattccagcagatctcatttgtgaacagcatcgccactactaaaggcggcagacacgtcgattacgtggtggaccaggtggtgggaaagctgatcgaggtcgtcaaaaagaagaataaagctggagtctctgtgaagccattccaggtgaagaatcacatctgggttttcataaattgtctgatagagaatccaacgttcgactctcagacaaaagaaaacatgacgttacaacccaaaagctttggctccaaatgccagctgtcggaaaaatttttcaaggctgcctctaactgtggaatcgtggaaagtatattaaattgggtgaaattcaaagcacaaacgcagttgaacaaaaagtgttccagtgtgaagtattccaagatcaaaggaatccctaagctagatgatgccaatgatgctggcggcaaacacagcctggagtgtaccctgattttgactgaaggggatagcgccaagtccctcgctgtgtctgggctgggagtgatcggtcgcgaccggtatggcgtctttccactaaggggaaagatactcaatgtgcgggaggccagccataagcagattatggaaaacgcagaaatcaacaatatcatcaaaatcgtgggccttcagtataagaaatcttatgatgacgcagagtccctcaaaacactgcggtacggcaagattatgatcatgactgatcaggatcaggatgggtctcacatcaaggggcttctcattaattttattcaccataattggccatccctcctcaagcatggcttcctagaagagtttatcacacctattgtgaaggcaagcaagaataaacaagagctctccttttattcaatcccagagtttgatgagtggaaaaaacacattgagaatcagaaagcatggaagatcaagtactataaggggctcggcacgagtacagcaaaggaggctaaggaatacttcgctgacatggaaagacacaggatcctgttcagatacgctggccccgaagacgatgctgcaataactttggcttttagcaagaagaagattgacgatcgaaaggaatggctgacaaatttcatggaagataggcgccagcggcgtttacacggactgcctgaacagtttctatatggcacagccactaaacacctcacatacaacgacttcatcaataaggaactaattctctttagcaattcagataatgaacgtagcatccccagcctggttgatgggtttaaacctggccaaagaaaggtcctgtttacctgtttcaaaaggaacgacaaaagagaagtcaaagttgcccaattggcggggagtgttgctgagatgtccgcctaccaccatggggagcaagccttgatgatgacaatagtgaacctagcccagaactttgttggctctaataatatcaatttgctgcaaccaattggacagtttggcacccgactccatgggggaaaagacgccgccagccctcggtacatctttacaatgctgagcacactggcaagattgttgttccctgccgtcgacgacaacctgctcaagttcctttatgacgataatcaaagggtggagcccgaatggtacatccccataataccaatggtgctgattaacggtgctgaagggatagggaccggatgggcttgtaagcttccgaactacgatgcccgcgagattgtgaacaacgtgcgccgcatgttagatggtttggatccccaccctatgcttccaaattataagaattttaaggggaccatccaggaactcggacagaaccagtatgctgtgtcaggcgaaatcttcgttgtggatcggaatacagtggaaataaccgagcttcccgttagaacatggacccaggtttacaaagaacaggtgcttgagcctatgctgaacggaaccgacaagactcccgctcttatctccgactataaagagtatcacaccgatactaccgtgaagtttgttgtgaagatgactgaggaaaagctcgctcaagccgaggcggctggccttcataaggtgttcaaactgcagactaccctgacttgtaatagcatggtgctcttcgaccacatgggttgtctgaagaaatacgaaactgtgcaggacattttaaaagaattttttgatctgagactgtcatactacggtctgcgtaaggaatggctagtgggcatgctcggggccgaaagtactaagctgaataatcaggcaagatttattctggaaaaaattcagggaaagataaccatagaaaaccgtagcaagaaggacctgatccaaatgttggtgcagcgaggctacgaatcagacccggtcaaagcatggaaagaagctcaggagaaggctgccgaggaggatgagactcagaaccagcacgacgattcatcttcagactcgggaacaccatcgggtccggacttcaactatatcctgaatatgagtctgtggtccttaacgtag

SEQ ID NO: 26699 - DNA, 4866 bp, Artificial Sequence
  Description of Artificial Sequence: Synthetic coding sequence
atggccaagagcggcggctgcggcgccggcgccggcgtgggcggcggaaatggggcactaacctgggtgaataatgccgccaagaaagaggaaagcgagactgcaaataaaaatgactctagcaagaagttgagtgtggagagagtgtatcagaagaagacgcagcttgagcacatactgctgcgacccgatacctatataggctcagtggaaccacttacgcaatttatgtgggtgtatgacgaggacgtcggcatgaactgcagggaggtgacctttgttccaggactgtataaaatctttgatgaaatcttggtgaacgcagcagacaataagcaacgggacaagaatatgacctgcatcaaagtttcgatcgatcctgaatccaacatcattagcatttggaataacggtaagggtatacctgtggttgagcacaaagtcgagaaagtgtacgtacccgctctcatttttggtcagcttctaacctcttctaactatgacgatgatgagaaaaaagtcacggggggtcgcaatgggtatggagctaaactgtgtaacatctttagcactaaattcacggtggaaactgcctgcaaggagtacaagcactcctttaagcagacttggatgaacaatatgatgaaaacttcagaggccaagatcaaacattttgatggggaggattacacatgcataacttttcagccagatttatctaagtttaagatggaaaagctagataaagatattgtggctctaatgacccggcgcgcctatgatctggccggttcgtgccgcggggtgaaggtgatgtttaatgggaaaaagctgcccgtcaacgggtttagatcttatgtggatctgtacgtgaaggacaagctcgacgaaactggcgtggccctgaaggtcattcatgagctcgcaaatgagaggtgggacgtatgcctgaccctttccgagaagggatttcagcaaatcagctttgttaacagtatcgccaccacaaaaggcggtagacatgtggactacgtggtggaccaggttgtgggtaagctgatagaggtggtgaagaagaagaacaaagctggggtgagcgtgaagccatttcaggtgaaaaatcacatctgggtttttattaattgtctgatcgaaaaccccacattcgatagccagaccaaagaaaacatgactctacagcccaaatcctttggctccaaatgccagctctccgaaaaattctttaaggccgctagcaactgtgggattgttgaaagcatactgaattgggtgaaattcaaggcacagactcagctgaacaaaaaatgcagctccgtcaagtactccaaaatcaaaggcatcccaaagctggacgacgccaatgatgctgggggaaaacactctctcgaatgcaccttgatcctgactgagggcgacagtgcaaagtcattagcagtgagcggcctgggagtgattggtcgagatcgttacggtgtgttccctcttcgcggcaagattctcaatgtccgagaagcttcccataaacagatcatggagaatgccgagataaataacatcataaagatcgtcgggctacagtataaaaaaagttacgacgatgctgaaagtctgaagacgcttagatacggcaaaatcatgattatgacagaccaagaccaggacggctcccacatcaagggactgctgataaatttcattcaccacaactggccttccctgctgaaacacgggttcctcgaagaatttatcacccctatcgtcaaagcttcaaagaacaaacaggagctctcattctattccatccccgagtttgatgaatggaaaaaacacatcgaaaaccagaaggcctggaaaatcaagtactataaaggcctgggtactagcacagccaaggaggcgaaggagtactttgccgacatggaaagacatcgtatcctgttccggtatgcaggtcccgaggacgatgctgcaataacactggccttttccaagaagaagatcgatgaccgcaaggagtggctcaccaacttcatggaggatcgccgtcagagacggttacatgggcttccagagcaatttctctacggtaccgcgaccaagcaccttacctataatgacttcatcaataaggagctgatcctcttcagtaacagcgacaatgaacgctccattcctagcctggtggacggcttcaaacccggacagcgtaaagtcctcttcacatgctttaaacggaacgacaaacgcgaagttaaagtggcacaacttgcaggctctgtcgctgagatgtccgcataccaccatggcgaacaggccctgatgatgaccattgtcaacctagcacagaattttgtcggatcgaataacatcaatctgctgcagcctattgggcaattcggaaccagacttcacggaggcaaggatgccgcttctccaagatacatctttactatgctgagcaccctggctcgcctgctattcccagcagtggacgacaacctcctcaaattcctttacgacgataaccagcgcgtagaacctgaatggtatattcctatcattccaatggtcctgatcaatggggcagagggcataggaaccggatgggcctgtaagcttcccaactacgacgcgcgagagatcgtgaacaacgtgcgacgtatgttggacggactggaccctcaccctatgctgcctaactataaaaacttcaagggcacaatacaagaactcggtcagaaccagtacgcggtctcaggagaaatctttgtggttgatcgcaataccgtggagattaccgagttgcctgtgaggacctggacacaggtgtacaaggaacaggtgttggagccaatgttaaacggaacagataaaacacccgccttgattagcgattataaggagtatcacactgacaccaccgtgaaattcgtggtgaagatgacggaagaaaagcttgcacaagccgaggctgccggcctccacaaggtgttcaaactgcaaaccactctgacctgtaattcaatggttctgtttgaccacatgggctgcctgaaaaaatacgaaaccgttcaagacattctgaaggaattcttcgacttacgacttagttactatggactgaggaaagaatggttggttggaatgcttggagccgagtcaactaaactcaataaccaggcccgcttcattctcgagaagattcaggggaaaatcaccatcgaaaacagaagtaaaaaggaccttatacagatgctggtgcagagagggtacgaatccgacccggtgaaagcctggaaagaggctcaagagaaggccgctgaggaggacgagacgcaaaaccagcacgacgactcctcttctgactctggcaccccttcggggccggatttcaattacatcctcaacatgagcctgtggtccctcaccaaggaaaaagtggaggagctcatcaaacagcgggatgcaaaaggaagagaggtaaatgacttaaaaaggaaatctcctagcgacttgtggaaggaggatctcgcagcctttgtggaagagctggataaggtggaaagtcaagaaagggaggacgtcttggctggcatgtccggcaaggccatcaaaggcaaggttggtaaaccaaaggttaagaagctgcagctggaggagactatgccatcaccgtacggtcgtcgcatcatcccagaaattaccgcaatgaaggcggacgcaagtaagaagctgcttaaaaagaaaaaaggagatctcgacactgccgcagtcaaggtagagtttgacgaagagttttcaggtgcacccgtggagggcgccggagaggaggctctgaccccttctgtcccaattaacaaaggacccaagccaaagagggaaaagaaagaaccaggcacccgggtccgcaaaacccccacctcctctgggaaacccagtgcgaagaaggtaaaaaagaggaatccatggagcgacgatgaatcaaaaagcgagagcgatcttgaggagaccgagccagtagtaatacccagagactcacttctgcgtcgggccgccgcagaacgtcctaaatacacctttgacttcagcgaagaagaggatgacgacgcggatgatgatgatgatgacaacaacgacttggaggagttgaaggtgaaagcttcccccattacaaacgatggagaagatgagtttgtaccttccgatgggctggataaggatgagtatactttttctcccggtaaatcaaaagccacacccgagaaaagtctgcatgacaagaaatcccaggatttcggtaacctgttctctttcccaagctactcccagaagagcgaggatgatagcgccaagtttgactctaacgaggaggattcggccagcgtctttagccctagtttcgggctgaagcagaccgataaggtgccaagcaaaaccgtggccgcgaaaaagggaaagccaagcagcgacacagtgccaaagccaaaacgggcacccaaacagaaaaaggtcgtagaggcagtcaactcggactctgacagcgagtttgggatacccaagaagactactactcctaaagggaaaggacggggggctaaaaaaagaaaggccagcggctccgaaaacgagggagactacaatccagggcggaagacgtctaaaaccacctctaagaagcccaagaagacatctttcgatcaagattccgacgtcgacatcttccctagcgacttccccaccgagcccccctccctgcctcgcactgggagagcaaggaaagaggttaagtacttcgctgagagtgatgaagaagaggatgacgtcgattttgccatgtttaattag

SEQ ID NO: 26700 - DNA, 174 bp, Artificial Sequence
  Description of Artificial Sequence: Synthetic coding sequence
accctgttcgaccagaacaacgccgccaagaaggaggagagcgagacggcaaacaaaaacgattcctcaaagaagttgagtgtggaacgggtctatcagaaaaaaacacaactggagcatattctgctgagacccgacacctatatcggcagcgtggagccactcacgcagtag

SEQ ID NO: 26701 - DNA, 1437 bp, Artificial Sequence
  Description of Artificial Sequence: Synthetic coding sequence
atgagcctgtggagcctgaccaaggagaaggtggaggagctgatcaaacagcgtgatgccaaaggccgggaggtgaacgatctcaaacgcaaatcaccttcagacttgtggaaagaagacctagcggccttcgtcgaggagctggataaggtggaatctcaagaacgcgaagatgtgcttgctgggatgtcagggaaggcgattaagggcaaagtcgggaaacccaaagtcaaaaaactccagctggaagagacaatgccgagcccctatggacggcggataattcctgagataaccgccatgaaagcggacgcttcaaaaaaactgctcaaaaaaaaaaagggagatcttgacactgctgccgtcaaggttgaattcgacgaggagtttagtggggctcccgtagagggcgctggagaagaggccttgaccccaagcgtccccattaacaaaggccctaagccaaagcgggagaagaaagagcctggcacccgcgtcagaaagacccctacatcatctggcaaaccatcagctaagaaagtaaagaaaagaaacccctggagtgatgacgagagcaaaagcgagtcggacctggaggagacagaacctgtcgtgatccccagggactcattattgaggagggccgccgcagaacgccccaaatatacttttgatttttcagaggaggaggacgacgatgctgatgacgatgacgacgataacaatgacctggaagaactgaaagtgaaggcctcccccattacaaatgacggcgaggatgagtttgtcccatctgacggcttggacaaagatgagtacactttctcacccggtaagagtaaagccacaccagaaaaatcgcttcacgacaaaaagtctcaagactttggcaatctcttctcctttccaagctacagccagaagagcgaggacgacagcgccaaatttgacagtaatgaggaagactccgctagcgtctttagcccctcttttggcctgaaacagaccgataaagtgcccagcaagacagtggcggccaagaaaggcaagcccagctccgatacggtgcctaagcctaaacgcgctcctaaacagaaaaaggtcgtggaggctgtcaactcggattccgattctgagtttgggatccccaagaaaaccacaacccctaagggcaaaggaagaggcgccaagaagaggaaggccagtggttccgagaacgaaggggattataaccccggcaggaagaccagcaaaaccacgagcaagaaacctaagaagacctcattcgaccaggatagcgacgtcgatatttttccctccgactttcccacagagcctccatctctccctagaaccggccgggcaagaaaagaagtcaagtactttgccgaaagcgatgaagaggaggatgacgtggatttcgctatgttcaattag

SEQ ID NO: 26702 - DNA, 1437 bp, Artificial Sequence
  Description of Artificial Sequence: Synthetic coding sequence
atgagcctgtggagcctgaccaaggagaaggtggaggagctgatcaagcagcgggacgccaaaggccgcgaggtcaatgatcttaagcggaaatccccatcagacttgtggaaagaagacctcgccgcctttgtggaagagttagacaaggtagagtctcaagagagagaagatgtacttgcaggaatgtcaggaaaggccattaaaggcaaggtgggtaaacctaaggtcaagaaactgcagctggaagaaaccatgcccagcccttatggcagacggataatccccgaaatcaccgccatgaaagctgacgcgagtaagaaattactcaagaagaaaaaaggcgatctggataccgcggcagttaaggttgaatttgacgaggagttttcaggtgcacccgtggaaggggccggcgaggaagccttgacaccttctgttccgatcaacaaaggtcctaagccaaagagagaaaaaaaggagcccggaacaagagtgcgtaagacccctaccagcagtggcaaaccgtccgccaagaaagtgaaaaaacgcaacccttggagcgacgacgaaagtaaatcagagtctgaccttgaggagacggagcctgtggtgatcccacgggatagccttctccgtagggccgccgcggagaggcccaagtatacgttcgatttctccgaggaggaggacgatgatgccgacgatgatgacgatgataataatgatttagaagagcttaaagtcaaggcatctcctatcactaatgacggagaggacgaatttgtaccaagtgacgggctggacaaggacgaatatacatttagccctggcaagtcaaaggcaacccctgaaaagtctctccacgacaaaaaaagccaggatttcggcaaccttttttcttttccatcgtatagccaaaagtcagaggacgactctgctaaattcgatagcaacgaggaggacagcgcctcagtgttcagcccttcctttggcctcaagcagacggataaggtcccgtcgaagaccgtggccgccaagaaaggtaaacctagttccgacacagtgccaaaacccaaacgggccccaaagcaaaagaaggtcgtcgaggccgtgaattccgacagcgatagcgagttcggcatcccaaaaaaaaccacaactccaaagggaaaaggccgaggcgcgaagaagaggaaggcctcaggaagcgagaatgagggtgattataacccgggacggaagacttccaaaacgaccagtaaaaaacccaagaaaacctctttcgaccaggactccgatgtagacatttttccgagcgattttccaactgagccaccaagtttgccccgtactgggcgcgccagaaaagaagtcaagtatttcgccgaatcagacgaggaagaggacgatgtggattttgccatgtttaactag

SEQ ID NO: 26703 - DNA, 3006 bp, Artificial Sequence
  Description of Artificial Sequence: Synthetic coding sequence
atgatcttccccgtggcccggtacgccctgcggtggctgcggcggccagaagatcgcgcattctcgagagcagccatggagatggcactcaggggtgtgaggaaggtgctttgtgtggccgagaaaaacgatgcagctaagggtatcgccgatctactttccaacggaaggatgcggcgcagggaagggctcagtaaattcaacaaaatttacgagttcgattaccacctatatggtcaaaacgtgactatggtcatgacaagcgtctcagggcatctcctggcgcacgatttccagatgcaattcaggaagtggcaaagttgtaatcctctggtgttgttcgaagcagagatcgaaaaatactgcccggagaacttcgttgatatcaagaaaactctggaacgggaaacaagacaatgccaggccttggtgatttggaccgactgcgatagggaaggagaaaatattgggtttgagattatacatgtgtgtaaggcagttaagccaaacctccaggtactgagagccagattctcagagattacaccccacgctgtccgaacagcctgcgaaaacttgaccgagcctgaccagagagtaagtgacgctgtagatgtaaggcaggagctggatctgcgtatcggagcagccttcactcgcttccagaccctgaggctgcagaggatttttcccgaggttttggccgaacagctcatctcttatggcagttgccagttccctaccctggggtttgtggtcgaacggttcaaagcgatacaggcctttgtccctgaaatattccatcggatcaaagtgactcatgaccataaggacggcatcgtggaattcaactggaagaggcatcgcctgttcaaccacaccgcctgtctcgtgttgtaccagctctgtgtggaagaccctatggccacagtggttgaggtgagaagcaagcctaaatccaagtggagaccccaagcgctggacacagtcgagttggagaaactggcttctcgtaaactgcgtatcaatgctaaggagaccatgcggatcgcagagaagttgtatacccagggatatatatcctacccccgcacagagacaaatatctttccccgagatctgaacctgaccgtgttggtggagcagcagacaccagatccaaggtggggcgccttcgcccaatcaattttagagcgcggcggacctacacccagaaacggtaataaatcagatcaggcgcaccccccaattcatccgacgaagtataccaacaacctgcagggggacgaacaacgactgtacgagttcatcgtgagacacttcttggcttgctgtagtcaggatgcccagggccaggagactactgttgaaattgacattgctcaggagcgatttgtggcccatgggttgatgatcctggcaagaaactatctcgacgtgtacccttacgaccactggagtgacaagatcctgcccgtgtacgaacagggtagtcattttcagcccagtaccgtcgagatggtcgatggggagacatccccccctaagctgctgacggaagctgatctcattgccctgatggaaaaacacgggataggtacagacgccacacatgccgagcacattgagactataaaagcccgcatgtacgtaggcttaactcctgataaacgcttcctgcctggccacctcggcatgggtctggtggagggctatgatagcatgggatacgagatgagcaagcctgatttgagggccgagctcgaagccgatctcaagctcatttgcgatgggaaaaaggacaaatttgtagtgctgagacagcaagtgcagaaatacaaacaggtattcatcgaggcagtggcgaaggcaaaaaagctagacgaggcacttgcacagtactttggcaacggcacagagcttgctcagcaggaagacatctacccagccatgcctgagcccattcggaaatgccctcagtgcaacaaagatatggtcctgaagacaaagaagaacggcggcttctatctgagttgcatggggtttcccgagtgtaggtcagctgtctggctccccgattccgtcttggaagctagccgggattctagtgtgtgccctgtatgtcaaccccacccggtttacaggctgaagctgaagttcaaacgcggatcccttcctccaaccatgcccttggagttcgtatgttgtattgggggctgcgatgacactcttcgagagatcctggacctgcgattttccgggggcccacctcgggcatctcagccttctgggcggctgcaagccaaccagagccttaaccgcatggataacagccagcacccgcagcccgcagattcgagacagaccgggtcttctaaagccctcgcccagactctgccgcctccaactgccgctggcgaatctaactctgtcacgtgtaactgcggccaggaggcagtgctgctgacagtgaggaaggaagggcctaatcggggacgacagttttttaaatgcaacggtggaagttgtaacttttttctctgggcggactctcccaaccctggagcgggggggcctccagccctggcctacagacccttaggagcaagccttggttgccctccaggaccgggtatacatcttggcggatttggcaacccgggagacggctcaggtagcggaaccagctgcctgtgtagtcagccatccgtgaccagaactgtgcagaaggacgggcctaataagggcaggcagttccatacttgcgctaagccccgggagcagcagtgcggattcttccagtgggtagacgaaaatacagcacccggcacttcaggcgcccccagctggacgggcgacagaggtcggaccctggagagtgaagccagaagtaaaagacctcgagcctcttcctctgatatgggctccacagccaagaagcccagaaagtgttccctctgccaccagcccgggcacacccgacccttctgtcctcagaatagatag

SEQ ID NO: 26704 - DNA, 1170 bp, Artificial Sequence
  Description of Artificial Sequence: Synthetic coding sequence
tgaagccgggccgccatggagatggccctgcggggcgtgcggaaggtactgtgcgtggctgagaaaaatgacgcagccaagggcattgcggatttactgtccaacggacgtatgagaaggcgggagggattatcgaaattcaacaagatctacgagtttgattatcacctgtacgggcaaaacgtgaccatggttatgacttctgtaagcggtcatctgttggcacacgacttccagatgcagttcagaaaatggcagtcatgcaaccccctcgtgctcttcgaagccgagatcgagaagtattgtcctgagaactttgtggacataaagaaaacgctggagagggaaacccggcagtgccaggccttagtgatttggacagattgcgatagagagggtgagaatatcgggtttgagataattcatgtttgcaaggcggtcaagcccaatctgcaggtgcttagagctcgcttcagtgagatcacaccccatgcagtgcggactgcctgtgagaatcttacagaacctgaccaacgagtctctgatgcggtggatgtccgccaggagctcgaccttagaattggcgccgcctttacgcgatttcagaccttgagactgcagaggatatttccggaggtgttagccgagcagttaatcagctatggctcttgccagttcccgactctcggatttgtagtagagagattcaaggcaatccaagctttcgtgcctgagatcttccatcggattaaggttactcacgatcataaagacggaattgtggagttcaactggaagcgacacaggctattcaatcacactgcctgccttgtactctatcaactctgtgtggaagaccctatggctacagtggtcgaggtacggagcaagccaaagtctaaatggcgtccccaagctctggatacggtggaactggagaaactcgcttctcgcaagttgcgcattaatgcaaaggagactatgcgcattgctgaaaagctatatacgcaggggtacattagttaccctaggaccgagaccaatatcttccctcgggacctgaacctgacggtgctggtggagcagcaaacaccagaccccagatggggggcatttgcccagagtatcctggagcggggaggaccaactccacgaaatggtaacaagtag

SEQ ID NO: 26705 - DNA, 1596 bp, Artificial Sequence
  Description of Artificial Sequence: Synthetic coding sequence
atgatcctggcccggaactacctggacgtgtacccctacgaccactggtcagacaagatcctgccagtgtatgagcagggatctcacttccagccaagtacggtggaaatggtcgatggggaaacctctcccccgaagctgctaactgaggccgacttaattgctttaatggaaaagcacggcattggtactgacgcaacccacgctgaacatatcgagacaatcaaagcgaggatgtatgtcgggctaacacccgacaagaggtttttgccaggtcacctgggtatgggcctcgtagagggctacgatagtatgggatacgagatgagcaaaccagatttgcgcgccgagttagaagctgaccttaagttaatctgtgacggcaagaaagataagtttgttgtgttgagacagcaagttcagaaatacaagcaggtgtttatcgaggctgtcgcaaaggccaagaagctggacgaggctcttgctcagtatttcggaaacgggaccgaacttgcccaacaggaggatatctatccagcaatgcccgaaccaatccgcaaatgcccccagtgcaacaaggatatggtcctgaagacaaaaaagaatgggggcttttatctgagctgcatggggttccccgagtgccgctccgcagtgtggctgcctgattctgtcctggaggcctcacgggattcctcagtatgtcccgtttgtcagccccatcctgtgtatcggctgaagttgaagtttaaacgtggatctctcccccctacgatgcctctcgagttcgtgtgctgtatcggcggctgcgatgatactttgcgagaaattctggacttacgtttctctggtggaccgccacgggcctcccagccatcaggtagattgcaggctaatcagagtttgaatcgaatggacaattcacagcaccctcagccagccgactcgaggcaaaccggctcttccaaagccttggcgcagacgctccctccccctactgctgctggggagtctaactcggtgacgtgtaattgcggacaggaggctgtcctgttgactgttcggaaggagggcccgaacaggggcaggcagtttttcaagtgtaacggcgggagctgtaattttttcctgtgggccgatagtcctaaccctggggccgggggaccccccgctctggcctaccggcccctgggggcttccctggggtgtccgcctggacccggcattcatctaggaggattcggcaaccccggagatggcagcgggagcggaacctcatgtttgtgctctcagccctcagtgaccaggaccgtccagaaggatggtccgaataagggcaggcagttccatacctgcgcaaagcctcgcgaacagcagtgtgggttcttccagtgggtggacgaaaacacagctccaggaacttcaggtgcgccttcctggaccggagatcggggcaggacacttgagtcggaagccagatccaaaaggcctagagcctcctcctccgacatgggctcaaccgcaaaaaaacccagaaaatgcagcctttgccaccagccaggccacacaagacccttctgcccacagaacaggtag

SEQ ID NO: 26706 - DNA, 2721 bp, Artificial Sequence
  Description of Artificial Sequence: Synthetic coding sequence
atgaacctgatcatcatctgcatggcccggcagagctgcaaccccctcgtactgttcgaggccgagattgagaagtactgcccggagaattttgtagacattaagaagactttggagcgtgaaactcgtcaatgccaggcattagtgatctggacggattgcgatcgagaaggtgagaatatcggtttcgagattatacacgtttgtaaggccgtcaagcccaaccttcaggtccttcgcgccaggttctccgaaatcaccccacacgccgtgcgcaccgcctgtgagaatcttacggagccagatcagagagtgtccgatgctgtcgacgtgcgacaggagttagacctgcgcatcggagcggcttttacgaggtttcagactctgcgcttacaacgtatctttccggaggttctggcagagcagttaatctcttatgggagctgtcagttcccaaccctaggatttgtagtggaaaggtttaaagccatccaagcgtttgtgccggagatctttcatcggattaaagtcacgcacgatcataaagacgggatagtggagttcaactggaagcggcaccgcctgttcaaccacactgcatgcctcgtcctgtaccaactgtgtgtggaagaccctatggctactgtagtcgaagtaagatcaaagcccaaatcaaaatggagaccacaggctctggacacagtcgagcttgaaaaattggcttctaggaaactgaggatcaacgcaaaagagactatgagaattgccgaaaagctgtacactcagggctatatcagctaccctcggaccgagacaaatatctttccacgggatctgaatctgactgttctggttgaacaacagacgccggacccccggtggggtgcgtttgcccagtccatcctggagagaggtggtcccactccaaggaacggcaacaagtccgatcaggcccacccccccattcatcctactaagtataccaacaacctccagggcgacgagcagagactgtatgaatttatagtgcggcactttttagcatgttgtagccaggacgcccaagggcaggaaacgactgtcgagatcgacattgctcaagaaagatttgtggcccatggtctcatgatactggctaggaattacctggacgtgtacccatacgatcactggagtgacaagatcctgccagtttatgagcagggcagtcatttccagccatcaactgtagaaatggttgacggggaaaccagccctcctaaactgctgactgaagcagacctgattgcgctgatggagaagcatggaattggcacagacgccacccacgcagagcacatagagaccatcaaggcgcgaatgtatgttgggctgactccagataaacgtttcctgccagggcatcttgggatggggcttgttgagggttatgacagcatggggtacgagatgtccaagccagatctgcgcgccgagctggaggccgacttaaagctgatctgtgatggaaaaaaggacaagttcgttgttctgcggcaacaagtacaaaagtacaagcaggtattcattgaggcagtggccaaagcaaaaaagctggatgaggctctggcacagtatttcggaaacggaaccgagctcgcccagcaggaagatatctatcccgctatgcctgagcccattaggaagtgtccgcagtgtaataaagatatggtcttgaagaccaagaaaaatggaggcttttacctgtcatgcatgggcttccccgaatgcagaagcgctgtgtggctgcccgacagcgtgctggaagccagccgtgatagttcggtttgtccagtgtgccagcctcacccagtataccggctaaagctcaaattcaagcgcggctcgttaccccctaccatgcctttagaatttgtgtgctgcataggcggctgcgacgacacccttagggagattctggacttgagattctccggcggccccccaagggcgtctcagccttccggcagactgcaggccaaccagtcgctcaaccgtatggacaactcacagcacccgcagccagcggattcccgccagaccggatccagtaaggccctggcccagacactgccaccacctacggcggccggggaatcaaactcagtgacgtgcaattgcgggcaggaggccgtgctcctcacagtgcgtaaagaaggacctaacagaggccgccagttctttaagtgcaacggcggaagctgcaacttcttcctgtgggccgatagccccaatcccggagcaggagggccgcccgctttggcgtatcggcccctcggcgcctcactgggctgccctcccggcccaggaatccaccttggtggctttggaaatcccggtgatggctcgggaagtgggacctcatgtttgtgcagtcagccgagcgttacccgaaccgtccagaaggacggccctaataaaggaagacaatttcatacctgcgcgaagcccagggaacagcaatgtggtttctttcagtgggtagatgagaataccgctcccgggacgtccggagcacccagttggactggcgaccgcggtaggaccctagaaagtgaggctagatctaaaagaccccgagctagttctagcgacatgggatcaaccgccaagaaacccaggaagtgctccttatgccaccaacccggtcacactagaccgttttgcccacagaaccgctag

SEQ ID NO: 26707 - DNA, 2589 bp, Artificial Sequence
  Description of Artificial Sequence: Synthetic coding sequence
atgaagaccgtgctgatggtggccgagaagcccagcctggcccagtcaatcgcaaagatactgagccgcgggtctctgtccagtcacaagggcttgaacggcgcttgctccgttcatgaatatacggggacattcgcggggcaacctgtgcgattcaaaatgactagtgtgtgcggccatgtgatgacactggattttctcggtaaatacaataagtgggataaggttgaccctgcagaattatttagtcaggcccccaccgaaaagaaagaggccaacccgaagctgaatatggtgaagtttctgcaggtggagggtcgcggatgtgactatatcgtgctgtggctggactgcgataaggaaggcgagaatatctgctttgaggtattagatgccgttctgcctgttatgaacaaagcccacgggggagagaagactgtcttccgcgcccgtttctcttctatcactgataccgacatttgtaacgccatggcttgccttggtgaaccagatcacaatgaggcgctgtctgtcgatgcaaggcaggaactagatctgagaatcggatgcgcctttactagatttcaaacaaaatacttccagggtaagtacggggatctcgattcttctctgatctcctttggaccctgccagacacccaccctgggcttttgcgtcgagagacacgacaaaatacagtcattcaaacccgaaacctattgggtgctgcaggcgaaggtaaacacagataaggaccgtagcctcctcctagattgggaccgcgtgcgtgtgttcgatagagagattgcacaaatgtttctgaacatgactaagcttgagaaagaagcccaggtcgaggccacaagccgaaaggagaaagccaagcagagacctctggccctcaatacagtggaaatgttgcgtgtagcctcttcttctctggggatgggaccccagcatgcaatgcaaacagccgaaagactttacactcagggctatattagctaccccaggactgagacaactcattacccggaaaacttcgacttaaaggggtcactgcggcagcaggccaaccacccgtactgggccgatacggtgaaaaggctcttagcggaggggatcaatcgcccgcgtaaagggcacgatgcaggcgaccatccaccaattacaccaatgaagagcgccaccgaagcagaattgggtggagacgcttggcgcctctacgaatacattaccagacatttcattgccacagtctcccacgattgtaaatacctgcagtctacaataagttttaggattggacctgagctctttacatgttcgggcaaaaccgtcttatctccgggatttaccgaggtgatgccctggcaaagtgtgccacttgaagagagccttcctacctgccaacgaggcgatgcctttcccgttggcgaggtcaagatgctcgagaaacagactaatcccccagattacctgacagaagcagaacttatcaccctaatggagaaacatggaatagggactgatgcgtctatccctgttcatataaataatatctgccagcgcaactacgtgaccgtggagtcaggcaggaggctgaagccaacaaacctcggaatagttctcgtgcatgggtattataagattgacgcggagttagtcctgcctaccatccgctcggctgtggagaagcagctcaacctcatagcccaggggaaagccgactaccgtcaggtcctgggacacacattggatgtgtttaagcgcaagtttcattatttcgtagactctattgccggcatggacgagctgatggaagtgtctttcagccctttagccgctacgggcaagcctttgtctagatgtggcaaatgtcaccgctttatgaagtatatccaggcgaagcccagtagattgcactgctcccattgtgatgagacttataccttgccacagaacggaacgatcaaactatacaaggagttgaggtgccccctggatgatttcgaattagtcttgtggagcagcggcagccgtggcaaatcgtacccactgtgcccatattgttataaccaccccccttttagagatatgaaaaaggggatgggctgcaacgagtgcacacacccgtcgtgccaacacagtctaagcatgctgggaatcggtcagtgcgttgaatgcgagtctggcgtcttagttcttgacccaacgtccggtcccaagtggaaggttgcttgcaacaagtgcaacgttgtggcccactgctttgaaaacgctcatagggtaagagtgagtgctgatacctgtagcgtgtgcgaggccgcactgctggacgtggactttaataaggctaagagtcctttgcctggtgacgagactcagcacatgggctgcgttttttgtgatcccgtctttcaggagcttgtagaactcaagcacgccgcctcctgtcaccccatgcaccgtggcggaccaggccgccgtcaaggcaggggtcgcggcagggcccggcgtcccccaggaaaaccgaaccctaggcggcctaaagataagatgtccgcgctggcagcctactttgtgtag

SEQ ID NO: 26708 - DNA, 2589 bp, Artificial Sequence
  Description of Artificial Sequence: Synthetic coding sequence
atgaagaccgtgctgatggtggccgagaagcccagcctggcccagtctatcgcaaaaatcctatcccggggttcccttagttcgcataaaggactgaacggcgcctgcagtgtgcacgagtatacgggaacatttgcaggtcagccagtgcgctttaagatgacctccgtctgcgggcatgtcatgaccttggacttcctgggcaagtataacaagtgggataaagtcgatccggctgagttgttttcacaggccccgaccgagaagaaagaggcaaatcctaagctgaacatggttaagtttctccaagtcgaagggaggggctgtgattacattgtgttatggctggactgcgacaaggagggggagaacatctgctttgaagtactggatgccgtgctgcccgttatgaataaggcccacggaggagagaaaacagttttcagagccaggttctccagcatcactgacacagatatttgtaacgcaatggcttgtctcggggagcctgatcataacgaggctctctctgtggacgcacgacaggaactagatctgcgaattgggtgcgccttcactcggttccagaccaagtatttccaagggaagtatggagatttggactcctccttgattagcttcggaccatgtcaaacacctaccctgggcttttgcgtggaaaggcatgataaaatccagagtttcaaacctgaaacatactgggtgctccaggcaaaagtcaacaccgataaagatcggtctttactgctagattgggatcgtgtgagggtattcgatagggagatcgcacaaatgtttctcaatatgaccaagctcgaaaaggaagcacaggtggaagctacctcacggaaggagaaggctaaacagcgccctcttgctctgaatactgttgaaatgctacgcgtggcgtcttccagcttaggcatgggtccgcaacatgcaatgcagaccgcagagagactttacacacagggctacatttcttatccaaggactgaaacaacacactaccctgaaaacttcgaccttaaagggagcttgagacaacaagcgaatcacccatactgggctgacacagtcaagcgattgctggcagaagggattaatcgcccacgaaaaggacacgacgccggagatcaccctcctatcactcctatgaagtccgccacagaagccgagctgggaggagatgcctggagactttacgaatatattacccgacatttcattgccaccgtgtcccacgattgtaaatatctacagagcacaatctcctttcgtatcggtccagaactatttacttgctctggcaagaccgtcttatccccaggctttacagaagtgatgccgtggcagtccgttccgctggaagagagcctgcctacatgtcagagaggagatgcattcccggtgggcgaagttaagatgctagagaaacagaccaacccgccggattatctcacagaggccgaactgattaccttgatggaaaaacatggtatcggtacagatgcgtccattcctgttcacattaataacatttgtcaacgcaactacgtgacagtggagtctggtcggcgcttaaagcccactaatctcggaatagtactcgtgcacggctactacaaaatagacgccgaacttgtgctcccaacgatcaggtcggccgtggaaaagcagttgaatttgattgcacagggtaaggctgattacaggcaggtgcttgggcacacgctggacgtgtttaagcgaaagttccactactttgtcgattccatcgccggaatggacgagttgatggaggtttcttttagtcctttagccgctacaggcaaacctctgtcgagatgcggaaaatgtcaccgtttcatgaagtatatccaagcgaaaccttctcggctgcactgctcccattgtgacgagacatatactctgccccagaatggaaccatcaagctgtacaaggagttgcggtgccccctggacgattttgagctggtcctgtggagctctggatcccgcgggaaaagctacccgctgtgcccctactgctataaccatcctccttttcgtgacatgaaaaagggaatgggctgcaatgaatgtacccatccttcctgtcagcacagtcttagtatgctggggatcggacagtgtgtggaatgcgaatctggagtcctcgtgctcgaccctacctccggaccaaaatggaaggttgcatgcaataaatgtaatgtggtggcacactgctttgagaatgcccatcgggtgcgtgtatcagctgacacttgtagcgtttgcgaggcagccctgctagacgtcgacttcaataaagccaagtctccgctgcccggagacgagacccagcacatggggtgcgtgttttgtgaccctgtcttccaggaactggtcgaactgaagcatgccgcatcttgtcatcccatgcaccgcggaggtcctgggcgaagacaggggagggggcgaggacgcgctagaaggcctcctggcaaacctaacccccggcgccccaaggacaagatgtccgccctcgccgcttacttcgtctag

SEQ ID NO: 26709 - DNA, 849 bp, Artificial Sequence
  Description of Artificial Sequence: Synthetic coding sequence
atgttcctgaacatgaccaagctggagaaggaggcccaggtggaggctacctctcggaaggaaaaggccaaacagaggccccttgctttgaacacagtggaaatgttacgcgtggcaagttctagcctcgggatgggtcctcagcacgctatgcaaaccgcagagcgtctgtacacccagggctatatctcctacccgcggaccgagacaacccactaccccgagaacttcgatcttaaaggatctctgcgccagcaggccaaccacccgtactgggcggataccgttaagaggttactagccgagggcatcaatagaccacgtaaaggtcatgatgccggggaccatcctccgatcactccgatgaagtcagcaaccgaggcagagctcggaggagatgcctggcggctgtatgagtacattacaagacacttcattgcgacagtatcacacgactgcaagtacttacagagtaccatcagcttccgcattgggccagagttgttcacctgtagtgggaaaaccgtcttatcacctggctttaccgaggtgatgccctggcagagtgtgcccctggaagaatctcttccaacatgccagaggggggatgctttcccagtgggtgaagtgaagatgctcgagaagcagacaaatccaccagactatcttactgaggcagagcttatcacactgatggaaaagcacggaattggaggctgcgcctgcccgggaccaagggccggaagtgttagttccactcaggcaagttccctacttacaaagctgcccaggcagccatgtgttcccagcccggcgcctctccacgggctcgtgtccggtaattggtag

SEQ ID NO: 26710 - DNA, 741 bp, Artificial Sequence
  Description of Artificial Sequence: Synthetic coding sequence
atgaagaccgtgctgatggtggccgagaagcccagcctggcccagagtattgctaagatacttagcagaggaagtctgtcctcacacaagggacttaacggggcctgtagcgtgcatgagtatacaggcacctttgctggccagccggtacggtttaagatgacaagcgtatgtggccatgttatgaccctagatttcctgggaaagtacaacaagtgggataaagtagatcccgcagaattgtttagccaggctccaacagaaaaaaaagaagcaaatccaaaacttaatatggtcaagtttttacaggttgagggcagaggatgcgactatatagtactgtggctcgactgcgacaaggaaggggagaacatctgttttgaggttctggatgcggttctccctgtcatgaacaaagcgcatggtggggagaagactgtgtttagagcccgtttttccagcataaccgacaccgatatatgcaatgcaatggcatgcctgggtgagcctgaccacaacgaggccttatccgtagacgcccgccaggagcttgacctgaggattgggtgtgcatttactcgcttccaaacaaagtacttccaagggaagtatggcgatctggattccagtttaatcagtttcggcccttgtcagacgccaacactgggattttgcgtggagagacacgacaaaattcagagttttaaacctgaaacttactgggtgttacaggccaagtag

SEQ ID NO: 26711 - DNA, 366 bp, Artificial Sequence
  Description of Artificial Sequence: Synthetic coding sequence
atgaagaccgtgctgatggtggccgagaagcccagcctggcccagagtatcgctaagattctcagtcgcggatcactgtcctcccacaagggcctgaatggtgcctgtagtgtccatgagtacacaggaacttttgccggacaacctgtgcgcttcaaaatgacttcagtgtgcgggcacgtcatgaccttagacttcctcggaaaatacaacaagtgggataaggtggacccagctgagcttttcagccaggcgcccaccgagaaaaaagaagcaaacccaaaactgaacatggtcaagtttcttcaagttgagggacggggttgcgactatatagtgctatggctcgattgcgacaaggagtag

SEQ ID NO: 26712 - DNA, 66 bp, Artificial Sequence
  Description of Artificial Sequence: Synthetic coding sequence
atgaagaccgtgctgatggtggccgagaagcccagcctggcccagagcatcgctaagatcctctag

SEQ ID NO: 26713 - DNA, 129 bp, Artificial Sequence
  Description of Artificial Sequence: Synthetic coding sequence
atgaagaccgtgctgatggtggccgagaagcccagcctggcccagagtattgctaaaatcctgtcgaggggcagtctcagtagccataaaggccttaacggggcctgtagcgtacatgaatacacctag

SEQ ID NO: 26714 - DNA, 369 bp, Artificial Sequence
  Description of Artificial Sequence: Synthetic coding sequence
atgaagaccgtgctgatggtggccgagaagcccagcctggcccagtcaatcgcaaaaatcctctctcgaggttccctctctagccacaaagggctgaacggggcctgctctgtacacgagtatacaggaacatttgcgggacagcctgttcgttttaagatgacgtccgtgtgtggtcatgtgatgacacttgatttcctgggcaagtacaataagtgggataaggtggacccagctgagcttttttctcaggcccctacagagaaaaaggaggcaaaccccaagttaaacatggtcaaattcttacaggtcgaaggtcgggggtgtgactatatagttctgtggctggattgcgacaaggagggctag

SEQ ID NO: 26715 - DNA, 144 bp, Artificial Sequence
  Description of Artificial Sequence: Synthetic coding sequence
atgaagaccgtgctgatggtggccgagaagcccagcctggcccagtcaatcgctaagatcttatctagggggtcactctcgtctcacaagggactaaatggcgcctgcagcgtgcacgagtacacagggacgttcgcagggtag

SEQ ID NO: 26716 - DNA, 399 bp, Artificial Sequence
  Description of Artificial Sequence: Synthetic coding sequence
atgaagaccgtgctgatggtggccgagaagcccagcctggcccagtccattgccaaaatcctgtcccgtggaagcttgagttctcataagggacttaatggtgcgtgtagcgtccacgagtacacagggactttcgccggacagcccgttcggttcaaaatgacctccgtctgcggccacgtgatgactttggactttctcggaaagtacaacaaatgggacaaagtggaccctgccgaactcttttcccaggcccccaccgagaaaaaagaagcgaatccaaagttgccacaggcctctgtgtgtactcaggctgctccaggagtgcgcccacatccctgtcctcccgctgcagcgcgcgtggccgatagagtggtcccttgtggacccgttacctag

SEQ ID NO: 26717 - DNA, 183 bp, Artificial Sequence
  Description of Artificial Sequence: Synthetic coding sequence
atgaagaccgtgctgatggtggccgagaagcccagcctggcccagagtattgctaagatattgtccaggggttcgctgagcagtcataaaggtttgaacggcgcctgttcagtgcacgagtatactggcactttcgctgggcagcccgtacggttcaagatgacatccgtgtgtggccattag

SEQ ID NO: 26718 - DNA, 186 bp, Artificial Sequence
  Description of Artificial Sequence: Synthetic coding sequence
atgaagaccgtgctgatggtggccgagaagcccagcctggcccagagcatcgcaaagattctttctcggggatcactcagctctcataagggtctgaatggcgcgtgttctgtgcacgaatataccggcacctttgctggtcagcccgtcagatttaagatgacgtccgtttgcggacacgtgtag

SEQ ID NO: 26719 - DNA, 1578 bp, Artificial Sequence
  Description of Artificial Sequence: Synthetic coding sequence
tgactggacagcagcctgatcagcttcggcccctgccagacccccaccctaggtttctgcgtggagagacatgacaagatccagagcttcaaaccagaaacctattgggtgttgcaggccaaagtgaatacggataaagacaggagtctactgctggattgggacagggtgagggtgttcgacagagaaatcgcccaaatgttccttaacatgaccaaattagaaaaggaggctcaggtggaagccacgtcgcgaaaggagaaggccaagcagagaccgttggctctgaatactgtcgaaatgctgcgggtggcttcttcgagcctgggcatgggcccacagcatgccatgcagacagccgaacggttgtacactcagggatacatctcctatccaagaacagagactactcactatcctgagaatttcgatttaaaagggagcttacgacagcaggccaatcacccctactgggccgatacggtgaaacgcctgctggctgaaggtatcaatcgccccaggaagggccatgatgccggggatcatccccctattactccaatgaaaagtgccactgaagccgaattgggcggagacgcctggagattatacgagtacattacaaggcattttatcgccacggtctcccatgattgcaaatatctccagagcacaatatctttcaggattgggcctgaactttttacatgtagcggcaagacagtgttaagtccaggttttacagaggtgatgccgtggcagagcgtgcccctagaagagtcattgccaacctgccagaggggcgatgcgttccccgtgggcgaagtaaaaatgctcgagaagcaaacaaatccaccggactatctgactgaggccgagctgattacactaatggaaaaacatggtattggaaccgacgcaagcatccctgtccatataaataatatatgccaaaggaattacgttacagtcgagtccggccgcaggctgaagcctacaaatctgggtatagtgctagtgcatgggtactataagatcgatgccgaactggtgctgcccacgatcaggtccgccgtagaaaagcagctgaacctgattgcccagggcaaagccgattacagacaagtactcggacataccctagatgtgtttaagagaaagttccattatttcgtggatagcatcgctggtatggacgaactgatggaggtgtctttctcgccactggctgccactggtaagccattgtcccggtgtggcaaatgccatcggttcatgaaatacatacaagccaaaccttcacgtctccattgctcacattgtgacgaaacctacacgttgccccagaacggcaccattaaactttacaaagagctgcgctgtcctctggacgatttcgaactggtgctgtggagcagcggatctcgcgggaaaagttacccgctgtgcccttattgctataaccatcctccattccgggacatgaagaagggtgagtgttcccactcacttctgagtactggctcgtgttccctctttagcgtacctacaccggccctacaccaggctggactgtag

SEQ ID NO: 26720 - DNA, 951 bp, Artificial Sequence
  Description of Artificial Sequence: Synthetic coding sequence
atgagcgccgaggtggagaccagcgagggcgtggacgagagcgagaaaaagaattctggagccctcgagaaagagaatcagatgcggatggctgaccttagcgaactgctgaaggagggcacgaaagaggcccacgaccgggctgagaatacccagttcgtgaaggactttctgaaaggtaatatcaagaaggaacttttcaaactcgccactaccgcactctacttcacgtactccgcactcgaggaggaaatggagcggaataaggatcatcctgctttcgcccctctttacttcccgatggagctgcaccggaaagaggccctgaccaaggatatggagtattttttcggcgagaactgggaagaacaggtgcagtgtcccaaagccgctcaaaagtacgtagaaagaattcattacatcggccaaaacgaacctgagctcctggtggcacatgcatatacccgatacatgggagacctgagcgggggacaggtgctcaagaaagtcgctcagcgggctctgaaattacccagtaccggcgagggtacacagttctatctgttcgagaatgtcgataatgcccagcagttcaaacagctttaccgcgcccgaatgaatgcactggatctcaacatgaagacgaaagagaggatcgtggaggaagctaacaaggctttcgaatacaacatgcagatattcaacgagctggaccaggccggctccacgctggcacgcgagactctcgaggatggctttcccgttcatgacgggaagggggacatgcggaaatgtccattttacgccgctgagcaggataaaggagctcttgaggggagttcctgcccatttagaactgctatggctgtgctgcgcaaaccatctttacagtttatcctggcagcgggagtggccttagcagcgggcctgctcgcgtggtattacatgtag

SEQ ID NO: 26721 - DNA, 1716 bp, Artificial Sequence
  Description of Artificial Sequence: Synthetic coding sequence
atgaagtgccagccccggagcggcgcccggcggatcgaggagcggctccactacctgataacgacctacctaaagttcgggaataataataactacatgaacatggccgaggcaaataatgcattcttcgctgcctcggagactttccataccccctctctgggcgacgaggagttcgagattccaccaattaccccgccccctgaatctgatccagcattgggcatgccagatgtccttttgcccttccaggcactgtccgaccctctcccgtctcagggcagcgaatttactccgcaattcccaccacagtctctagatctcccatccatcaccatctctaggaacctggtggaacaagatggcgttctccactcaagtggtctgcatatggaccaatctcacacgcaagtctcccagtatagacaggatcctagtcttatcatgaggagcatcgtccacatgacagatgctgcacgctctggggtgatgcccccagcccaactgacaaccataaaccagtcccaactatccgcccagttggggcttaatctgggaggtgcaagcatgccacacacatctccgagcccccccgccagcaagagtgctacgccaagcccatcgtccagtatcaatgaagaagacgcggacgaggccaacagagcaatcggggaaaagagagccgcaccagattcaggtaagaaaccgaaaacacccaagaagaaaaaaaaaaaagatccgaatgagccccagaaaccagtctcagcctatgctctgttttttagggatactcaggcggcaatcaaaggccagaatccgaacgctacgttcggcgaagtgtccaagatagtcgcgagcatgtgggatagtctaggggaggaacagaagcaagtgtacaaaagaaagacagaggcagccaagaaggagtacctgaaggccctggcagcatatagagcgagcctcgtgtcaaaagcagcagccgagagtgctgaggcacagaccatccggtctgtgcagcagaccttggcctctacaaacctgacttcatccctgctcctaaataccccgttatcacagcatgggaccgtgagcgcctcacctcagactctgcagcagtccctaccgcgctccattgcacccaaaccgctgaccatgaggttgccaatgaatcagatagttactagcgtcactatcgccgccaacatgccatcgaacatcggggctccactcatctcatctatggggactactatggtggggtccgcaccgagcacacaggtgtctcctagcgtccagacacaacagcatcagatgcagctgcaacagcagcagcagcagcagcagcagcagatgcagcagatgcagcaacaacagctgcagcagcaccagatgcaccagcaaatacaacaacagatgcagcagcagcactttcagcatcatatgcagcagcacctgcaacagcagcagcagcatctgcagcagcagataaatcaacaacaacttcagcagcagctacagcagcggttgcagctgcagcaactgcaacatatgcagcaccagtcacaaccgtcccccagacaacactctcccgtggcttcccagatcaccagccccatccctgcaatcggctctcctcagcctgcaagccagcagcaccagtcacagattcaatcccaaacacagacacaagtgctgagtcaagtgagtattttttag

SEQ ID NO: 26722 - DNA, 5817 bp, Artificial Sequence
  Description of Artificial Sequence: Synthetic coding sequence
atgcagagcttccgggagcagagcagctaccacggcaaccagcagtcttacccccaggaggtgcacggctccagccgcctggaggaattcagtcctaggcaggctcagatgttccagaattttggaggtactggaggatctagtgggagtagcggctccggttccggtggtggaagacggggcgcagctgccgcagccgctgcgatggcttccgagacttcggggcaccagggctaccagggctttagaaaggaggctggcgatttctactacatggccggcaacaaagacccagtgaccactggtacgccacagcctccacagaggcgcccatccggtccggttcagtcttatggacccccccagggcagtagcttcggaaatcaatacggttccgaagggcacgtgggccagtttcaagcacagcattccggtctggggggggtctcccactaccagcaggactataccggcccattctctcctggatctgcccagtaccagcagcaggcctcatctcagcagcaacaacagcaggtccaacagctgcgacagcaactataccagagccaccagcccctgccacaggcaacagggcaaccagcatccagtagcagccatctgcagcccatgcaaagacctagtactctcccaagtagcgcagccggctaccagcttagagtgggacaattcgggcagcattaccagtcctccgcgtctagtagtagtagctccagtttccctagcccccagcgattctcccagagcgggcagtcctatgacgggagctataatgtgaatgctggatcccaatacgaaggtcacaatgtgggatcaaatgcccaggcatatggaacacaatcaaactattcctaccaaccccagtcgatgaagaacttcgaacaagcaaaaatcccacagggaacacagcagggacagcagcagcagcagccacagcagcagcaacatccctcccaacacgttatgcaatacaccaatgccgcaacgaaactgcccctgcagtcccaggtcgggcaatacaaccagcctgaagtgccagtccgctctccaatgcagttccaccaaaatttttctcctatttcaaacccctccccagccgcttccgtggtgcagtctcctagttgcagctctactccaagtcctcttatgcagacaggagagaatctccagtgcggccaaggctccgtgcccatgggatcccgaaaccgtattctgcagctgatgccccagctgtcacctacaccttctatgatgccctctcccaactctcacgccgcaggtttcaaggggttcggactggaaggtgtgcccgaaaagcgcttaactgatcccggcctttcctcactgagcgccctgtcaacccaagtggccaatcttccgaacactgttcagcacatgctgctgagcgatgcgctgacaccgcagaagaaaacaagtaaacgaccctccagtagcaaaaaggcagatagctgtactaactcagagggcagcagccaacctgaagaacaactcaagtctccaatggcggagtctctggacggaggctgctctagcagcagtgaggatcagggagaacgggtcagacagctgtcaggtcagtccacttcaagcgatactacttacaagggtggggccagcgaaaaagcaggctcatcccccgctcaaggagctcagaacgaacctccccgactcaacgcatcgcccgccgcccgcgaggaggccacgtcacctggagctaaagacatgccactgtctagcgacggaaaccctaaggttaatgagaagacagttggagtgattgtctcccgggaggcaatgaccggccgggtcgagaaacccggaggacaagataaaggcagccaggaagacgatcccgccgctacccagcgcccaccatccaatggaggcgctaaggagacctcccacgcatccctgcctcaacctgagcctccaggcggcggaggatccaaaggtaataaaaacggggacaacaactcaaaccacaatggagagggcaacgggcagtctgggcattctgccgctggacctgggtttactagtaggaccgagccgtcgaaatcaccgggttccttgcgctactcttacaaagacagcttcggatcggcagttcctcggaacgtgagcggtttccctcaataccctacgggacaggaaaaaggcgacttcactggccatggcgaaagaaaaggtcgcaatgagaagtttcctagcctgctccaagaagtgcttcagggataccaccaccacccagataggagatactctcgttccactcaggagcatcagggtatggccggatcactggaagggactaccagacccaacgtgctggtgtcacagaccaacgagttggctagccgaggtctcctgaacaagagcatcggctccctccttgaaaaccctcactggggaccctgggaacggaaaagttcgtctaccgcccctgagatgaagcagattaatctaacggattatccaatcccacgcaagttcgagatcgagccacagagcagcgcccacgaacctggaggctcactctccgagagaaggtctgtgatatgtgatatctccccgttaagacagatcgtaagagaccctggtgcccacagcttgggccacatgagcgctgatacccggattggcaggaatgatcggctgaacccaacgttgagtcagagtgtgatcctgcctggggggctggtgagcatggagaccaagctgaaaagccaatccggtcagattaaggaagaagacttcgagcagagcaaaagtcaggccagctttaacaataaaaagtccggcgatcactgccaccccccgagcatcaaacatgagagctatcgcggtaacgcaagccctggagccgcgacccatgattctctcagcgactacggcccacaggattcaaggcctacaccgatgcgtcgcgttcctggccgcgtagggggcagagaggggatgagagggagatccccaagtcaataccatgacttcgccgagaaactcaaaatgagccccgggagatcccggggccctgggggcgacccacaccatatgaaccctcacatgaccttttcggagcgagccaatcgatcaagtctgcacaccccattttcgccaaactctgaaacactggccagtgcctaccatgcaaataccagggcccacgcatatggagaccccaacgctgggctgaactcacagctgcactacaagcgccagatgtaccagcagcagccagaggaatataaagattggtctagcgggtctgcgcagggcgtgattgctgctgcacagcatagacaggaaggaccgcgcaaatcacctcggcaacagcaattccttgacagggtgcgcagtccactcaaaaatgacaaggacggcatgatgtatggtccaccagtcggcacatatcacgacccttccgcccaagaagcaggccgttgcctcatgtctagcgacggcctgcccaataagggaatggaactgaaacacggaagtcagaagctgcaggagagttgttgggatctgagtcgccagactagccctgccaagtcctccggtcctcccggcatgagtagtcaaaagagatacgggcctccccacgagactgatggccatggcctggcagaggccacacagtccagcaagcccgggtcagtaatgctgcggctacctgggcaggaagatcacagttctcagaaccccctcatcatgagacgacgcgtgaggtcctttatttcccctattccaagcaagcggcagtcacaggacgtcaaaaactcaagtactgaggacaaaggtcgcctgctgcactcatctaaagaaggagccgataaggccttcaacagttacgcccacctgagtcatagccaggatattaagagtatccccaaaagagatagctctaaggatcttcccagtcccgattccaggaactgtccagctgtcaccctgacctcaccagcaaagaccaagattttgccccctcgaaagggaagggggttaaaactagaggcaatcgtccagaagataaccagtcctaatattcgcaggagtgcatcttccaattcagccgaagccgggggtgatacagtaactttggatgatatactcagcctgaaatctggccccccggaaggaggtagcgttgctgtgcaagatgccgatatagaaaaaagaaagggggaagtcgcctctgatctggtgtccccggctaatcaagagcttcacgtggagaagcctttgccaagaagtagtgaggaatggcgcggttctgtggacgataaggtaaagaccgagacacacgccgagaccgtcaccgccgggaaggagcccccaggcgccatgacctctaccacgtcacagaagcccggaagtaaccaaggaaggcccgacggcagtctgggcggaacagctcctctcattttcccagacagcaaaaacgtcccaccagtgggcatactggccccagaggcaaaccctaaagccgaggaaaaggagaatgacacagtgacgattagtcccaaacaggaagggtttccacctaaaggctattttccctcaggcaagaaaaagggcagaccaatcggatctgtcaataaacagaaaaagcagcagcagccgcccccaccgcctccccagccaccccaaatccccgaaggcagtgctgacggggagccaaagcccaaaaagcagaggcagaggcgggagcgaaggaagcccggggcccagccccgcaagcggaagactaaacaagcagtgcctatcgtggaaccccaagaacccgagatcaagctgaagtacgcaactcagcctctagacaagaccgacgcgaagaataagagcttctatccctacatccacgttgtgaataaatgtgagctgggtgccgtgtgtaccattataaatgctgaggaagaagaacagaccaaactcgtaaggggaagaaagggccagcgttccctgacaccgccaccttccagcaccgagtccaaagccctgcctgcaagctcatttatgctgcagggacctgtagtcacagaatcctctgtgatgggacatttagtgtgctgtttatgtgggaaatgggcatcatatcgcaacatgggcgacctctttggcccattctacccacaggactacgccgccacgttgcctaaaaatccccccccgaaaagggccaccgagatgcagtccaaggtcaaagtgcggcacaaatccgcgtcaaacggctcaaaaaccgacacagaagaggaggaagagcagcagcagcagcagaaggagcagagaagccttgcagcccatcctcgttttaagcgcagacatcggtctgaggattgtggaggcggtcccaggtcactgtccaggggattaccctgtaagaaagctgccacagagggaagtagcgagaagacggtgctagattctaagccaagcgtgccaacaacctctgagggaggccccgagctcgagctgcagatcccagagctcccgctggactccaacgaattctgggtccacgaggggtgtatattgtgggctaatgggatttacctcgtttgcggaaggttgtatggcttacaagaggctctcgaaatcgcccgggagatgaaatgctcccactgccaggaagcaggggcaactctcgggtgctataataaggggtgcagctttcgttatcattatccttgcgccattgatgctgactgcctattgcacgaagaaaatttctccgtgcgatgccccaaacacaaggtgcgcctctggcggtag

SEQ ID NO: 26723 - DNA, 5883 bp, Artificial Sequence
  Description of Artificial Sequence: Synthetic coding sequence
atgcagagcttccgggagcagagcagctaccacggcaaccagcagtcttacccccaggaggtccacggttcgtctcgtctagaggagttctctccccggcaggcccagatgtttcagaatttcgggggcaccggcgggagctctgggagcagtggtagcggatccggcggggggcggagaggggccgcggctgccgccgcggctatggcctccgaaacctccggacaccagggttaccaaggatttcgaaaggaggccggcgacttttattatatggcagggaacaaggatcccgtgaccacaggcaccccacaaccaccacagagaagaccaagtggcccagtgcagtcctatgggcctccccagggatcttcattcggaaaccagtatgggagtgagggccatgttggacagttccaagcccagcattccggtttaggaggggtatcacactatcagcaggattacacaggccctttttctcccggttctgcgcagtatcagcagcaggcgtcttctcaacaacagcagcagcaggtccagcagttgaggcaacagctttatcaatctcaccagccattgccacaggctactgggcagccagcaagctcctcctctcatttacagccaatgcaacgccccagcaccttaccctcttctgctgccggataccagcttcgtgtgggacagttcgggcagcattaccaatcttccgcaagttcaagcagcagctctagctttccgagtccccagcgatttagccagagcggccagtcttatgatggatcctataacgtgaatgcgggttctcagtatgagggccacaacgtagggagtaacgcacaagcctacgggacccagtcaaactattcttaccaacctcagagcatgaagaacttcgagcaagccaagataccgcagggtactcagcagggtcagcagcagcagcaaccgcagcagcaacaacacccatctcagcacgttatgcaatacaccaacgccgccacaaagctacccctgcagagccaggtgggccagtacaaccagcccgaagttcctgttcggtcccccatgcagttccaccaaaacttttccccaatctccaacccctctcccgcggctagcgtggtccagagtccctcttgctccagcactcccagccctctcatgcagacaggagagaatctccagtgcgggcagggatcagtgcccatggggagtagaaatcgcatactgcagcttatgcctcaattgagtcctacaccttcgatgatgccttcacccaactcacacgcggctgggttcaaaggctttgggctggaaggggtgcctgaaaagagactcacggatccggggctgtctagtttatccgctttgagtacccaagtcgctaatcttcccaacacagtacagcacatgttgctgtcagatgcccttactccacagaagaagacatcaaaaaggccctcctcttccaagaaggctgatagctgtacaaatagcgagggctcatcccagcccgaggaacagttgaagagcccaatggccgagtccctggacggtggctgttccagcagctcagaggatcagggtgagagggtgcgccagctcagtggccaatccacttcttccgatacaacgtacaaggggggtgcttccgagaaagcaggttctagcccagcccagggtgcccagaacgagccgcctagactgaatgcctcgcccgcggccagagaggaagccaccagcccaggagccaaagacatgccgttgagcagtgatggaaatcccaaagttaatgagaagacagtgggagtgattgtatcacgtgaagccatgactggtcgtgtagagaagcctggaggacaggataagggcagtcaggaggacgaccccgccgcaacacaacgccccccctcgaacggaggagcaaaagagactagtcatgcctctttgccccagcctgagcctccaggtggtggaggctctaagggaaataaaaacggtgataataattctaatcataacggagaagggaatggccaatcagggcattcagccgctggccccggctttaccagtagaactgagccgtcaaaatcgcccggctcgctacggtactcttacaaggatagttttggcagcgcagttcctcggaatgtttccggcttccctcaatacccgactggccaggaaaaaggggactttaccggacacggcgagcgaaaaggacgcaacgagaagttcccctcactcctccaggaggtgctgcaggggtatcaccaccatcctgacagaagatactcaagatctacacaggaacaccaagggatggccggtagtttggaggggactaccaggcccaacgtgttggtgagtcagaccaatgagctcgcttcacgcggcctcctgaacaaatccataggctctcttctcgaaaatccccattgggggccttgggagcggaaatcgtccagcaccgcgcctgaaatgaagcagattaacctgacagactatcccatccctcgtaagtttgaaatcgaacctcagagcagcgctcacgagccaggcggatcactctctgaacgcaggtctgtgatctgcgatattagccccctgagacaaattgttcgagacccgggagcccactctctgggccacatgtccgcagacaccaggataggacgtaatgatcgcctgaatcctacactgtcacagagtgtcatcctcccagggggcctggtgtccatggaaacaaagcttaaatctcagtctgggcagattaaagaggaggattttgagcaaagtaagtcccaggcgtcatttaataataaaaagtctggagaccactgccatccgccatccatcaagcatgaaagctataggggcaacgccagtcccggagcggctacccatgactcactgtccgattatgggccccaggacagccgccctactccaatgcgacgggtacctggccgggtcgggggcagggaaggtatgaggggaagaagcccatcacagtaccatgacttcgcagagaagctgaagatgtctcccggccgctcccgcggtcctggtggcgatccacatcatatgaacccgcacatgacattctcagaaagggccaaccgaagcagtctacatacccccttctctcccaatagcgaaacactagcatctgcataccatgcaaacaccagagctcacgcttacggtgaccccaacgccgggcttaacagccagctccactataagcggcagatgtatcagcaacagcctgaagaatacaaagactggtcctcaggtagcgctcagggagttattgctgccgcccaacacaggcaggaaggacctcgaaaatcaccccgccagcagcagttcctcgaccgtgtgcggtcccccctcaagaacgataaagatggaatgatgtacgggccccccgttggaacataccatgatcccagcgcgcaggaggccgggcgatgtcttatgagctctgatgggctgccaaataaggggatggagctgaaacatggtagtcaaaaattgcaggagagctgctgggacctgtcacggcagactagccctgccaaatccagtggcccccctggaatgtcctcccagaagaggtatgggccgccacatgaaacagatggccatggcctggcagaagcgacccagtcaagcaaaccaggcagtgtgatgttacggctaccagggcaggaagatcatagttcacagaatcccctgataatgaggagaagggtcaggtccttcatatcacctatcccttcaaaacgacaatcgcaagatgtaaaaaactcctccacagaggataaaggtagactgctgcattcatccaaggagggagctgacaaggcctttaactcttacgctcatctgagccattcgcaggacatcaaatcaattcctaaacgagattcaagcaaagatttaccctctccagactcgcgcaattgcccagcagttacccttacatcaccagcaaagaccaaaattctcccacccagaaaaggcagagggcttaagctggaagcgattgtccaaaaaatcacctcacccaatattcggagatccgcatcttctaactctgctgaagcaggtggagataccgtgacattggatgacattctgtcattgaaaagcggtccaccagagggcgggtctgtggccgtgcaggatgccgacatcgagaaacgcaagggtgaggttgcgtccgacctcgtgtctccagctaatcaggaactgcacgtggagaagccactccccagatcatcagaagagtggaggggcagtgtcgacgacaaggtgaaaacagaaacccatgccgagacggtgaccgcagggaaggagccacctggcgccatgaccagtactacatctcagaagcctgggagcaatcaaggaaggcccgatggctccctgggagggactgcacccctgattttccccgatagtaagaacgttccgcctgtggggatcctggcacctgaagccaacccgaaggcggaagaaaaggagaatgacaccgtgactatatctcccaagcaagaaggcttccctcctaaaggatactttccctctgggaagaaaaaaggccgaccaatcggaagcgttaataaacagaagaagcagcagcagccaccaccacctccaccacagccaccccagatcccagaaggctccgctgacggcgagccaaaacccaagaaacagaggcagagaagagagcgccgtaaacccggcgcacaacctcggaaaagaaagacgaagcaagccgtgccgattgtcgaaccccaggagcctgagatcaagctgaaatacgccactcaaccattggataaaaccgacgccaaaaataagtcattttacccgtacatacacgtggtaaacaagtgtgagttaggggcggtttgtaccattataaacgccgaagaagaggaacagacaaagctggtacgcggacggaaggggcaaaggagtcttacacctccgccctcttcgactgagagcaaagcccttcccgctagctcatttatgctgcaaggtcctgtagtcactgagagtagcgtcatgggccaccttgtctgctgtctgtgtgggaaatgggcaagttacaggaacatgggcgatctgttcggccccttttatccacaggattacgcagctacgctcccaaaaaatccgccaccaaaaagagccactgaaatgcagtctaaagtcaaggttcggcacaagtctgcaagcaatggtagtaagaccgacacggaagaggaggaagagcagcaacagcagcaaaaggagcaacggtcactggcagcccacccgcgtttcaaacgccgacacaggagtgaggactgcggagggggccctcgaagcctgtcacggggccttccctgtaaaaaggccgcaactgaaggatcgagtgaaaagactgtgttggattccaaacccagtgtcccgacaacgagcgaaggcgggcccgaactagagctgcagattccagagctgcctttggacagcaatgagttctgggtgcacgaggggtgtattctctgggctaatggcatctacctggtatgcggacgcttatacggtctccaggaagctctggaaatcgccagggagatgaaatgctcacactgccaggaagccggtgccaccctgggttgctacaataaggggtgctcgttccggtaccactacccttgtgcaattgacgccgattgcttattgcacgaagagaattttagtgtgagatgccctaagcacaagcctccactgccctgcccacttccacccttgcaaaataagaccgccaaaggatcgcttagtactgagcagtctgagaggggctag

SEQ ID NO: 26724 - DNA, 540 bp, Artificial Sequence
  Description of Artificial Sequence: Synthetic coding sequence
atgagcaccggcagcctgagcgacgtggaggacctgcaggaggtggaaatgctggaatgtgacggactcaagatggattccaataaagaattcgtcacttcaaatgagagtaccgaggagtcgtcaaactgcgagaatggctccccacaaaaggggcgggggggactaggaaagcgaagaaaagcccctacaaaaaagagcccactcagtggtgtgagccaggagggcaagcaggtgcagcgaaatgctgctaatgcccgggaacgcgcgcgaatgcgtgtcctcagtaaagcgttctctagacttaaaaccacactgccatgggttcctccagatactaaactgtccaaactcgatactttgcgccttgcctcctcttatatagcgcacctaagacaaatcctggcaaacgacaagtatgagaatggttacatacatcctgtgaacttaacctggcctttcatggtcgcgggtaaaccagagagtgacctgaaggaggtagttaccgcctcccgcctctgcggcaccaccgctagctag

SEQ ID NO: 26725 - DNA, 540 bp, Artificial Sequence
  Description of Artificial Sequence: Synthetic coding sequence
atgagcaccggcagcctgagcgacgtggaggacctgcaggaggtggagatgctggagtgtgacggtctgaagatggacagcaataaagaattcgtcacctctaatgagtctactgaagagtcgtctaattgcgaaaatgggtccccacagaaggggaggggcggtcttgggaagcgcagaaaggcaccaacgaagaaaagcccactcagtggcgtgtcacaggagggcaagcaagttcagcggaatgcggccaatgccagagagagggcccgaatgagggtgcttagtaaggccttctcgcgtctgaagactacgctgccatgggtccctccggacaccaagttgtctaagctagatacactgcgtctagccagctcctacattgcccatctgcgccagatcctagcaaacgacaaatacgagaacggatatatccaccccgttaatctgacatggccttttatggtagccggcaagcccgagtcagacctcaaggaggtggtgacagcgagcagactttgcggcactactgctagctag

SEQ ID NO: 26726 - DNA, 1965 bp, Artificial Sequence
  Description of Artificial Sequence: Synthetic coding sequence
atgaaccagccccagcggatggcccccgtgggcaccgacaaggagttatctgacctgctggacttcagcatgatgtttccacttcctgtgacaaatggaaaggggagaccagccagcttagccggggcacagtttgggggctccggactcgaggacaggccttcaagcggctcatggggctcaggcgaccagagcagctcttcatttgatccatcgaggacttttagtgaagggacccattttacagagagccattcgagtctctcatcttccacattcctgggccccggactcggggggaaatcaggggaaaggggggcatacgcatcttttggtcgcgacgcaggtgtcggcgggttgactcaggcagggtttctatcaggcgaacttgctctcaacagcccaggaccgctaagccctagtgggatgaagggaacctcacagtactatcccagctattctggctcatcaagacggagggccgccgacggctccttggatacacagccgaagaaggtgaggaaggtaccccctggcctcccttcttctgtctatcctcctagcagcggggaggattatgggcgggacgcaactgcttatccttctgccaaaacaccctcgagtacctacccagctcccttctatgttgctgacggctctttacaccccagcgctgaactgtggtcacctccaggtcaggccggctttgggcctatgttgggtggaggttccagtccgttgcctctcccaccgggcagcggcccagtggggagcagcggctcctcctccacgttcgggggattacaccagcacgagagaatgggttatcaactgcacggcgccgaagtgaacggtggtttacctagcgcctcgtccttttcttccgcccctggagctacctatggaggagtgtcgtcccacacacctcccgtttccggagccgattctctcctgggctcgcgcggaacaaccgctgggtcctctggcgatgcactcggcaaggctcttgccagcatttactccccggatcacagcagcaacaatttttcgtccagcccctcaacgcctgtcggcagccctcaaggcctggcgggtacatcacagtggccgcgagcaggcgcccctggtgctctctctccgtcctatgacggagggctccacggtctgcaatcaaaaatcgaagaccaccttgatgaggcgattcacgttctgcggtctcacgccgttggaactgctggcgacatgcacaccttgctgcccggacatggagccctcgcaagtggctttacaggccctatgtccttgggcggacgacacgctggtctggtgggaggctcccatcccgaggatgggttagctggcagcacctctttaatgcacaaccacgcggcattgccctctcagccgggaacactgcctgacctgtcccgccctccagattcgtattccggcctcggcagggctggagcaactgcagccgcgagcgaaatcaaacgtgaggagaaagaggacgaggaaaacacgagtgcagctgatcacagcgaagaagagaagaaagaactcaaagcaccccgggccaggacctcaccggacgaggacgaggacgacctgttgcccccagagcagaaggccgaacgagaaaaagagaggcgagtcgcaaataacgccagggagcggttgagagtaagagacattaacgaggcttttaaggagctagggagaatgtgtcaactgcatcttaattccgagaagccacagaccaaactgttgatactgcaccaggcggttagcgtaatcttgaacctcgagcagcaggtgagagagcgaaacttgaatcctaaggccgcctgtttaaaaaggagagaagaggagaaagtgagtggcgtggtgggagatccgcaaatggttctctctgccccgcatcccggcctgagtgaggcacataaccctgctgggcacatgtag

SEQ ID NO: 26727 - DNA, 1956 bp, Artificial Sequence
  Description of Artificial Sequence: Synthetic coding sequence
atgaaccagccccagcggatggcccccgtgggcaccgacaaggagttgtccgatcttctggatttttcaatgatgtttccactccccgtcaccaatggtaagggccgacctgccagtttggctggagctcagttcggaggaagcgggctggaggatcgaccatcttctgggagttgggggtccggagaccagagtagctcgtctttcgacccgtcccggacgtttagcgaaggtacccatttcactgagtctcactcctccttgtcctcctccacttttttgggtcctgggctggggggcaaaagtggagagcgcggggcttacgcatccttcggacgcgacgcgggagtgggaggactgacccaagcaggctttctttccggggagctggcactaaacagccctgggcccctgagtccaagtggcatgaagggcacttctcagtactatccatcctattctgggtccagtcgcagaagagcagccgatggcagcctggacactcagcctaaaaaggtcaggaaagttccgcccgggctgcctagttctgtatatcccccatcaagcggtgaggactacggacgcgatgctaccgcctatcctagcgcaaaaaccccgtccagcacttaccctgcacctttctacgtggctgacggtagtttacatccttcagctgagctgtggtcacctcccggccaagccggcttcggtccaatgctaggcggggggagctccccgctgccactacccccaggaagcggccctgtcggaagctcgggttcctcttccacattcggcggactgcatcagcacgaaaggatgggctaccaattacacggcgcagaagttaacggaggcttgccttctgcgtcttcattcagcagtgctccaggcgccacatacggcggcgtgtccagtcataccccccctgtatccggggcggattctctgttgggatcgagaggaaccactgcaggatcaagcggagacgctctgggaaaagctctggccagcatatactcgcccgaccatagctccaacaacttctcaagctccccgtccacccccgtcgggagccctcaaggtcttgcgggcaccagtcagtggccaagggctggggctcctggagccctcagtcctagttacgacggtggtctacacgggctgcagagtaaaatagaggatcacctcgatgaagcaatccacgtgcttcgcagccatgccgttggcaccgctggcgacatgcacaccctgctacctggccacggagcactcgcttctgggtttacaggacccatgtccttaggggggaggcacgctggcctggttggtgggtcacaccctgaagatggtcttgccggcagcacctcgctaatgcacaaccatgctgccctcccctctcaaccaggaactctacccgaccttagtagacccccggatagctactcaggacttgggagggccggagcaaccgccgcagcctccgaaatcaagcgcgaagagaaggaggatgaagagaatacatctgctgctgaccactctgaggaggagaagaaggagctgaaagcccctcgggcccggactagcagcacggatgaggtgttatctttagaagagaaagacttacgtgaccgagaaaggcggatggcgaataacgcacgcgaaagagtgcgcgtgagggacatcaacgaggcatttagagaattggggcgcatgtgccagatgcatctgaagtcagacaaggcccagacaaagctgcttatccttcagcaggctgtgcaagtaatcctggggctggaacagcaagtccgcgagcggaatctcaaccccaaggcagcatgcctgaaacgccgcgaagaagaaaaggttagtggggtggtgggggatccacagatggtgctatccgccccccacccaggactgtcagaggcccacaatccagcaggtcacatgtag

SEQ ID NO: 26728 - DNA, 1977 bp, Artificial Sequence
  Description of Artificial Sequence: Synthetic coding sequence
atgaaccagccccagcggatggcccccgtgggcaccgacaaggagttgtctgatttactggactttagtatgatgtttccgctgccagtcacaaatggaaaaggacggcctgcttctctggctggagctcagttcggagggagcgggaagagcggagagagaggcgcatatgcgtccttcggacgtgatgcgggggtgggcggccttactcaagcgggattcctcagtggtgaactggctctaaatagccccgggcctctctcacctagcggtatgaagggtacctcccagtactatccctcctattcaggtagttcacgcaggcgagccgctgacgggagcctggatacccagccaaaaaaggtaaggaaagtgccccccggcctgccctcttccgtttacccccctagttctggcgaggactacggaagggacgccacggcttacccttctgccaaaacaccgtcctcaacataccctgctccattctatgtggccgatggaagtctgcaccctagcgcagagctgtggtcaccgccaggtcaggctggcttcggccctatgctaggaggaggcagctcacccctgcccctgcccccaggcagtgggccagtgggaagcagcggtagcagcagtaccttcggcggtctgcatcagcacgaaagaatggggtatcagttacatggagccgaagtgaacggaggattaccttcggcctcttccttctcatcagcccccggggccacatatggcggcgtaagctcacacacacctcccgttagcggcgccgattccttactgggatccaggggtactaccgccgggagctccggtgacgcgctaggcaaggctctggctagtatctatagtcccgatcacagcagcaacaatttttcgtcgtccccttcaactcccgttggttcacctcaaggattggccggcactagccagtggcccagagcgggagcccctggggccctctccccgtcttacgacgggggattacacggtctccagtccaaaatagaggaccatctggacgaggccattcacgtgctgaggtcccacgcggtcggcacagcaggcgacatgcatacactcctgcccggtcatggcgctttagcttccggatttacagggccaatgagcctgggaggacggcacgcgggactcgtaggcggttctcatcctgaggacggtctcgccggctccacctcgctaatgcacaatcacgccgctctgcctagccaacccggcactcttcccgatttgtcaaggccccccgatagctatagtggcttgggacgcgcaggagccacggcagccgcctctgagattaagcgggaagagaaggaggatgaggagaacacatccgctgctgatcatagcgaggaagagaaaaaggaacttaaggcaccgcgtgcaaggacacgctgccagccaacgcccaggcactcccccccatcaccccatcaagacgcccatgtgcataggccccatgcccatcgcacacacaccggacggccttcagcaggcccaaccctgtttccacaaccccactgcctcccgttggcgcctagccgccggccaccacattctccagacgaggacgaagacgatcttctccccccagagcagaaggccgaacgggaaaaggagagacgggttgctaacaacgcaagggagagactgagagtgcgggacatcaacgaggctttcaaagagctgggtagaatgtgtcaactccacctgaactcggaaaagccccaaactaaattgctgattttgcaccaggccgtgtccgtgattctcaatctagagcagcaggttcgcgaacgcaatttgaatccaaaggcggcatgcctcaagaggagagaggaggaaaaggtctcaggagtggtcggcgatccccagatggtgctgagtgccccgcacccgggccttagtgaagcacataacccggctgggcatatgtag

SEQ ID NO: 26729 - DNA, 1956 bp, Artificial Sequence
  Description of Artificial Sequence: Synthetic coding sequence
atgaaccagccccagcggatggcccccgtgggcaccgacaaggagcttagcgatctgctcgatttcagcatgatgtttcctctccctgtcacgaacggtaagggacggcctgcctctctcgccggcgctcaatttggcggcagtggcctggaagacaggccttcctccggatcttgggggagtggagatcagtcctcttcttcattcgacccttcgcgcaccttcagtgaaggcacacatttcacagagagccattcgtcactgagcagctctacttttctcggccctggattgggggggaaaagcggagagaggggagcttatgcctcttttggacgggacgccggagtcggcgggctgactcaagccggttttctgagtggggaactcgcactgaactcgccaggtcccttatccccatccgggatgaagggcacatcacagtactacccatcctattctgggtcaagtaggaggcgagccgccgatggttccctggacacgcaacctaagaaagtgagaaaagtgccaccaggactgcctagcagtgtctatccgccatcttcaggggaggactatggtcgcgacgctaccgcttacccctctgctaagacgcctagcagtacctaccctgcgccattttatgtggctgacggatccctacacccttcggccgagttgtggtccccacccgggcaggcaggattcgggcctatgcttggcgggggcagtagccccttacctctgccccctggcagcgggccagtcggtagcagcgggtcatcctctacattcggcgggctgcatcagcatgaacgaatgggctaccaactgcatggtgcggaagtgaacggcggccttccgtccgcgtcttctttctcgtcagccccgggggccacctatggaggagtgtcttcacatactccaccggtgagtggcgccgacagtctgctggggtctagaggcactacagcgggaagctctggagacgccttggggaaggccctcgcatccatctatagccctgaccactcatctaataatttttcgtccagtcccagtacacccgtcggttccccccagggtctggcgggaacatctcaatggccgagggcaggcgccccaggagctctgtcaccttcctacgacggtgggctccacggcctccaaagcaagattgaagaccatttagatgaagcaatccacgtgctgcggtcccacgccgtgggaaccgctggcgacatgcacactctcttgcctggacacggcgccctggcctctggcttcactggccccatgtctttgggcggcagacacgctggcctggttggcggatctcaccccgaggatgggctggccggaagcacatctctgatgcataatcacgcagctcttccctcccaacccggcacattaccagatctgtcccgcccaccagattcatacagtggacttggaagggccggcgccaccgccgctgcctccgagatcaaaagagaggaaaaggaggatgaggagaacacatcagctgccgaccactccgaggaagaaaagaaagaactgaaggcacctagagcacgtacatcctccacagacgaggtgctgtcgctagaggagaaggacctccgagaccgcgaacgccgaatggccaataacgcccgggaaagagtgagggtcagggacattaacgaagcattcagagagttaggccgaatgtgccagatgcatctgaagtccgacaaggcgcagacaaagttgctgatcctccagcaggcagtccaggtgatcctgggtttggagcaacaggttagagaacgtaatctcaaccccaaagctgcctgtcttaaaaggcgcgaggaagaaaaagtgagcggcgtggtgggagacccccagatggtccttagtgctcctcaccccgggctgtctgaagcacacaatccagcaggccacatgtag

SEQ ID NO: 26730 - DNA, 474 bp, Artificial Sequence
  Description of Artificial Sequence: Synthetic coding sequence
atgggctaccagctgcacggcgccgaggtgaacggcggcctgccctctgctagttctttctcatctgcaccaggcgcaacatacggtggtgtctcctcacacactcctccagttagtggcgcagacagcttactgggctcccgcggaaccacggccgggtcttctggagacgccctgggcaaagctctggcaagcatctactcaccagatcactcatccaataatttctcttctagtccctccacgcctgttggaagcccccaggggctggcaggtacaagccagtggccccgcgccggggctcccggtgccttgtcaccaagttatgacggcggcctccacggccttgtcggcgggagccatcccgaggacgggcttgctggttccaccagtctcatgcataatcatgctgctttgccttcgcagcctggcaccctccctgacttatcacggccacccgatagttactcttag

SEQ ID NO: 26731 - DNA, 2016 bp, Artificial Sequence
  Description of Artificial Sequence: Synthetic coding sequence
atgcaccaccagcagcggatggccgccctgggcaccgacaaggagctgagcgatttgctcgacttttctgcaatgttttccccgcccgtctcatcggggaaaaacggacctactagcctggcctctgggcatttcactgggtccaacgtcgaggaccgctcgtcatctggtagctggggcaatggcggccaccctagcccatcacgcaactacggcgacgggaccccctatgaccatatgacctctcgtgatctcggcagtcacgataatcttagtccaccctttgtcaatagtagaatacagtcaaaaaccgaacgaggctcatattcaagttacggacgtgaatctaatctgcaggggtgccaccagcaatctctgctcggcggtgacatggatatgggcaacccaggcacccttagcccaactaagcccggttctcagtactatcaatacagctctaacaaccccaggcggcggccccttcatagcagcgctatggaagtgcagaccaaaaaggtccgaaaggtccctccgggactgcccagttccgtgtacgcacccagcgcttctacagctgattataaccgcgactctcccggctaccctagcagtaaacctgccacctccactttcccttccagcttcttcatgcaggatggccatcattctagcgatccatggtcatcttcatcggggatgaatcagcctggctacgctggcatgctggggaactcttcgcatatcccgcaatctagttcttactgtagcctgcacccccacgagcgcctttcgtatccgtcccatagctccgccgacattaactcgagcctccctccaatgagtacatttcataggtccggcactaatcattatagcaccagtagctgcactccccccgccaatggaaccgatagcatcatggccaataggggttccggggctgccggcagctctcagaccggtgatgctctgggcaaggccctggccagcatctattctcccgaccacactaataattccttctcttccaatccgagtactcccgtaggaagtcccccgagcttatcagctgggactgccgtctggtcgcggaatggcggacaggccagctcctcacctaactacgagggccccctgcatagcctccaaagccgcattgaagatcggcttgagaggctcgacgacgcaatccatgtactaaggaatcatgctgtggggcctagcactgcgatgccaggcgggcatggggatatgcatggtatcattgggccatcgcacaatggtgccatgggggggctgggatccgggtacgggactggcctgctgtctgccaaccggcattcactaatggttgggacacacagagaggatggggtggcgctgcggggctctcatagcctcctaccgaaccaggtgccggtgcctcagctgcccgtgcagagtgctacgagccctgatctaaacccacctcaggatccttatcggggcatgccgcctggactgcagggacagtcggtctcttcagggagctcagagattaaaagcgatgacgaaggtgatgagaacttgcaggataccaaaagctctgaggacaaaaaattggatgacgataagaaggacattaagtctatcactagaagccgaagctcgaacaatgacgacgaagatctcactcctgagcagaaagcggagcgcgaaaaggagaggcggatggccaataacgctcgcgaaaggttgcgcgtgcgagatattaatgaggcttttaaagagcttggacgaatggtccaactacatctgaaaagtgacaaaccacaaacgaagctattgattctgcatcaagccgtggcagtgatcctctcgctcgaacagcaggtgagagagcgcaacttgaaccctaaggctgcctgtctaaagagaagagaggaggaaaaggtttcgagtgagccacctcccctgagtttggccggtcctcaccccggaatgggagatgcgtcgaatcatatgggacagatgtag

SEQ ID NO: 26732 - DNA, 2004 bp, Artificial Sequence
  Description of Artificial Sequence: Synthetic coding sequence
atgcaccaccagcagcggatggccgccctgggcaccgacaaggagctgagtgatctgctggatttctctgctatgtttagtccaccagtcagctccgggaagaatggccccacaagtctggcatcggggcatttcactggcagcaatgttgaagatcgaagttcatcaggttcttggggcaacggcgggcacccatctccctccagaaattatggagacggcactccgtacgaccatatgacaagccgcgacctgggatctcacgataacttgtctcctccttttgtgaattcgcgaattcagtccaagactgaacgagggagctatagttcgtatgggagagaatcgaatctccagggctgccaccaacagtccctgctgggcggtgacatggatatggggaatcccggcacccttagccctactaaacccggctcccaatactaccaatacagctcgaataacccccgccgacgccctctgcattcctctgccatggaggtgcagaccaaaaaggtgaggaaggtgcctcccggcctcccatcttccgtttatgctccatctgcaagcaccgcagactacaatcgggattctcctggatacccttcttcaaaaccagcaacaagcaccttcccttcgagtttttttatgcaggatgggcaccactccagcgacccctggagctcatccagcggcatgaaccagcctggttacgccggtatgctgggaaactcctcccacatcccccaatcctcatcatactgcagcctgcacccccatgaacgtctgagttacccttctcacagttcagctgacatcaactcttcactgccccctatgtccacatttcacagatctggtacaaatcactacagcacttctagttgcacccctcctgctaacgggaccgactccatcatggctaatcgcgggagcggagctgcggggagctctcagactggagatgccctggggaaagccttagccagcatttacagccccgaccacacaaataatagcttttcatctaatcccagcaccccggttggaagcccacccagtttgagcgccggcaccgctgtctggtcccgtaatggcgggcaggcctctagcagtcccaattatgaggggcctttgcatagtcttcagagtcggatagaggatagactggagcgattggacgacgccatccacgtgctacgtaaccatgctgtgggcccctccacagccatgccaggtgggcatggcgacatgcatgggattataggccccagtcataacggcgctatggggggacttgggagtggctatggcactggtttgctgtctgcaaacaggcactcactcatggtcgggactcaccgggaggatggagtcgcacttcgtggaagccactctctgctgcctaatcaagttcctgtcccacagcttcccgtgcaaagcgcaactagtccagatctcaacccacctcaggacccctatcgcggaatgccaccgggactacagggccagagtgtctcttcaggaagctcagagattaagagtgacgatgaaggagacgaaaatctgcaagatacaaagtcttccgaggacaagaagttagacgatgacaagaaggacatcaagagtattacttctaataacgacgatgaggatctcacacccgagcaaaaggctgaacgcgagaaagagcggagaatggccaacaacgcccgcgaacgtctcagagtgcgagatattaacgaagcctttaaggagctggggcggatggtgcagcttcaccttaagagtgataagccgcaaaccaaactgctgatcctccaccaagctgtcgcagtgattctgagtttagagcagcaggtgcgagaaagaaatttgaacccaaaagctgcctgcctgaagcggagagaggaagaaaaagtgtccagcgaaccacccccactgagcttggccgggccgcatcccggaatgggggacgcttccaatcacatgggacaaatgtag

SEQ ID NO: 26733 - DNA, 2322 bp, Artificial Sequence
  Description of Artificial Sequence: Synthetic coding sequence
atgttcagcaagcggctggagaagatcgcccaggtgcccctgctgttcccctttatttttattatcttgacaaattattcaaagatggaaggcgctgtggagtcccaaccctcattcttcaagacatcgcaagatatcgtgacctgtacttgggtagagaactgctattcctccttcagtcgcaggccactagagcagatgttctgtaaacaccaatctaagaacattattagctggaccggaatggttgcccacacttgtaatccgtccacactgggcggacaggggttgtgtgacttcgctaagatgcatcaccagcagagaatggccgccctcgggactgacaaggagctttctgacctacttgatttctcagcaatgtttagcccacccgtgtcaagtggtaagaacggtccaactagcctggcgtctggccattttactggctccaatgtggaggaccggagctcctccggaagctgggggaatggcgggcatccatctccgtccagaaactatggagacggaaccccttacgaccatatgacgagccgtgatctaggctcgcacgacaatctttctcctcctttcgttaactctcgcatacagtccaaaaccgaacgtggctcttactcttcctatggccgagagagtaaccttcagggctgtcaccaacagtcactcttggggggcgatatggacatggggaatcctggcactcttagtcctactaaacccggttcgcagtattaccagtacagtagcaataaccctcggaggcggccattgcatagcagcgcaatggaagtgcagaccaagaaagtgaggaaggtgccccctgggttgccttccagtgtgtacgccccctccgctagcaccgctgattataatagggatagcccgggctatccatcatccaaaccagccactagcacttttcctagctctttctttatgcaggatggtcaccattccagcgacccatggtcctccagctctggcatgaaccaaccggggtacgccgggatgttaggcaactcatcacatattccacagagtagtagttattgctccctgcatcctcatgagaggctatcctatccgtcacattcttccgctgatatcaacagctcgcttcccccaatgagtacttttcatcgctccggcacaaaccactacagcacatcttcttgtactccccctgccaacggcactgactcgattatggcaaaccggggcagtggggcagccggatcatctcagaccggggatgctctcgggaaagcactggcctccatctattctccggaccataccaacaactctttctcttcaaatccatctacgccggtcggcagcccaccaagcctgagcgctgggaccgcagtctggtcacgcaacggaggccaagcatcttccagccctaactatgaaggcccactccacagcctgcagtccaggatcgaggaccggcttgaaagactggacgatgctattcatgtgctgcgtaaccatgccgtgggaccaagtacagctatgccgggaggacatggcgatatgcacggcataattggccctagtcacaatggagctatgggaggcctagggtccggctatggcaccggcctgttatctgccaatagacacagtttaatggtgggaacccatcgggaggacggcgtggcactcagaggatcacatagtctgctgcccaatcaggtgcctgtgccccagctgcccgtgcagtctgcaacttcccccgacctgaacccccctcaggatccataccgcggaatgccgcccgggcttcaaggccagtccgtgtcgagtggcagttcagagattaaaagcgatgatgagggggacgagaacctccaagatactaagtcctccgaggacaagaaattggacgacgataaaaaagacataaagtcaattacccggtccagatcctccaacaatgatgacgaggatctgacccctgagcagaaggctgagcgggagaaggaacgaaggatggccaacaacgcccgagagagattacgggtgcgtgacatcaacgaagcgttcaaggagctcggcagaatggtgcagcttcatctgaagtcagataagccacagaccaagctgctgatactgcatcaggcggtagcggtcattctttccctggagcagcaggtgagagaacgcaacctcaatccaaaagcggcgtgccttaagaggcgcgaggaagagaaggtgagcagcgaacccccgcccctatccctcgctggcccccatcctggaatgggtgacgcttccaaccatatgggccagatgtag

SEQ ID NO: 26734 - DNA, 1536 bp, Artificial Sequence
  Description of Artificial Sequence: Synthetic coding sequence
atgtactgcgcctacaccatccccggcatgggcggcaacagcctgatgtactactataacggcaaagcggtatacgcaccaagtgcgtctacagctgattataatcgtgatagccctggctaccctagtagcaagcccgccacctcaacttttcccagtagcttcttcatgcaagacgggcatcactcaagcgacccatggagcagcagttccgggatgaatcaaccgggatacgctggaatgctgggtaacagctcacacatccctcagtctagctcctactgtagcctacatccacacgagagactgagctacccaagtcactcctcagccgatattaatagtagtcttccccccatgagtactttccatcgctccggcacaaatcattactccacctcctcttgcaccccacctgctaacgggacagactctatcatggccaaccggggctcaggagctgccggatcaagccagaccggggacgcgctggggaaggcactggcaagtatttactctcccgaccacaccaacaattctttctcctccaacccttcaacccctgtggggagcccgccctctctgagcgccggaactgccgtgtggtctcgcaatggaggccaggcttcgagctcaccaaattatgagggccccctccatagtcttcagagtagaatcgaagacaggcttgagaggctggacgatgccatccacgtgttaagaaaccacgctgtggggccgagtactgctatgcctggtggccatggtgatatgcatggaataattggaccatctcataacggggcaatgggcggactgggctctgggtatggtactgggcttttgtcagctaatagacacagtctgatggtgggtactcatagggaggatggcgtggctctgagggggtcccacagcctgttgcctaaccaagtcccggtgcctcagctgcccgtgcagtccgccactagcccagatctcaatcctccacaggatccgtatagaggtatgcccccaggcttgcaaggccagagcgtctcctccgggagcagtgaaatcaaaagtgacgatgagggtgacgagaacctccaggataccaagtcaagtgaagataagaagctggatgatgacaaaaaggatatcaaaagtatcacccggagcaggagctcaaacaatgatgacgaagacctcacacccgaacagaaggctgaacgcgaaaaggaaaggaggatggcaaacaatgcccgcgagaggctgagggtgagggatatcaatgaggcctttaaagagctgggcaggatggtgcagctccacctcaaaagcgacaaacctcagacgaaactcctaattcttcatcaagcggtagcggttatcctatcgctcgagcagcaagtccgggagaggaatctcaaccccaaagccgcctgccttaaaaggagagaggaggagaaagtaagctctgagcctcccccgctgagtctggcagggccacaccccgggatgggcgacgcttccaatcacatgggacagatgtag

SEQ ID NO: 26735 - DNA, 1944 bp, Artificial Sequence
  Description of Artificial Sequence: Synthetic coding sequence
atgttcagcccccccgtgagcagcggcaagaacggccccaccagcctagcaagtggacactttacaggctcaaacgtggaggacaggtcctccagtggctcatggggtaacggcgggcatccaagtccaagtcgaaactatggcgacggtacaccgtatgaccacatgactagccgcgatcttggcagtcatgacaatctttcaccaccatttgttaattctaggatacagtccaaaacagagcgcggcagttacagttcgtacgggagggagagcaacctccagggatgtcaccagcagagcttacttgggggggacatggacatgggcaacccaggcacgctctctcccacgaaacctgggtcacagtactatcaatacagcagcaacaaccctcgccggcgccctttgcactctagtgcaatggaggtgcagaccaaaaaagtgcgaaaggtgcctcctgggctgccatcgtctgtgtatgccccttctgctagtacagcagattataacagggactcccccggctatccatcgtcaaaacctgcaacaagtactttcccgagcagcttctttatgcaggatgggcaccacagctccgatccatggtccagctcctcgggtatgaatcagcccggctacgccggaatgctgggcaattcttctcacatccctcagtcctcaagctattgtagcctccatcctcatgaacgcttatcctatccctcgcattctagtgccgatattaattccagcttacctcccatgtcgacgttccatcgatcaggaaccaaccattacagcacgagctcctgcaccccacccgcaaatggcaccgactcaatcatggcaaatcgcggcagcggcgctgccggaagcagccagacgggggacgcacttggcaaggctctagcaagcatctatagcccagaccacactaataactcctttagttctaacccatcgactccggtcggctctccgccctctctgagcgcaggcacagcggtgtggtcaagaaacggtggtcaggcctccagtagcccaaattacgagggacccctgcactcacttcagagcagaatcgaggaccggctggagcggctagacgatgctattcacgtgttaaggaatcacgctgttggacccagcacagcaatgcctggaggccacggggacatgcacggaataattgggccctcacataatggagctatgggaggcttagggtctggctatggtaccggtctgctgagtgcaaacagacattctctcatggtgggaacacaccgggaggatggggtcgccctccgcggttcacattcattattgccgaaccaggtgcccgtgccccagttgccggtgcagtcagccacgtcccctgaccttaacccccctcaggacccctaccgaggcatgcctccaggtctgcagggccagtccgtgagcagcggtagttccgaaatcaagtctgatgacgagggggacgaaaaccttcaagatactaagagctcagaagacaaaaaactagacgacgacaaaaaggacatcaagagcatcaccaggagcaggtcttccaataatgatgatgaggacctgacaccagaacagaaggccgaacgggaaaaggaacgccggatggcaaacaatgcccgggagagattacgcgtcagggatattaacgaagcctttaaggaattaggccgcatggttcagctgcacctgaagtccgataaaccccagacgaagctgcttatcctacaccaggccgtggctgtgatcctgtctctggaacagcaggtgagggagagaaacttaaatcctaaagcagcctgtttgaaacgacgtgaggaggaaaaggtaagcagcgaacccccacccctctctctagcaggtccacatccgggtatgggggatgcatccaaccatatgggccagatgtag

SEQ ID NO: 26736 - DNA, 1614 bp, Artificial Sequence
  Description of Artificial Sequence: Synthetic coding sequence
atggacatgggcaaccccggcaccctgagccccaccaagcccggctctcagtactatcaatattcaagtaacaaccctaggagacgcccactgcactcatctgccatggaggtgcagacaaagaaggttcgaaaagtccccccagggctgccctccagcgtctatgctcccagtgcatccactgctgattataacagggactctcccggataccccagctcgaaacccgccacgtcaacctttccttcatctttttttatgcaagacgggcaccatagcagcgacccgtggtccagttcctctggaatgaaccagccaggatacgcgggcatgctggggaactcatcacatatccctcagtctagcagctactgcagcctgcatcctcacgaacgactgtcttatccttctcacagctctgccgatattaacagctccttgccccccatgagtactttccaccggtcgggaaccaaccattatagtactagtagctgtaccccacccgctaatgggacggattcaatcatggccaacagggggtccggtgcggctggaagttctcaaaccggggatgccttgggcaaggctctggcctccatctacagccctgatcatacaaacaattccttttcctcaaacccttctacccccgttggctcccccccatcgctgtcagccgggacagccgtttggtcccgcaacggcggacaggctagctccagtcccaactacgagggccctttgcacagccttcagtcccgtatcgaggataggttagagcgcctggacgacgcaatacatgtgttacgtaatcacgcagttggaccttcaactgcaatgcctggcggtcacggggacatgcatgggattatcggtccgagtcataatggcgcaatgggtgggctcggatcagggtacggcactggtttgctgagcgcaaatcgccattcactaatggtgggaacccatcgggaggatggggtagctttgcggggatcacactctctgctgcccaatcaggtgccggtgccgcagcttccagtgcagtcagctaccagcccagatctcaatcctccccaggatccctatagggggatgccacctggactccagggacagtctgtctcaagtgggtcctctgagatcaagtcggatgacgagggtgacgaaaaccttcaggatactaagtcctcagaggacaaaaagctggatgatgacaaaaaggatataaaatccatcacttctaataatgatgatgaggacctcaccccagagcagaaggcagaaagggagaaggaaagacggatggcaaataatgctagggaacgcctacgagtccgggatattaatgaggccttcaaagagctcggccgcatggtgcagctacatttaaagagtgataagcctcagactaaactcttaattctgcaccaggcggttgcagtaatcttgtctctcgagcagcaggtgcgtgagcgcaacctgaaccccaaggcggcctgcttgaagcgtagggaggaggagaaagtttccagcgagccaccccccctgtcacttgccggtccccatcccggtatgggcgacgcatcaaatcacatgggccagatgtag

SEQ ID NO: 26737 - DNA, 1932 bp, Artificial Sequence
  Description of Artificial Sequence: Synthetic coding sequence
atgttcagcccccccgtgagcagcggcaagaacggccccaccagccttgcatccggacattttacggggagcaatgtggaagataggagttcttccgggagttggggcaacggcggtcaccctagtccgtcaagaaactacggcgatggcaccccttatgaccacatgacttcgcgggacttaggcagccacgacaatctctcccccccgtttgtgaatagtaggatccagtccaagactgagagagggtcatactcgagttatgggagagaatccaacctacagggatgccaccagcagtctctgttgggaggcgatatggacatgggcaatccaggaacactctctcccacgaaacccggatcccaatattaccagtactcgagcaataacccgcgccgcagaccattgcacagctcagctatggaggtacaaacaaagaaggtgcggaaggtacctcccggactgccttcctccgtgtatgctccatcggcgtccaccgcagattataatagggatagtcctggctacccaagttccaagcctgccacctccacattccccagctcatttttcatgcaggacgggcaccactccagcgacccgtggagctcaagctcaggtatgaaccagcctgggtacgcggggatgttaggtaatagttctcacataccgcagtcaagtagctattgttcactgcacccccacgagagactgtcctaccctagccatagttctgccgacatcaactcgtccctgcctcctatgtctacatttcacaggtcgggcacgaatcactactcaactagtagctgcactccccccgccaacgggacagactctatcatggccaaccgagggagcggggctgccggatcaagccagacaggggacgcgttaggcaaggctctggcctctatctactcacctgatcatacgaacaatagctttagctctaatccgagtactcccgtcggatcccctccgtcgctttctgccggcactgccgtctggagtcgaaacgggggtcaagctagtagttcacccaattatgagggtcctttgcattcacttcagagtcgcatcgaagacagacttgaaaggcttgacgacgcaatccatgtactcagaaatcatgccgtcggaccctcaacagccatgcctgggggacacggggacatgcacggtataataggacctagccataacggggcgatgggcggtttagggtcaggatacggcactgggctgctgtctgccaaccgccactctctgatggtgggaacacaccgtgaagacggggttgcgctgcgtggctcccattctctgcttccaaaccaggtcccggtcccccaactccccgtgcagtcggcaacctccccggacctcaacccaccccaggatccgtaccggggtatgccgcctggactgcaagggcagtctgtttcctcagggtcttctgagatcaagtcggacgatgaaggcgacgaaaacctgcaggacactaaatcttctgaagataaaaaactcgacgacgacaaaaaagatatcaagagcatcacaagtaataacgatgacgaggacctgaccccagaacagaaggccgagagagagaaagagaggcggatggctaacaacgctcgcgaaaggctcagagtgagagacattaacgaggcctttaaggaactcgggcgcatggtccagcttcacctgaagagcgataagccccagaccaagcttctgatcttgcaccaggccgtcgccgtaattctgtcgctggaacagcaagtgcgagagagaaacctaaaccccaaggcagcatgccttaaacggagagaggaggaaaaagtctcttccgagccccctcccctgtctctggcgggaccacatcccggcatgggagacgcaagtaaccacatgggacaaatgtag

SEQ ID NO: 26738 - DNA, 1878 bp, Artificial Sequence
  Description of Artificial Sequence: Synthetic coding sequence
atggaggaggacagccgggacgtggaggaccggagcagcagcggcagctggggcaatggcggacaccctagtccgtccagaaattatggcgatggtacaccatacgatcatatgacgagcagggacctggggtctcacgataatcttagcccaccatttgttaactcgcgaattcaatctaaaaccgagcgcggctcttattcatcttatgggcgcgaaagcaacctccaaggatgccatcaacaaagtctgctaggaggagatatggacatgggaaacccagggaccctctcaccaaccaaaccgggatctcagtactaccaatatagtagtaacaaccctagaaggagacctctccatagctcagcgatggaggttcagaccaagaaggtacgcaaggtaccacccggattaccaagtagcgtctatgcaccctccgcaagtacagcggactataacagagattcacctggatatcctagctctaaacccgctacgtccacatttcccagcagtttcttcatgcaagatgggcaccactcatccgatccttggagcagttcctcgggtatgaaccagcctggctatgctggcatgctcgggaatagttctcatatcccgcaatccagctcctattgcagtttgcatccgcacgagcggttgagctatccttcccactctagcgccgacatcaattctagcctcccgcccatgtcaacatttcacaggtctggaactaatcattattcaacatcttcctgtacccctcctgctaatggaaccgacagtatcatggcgaatcgaggatcaggtgcagcaggaagctcccagactggtgacgctttggggaaggcccttgccagtatctattcgccggaccatacaaacaactcattcagctccaatccatctactcctgtggggagccccccaagcctatccgccggaaccgccgtgtggagtcggaatggtggacaggcctccagcagtcctaattacgagggaccattacattcattacagagtcgcatcgaggatcgtctggagcgattagatgacgcaatccacgttttgcggaaccacgccgtgggccctagtaccgctatgcccggaggccacggagacatgcatggcattattggccccagtcacaacggagccatgggcgggttggggagcggatacgggactggactgctgtctgccaatcgccattccctcatggtcggtacccatagggaggacggcgtcgcactcagagggagtcactccctgctcccgaatcaggttcccgttccacaattgccggtacagtctgcaacaagccccgaccttaacccaccccaggacccttacagagggatgccacccgggttgcagggccagtccgtctcatcaggtagctccgaaattaagagtgacgatgaaggcgacgagaatttacaggatacaaaaagcagcgaagataaaaaactcgatgacgataagaaagatatcaaatccatcaccagcaacaacgatgacgaggacttaactccagagcagaaagccgaacgtgaaaaagaacgtcggatggccaataatgcccgtgagaggcttagggtgcgcgacatcaatgaagcatttaaagaactgggccggatggtccagctacacctgaagtccgataagccccaaacaaaactactgatactgcatcaggccgtagcagtgattctgtcacttgagcaacaggtgcgagagcggaatttaaacccaaaagctgcctgcctgaagaggagggaggaggagaaggtgtcatctgagccacccccgctgtcactagccggcccccatcccggtatgggtgatgcaagcaaccacatgggtcagatgtag

SEQ ID NO: 26739 - DNA, 1803 bp, Artificial Sequence
  Description of Artificial Sequence: Synthetic coding sequence
atgaaggacatcttcttccagttcatcatcgcccgggtgcggaagtgctatagtctaagctgcttacacacccttcctgtggtgccaacgttgcggaaaaccgagcgtgggtcatacagctcctacggccgagagagtaacctccaagggtgccaccagtcattgttgggtggtgatatggatatggggaaccccggaacactctcgccaacgaagcccggatctcagtattaccagtactcttctaacaatccgcgacgtcggcccctgcattcctccgctatggaggtacaaacaaagaaagtcagaaaggtccccccgggcctgccctcatctgtctacgccccttcagcatctacagcggattacaatagagactctcctggctatcctagctctaagcccgccacatctaccttccccagcagctttttcatgcaagacggccatcactcctcagacccttggagttctagctctgggatgaatcaacccggatatgcaggaatgcttggaaacagtagtcatattccccagtcttcctcgtattgtagccttcacccgcatgagcggctgtcgtaccccagccatagtagcgccgatatcaattcatcactgccaccaatgtcaacttttcacaggagtgggacaaatcactattccacaagcagttgcacccctccggcaaacggcaccgactccataatggctaacagaggctccggagctgcgggatcctcgcagacgggagatgccttaggaaaagccctagccagcatctactccccagatcacactaataatagcttttcgagtaacccatcaaccccagtgggttctccaccatctctgtcagcaggcaccgccgtgtggtccagaaatgggggccaggcttcaagcagtcctaactacgagggacccctgcacagccttcagtcccgcatcgaagaccgtctcgaaagactagacgacgccatccatgtgctgcgcaatcatgctgtcggcccgtcaacagcgatgcctggggggcatggagacatgcatggcataatcggtccttcacacaacggggctatgggtggattgggctccggttacggtacaggtctgctgtctgccaatcggcactcacttatggtgggcactcaccgggaagacggcgtggccctacgtgggtcccactccttgctgccaaatcaagtacccgtgccacagctgcctgtccagtcagcgacatccccagatctcaaccccccccaggatccctatcgaggcatgccccctgggctgcaaggtcagagtgtgtcctcggggtcatccgagatcaagtcagatgatgaaggggatgaaaatcttcaagacactaagtcttccgaagacaagaagctggacgacgataagaaggatattaagagcatcactagaagtcgtagtagcaataacgacgacgaggacctgactcccgagcagaaggcggaacgtgaaaaggaaaggaggatggccaataacgcaagggagcgacttcgtgtgcgggatattaacgaggcttttaaggagctgggacgcatggtgcagctgcatctcaaatccgataagccacagacgaagctgcttatcctgcatcaggccgtagcagtcatcttgagcctggaacagcaggtcagggagagaaatctgaatcccaaggcggcctgcctgaagagacgtgaggaggagaaagtcagttccgagccaccacccctgagcttggccggtccccaccctggaatgggtgatgcaagtaatcacatgggacagatgtag

SEQ ID NO: 26740 - DNA, 1233 bp, Artificial Sequence
  Description of Artificial Sequence: Synthetic coding sequence
atggccaaggacgccggcctgatcgaggccaacggcgagctgaaggtattcattgaccagaatctcagcccagggaaaggcgtggtgtctctggtcgccgttcatccatcaaccgtgaatcctctggggaagcagctcctacccaagacatttggccaatcaaatgtcaacatcgctcaacaagtggttataggaactccacaaaggccagcagcctcgaacacgctagttgtgggtagcccacacacaccaagcacacacttcgccagccaaaatcagcctagtgatagtagcccctggtctgccggcaaaagaaatagaaagggtgaaaagaatggaaaaggactgcggcatttctccatgaaggtctgtgagaaagtccagcgcaaggggacaacatcctacaatgaggtggctgatgagctggtggctgagtttagtgccgcagataaccacatattgcccaacgagtccgcatacgaccagaagaatatccggcgaagagtgtacgacgcattgaacgtcctaatggcaatgaatataatatctaaggagaaaaaagagatcaagtggattggcttgccaacgaattcagcccaggagtgtcagaacctcgaggtggaacggcagcgacggctcgaacgtataaagcagaaacaaagtcagctgcaggagctgatacttcagcagatcgcgttcaaaaatcttgtgcagagaaacaggcacgctgagcagcaggccagtcggccgccacctccaaattctgttattcacttgccctttattatcgtgaacacatctaagaaaaccgtgattgactgttctatcagcaatgataagttcgaatacctttttaatttcgataatacattcgagattcatgacgatattgaggtcctcaagagaatgggtatggcctgcggtcttgagagcggatcatgctcggctgaagacctgaagatggcacggtccctggtgcctaaggccctggagccgtacgtcaccgaaatggcccaggggaccgtgggcggggtttttatcacaacagccggatcaacatcaaacggcactcgcttcagcgccagcgaccttactaatggggcagacggcatgctagccaccagctccaacgggagtcagtattccggcagtcgggtggagacacccgttagttatgtgggggaagacgacgaagaagatgatgattttaacgaaaatgacgaggacgactag

SEQ ID NO: 26741 - DNA, 711 bp, Artificial Sequence
  Description of Artificial Sequence: Synthetic coding sequence
atggccaaggacgccggcctgatcgaggccaacggcgagctgaaggtgttcatcgatcagaatttgagcccaggaaaaggagtggtcagcctggtggcagtgcaccctagcaccgttaacccgttagggaaacagctgttaccaaagaccttcggccagagcaatgtcaatatcgcgcagcaggtcgttattggcacaccccagcgacccgccgcatcaaatactctggtggttgggtcccctcacactccgagcactcacttcgcctcccaaaaccaacccagcgactctagcccctggagcgcaggtaaacgcaatagaaaaggcgaaaagaatggaaaaggactgcggcactttagtatgaaagtctgcgagaaggtacagcgcaaaggcaccaccagttacaatgaagtagccgatgaactggttgccgagttctcagctgcggataatcatatcctgccaaatgaaagcgcatacgatcagaaaaatatccgccgcagggtttacgatgcattgaatgttctgatggctatgaacatcatctcaaaggaaaagaaggagatcaaatggatcggactgcctaccaacagcgcacaggagtgtcaaaacttggaagtggagcggcagcgccgacttgagcgaataaagcaaaaacagagtcagctgcaggagctgatactgcagcagatcgctttcaaaaatctttag

SEQ ID NO: 26742 - DNA, 480 bp, Artificial Sequence
  Description of Artificial Sequence: Synthetic coding sequence
atggccaaggacgccggcctgatcgaggccaacggcgagctgaaggtcttcatcgaccagaatctttcacccgggaagggagtagtgagcttggtggcggtacacccctccaccgtgaatccacttggaaaacagctgctccctaagacctttgggcagagtaatgtcaacatcgctcagcaagtcgtaattgggactccgcagagacctgcagcctcgaacaccctggtcgtggggagtccccacacgccttctactcacttcgcaagtcagaatcagcccagtgatagtagcccttggagtgctgggaagcgcaatcggaaaggcgaaaagaacggcaaggggctacggcacttttccatgaaggtttgcgagaaagtgcagagaaaggggacaacatcctacaacgaagtggccgacgaactggtcgcggagtttagcgctgccgacaatcacattctcccgaatgagagcgtctag

SEQ ID NO: 26743 - DNA, 936 bp, Artificial Sequence
  Description of Artificial Sequence: Synthetic coding sequence
atgagcaccctgcccagcaagtggaagcggaaccggaagggcgagaagaatggcaagggccttagacattttagcatgaaggtgtgtgagaaagtacaacggaagggcactacgagttacaacgaggtggccgacgaactggttgccgaattctcagcagccgacaaccacatcctccctaatgaatccgcctacgatcagaaaaacattagaaggcgggtctatgacgctctcaatgtcctgatggccatgaacatcatatcaaaagagaagaaagagatcaaatggattggacttcctaccaactctgcccaggagtgtcagaaccttgaggtggagaggcagcgaagattagagagaatcaaacagaagcagagccagctccaggagttgattctgcagcagattgcttttaagaacctcgtgcaacgcaatcgccatgccgagcaacaggcatccaggccaccgccccccaatagtgtgattcatctgcccttcatcatcgtgaataccagtaagaagacagtgatagattgttccattagtaacgacaagttcgaatatctgtttaatttcgataatacattcgagattcatgatgatatcgaggtgctcaagcggatggggatggcctgtggacttgagagtggtagttgctcggccgaagatttgaagatggcccgatccctggtacctaaggctctggaaccgtatgtcaccgaaatggcacaagggaccgtgggcggggtgttcatcactaccgccggcagcacaagcaatggcacttccgacctgacaaacggtgcagacggtatgctggccacatcctcaaacggcagtcagtattctgggagccgggtagagacgcctgtctcctacgttggagaagatgatgaggaggacgacgatttcaacgaaaacgacgaagatgattag

SEQ ID NO: 26744 - DNA, 1146 bp, Artificial Sequence
  Description of Artificial Sequence: Synthetic coding sequence
atgagcaccctgcccagcaagtggaagcggaaccggaagggcgagaaaaatggcaagggattgcgacacttcagcatgaaggtgtgcgagaaggtgcagcggaagggcacgaccagctacaacgaggtggccgacgagctggttgccgaattcagcgccgcagataatcatatcctcccaaacgaaagcgcttacgatcagaagaacatccgtcgccgggtctacgatgctctcaatgtgctgatggctatgaacataatttccaaagagaaaaaggaaatcaagtggattgggctaccgactaatagcgcccaggagtgccagaatcttgaggtcgagcggcagcgcaggctggagcgaatcaaacagaagcaatcccaactccaagaactgatcctacagcagattgcttttaagaacctggttcagcggaaccggcatgctgagcagcaggcatcacgaccccctcctcccaactcagttattcacttgccattcatcatcgtgaacactagtaaaaaaaccgtgatcgactgcagcataagcaatgacaagttcgagtacttgtttaattttgacaatacttttgagatccacgatgatatcgaagtcctgaaaagaatgggaatggcctgtggtctggagtcaggcagctgctctgccgaggacctgaaaatggctagaagtcttgtcccaaaggccttggaaccttatgtcactgagaagactggattgtgcgactgtaccgctggctgtcctgctccctggaggtcagtcgaaaacactgggcaagcaaaagatatccgaaaactgcttcaaccctccgtgctgtggaactgcgctagtttttgctggctcccggtccggttggtcctatttctgtttcatgatcattctctgattttctttccattctcagagatggcacagggcacagtggggggagtatttatcaccacagcaggctctacatcaaacgggacacggttcagcgcctcggatctgaccaacggagccgacgggatgcttgccacatcttctaacggcagtcagtatagtggcagcagagtggaaacacctgttagctatgtcggcgaagacgatgaagaagatgacgatttcaacgaaaacgacgaagatgattag

SEQ ID NO: 26745 - DNA, 1161 bp, Artificial Sequence
  Description of Artificial Sequence: Synthetic coding sequence
atgatcatcagcaccccccagcggctgaccagcagcggcagcgtgctcataggaagcccctatacaccagccccagctatggtgacacagacccatattgcagaggcaacggggtgggtaccaggcgacagaaaacgcgctcgtaaattcattgattccgacttctctgaaagtaagagatcaaagaagggggacaagaatgggaagggcctcagacacttctccatgaaagtctgcgagaaggtgcaacggaaagggaccactagttacaacgaggttgcggacgagttggtgtctgaattcacaaattctaacaaccatttggcagccgattcccaggcctatgaccagaagaacattcggagaagggtctacgacgccttgaatgtgctcatggctatgaacatcatttctaaggaaaagaaggaaattaaatggattggacttcctactaactccgcacaggaatgtcagaatttggagattgagaagcagaggcgaattgagcggataaagcagaaacgggcccaactccaggagctgctccttcaacagattgcatttaagaacctcgtgcagcgcaacaggcaaaatgagcagcaaaaccagggtccaccagcattgaattccacaatccagctgcccttcattatcatcaatacgtctcgcaagacagttatagactgctccatctcatcagacaagttcgagtacctttttaattttgacaacacgttcgaaatccacgatgacattgaagtactgaagcggatggggatgtcgtttgggctggagtccggaaaatgcagcctggaggacttaaagttggcaaagtctctggtgccgaaagctctagagggttacattactgacatttccacgggtccctcctggctgaatcaggggctcctcctgaactccactcagagcgtctctaatctggatctgaccactggcgctacacttccacaatcttccgtcaaccagggcctgtgcctcgatgcagaggtcgctttggccaccggccaattcttagccccgaatagccaccaaagctcctcagcagccagccactgctctgaaagcaggggcgaaacaccctgctctttcaatgacgaggacgaagaggatgacgaagaggattcgtctagccccgagtag

SEQ ID NO: 26746 - DNA, 1113 bp, Artificial Sequence
  Description of Artificial Sequence: Synthetic coding sequence
atgatcatcagcaccccccagcggctgaccagcagcggcagcgtgctgattggaagtccatatacaccagcgcccgctatggtgacacaaacccacatcgccgaggccacgggctgggtcccaggcaaaaggagcaaaaagggagacaagaacggcaaaggtcttcggcacttctccatgaaagtatgcgaaaaagtccagcgaaaaggtaccacaagctacaacgaggtggctgatgagctcgtaagtgagtttaccaattctaataaccacttggcggccgattcccaagcctacgaccagaagaacattagaagaagggtgtacgacgcattaaatgttctgatggcgatgaatatcataagtaaggagaaaaaagaaatcaagtggatcggcttgcccaccaacagcgcccaggagtgtcagaacctggagatcgaaaaacagcgtcggatcgaacgtatcaagcaaaagcgggcccaattgcaggagctgttactgcagcaaattgcatttaagaacctcgtgcagagaaatcgacagaacgaacagcagaatcaagggcctccggccctgaatagtacaatccagcttccctttattattataaatacctccagaaagaccgtgatagactgctcaatctcctctgataagtttgaatacctgttcaatttcgacaacacattcgagatccacgatgatatcgaagtgctgaagagaatgggtatgtcattcgggcttgaatctggcaaatgctcactcgaggacctgaaactggccaagtctcttgtgcctaaggctctggaggggtatatcacagacatatcaaccggaccaagctggttaaaccaaggattgcttttaaattctacacaaagcgtctccaatcttgacctgactacgggagctaccctgcctcagtcgagtgtcaaccaggggctctgtctagacgccgaggtggccctggctacaggccagttcctcgcacccaattcgcaccaatcctcatcagccgcaagccactgttccgaatcacgcggcgaaacaccttgttcattcaatgacgaagacgaagaagacgatgaagaggattcttcatcacctgaatag

SEQ ID NO: 26747 - DNA, 1257 bp, Artificial Sequence
  Description of Artificial Sequence: Synthetic coding sequence
atgcagcccgagggcatcatcttcgaggccgagaacaagcccagcccaggcaccgaatcagcaggcacctttatcctcgaccttagcgcaacgagccggaccattatctcaactcctcagcgattgacttcctcaggcagtgttctcatcggtagcccttacacccctgcgccggcgatggtgacccagacccacattgccgaagctactggttgggttccgggcgatagaaagagggcccgtaagttcatcgattccgatttctcagaatccaagagatccaagaagggagacaagaatgggaaaggcctccgacacttctcaatgaaagtatgtgaaaaagtccagagaaaaggaaccacctcctacaatgaagtggcagatgaactcgtttcagagtttactaactctaacaaccacctggcggctgattcggcttacgaccaaaaaaacatccgccgtagggtgtacgatgccttgaatgtacttatggcgatgaatatcatcagcaaggaaaaaaaggagattaagtggatcggactgccaaccaatagcgcgcaggaatgccagaatctcgagatcgagaagcagcgcagaatcgaacgaattaaacagaaaagggcgcagctgcaggaactgcttctgcagcaaatcgcttttaaaaacctcgtccaacggaatcgccagaatgagcagcagaaccagggacctccggccttgaacagtaccatacagctccccttcatcatcataaatacaagccgtaaaaccgtgattgattgctccatttcatcagacaagttcgagtatctatttaacttcgacaacacttttgagatacatgatgatattgaagttttaaagcgcatgggaatgtctttcggactggagtctgggaaatgctcactggaggatttaaaactggcgaaatccctggtacccaaggcgctagagggctatataaccgacatctccacaggcccgagttggttaaaccagggcctactattgaattcaacccaaagcgtgagtaatctggatctcacaactggcgctactctaccccaatcaagcgttaatcaggggctgtgtttagacgctgaagtagcccttgctactgggcagttccttgctcctaattcccatcagtcaagctctgccgctagccactgttctgagtcgagaggcgaaaccccgtgctcattcaatgacgaggatgaggaggatgatgaagaagactccagttcccccgagtag

SEQ ID NO: 26748 - DNA, 1161 bp, Artificial Sequence
  Description of Artificial Sequence: Synthetic coding sequence
atgatcatcagcaccccccagcggctgaccagcagcggcagcgtgctgattggctcaccttacacacctgccccggctatggtcacgcagacccatatagcagaagcaacaggatgggtccccggtgatcgcaagcgagcccggaaattcatcgatagcgatttttctgagtccaagcgatctaagaaaggcgataagaacgggaaaggtctcagacactttagtatgaaggtgtgcgagaaggtgcagaggaagggcacaactagctacaatgaagtggccgacgaactagtttccgaattcacaaatagtaacaaccacttggcagcagatagtcaagcatacgatcagaagaacattaggcggagggtgtatgatgccctgaacgtgcttatggcgatgaatatcatctcaaaggagaaaaaagaaattaaatggatcggattgcccaccaacagcgcccaggaatgtcagaacctcgagatcgaaaagcagcgccgcattgaaaggatcaagcaaaagagagcccaacttcaagaactgttactgcagcagatcgccttcaagaacttggtacagcggaatcggcagaacgagcaacagaatcagggccctcctgcattgaactcaacaattcagcttcctttcatcattattaacacctctcggaagaccgttatcgactgttcaatcagctcggataaatttgagtatcttttcaacttcgacaataccttcgagatccatgatgacatcgaggtgctgaaacgcatgggtatgagtttcggcctcgaatcaggcaagtgctcgctcgaggatctcaaattggccaaatcacttgtacctaaggctctcgaaggttatattaccgatatctctaccggacctagttggttgaatcaggggttactcctaaactcgacccaaagcgtgtctaaccttgacctgactacgggggccacactcccccaaagctccgtaaaccagggcctgtgcttggatgccgaagtcgccctagccaccggccagtttctggcccccaatagccatcagtcgagttctgccgccagtcattgctcggaatcacgcggggagacaccatgcagctttaacgacgaagatgaggaggatgacgaagaagattcttctagtccagaatag

SEQ ID NO: 26749 - DNA, 261 bp, Artificial Sequence
  Description of Artificial Sequence: Synthetic coding sequence
atgaccgccaagaacgtgggcctgaccagcaccaacgccgaggtgagaggtttcatcgaccagaatctgagcccgactaagggtaatataagttttgttgcattccctgtctccaacacaaactcacccaccaagatattgcctaagacactcggccctataaatgtcaacgtagggccccaaatgatcatttctacacctcagagattgacctcaagtgggtctgtactgattgggtctccgtataccccagccccctag

SEQ ID NO: 26750 - DNA, 141 bp, Artificial Sequence
  Description of Artificial Sequence: Synthetic coding sequence
atgatcatcagcaccccccagcggctgaccagcagcggcagcgtgctgattggctctccatacacaccagctcccgccatggtgactcagactcacatcgccgaggccactggttgggtgccaggtgataggaaacggtag

SEQ ID NO: 26751 - DNA, 1158 bp, Artificial Sequence
  Description of Artificial Sequence: Synthetic coding sequence
atgatcatcagcaccccccagcggctgaccagcagcggcagcgtgctgatagggagcccctatactccagcaccggctatggtaacccagacacacatcgctgaggctaccggctgggtaccgggtgatcggaagcgagctagaaaattcatcgattccgactttagcgaatccaagcgaagcaaaaaaggtgacaaaaatggaaaggggttgcgccacttcagcatgaaggtctgtgaaaaggtccagcgcaagggtacaaccagttataatgaggttgccgatgaactggtcagtgaattcacaaactctaataatcacctggccgcagattccgcctacgatcagaagaatattaggcgaagggtttacgacgcactcaacgtgctcatggccatgaatattattagtaaagagaagaaagaaataaaatggataggactccccacgaactccgcacaggagtgccagaacctggagatcgagaagcagagacggattgaacgcattaagcagaaacgcgcccagcttcaggagcttctgctgcagcagattgcctttaaaaacctggtgcaacggaacaggcagaacgaacagcagaaccagggaccacccgccttgaattctacaatacagctgccattcattattattaataccagtcggaaaaccgttattgattgctctatttcaagtgataaattcgagtatctcttcaatttcgataatacttttgagatccacgacgatatcgaggtgctgaagcgcatgggcatgagtttcggactcgagtccgggaaatgctcattagaagatctgaaactggcaaagtccctggtaccaaaagcccttgagggttacatcactgatatctccacaggaccttcttggttgaatcagggccttctccttaattcgacccagtcagtctccaacctggatctgacaactggcgcaacactgccgcaatcatccgtcaatcagggcctttgcttagatgccgaagtagccctggcaacagggcagttcctcgccccaaattcacatcaaagctccagcgctgcatctcactgctccgagagtcgcggagaaacaccctgctccttcaacgacgaggatgaagaggacgacgaagaggattcctcttcacccgagtag

SEQ ID NO: 26752 - DNA, 270 bp, Artificial Sequence
  Description of Artificial Sequence: Synthetic coding sequence
atgatcatcagcaccccccagcggctgaccagcagcggcagcgtgcttatcggctccccctacactccagcgccagcaatggtgactcagacccacatagccgaggccaccgggtgggtaccaggggatagaaagcgagctcggaaatttatcgactcggatttttctgagagcaaaaggtctaagaagggtgacaagaatggaaaaggactgagacacttctctatgaaggtctgcgaaaaagtacagaggaaaggtaccacatcgtag

SEQ ID NO: 26753 - DNA, 1341 bp, Artificial Sequence
  Description of Artificial Sequence: Synthetic coding sequence
atgaccgccaagaacgtgggcctgaccagcaccaacgccgaggtgcggggattcatcgatcagaatctgagccctaccaaagggaacatctctttcgtagctttccctgtttccaacacaaattctccaactaagattctgcccaaaacactgggtcccattaacgtcaatgtgggccctcagatgattattagtaccccacagcgactgacgtcctccggctccgtcctgatcggctcaccctacacaccagctcccgccatggtaacccagacacacatcgcggaggcaacaggatgggtgcctggcgatcgtaagagggcgcgcaagttcatagatagcgatttcagtgagtccaagcgttcaaagaaaggggataaaaatggtaagggtctgcggcacttctcgatgaaggtgtgcgagaaggtccagaggaagggaaccacttcttataatgaagttgctgatgaattggtctctgagttcaccaacagtaacaaccacctcgcagccgacagtgcctatgatcagaagaacattcgcaggagggtgtacgacgccctgaatgtactcatggcaatgaatatcatctctaaagagaaaaaggaaatcaagtggatcggcttacccacaaattcagctcaagagtgtcaaaaccttgaaattgaaaaacagcgccgaatcgagcgcattaaacagaagagggctcagctgcaggagttgctccttcaacagatcgcctttaagaacctggtgcagcgcaaccgccagaatgaacagcagaatcaaggccctcctgcgcttaactcaaccattcagttaccctttattattataaacactagtagaaagacagttatcgactgttccattagctctgataaattcgagtacctgttcaacttcgacaatacgtttgaaatccacgatgatattgaggtcctgaagcgcatggggatgagttttggcttagagagtggaaagtgttcactggaggatctcaaactggcgaagtccctggttccaaaggcgttggaggggtacatcacagacatatccaccgggccaagttggctcaatcagggtctgctcctgaatagcacccagtcagtcagtaacctggatctcacaactggggctactctccctcagtcctcggtgaaccagggactctgcctcgacgccgaagttgccctcgccacaggccaattcctggcccccaattcacaccagtcatcttctgcagcctcgcattgctctgaaagccgcggcgagactccctgtagtttcaatgacgaggacgaggaggacgatgaagaggattcaagctccccagaatag

SEQ ID NO: 26754 - DNA, 84 bp, Artificial Sequence
  Description of Artificial Sequence: Synthetic coding sequence
atgatcatcagcaccccccagcggctgaccagcagcggcagcgtgctgataggtagcccctacactccagcacccgctatgtag

SEQ ID NO: 26755 - DNA, 1050 bp, Artificial Sequence
  Description of Artificial Sequence: Synthetic coding sequence
atgctggaccccaagtgcgaccggaagcgggcccggaagttcatcgacagcgacttttccgagagcaagagaagcaagaagggcgacaagaatggcaaggggcttcggcacttctcaatgaaagtgtgtgagaaggtgcagcggaagggcaccacaagctataacgaggtcgccgacgaactggtgagtgagttcacgaatagcaataaccatttggcagcagactccgcatacgatcaaaaaaacatccggagacgtgtgtacgatgcactgaacgttttaatggccatgaacatcatttcaaaggaaaagaaggagattaagtggatcggacttcccactaactctgcccaggaatgccaaaacctcgagatcgagaagcagcgcaggattgaaagaattaaacagaagagagcccagctgcaagagttgcttctacagcagatagcttttaagaacttggttcagcgcaaccgtcagaacgagcaacaaaaccagggacctcccgccctaaattccaccattcagcttcccttcattattattaatacctctagaaagacagtgatcgattgctccataagctccgataagttcgaatatctctttaatttcgacaacacctttgagattcacgatgacatcgaagttctgaaaagaatgggtatgtctttcgggctggaaagcgggaaatgcagcctggaggatttgaagctggctaagtctctcgttccgaaagctcttgaggggtatatcacagacatcagtactgggccaagttggttgaatcaggggcttctcctaaatagtacccagagtgtctcaaacttagatctaactacaggcgcgactctgccccagagctctgtcaaccaggggttgtgtttggatgcggaagtagctctggccaccggtcagtttctggctcccaatagccaccagagttcgtctgctgcatcccattgttccgaaagccgaggtgagacaccttgttcttttaacgacgaagacgaggaagacgatgaggaagacagctcatcgcccgaatag

SEQ ID NO: 26756 - DNA, 663 bp, Artificial Sequence
  Description of Artificial Sequence: Synthetic coding sequence
atgatcatcagcaccccccagcggctgaccagcagcggcagcgtgctcatcggatccccttacacgcctgctcctgccatggtgactcaaactcacatcgccgaggccaccggatgggtccccggagatagaaaacgcgctcgcaagttcatcgacagcgatttctcagagagcaagcgttccaagaagggcgacaaaaacgggaaagggttgaggcactttagcatgaaagtttgcgaaaaggtgcagcgtaaaggcaccacgtcctacaatgaggtggcagatgagctcgtgagtgaatttaccaattctaataaccacctggccgctgattctgcatacgaccagaagaatatcagacggcgagtgtacgacgctttaaatgtattgatggccatgaatataatctcgaaagagaagaaggagattaagtggatagggctccccactaacagtgctcaggaatgtcagaatctggagatcgagaaacagcgacgcatcgagaggattaaacaaaagcgcgcccagctgcaagagcttctgcttcaacagattgcattcaaaaatctggtgcagaggaatcgccagaacgagcagcaaaatcaggggccacctgccctcaatagcacaatccagttgcccttcataatcatcaacacctag

SEQ ID NO: 26757 - DNA, 1161 bp, Artificial Sequence
  Description of Artificial Sequence: Synthetic coding sequence
atgatcatcagcaccccccagcggctgaccagcagcggcagcgtgcttattgggtcaccttatacccctgcacctgctatggtaacccaaactcacattgccgaggcgaccggctgggtgcccggtgatcgcaagagagcccgaaagttcatcgactccgatttctctgagagcaagaggtctaagaagggtgataaaaacggtaagggcttacgacattttagcatgaaagtttgtgagaaagtgcagcggaagggaaccacatcatataatgaagttgctgatgaactggtctccgaatttacaaactccaacaatcatttagccgcagatagccaggcgtatgatcagaagaatatccgcagaagagtgtacgacgcactgaacgtgttgatggctatgaatatcatatcaaaagagaaaaaagaaatcaaatggatcggactgccgactaattcagcccaggaatgccagaatcttgaaattgaaaaacagcggaggattgagcggatcaaacagaagagagcacagctgcaggaactgctgctccagcagatcgcctttaagaacctagtgcaaagaaaccggcagaatgagcaacaaaaccagggccctccagctctgaattctaccatccagctgccctttataattattaatacttctcgaaagacagtgatagattgcagtatcagtagtgataagttcgagtatctgttcaacttcgataatacatttgagattcacgatgacattgaggtacttaagcgaatgggcatgagcttcggcctggagtcagggaagtgtagccttgaggaccttaagcttgccaagagtttagtcccaaaggccttggagggctacattacggacattagcaccggaccctcgtggcttaaccagggactgctcctcaattccacgcagagtgtgtccaatttggacctgactacaggcgcaacactgccccagtcatctgtcaaccagggcctttgtctcgatgctgaagtggctctggctactgggcagttcctggctcccaacagtcaccagtcatcctccgctgcctcccactgctccgaatcaaggggagagaccccctgctctttcaacgatgaagacgaggaggatgacgaagaggattcttccagccctgaatag

SEQ ID NO: 26758 - DNA, 933 bp, Artificial Sequence
  Description of Artificial Sequence: Synthetic coding sequence
atgaaggtgtgcgagaaggtgcagcggaagggcaccaccagctacaatgaggtggctgacgaattggttagtgaatttactaatagcaacaatcacttggcagcggatagcgcctatgaccagaagaatattcggaggagggtgtatgatgctttgaatgttctcatggcaatgaacataatttcgaaggaaaagaaggagataaagtggattggcttgccgactaattccgcacaggaatgccagaacctggagattgagaagcagagacgcatcgaaaggatcaagcagaaacgcgctcagcttcaggaattgctgttgcagcagatcgcttttaaaaatctagtccagcgcaaccggcagaatgagcagcagaaccagggccctccagccctgaattccacgatccagttaccctttatcattattaatacgtcccggaagaccgtgatagattgctccatctcatcggacaagtttgagtacttgttcaacttcgataacactttcgagattcacgacgacatcgaggtacttaagcgcatgggtatgtctttcggacttgagagtggaaagtgcagtttggaggatcttaagcttgccaaatcgcttgtgcccaaggccctagagggctacatcaccgatatctccaccggcccttcctggctcaatcaaggactgctcctgaattccactcaaagcgtgtcaaatctcgatctgactactggcgccactctgccacagtccagtgtgaaccaagggctatgcttggacgcagaagtggctcttgctacgggccagttcctggcgcccaattcccaccagtcatcgagtgccgccagccactgttctgagagcagaggggagacaccctgctcttttaacgatgaagacgaggaggacgacgaagaggattccagcagtccagagtag

SEQ ID NO: 26759 - DNA, 1335 bp, Artificial Sequence
  Description of Artificial Sequence: Synthetic coding sequence
atgccccggagcggcgcccccaaggagcggcccgccgagcccctgacaccacccccctcttatggccatcagccccagacaggtagtggggagagctcgggggcttcaggcgacaaggaccacttgtacagtacagtctgcaagcctcgttcaccgaagccagctgctccagcagcccctcctttttcttcctcgtcgggagtcctgggcaccgggctctgtgagctggacaggctcctccaggaactgaatgccacgcagtttaacatcaccgacgaaatcatgagccagttccctagttctaaggttgccagcggcgaacagaaggaggaccaatctgaagataaaaagagacccagcctcccttcttctccctctccaggcttgccgaaagcctctgctacctctgcaaccttagagctcgacaggctgatggccagcctctccgatttcagagtgcagaaccatctgcccgccagcggacctacccagccaccagtggtgtcgagcactaacgaaggcagcccatcacctccggaacccaccggtaaaggttcactcgacaccatgctgggactactccaatccgatttgagtcggcgcggtgtacccactcaggccaaaggcctatgcggaagctgcaacaagcctatcgcggggcaggtagtgaccgccctgggcagggcttggcacccggagcatttcgtttgcggcggctgctccaccgctttaggggggagctctttcttcgaaaaggatggcgccccattctgtccagaatgctactttgagcgatttagtccccgatgtggcttttgtaaccagcctattcgccacaagatggtgaccgccctcggaacacattggcaccctgagcatttttgttgtgtgtcctgtggtgagccatttggagatgagggtttccatgaaagagaggggaggccctactgccgccgggatttcctgcagctgttcgcgccaagatgtcagggatgccaaggaccaattctcgataattacatttcagcactctctgcgttatggcaccctgattgtttcgtctgccgtgagtgttttgcacctttctccgggggaagcttttttgagcatgaaggccgcccgctctgcgaaaatcatttccatgctcgacgtgggtcactctgtgctacctgtgggttgccggtcaccggccgctgcgtcagcgcattgggaaggaggttccacccagaccacttcacgtgcaccttttgtctacgtcctctaactaaaggtagcttccaggaacgcgcaggcaagccctactgccagccttgtttcctgaagctttttgggtag

SEQ ID NO: 26760 - DNA, 1335 bp, Artificial Sequence
  Description of Artificial Sequence: Synthetic coding sequence
atgccccggagcggcgcccccaaggagcggcccgccgagcccctgacaccacccccgagttatggacaccaaccacaaacaggatcaggagagtcaagcggggctagcggcgacaaggatcacctgtactcaaccgtgtgtaagcctcgtagtcccaaacctgcggccccagccgcccccccatttagttcgagttctggcgtcctcgggaccgggctctgcgaacttgaccgactgctgcaagagctcaatgcaacacagttcaatattacagatgaaatcatgagtcagtttccctctagcaaagtcgcctctggggaacagaaagaggatcaaagcgaagataaaaagcgaccctctctgccatcatctcccagtccaggcctgccaaaggcttccgctacatctgccaccttagaacttgacaggctgatggcaagtctttctgattttagagtgcagaaccacctgcccgccagtggacctacccagccccccgtcgtgagcagtacgaacgagggaagcccctctccacccgagcctaccgggaaagggtcactagatactatgctcggcctgctacagagtgacctgtcacgacgcggggtgcccacacaggccaaggggttgtgcggatcgtgtaacaagccgatcgcagggcaggtggtaactgccttggggagagcctggcatccagaacattttgtgtgcggcgggtgcagcactgcacttggaggctctagcttttttgaaaaggacggcgcacccttctgtcctgaatgttattttgaacgctttagtccaaggtgcggcttttgtaaccagcccattagacacaagatggttacagctcttggaacacattggcatcctgaacacttctgctgcgtgagttgcggagagcctttcggggacgagggcttccatgaaagagaggggagaccctactgtaggagggatttcctgcaactgttcgcacccagatgccaggggtgtcagggaccaatcctggacaactatatctctgctctatccgcattgtggcatccagactgttttgtttgcagagagtgttttgccccattttccgggggaagcttttttgagcacgagggcagacctctttgcgaaaatcattttcatgcacgaaggggaagcctctgcgcaacctgcgggctccccgtgactggtcgatgcgtgtccgcactggggcgacgttttcacccggaccacttcacctgtactttctgcctccgtccattaacgaaaggttcgtttcaggagagagcaggcaaaccctactgccaaccatgcttccttaaactgtttggatag

SEQ ID NO: 26761 - DNA, 1386 bp, Artificial Sequence
  Description of Artificial Sequence: Synthetic coding sequence
atggaggacctggacgccctgctgagcgacctggagaccaccacctcccacatgccacgctctggggcaccgaaggaacggcctgccgagccactgactccacccccaagctatggccatcaacctcagaccggaagtggcgagtcctccggtgcaagcggcgacaaagaccatttatatagcaccgtctgtaagcccaggagtcccaagccggcggctccagccgctccacccttctcatctagcagcggagtgctgggtacagggctttgtgagttggaccggcttttgcaggaattgaatgcaactcagtttaacattacggatgaaatcatgtctcagttcccatcgtcaaaggttgcttccggagagcagaaagaagaccagtcggaagacaagaaaagaccaagccttccatcatccccttctcccggattacctaaggcaagcgcaacatccgctaccctcgaattagatagactgatggctagcctgtcagatttccgcgtgcagaaccatcttcccgcaagtggaccaacacagcctcccgtagtgagctctacaaatgaggggagcccctccccaccagaaccaacaggcaagggcagcctggatactatgcttggcctactgcagagcgatctttctaggcgaggagtacctactcaggctaaaggtctttgtggctcttgcaataagcctatcgcgggccaggtggtaaccgcgctgggacgcgcatggcaccccgaacacttcgtgtgcggcgggtgttccacagcgttaggtggcagttcctttttcgaaaaagatggcgcaccattttgccccgagtgttatttcgagcggttcagcccaagatgtggcttttgcaaccaaccaatccgccacaaaatggtcaccgccttaggcacacactggcaccctgagcacttctgttgcgttagttgcggggagcccttcggagacgaaggctttcacgaacgggagggccgaccttattgcagacgcgattttctgcaattgtttgcaccacgctgtcagggctgccaggggcctatcttagacaattacatttccgcactgtcggcactgtggcatccagactgctttgtgtgccgcgagtgcttcgccccgtttagcggagggagctttttcgaacacgaaggacggccattgtgtgaaaatcattttcatgcccgccgaggctccttgtgtgccacatgcggactgcctgtaaccggaaggtgcgtgtccgcactgggccgccgatttcaccccgaccattttacttgcactttctgtcttaggcccttgacgaagggctcttttcaagagagggccgggaagccctattgccagccctgcttcctgaaattatttgggtag

SEQ ID NO: 26762 - DNA, 783 bp, Artificial Sequence
  Description of Artificial Sequence: Synthetic coding sequence
atggtgtggcccgccctgtgggagctgtaccgggagctgggcctgtttcaggggcccgcccttggtctgcgtaatcatctgggaagaaagctccgccggcgtaagaaaaaaaaagccaagcggacgaccaattggaagatcattacggatcggccaggatttcacgacgagagcgctatatatcccgtcggctactgttccactagaatttacgcaagtatgaagtgcccagaccaaaagtgcctgtatacatgtcaaataaaggacggtggggtgcagcctcagttcgagatcgtgccggaggacgatccccagaacgcgattgtgagctcgtctgccgacgcttgtcatgcagagctgttaagaaccatatccaccacgatgggcaagctgatgcctaatctcctgccagccggagctgactttttcggtttttctcatccggccatccataacctcattcagtcatgtcccggtgctagaaaatgtataaactaccagtgggtaaagttcgacgtgtgcaagcctggcgacgggcagctcccagagggtctcccagaaaacgatgctgccatgtccttcgaagccttccaacggcaaatatttgacgaagaccagaacgacccgctgctgcctgggagtctggatttacctgagctgcagcctgccgcttttgtgagcagctaccagcctatgtatcttacccacgagcccctcgtcgacacccacctgcagcatttgaagagccctagccaaggtagccctatccaatccagtgactag

SEQ ID NO: 26763 - DNA, 1236 bp, Artificial Sequence
  Description of Artificial Sequence: Synthetic coding sequence
atgagcctgctggacggcctggccagcagcccccgggcccccctgcagtcttctaaggcacggatgaaaaaactcccaaagaagagtcagaacgagaaataccggctcaaataccttaggctgcgcaaagccgcgaaggccacagtgtttgagaacgctgctatttgtgatgaaattgctagattagaggaaaaattcctgaaggctaaagaggaacgaaggtatttactcaaaaagctgctgcaattgcaggcattgacagaaggcgaggtccaggctgccgcacccagccattcttcctccctgcccctgacttatggagttgctagcagcgtgggaaccattcagggggcaggacctatcagcggcccttctaccggggccgaagagccttttgggaaaaagaccaaaaaggagaagaaagagaagggaaaggaaaacaacaagcttgaggtgctgaaaaaaacctgcaagaagaagaagatggctggaggtgcaaggaagttggttcaaccaattgcacttgacccctcaggccgcccagtattccctatcgggcttggaggcttgaccgtctacagcttgggagaaatcatcacagacagacccggtttccacgacgagtcagcaatataccccgtgggctactgctccaccagaatttacgcatcaatgaaatgtcctgatcagaagtgcctgtacacctgccagataaaggatggaggggtccagcctcagtttgagatcgtgccagaggacgatccacagaacgccatagtgtcatcatctgccgatgcttgccatgctgagcttttgaggaccattagcacgactatgggtaagctgatgccaaatctgcttcctgcaggggcggactttttcggattcagtcatcctgccattcacaacttaatccagagttgcccgggggcccgaaagtgcatcaattaccaatgggttaaattcgacgtctgcaaacccggagatgggcaactccccgaaggactgcctgagaatgatgccgccatgtccttcgaggcttttcagcgccagatttttgacgaagaccagaacgaccctctacttcctggcagtttagatctccccgaactccaacccgcagcatttgtgtcctcctatcagcccatgtaccttacccatgagcctctcgtcgacacccacttgcagcacctgaagagcccaagccaagggagccccattcagagctctgattag

SEQ ID NO: 26764 - DNA, 1281 bp, Artificial Sequence
  Description of Artificial Sequence: Synthetic coding sequence
atggaggccgccgtggccgccccccggccccggctgctgctgctggtccttgccgcggctgcggccgcggcggcagctctcctgccaggagccactgccctgcagtgtttttgccacttgtgtaccaaagataactttacatgcgtgacggacgggctgtgttttgtctcagtcaccgaaaccacagataaggtcattcataactcaatgtgcattgctgagatcgacctgattcccagagacagacctttcgtttgcgcgccaagctccaagacaggctctgtgactaccacttactgttgcaatcaagaccactgcaataagatcgagctgcccaccacaggcttaccgctgttagtgcagaggacgattgccagaaccattgttcttcaggaatccatcggaaagggtcgcttcggggaagtctggcgggggaagtggagaggcgaagaggtcgcagtgaagattttttcctctcgggaggaaaggtcatggtttagggaagccgagatatatcagaccgtcatgctcagacacgaaaacatcctcggcttcattgcggcggacaacaaggataacggtacatggacacagctttggttggtctcagactatcacgagcacgggtcattgttcgactatctgaatcgctacaccgtcaccgtagaggggatgatcaaactggctttaagcaccgcaagtgggctggcacatctacacatggaaatagtgggaacacagggaaagccggctatagcccaccgggatctgaagagtaaaaatattctggtcaaaaaaaacggtacctgctgtatcgctgaccttggcctggccgtccgacatgatagtgctaccgatacgatcgatatcgctcccaatcatcgcgtcggtaccaagaggtatatggctcctgaagtactagacgacagcattaacatgaagcattttgagagttttaagcgagccgatatctatgccatgggtctggtcttttgggagatcgcccggaggtgctcaattggcggtatccatgaagattatcagctgccttactatgatctcgtgccatctgatccatcggtggaagaaatgaggaaggttgtgtgtgaacagaaactgcgccccaacataccaaatcggtggcagtcttgtgaggcactccgtgtcatggccaaaatcatgagggaatgctggtatgctaatggagcggctaggttaaccgcacttcgcattaagaagacattgagtcagctgtctcagcaggagggcatcaaaatgtag

SEQ ID NO: 26765 - DNA, 1512 bp, Artificial Sequence
  Description of Artificial Sequence: Synthetic coding sequence
atggaggccgccgtggccgccccccggccccggctgctgctgctggtcctggctgccgcggctgccgcagcagccgctctcctgccgggcgccacagctttgcagtgtttttgccatttgtgcactaaagacaacttcacctgcgttacggatggtctatgttttgtgtccgtgacggaaacaaccgacaaggtgatacacaatagtatgtgcatcgcagaaatagacctcattccaagggataggccttttgtgtgtgcccctagctcaaaaacaggtagtgtgaccaccacttactgctgtaatcaggaccattgcaacaaaatcgagctgcctacaacagtaaagtcatcacccggcctcggacctgtggaacttgccgcagtcattgccggccctgtgtgttttgtttgcatcagcctgatgctcatggtgtatatctgccataacaggaccgtaattcaccatcgcgtgcctaacgaggaagaccccagtctggataggcctttcatctccgaaggcacaacactcaaagacctcatctacgacatgaccacaagcggtagtggctctggtttacctttactggtacagcggaccatcgcgcggaccatcgtgttgcaggaaagtattggcaaggggcgtttcggagaggtgtggaggggaaaatggagaggggaggaggttgctgttaagattttttcttcgagggaggagcgatcatggttccgggaagctgagatttatcagaccgtcatgttgaggcacgaaaacatccttggctttattgctgctgacaataaagataacggcacatggacccaattgtggctcgtcagcgactaccacgagcacgggtcactctttgactatctgaatcggtatacagttacggtcgaagggatgattaagcttgccctcagtaccgccagcggcctagcgcatctccacatggaaattgttgggacgcagggaaagcctgcaatcgcacatcgggacctgaagtcgaagaatattcttgtaaaaaaaaacggtacttgctgcatcgccgatttagggctcgccgtgagacatgacagcgccacagatacaatcgatatcgcccccaaccacagagtcggaaccaaaagatacatggctcctgaggtgctagacgatagcatcaacatgaagcactttgagtcttttaaacgcgcagatatctacgctatggggctggtgttttgggagatcgcaagacgatgtagtattggcggcattcatgaggactaccagcttccctactatgatctcgtcccatcagacccaagcgtagaggagatgcgtaaggtggtatgtgaacaaaaattgcgccccaacatccccaaccggtggcagagttgcgaggcactcagggtgatggctaaaataatgagggaatgctggtatgcaaacggtgctgccaggctgaccgcactgcggatcaaaaagacattatctcagctgtcccagcaggaaggaataaagatgtag

SEQ ID NO: 26766 - DNA, 1398 bp, Artificial Sequence
  Description of Artificial Sequence: Synthetic coding sequence
atggaggccgccgtggccgccccccggccccggctgctgctgctggttctggctgccgcggccgccgcagctgccgccctgctccctggtgccaccgccctgcagtgcttctgccacttatgcaccaaagataactttacctgcgtcactgacggtctctgcttcgtctcagtgactgaaacaactgacaaggtgattcataacagcatgtgcattgctgagatcgacttgattccacgcgatagaccctttgtgtgtgctccgtcttctaagaccggcagtgttaccactacttattgctgcaaccaggatcattgtaataagatagaactgccaactaccgtgaagagtagcccaggccttggccccgtagaactggccgccgtaatagccgggcccgtctgtttcgtctgcattagtctaatgctaatggtttacatctgtcacaatcggacagtgatacaccatcgggtcccgaacgaggaagatccaagcctggacagaccattcatcagcgagggtacaacactcaaggatctgatctacgacatgactacctccggatctggaagtggactcccgctgctggtccagcgcacaatcgcccgtacaattgtgctgcaagaatcaatcgggaaagggaggttcggagaagtttggcgcggaaagtggcggggggaagaagtcgcagtgaaaattttctcctccagggaagaacggtcatggtttcgggaggcagagatttatcagactgttatgttgaggcatgagaatattttaggcttcattgctgctgacaacaaagacaacggcacttggacgcagctatggttagtttctgattatcatgaacatgggagtctatttgattatctgaataggtatacagtgactgtggagggaatgatcaagcttgccttaagtacagcctccgggctggcacacctgcacatggagatcgtgggcacacaaggcaaacccgccatagcccctaatcaccgcgtgggcacaaagagatacatggctccagaagtgttagacgattctatcaacatgaagcattttgagtccttcaagagggcagatatctatgccatgggcctcgtattctgggagattgctcgtcgctgttctatcggaggaatacacgaagattaccagctgccctactatgacttggtgcctagtgatccgtcagtggaggaaatgcgtaaggtagtttgtgagcaaaagctgagaccgaacatacctaatcgctggcaaagctgcgaggccctgcgggtaatggcaaagatcatgcgagaatgctggtacgcgaatggcgccgcaagattaactgccctccggataaagaagacgctcagccaactgtcacagcaggaagggatcaagatgtag

SEQ ID NO: 26767 - DNA, 216 bp, Artificial Sequence
  Description of Artificial Sequence: Synthetic coding sequence
atggaggccgccgtggccgccccccggccccggctgctgctggcctccacatcactccagtgtttttgtcacctttgcaccaaagataacttcacctgcgtgaccgatggactttgcttcgttagcgtgaccgaaacaacagataaagtgattcataattctatgtgcattgccgagattgaccttattcctagggaccggcccttcgtgtgctag

SEQ ID NO: 26768 - DNA, 1305 bp, Artificial Sequence
  Description of Artificial Sequence: Synthetic coding sequence
atgtgcatcgccgagatcgacctgatcccccgggaccggcccttcgtgtgcgctcctagtagcaagacgggctcagtaactacaacttattgctgcaaccaagatcactgtaataagattgaactccctacgacagtaaagtcttctcctgggctgggaccagtggagctggctgccgtgattgctggccctgtctgttttgtgtgcatcagtcttatgttgatggtgtatatctgccacaatcgcacagttattcatcaccgcgttccaaacgaagaagacccctccttagacagacccttcatttccgaaggaaccactctgaaggatctgatctatgacatgacaaccagcgggagcggatccggactgccactgctggtgcagcggacaatagcacgcacaattgttttacaggagagtatcggcaagggcaggtttggggaggtgtggcgcggaaaatggaggggagaggaagtggcggttaaaattttctcctcacgtgaggagaggtcttggttcagagaagcagaaatctaccagaccgtaatgctgcgacatgaaaatattcttgggtttatcgccgccgataacaaagacaacggaacatggacacagttgtggctggtgtcagactatcacgagcatgggagcctgtttgactacctaaatcggtatactgtcactgtggaaggaatgatcaaactggctctgagcacagcctccggactcgcgcatttgcatatggaaattgttgggacacaagggaaaccagcaattgcgcatagagacctgaagtcgaagaatatcctggtcaagaagaacggtacatgctgcattgcagacctgggcctcgctgtgcgacatgacagcgcaacagacacgatcgacattgcaccgaatcacagggtcggtacgaagagatatatggcacctgaagtgctcgatgactcaatcaacatgaagcactttgagagcttcaaacgcgcagatatctacgcaatggggctggtcttctgggaaatcgcccggcgttgtagcatcggagggatccacgaggattatcaattaccttactatgatctcgtcccttctgacccttccgtggaagaaatgagaaaggtggtgtgtgagcagaagctccgacctaacattcctaacaggtggcagagctgcgaagctctccgggtgatggccaagatcatgcgcgaatgttggtacgctaatggggcggctcggctgacagctctcagaattaaaaagactctcagtcagctttcacagcaggagggcatcaaaatgtag

SEQ ID NO: 26769 - DNA, 411 bp, Artificial Sequence
  Description of Artificial Sequence: Synthetic coding sequence
atgaaggacagcaaccggtgctgctgcggccagttcaccaaccagcacatcccgcccttaccctctgccacacctagtaaaaatgaagaagagtctaagcaagtcgagactcagccggaaaaatggagcgtggccaagcacacacagtcctaccctactgactcatacggggttctggagttccaggggggcggatactctaataaagcaatggtgcggaaagctttccgccacggggctacaagaatcaccgcctttatcgggggccaatctccgagcccgaaactgcagataccaggactgctgcacggctgcggatctattttcttggatatatccctgaaaaaccaggagatatacctctgcacttggctgctcgcaatgcgcctggggaactggacaccgctgtag

SEQ ID NO: 26770 - DNA, 4878 bp, Artificial Sequence
  Description of Artificial Sequence: Synthetic coding sequence
atgggccagaagagctggatcgagaagaccttctgcaagcgggagtgtatatttgtaatccccagcatgaaggactctaacagatgttgctgtggtcagttcaccaatcaacatatcccaccactgcctagcgcgactccaagcaaaaacgaggaagaaagcaaacaggtcgagacgcaaccagagaaatggagtgtggccaaacacacacagtcctatccgactgacagttatggagtcttggaatttcagggagggggctattcaaataaagccatgtatatcagagtgtcctatgatacaaaacccgactccttgctgcatctgatggtgaaagactggcaactggaactgccaaaactgctgatttccgtgcacggcgggctgcagaacttcgaaatgcagcccaagctaaaacaggtgttcgggaaggggttgatcaaagccgcgatgaccaccggggcttggatctttacaggtggggtctccaccggggtcattagccatgtgggcgatgcccttaaagatcactcttccaagagtcgaggccgggtctgtgctatcggtatcgccccatggggaattgttgaaaacaaggaagatctggtgggcaaggatgtcactagagtctatcagaccatgtctaatcctttgtcaaagcttagcgttctcaataattcacacactcacttcatcctggcagacaacggcacactgggcaaatatggagctgaggtcaagctacgcaggttactggagaagcacattagtctacagaagatcaatacccggctcggccagggagtgccattagtgggtctggttgttgaaggcggacccaatgtggtatccatagtgttagagtatctacaggaggagcccccgatacccgtggtgatttgtgatggcagtgggcgagcctctgacattctctcctttgcccataagtattgtgaagagggagggataataaacgagagtctgcgagagcaattattggtgaccattcagaaaacctttaactataacaaagctcagagtcatcaacttttcgcgatcatcatggaatgtatgaagaaaaaggaactggttaccgtgttccgcatgggctctgagggacaacaggatatcgaaatggctattctcacggcactgctcaaagggacaaatgtttctgccccggatcaattatctctcgctctggcttggaatcgagtggacatagcacgctcgcagatctttgtgtttgggccacattggccacccctgggatctcttgccccacctactgactccaaggctacagaaaaggagaagaagcctcctatggccaccactaagggcggcagggggaaggggaaggggaagaaaaagggaaaagtgaaggaagaggtggaggaggagactgatccacggaagattgagttactcaactgggtgaacgccttagagcaagctatgctcgatgctctggtcttggaccgcgtcgactttgtcaagctgctcatcgagaatggagtgaacatgcagcatttcctaacaatccctagactggaggaactgtacaatactcgcttgggacctcctaacacactgcacctcttggtccgggacgttaaaaagtccaatctgcctccggattaccatattagcctcattgatattggacttgtgctcgagtacctgatgggcggcgcctaccggtgcaactacacccgaaagaatttcaggaccctctacaacaatctgtttgggccaaagcggcccaaagctctcaagctgcttggaatggaagacgacgagcctccagccaagggtaaaaagaagaagaagaaaaagaaggaagaggaaattgacatcgatgttgacgatcccgccgtgagcagattccagtacccctttcatgagctgatggtgtgggccgtactgatgaaacggcagaagatggctgttttcctgtggcaacggggggaagagtctatggccaaggctttggtagcgtgcaaactctataaagccatggcacatgaaagcagtgagagcgatctcgttgacgatattagtcaggacctggacaacaattccaaagatttcggtcagctcgcgctcgaacttctcgatcagtcttacaagcacgacgagcagatcgccatgaaattactgacctatgagctgaagaattggtccaattcaacctgtttgaaattggcagtggccgccaagcacagggatttcattgctcacacgtgttcccagatgttactgacggacatgtggatggggcgactcaggatgcggaagaatcccggcctgaaagtcattatgggtattttgctaccccccaccatcctgttcctggagtttcgcacctacgacgacttcagctaccagacctcgaaagagaacgaggacggcaaagaaaaggaggaggagaacactgatgcaaacgcagacgccgggtctagaaaaggggatgaggaaaatgaacacaagaagcagcggagcattccaatcggaaccaaaatttgtgagttctataatgcgccaatagtgaaattctggttctatacaattagctacctgggctacctgttgttgtttaactacgttatccttgttagaatggacggttggcctagcctacaggagtggatcgtgatctcctacatcgtgtctctggcattggagaaaatcagggagatactgatgagcgaacccggcaaactgtcgcagaagatcaaagtctggcttcaggagtattggaacatcacagatctcgtggctatatccacctttatgatcggagcaatactgcgtctgcagaatcagccttatatgggttatgggcgagtgatatattgcgtagatataattttctggtacattagagttctggacattttcggagttaataaatatcttggaccttatgtgatgatgatcgggaaaatgatgatcgatatgctttacttcgtcgtcatcatgttagtagttttgatgtccttcggagtcgctaggcaagccatcctgcaccccgaagagaagccttcatggaaattagcccggaacatcttctatatgccgtattggatgatctatggagaagtttttgctgaccagatcgacctttatgccatggagataaatcccccttgtggagaaaacctgtatgatgaggagggaaaacgcttgcctccttgcattcccggcgcctggcttactcccgccctgatggcctgttacctgcttgtagcgaatatcctgctcgtgaacctcctcattgccgtattcaacaataccttctttgaggtcaaaagcatctcaaatcaggtgtggaaattccagcggtatcaactgatcatgacgttccacgaccgccctgtccttccacctccaatgattattctgtcacatatctacatcattataatgcgcctgtccggaagatgccgaaagaagagggagggggatcaggaagagcgcgaccggggcttaaaactcttcctgtctgacgaggaactaaagagactgcacgagttcgaggagcagtgcgtccaggaacattttcgagagaaggaagacgaacagcaaagctccagcgacgaacggattcgggtgacctctgagcgcgtggagaatatgtctatgcgcctagaagagattaacgagcgcgaaacttttatgaaaacatcacttcagacagtggatctgaggctggcccaactggaagaactctcaaacaggatggtgaacgccctggagaacttagctggaatcgaccgaagtgatttgattcaagctcggagtagggctagtagcgagtgcgaggcgacttatctactcagacagtcaagcattaactccgctgacggctattcattatatcggtaccattttaatggcgaggagctactgttcgaagatacgagcctgtcaacctcccctgggacaggtgtgagaaagaaaacatgctcgttcagaataaaggaggaaaaagatgttaaaacccatctggtccccgagtgccagaactccctacacttatccctggggaccagtacttcagccacgcccgatggcagtcatctcgcagtggatgatctgaagaacgcggaggagagcaaattgggtccggacattggcatctccaaggaggacgacgagaggcagacagatagtaaaaaagaagagaccatctctccaagcctcaataagacagacgtcattcatggtcaggataagagtgatgtgcagaatactcagcttaccgtggagactaccaatatcgagggaacgatcagctatcccctggaggaaaccaaaattaccagatatttccccgatgagacaataaatgcctgtaaaacgatgaagtcccggagcttcgtttactctcggggtcgtaagctcgttggaggagtgaatcaggacgtggagtattcttctattacggaccaacagctcacaacagagtggcagtgccaggtccagaagatcacgagatctcatagcaccgacatcccgtacatcgtgtcggaggctgctgttcaagccgagcataaggagcagttcgctgacatgcaggatgagcatcacgtggccgaagccattcctcgcatccccaggctctcattgactattactgataggaacgggatggaaaatctcctgagcgtgaagccagatcaaacacttggcttcccttcattacgctccaagagtctgcatggccacccccgcaatgttaagtccatccagggaaagctggataggtcaggacatgcctctagtgtctctagtctggtcattgtttcaggaatgaccgctgaagaaaagaaggtgaaaaaggaaaaggcgtcaactgagacggaatgctag

SEQ ID NO: 26771 - DNA, 4812 bp, Artificial Sequence
  Description of Artificial Sequence: Synthetic coding sequence
atcaagaccagcaagcggtgctgctgcggccagttcaccaaccagcatatcccacctctaccatcagccacgccgtccaagaatgaagaggaatctaagcaagtcgaaactcagccggaaaaatggtccgtcgcaaagcatactcaatcttatccaacagatagctacggcgtactggagttccagggaggaggctactcaaacaaagccatgtacatacgcgtgagctatgacactaaacctgattctctgctgcacctaatggtgaaggattggcaactggagcttcccaaattactgattagcgttcacggtgggctgcagaacttcgaaatgcagccaaagctgaagcaggttttcggcaaagggttgatcaaagccgccatgactactggagcatggattttcactggcggcgttagtactggcgtgatcagtcacgtgggagacgccctgaaagatcacagcagcaaaagtagagggcgagtttgcgcgattggcattgccccctgggggatcgttgagaataaggaagatctcgtgggcaaggatgtgactagggtttaccagaccatgtctaaccccctgagcaagctgtcagtacttaacaattcccatactcacttcattcttgccgataacggcacactgggcaaatacggcgctgaagtcaagttgcgtcgtctcctggaaaagcacatttcactgcagaaaatcaacacacggttggggcagggtgtgccactcgttggcttggtagttgaaggaggcccgaacgtcgtttcaattgtcctggagtatttgcaagaggagcccccaatccccgtggtgatctgcgacgggtcagggcgcgcctccgacatcttgtctttcgcccataagtattgtgaggagggcggaatcattaacgaatccctgcgggagcaattactggtaaccatccagaaaactttcaactacaacaaagctcaaagccaccagctgttcgccataatcatggaatgtatgaagaagaaagaattagtgaccgtgttccggatgggttcagaggggcagcaggacatcgaaatggcaattctcaccgcccttctgaaaggcactaatgtcagcgctccggatcaactctcattggctcttgcttggaaccgagtggatatcgcccgatctcagattttcgtcttcgggcctcattggcctcccctggggtcgctggccccgccaactgatagtaaagcaaccgagaaagagaaaaagcccccaatggccaccacaaaaggcgggcgcggaaagggtaagggaaagaaaaaggggaaggtgaaggaggaggtggaagaggagactgatccccggaaaattgagctcctgaattgggtgaacgctcttgagcaggctatgctcgacgcactggtcctggatcgagtcgactttgtgaagctcctaatcgagaacggggtgaatatgcagcacttcctgacaattcctcgtttggaagagctttacaacacccggctgggcccaccgaacactctgcacctcttggtccgcgatgttaaaaagagtaacctgccccccgactatcacatctctctgatcgatataggtctggtgctcgaatacctgatgggcggggcttatcgatgcaattatacacggaagaatttccgcaccctttataacaacctgtttggtcccaagcgtccaaaggccctgaaactcctgggtatggaagacgacgagcctcctgccaagggaaagaagaaaaagaaaaagaagaaggaagaagaaatcgatatagatgttgatgatcccgctgtgtcacgctttcagtatcctttccacgaactgatggtgtgggcagtgctgatgaaaagacagaagatggccgtgttcctctggcagcggggcgaggagtccatggccaaagccctggtggcttgcaaactctataaggcaatggctcacgagagcagcgagagtgatctggtggatgacatttcgcaggacctcgacaataactcgaaggattttgggcagctggccctggaactgctggaccagtcctacaaacatgacgaacagatcgctatgaagctattgacctatgaactcaaaaattggtccaattccacatgccttaaactggccgtggccgcgaagcatcgggacttcatcgcccatacctgcagtcagatgctgctcacagatatgtggatgggccgcctgcggatgcgaaagaatccaggcctaaaagttattatgggtattctgcttccgcccacaatcctcttcttggagttccgcacttatgacgacttctcgtatcagacctccaaggaaaatgaggacgggaaggaaaaagaggaggagaatacggatgctaatgccgatgctggatcacgcaagggggacgaggaaaatgagcataaaaaacagcgatccatcccgatcggaaccaagatttgtgagttttataacgcccccattgtgaagttttggttctacacaatctcttatttaggttacttgctgctatttaactatgttatactcgtgcgaatggacggatggccctctctacaggagtggatcgtgatctcctatattgtatcactggcccttgaaaagatccgcgaaattctcatgagcgagccaggtaagctttctcagaagatcaaagtatggttacaagagtactggaacatcaccgacctagtagccataagtacatttatgatcggggcaatcttgcgccttcagaaccaaccctacatgggctatggccgagtgatttactgcgtggacattatattctggtatatccgtgtgctcgacattttcggcgttaacaagtacctgggtccttatgtgatgatgattggcaagatgatgatagatatgctgtactttgttgtcatcatgctcgtagtcttgatgtcatttggcgtggccaggcaggcaatcctgcatcccgaggagaaacccagttggaagcttgctcggaatattttctatatgccgtactggatgatttacggggaggtctttgccgaccaaattgatctatacgcaatggagataaaccccccctgtggcgaaaacttatacgacgaagaaggtaaaagactcccgccatgtattcctggcgcctggctgactcccgctctgatggcttgttatctactcgttgctaacatacttttggtgaatctattaattgcggttttcaacaacaccttcttcgaagtgaagagtattagcaatcaggtgtggaagttccagaggtatcagctgatcatgacttttcacgaccggccagtactgccccctccgatgattattctgagccacatctacattattattatgagattatccggcaggtgtaggaaaaagcgggagggggaccaagaggaacgggatcgcgggcttaagctgttcctttcagatgaggagctcaagcgcctccacgagtttgaggagcaatgtgttcaagaacacttccgcgagaaggaagacgagcagcagtccagctctgacgagaggataagagtgacgtcggagcgggtcgagaatatgtctatgcgcctggaagagattaatgagagagaaacttttatgaagacgtcgttacagactgtggacttgcgcttggctcagttagaagaactgtccaaccgtatggtgaatgctctcgaaaatcttgccggaatcgataggtctgatttaattcaggcgaggagtagggcgagctcggaatgcgaggcgacatacttacttcgccagtcttccatcaacagcgcggacgggtattccctctaccggtatcacttcaacggagaggagttgctgtttgaggacacatctctgagtacctcaccaggtacaggcgtgcgtaaaaaaacgtgctctttccgtatcaaagaagaaaaggatgtcaaaacacatctggtacctgagtgccaaaatagcttacacctgtccttgggaacgtccaccagtgctacgccagatggatcccatctcgctgtggatgatctaaagaacgccgaggaatccaagctgggcccggatatcggaatatctaaagaagatgatgagaggcagacagatagtaagaaggaagagacaatctccccttcgctgaataaaaccgacgtgatccacgggcaggacaaaagcgatgtgcaaaacacccagcttactgtcgagactacaaacattgagggcacaatctcctacccccttgaggagacgaaaattacaaggtacttccccgatgagaccatcaatgcctgtaaaactatgaagagccgctcattcgtatattcccgggggaggaagctggtgggcggcgtgaatcaagacgttgaatactcctccattacagatcagcaactgaccacagagtggcaatgccaggtgcagaagatcacccgatcgcactcaacagatataccatatatcgttagcgaagccgccgtccaggccgaacataaggagcaatttgcggacatgcaggatgagcaccatgtcgcagaggctatcccgcgaatccctcgtttaagtcttaccatcacagataggaacggcatggagaatctgctttcggtaaagccggatcagacccttggcttcccttcgctgagatctaagtctttgcacggacatcctaggaatgtcaaaagcattcaaggaaagctcgaccgttctggacacgcctcttccgtgtctagtctagtgattgtgagcggtatgacagccgaagagaagaaagtgaaaaaggaaaaagcatcgaccgagaccgagtgctag

SEQ ID NO: 26772 - DNA, 4812 bp, Artificial Sequence
  Description of Artificial Sequence: Synthetic coding sequence
atgaaggacagcaaccggtgctgctgcggccagttcaccaaccagcacatccctccccttccctctgccacaccgagcaaaaatgaggaagaaagtaaacaggttgaaacacagcccgaaaagtggagtgtcgctaaacatactcaatcctatccgaccgactcttatggcgttttggagttccagggtggcggctacagtaacaaggcgatgtatattcgcgtgagctacgatacaaagcccgatagcctgttgcacctcatggttaaagactggcagcttgagctcccgaaactgttgatcagcgtgcacggcggattacagaacttcgaaatgcagccaaaacttaagcaagtgtttgggaagggactgatcaaggcggctatgacaaccggtgcatggatctttaccgggggtgtgtctacaggcgtgatctctcacgtcggtgacgccctgaaagatcacagcagtaaaagcaggggtagagtttgcgccattggcatcgccccctggggaatcgtggaaaataaggaggacctggtgggaaaggatgtgacccgggtatatcagactatgtcaaatcccctgtctaagcttagcgtcctgaacaatagccacacacattttatattggccgacaacggtactctgggtaaatatggtgccgaggtgaaattgcgaaggttactagaaaaacacattagtcttcaaaaaattaacactcgcctgggccagggagttcctctagtgggcttggttgtggagggaggccccaatgtggtgagcatcgtgctggaatacttgcaggaagagccgccaattcctgtggtgatatgcgacgggtctggtcgagcatctgacatcctttccttcgctcacaaatactgcgaagaaggcggaatcattaatgagtcactgagagagcagctcttagtcactatacaaaagacgtttaattacaataaagcccagagccaccaattgttcgccattatcatggaatgcatgaaaaagaaagaactggttacagtgtttcggatgggatccgaaggtcagcaggatatcgaaatggcgattctcacggcgctcctgaaagggaccaacgtctcggccccggatcagctgtcgctggctcttgcttggaacagggtagatatagcaaggagtcaaatctttgtgttcggcccccattggccgccattgggctcactggcccctcctaccgacagtaaagccactgaaaaggagaaaaagccaccgatggcgactactaagggagggcgcgggaaaggaaagggtaagaagaaaggaaaagtgaaggaggaagtggaggaggaaactgaccccagaaagatcgaattattaaattgggtcaacgctctggaacaggcaatgctggatgctcttgtcctggatcgtgtcgacttcgtaaagttgctcattgagaatggggtgaatatgcagcacttccttacaatcccccgcctcgaggagctgtacaataccaggctggggcccccaaatacgctacatttgctcgtacgggacgtgaagaagtccaatctccccccagactatcacatttccctgatcgatatcggcttggttctggagtatttaatgggcggcgcctaccgctgcaattacaccagaaaaaatttccgtaccctctataataacttatttggacctaagcgccccaaggcactgaaactgctcgggatggaggatgacgagccgccagccaagggcaagaaaaaaaaaaagaagaagaaggaagaggagatcgacatagacgtggatgatcctgcagtgtctaggttccagtaccccttccatgaattaatggtctgggccgtgctcatgaagcggcagaaaatggctgtatttctgtggcagaggggggaagagtctatggcaaaggccctggtggcctgcaagctttataaagccatggcccacgagagctctgagtcagatctggtggatgatatttctcaggacctcgataataactccaaagatttcgggcagttggctcttgagttacttgaccagtcttacaagcatgatgagcagatcgccatgaagcttctcacatatgaactgaaaaactggtcgaattccacatgtcttaaactcgctgtagcagccaaacacagggactttatagcccatacatgctctcagatgctccttacagacatgtggatgggacggctgcgcatgcgcaaaaaccctggtctgaaggttatcatgggtatcctattgcctcctaccattctatttctcgagtttcgcacatatgatgacttcagctatcagacttcaaaagaaaatgaggacggaaaggagaaggaagaagaaaatacagatgcgaacgctgatgcaggttctaggaagggtgatgaagagaacgaacacaaaaagcagagatccatccctatcggaacaaagatctgcgagttttacaatgcacctattgtcaagttctggttttacaccatttcctaccttggctatttacttctgttcaattacgtgattctggtgcggatggacggatggccttcactacaagaatggattgtgatctcatacatcgtttcgctcgccctggagaagattagggagatcttgatgagtgagccaggcaaactgtcacagaagatcaaagtgtggctccaggagtactggaacattactgatcttgttgcaatctccacctttatgatcggggccatcctcaggttgcaaaaccagccttacatgggttacggacgcgtgatatactgcgtggatattatcttttggtatattcgggtgctcgatatcttcggggttaacaaatacctcggtccctatgtgatgatgatcgggaaaatgatgatagacatgttatactttgtggtcatcatgttggtggtacttatgtcgtttggcgtggctaggcaggccatcctccatcccgaggaaaagccctcctggaagcttgcgcgaaatattttttacatgccctactggatgatctatggtgaagtgtttgccgaccagatcgatctttacgctatggaaataaacccaccatgtggggaaaatttgtatgacgaggagggcaaacgcctgccaccatgcattccaggcgcttggctaacgccagctcttatggcatgttacctgctagtagcaaatatcttgctggtgaatctgctgattgcagtcttcaacaatacattcttcgaggtcaagtcaatttccaaccaagtgtggaaattccaacgctatcagctgattatgacattccacgacagaccagtcctgccaccgccaatgatcatactgtctcatatatacatcataatcatgcgactgagtggccgatgtaggaagaagagggaaggagaccaggaagagagggatcgcggactaaagctgtttttgtccgacgaagagttgaaaagattacatgagttcgaagaacagtgcgtgcaagagcactttcgggaaaaggaagatgaacaacaaagcagctctgacgaaagaatccgggtcacctctgagcgtgtcgagaacatgagcatgagactggaggaaattaatgagcgagaaaccttcatgaaaacgtctcttcagacagtggatctccggctggcccagctggaggaacttagcaatagaatggtcaacgctctggagaacctcgccgggatcgaccgaagcgacttgattcaagcgcggtcacgcgcctcttctgaatgcgaagccacctacctcctccggcagagcagtatcaatagtgccgacggatattctctgtataggtatcactttaatggcgaagagttgcttttcgaagacaccagcctgagtacttctccggggaccggtgtgcgaaaaaaaacttgttcatttcggattaaagaggaaaaggacgtcaaaacacacctggtgccagaatgtcagaatagcctgcacctatcattggggacctctacaagcgctacgccggacggctcccacctagccgtggatgatctgaaaaatgccgaagagtctaagctcggaccagatattggcatctccaaggaagatgacgagcgtcagactgactctaagaaagaggaaacaatctctcctagcctcaataagaccgacgtcatccacggccaagacaaaagcgatgtccagaatacccagctgactgttgagacaactaacatcgaaggcactattagctaccccctcgaggagacaaagatcacgagatactttccagatgaaacaatcaacgcctgcaagaccatgaaatctcgcagttttgtttactctaggggcagaaaactggtgggcggcgtgaaccaggatgtcgaatattcatctataaccgatcagcaattgaccaccgagtggcagtgccaagtccaaaaaatcaccagaagtcacagcacagatataccttacatcgtctctgaggctgctgtacaggctgagcataaagaacagttcgctgatatgcaagacgaacaccatgtcgccgaggccatcccccggatcccccgcttaagtctgaccattaccgaccggaatggcatggaaaatctactgagcgtgaagcctgaccagacgctgggatttccttcactaagatctaagtcacttcacgggcaccctagaaacgtgaaatcaatacagggcaagctagatcggagtggccacgcctcctccgtgtcaagcctggtaatcgtgagcgggatgacagcagaggagaagaaggtgaagaaagagaaggcttctaccgaaaccgaatgttag

SEQ ID NO: 26773 - DNA, 4929 bp, Artificial Sequence
  Description of Artificial Sequence: Synthetic coding sequence
atgagcagcttcaagcggggcagcctgaagagcagcaccagcggctcgcagaagggccaaaagagctggatcgaaaagacgttttgcaagcgggagtgcatcttcgtcatcccatccatgaaagattctaatcgatgctgttgtgggcagttcacaaatcagcacatcccccctttgcccagcgcgaccccatcaaaaaacgaggaagaatccaagcaagttgagactcaaccagagaaatggagcgtcgcgaagcacacacagagctacccgacagactcctatggcgtgctcgaatttcagggggggggctattctaataaagctatgtatatccgggtcagctatgacacgaagcccgactctctcctgcatctgatggtgaaagattggcagctcgaactgcctaagctactcatttctgtgcatggcggcttacaaaacttcgagatgcagcccaaactcaagcaagttttcggtaaagggcttatcaaagcagccatgaccaccggggcctggatcttcactggtggtgtatccacaggcgtcattagtcacgtcggagatgctctgaaagaccattcttccaagtctaggggaagagtgtgtgcaattgggattgctccttggggaatcgtcgagaacaaggaggatcttgtggggaaggacgtcacaagggtgtatcagacaatgtccaatcccctgtccaagctgtccgtgcttaataatagccacacacatttcatcctggccgacaatggcactctgggcaagtatggtgctgaagtaaagctcagaaggctcctcgagaaacacattagcttgcaaaaaattaatacccgactggggcagggagtgccgcttgtgggactggtggtggagggcggacctaacgtagtgagtattgtgctggagtatctccaggaggagcctcctatcccagtggtaatttgcgatggatctgggagagctagcgacatcttgagctttgcccataagtactgcgaagaagggggtattatcaatgagtccttgcgggagcagctgctcgtaactatacagaaaacctttaactacaataaagcacagagccaccagttgttcgccatcatcatggagtgcatgaagaagaaggagctcgtgaccgtctttaggatgggctctgaagggcagcaggatatagagatggccatccttacagcattgcttaagggaactaacgtctctgcgccagaccagctctccctggcgctcgcctggaaccgcgtggacatcgctcggagccaaatcttcgtgttcggccctcactggccaccactggggtccctggccccccccaccgattctaaggccacagaaaaagaaaagaaacctcctatggcgacgactaaggggggcagaggtaaaggcaaggggaagaaaaaaggcaaagttaaagaggaagttgaggaagagaccgacccccggaaaattgagcttcttaactgggtcaacgcacttgaacaggcgatgctagatgccctcgttcttgatagagtggatttcgtgaagctgcttattgagaacggagtgaacatgcaacactttttaactatcccccggttggaggagctgtataataccagactcgggccccctaataccctgcacctcttggtccgggatgtgaaaaaaagcaacctgccaccagactaccatattagtttgattgatatcggactcgtgcttgaatatttgatgggcggagcgtatcgatgcaattatactagaaaaaattttcggaccctttacaacaatttgttcggccccaagcgccctaaggcccttaagctgcttggcatggaggatgatgagcctcctgctaaaggcaaaaaaaaaaaaaagaagaagaaagaagaggagatcgatatcgacgtggacgacccggccgtaagtcgatttcaatatcccttccatgaactgatggtgtgggctgttcttatgaaaaggcagaagatggcagtctttctttggcaaagaggggaagaatcaatggcaaaagctttggtcgcatgtaagctctacaaagccatggcacacgagtcctctgagtctgacctcgtggacgacatcagtcaagatttggacaacaattcgaaggactttgggcagctggccctcgagttactggaccaatcctataagcatgatgagcagattgcaatgaagcttttaacctacgagctgaagaattggtccaattccacctgtttgaaactggctgtagccgcaaaacatagagattttatagctcatacatgctcacaaatgctcttgacagatatgtggatgggtaggctgcggatgcggaaaaacccaggtctcaaagtgatcatggggattcttctgccacccaccatactgtttctggagttccgtacatacgacgatttcagctaccagacatctaaggaaaacgaggatggcaaggagaaggaggaagagaacacggatgcaaacgcagacgccgggtcgcggaagggggacgaagagaatgagcataagaaacaaaggtctattcctattggcactaaaatctgtgaattttataacgcacccatcgtcaagttctggttttatactataagttacctcgggtacctccttctattcaactacgtgattttggtgcggatggacggttggccctcactccaggagtggatcgtcatatcttacattgtctcacttgcactggaaaaaatcagagaaatcctcatgagtgagcctggaaaattatcccagaagatcaaggtctggctgcaagagtattggaacataactgacctagtggctataagcaccttcatgatcggcgccattcttcgtctgcaaaatcaaccatacatgggatacggaagggttatctactgcgtagacattattttctggtacatccgtgttttagacatcttcggcgtgaataaatacctcgggccatacgttatgatgatcggaaagatgatgatagacatgctgtatttcgtggttatcatgcttgtggtgctgatgtcctttggtgtggcacggcaggccatcctgcaccccgaggaaaaaccatcatggaaactggcaaggaacattttttacatgccctactggatgatctatggcgaagtgttcgcggatcagattgacttatacgccatggagatcaatcccccctgcggggagaatctttatgacgaggagggaaaacgcttacccccatgcataccaggagcttggctgaccccagccctcatggcctgctacttgctcgtggcgaacatcctcctcgtgaacctgttaatcgccgtgttcaacaacaccttctttgaagtgaagagtatctcgaatcaggtgtggaaatttcagaggtaccaattaattatgactttccacgacagacctgtgctgcctcctcctatgatcatactgagtcacatttatatcattatcatgcgattgagcggtcgttgccgaaagaagcgagaaggagaccaagaggagcgcgacaggggcttaaagttattcttatcagacgaagagttgaagaggttgcatgagttcgaggaacaatgcgtccaagagcattttcgtgagaaggaggacgaacagcagtcctcttcagatgagcgtattagagtcacaagcgagagggtggaaaacatgtccatgagattggaggagattaacgagcgagaaacttttatgaagacaagtcttcagactgtggatctgagactggcacagttagaagaactgagtaacaggatggtgaatgccctagagaacctggccggaatagatcgtagtgatctcatccaggcccgctcgagggcttccagcgagtgtgaggccacgtatctgctccggcagagtagcatcaatagcgctgatggctattctctctatagatatcattttaatggagaagaactgctgtttgaagacactagcctgtctaccagtcccggcactggcgttcgtaaaaaaacctgtagtttccgtatcaaggaggagaaggacgtgaaaactcacttggtgccggagtgccagaactctctgcacctatcactgggtaccagtacctctgctacaccagacggaagtcacttagcggtcgacgacctgaaaaacgctgaagagagtaagctgggccctgacatcggcatatccaaggaagacgacgaaaggcagacagattcgaagaaggaagaaaccatcagcccatccctcaataagaccgatgtcatccacggccaggataaatccgacgtgcagaacacgcagctgactgtggagacaacaaatatcgaaggaacaattagctacccgctcgaagagacaaaaattactcgatacttcccagacgagacgatcaatgcctgtaaaactatgaaatcaaggtcgttcgtgtacagcagagggagaaagctggtcggtggcgtaaatcaggatgtcgagtactccagtatcacagatcagcagttgaccacagaatggcagtgccaagttcagaaaatcactcgcagccacagcaccgatataccgtacatcgtctccgaggctgctgtccaggccgagcataaggagcagtttgccgacatgcaggatgaacaccatgttgcagaggccatccccagaatccctaggctaagcttaacaattaccgacagaaacggtatggaaaatctgctgtccgtcaagcccgaccaaactcttgggtttccctcactgagatctaagtcactgcacggacatccaagaaacgtcaagtcaatccaaggtaaactggatcgttccggtcatgcctccagcgtttctagtttggtcattgtctcggggatgacagctgaggagaaaaaggtgaagaaggagaaggcttccaccgaaactgagtgttag

SEQ ID NO: 26774 - DNA, 4173 bp, Artificial Sequence
  Description of Artificial Sequence: Synthetic coding sequence
atgaaggacagcaaccggtgctgctgcggccagttcaccaaccagcatatccccccacttccttccgcaacaccgagcaaaaatgaggaggaatctaaacaggtcgagactcagcctgaaaagtggtctgtcgccaagcacacccagtcctaccctacagacagctatggcgttcttgaatttcagggtgggggttacagcaataaagctatgtacattcgagtctcctatgacaccaagccggactccctactacatctgatggtgaaggattggcagctcgaacttccaaaactgctcatctcagtacatggaggattgcagaactttgagatgcagcccaagctgaagcaggtctttggcaaggggttaatcaaggcagccatgactacgggagcctggatcttcactgggggggtgtcaactggcgtgataagtcacgtcggggacgcattaaaagaccatagctcgaagtcccggggcagagtgtgtgcaatcggcatcgctccctggggcatcgtagagaataaagaagatctcgttggtaaagatgtgaccagagtttaccagaccatgtcaaatcccctcagcaaactgagtgtgctgaacaattcgcacacacatttcattctggccgataacggtacgcttggaaagtacggcgccgaggtcaaactaagacgactgctggagaagcacattagcctgcagaagattaatacaaggctgggtcagggtgtgcctctggtggggttggtggtggaaggagggcccaacgtagtaagcatcgtcctcgaatatctgcaggaagagccacccattcccgttgtgatctgcgatggcagcggtagagcatctgatattctgtccttcgctcacaaatattgtgaggaagggggcatcatcaatgaaagcctaagagagcagctcctcgtcacaattcagaagactttcaactataataaggcacagagccaccagctctttgctatcatcatggaatgcatgaaaaaaaaggagttagtgaccgtgtttcgtatggggagtgagggccagcaggatattgaaatggctatactaaccgctctccttaaggggaccaacgtatcagctcccgaccagctgagtctcgctctggcctggaacagggtggatattgcgcggtcacagattttcgtgttcggcccccattggcctcccctcggcagtctcgctccaccaacagacagcaaggccaccgagaaggagaagaagccccccatggccactacaaagggcggccgcgggaaaggcaaggggaagaagaagggtaaagtgaaggaggaggtagaagaggagacggaccctcgaaagattgagttgctgaattgggttaatgccctggagcaggccatgctggatgccctggtcctggaccgcgtcgattttgtcaaactgttgatcgagaacggggtaaatatgcagcactttctgaccatcccaaggcttgaggagttgtataatacgaggctgggcccccctaataccttacatcttctggtaagggacgtgaagaaaagcaacctcccaccagactatcatattagcctgatcgacataggccttgtcctggagtatctgatgggtggggcctacaggtgcaactacacccggaaaaattttcggaccttatacaataatctgtttggacctaaaaggccaaaggctcttaagctgctggggatggaggacgatgagcctcctgccaagggcaaaaagaagaagaaaaagaagaaggaagaggagatcgatatcgacgttgatgatcccgcggtgagcagatttcagtatccctttcatgagctcatggtgtgggccgttctcatgaagagacaaaagatggctgtgttcttgtggcagagaggggaggagtctatggctaaggccttggtcgcatgtaagttgtacaaggccatggcgcacgaaagcagcgagagcgatcttgtggatgatatttcgcaggatctcgacaacaacagcaaggacttcgggcagctcgccttagagctgcttgaccagtcatataaacacgatgaacaaatagcgatgaaactgttgacatacgaactcaaaaattggtccaactccacttgcttaaaattggcagtcgccgccaaacatagggactttatagcacatacctgtagccaaatgctgctgaccgacatgtggatggggaggctcaggatgcggaagaatccaggattgaaggtgatcatgggcattttgcttccacctaccatcctgtttctggagtttagaacatacgacgatttcagttatcagacatccaaggagaacgaggacggcaaagagaaggaagaggaaaacaccgacgccaacgctgacgccggtagtagaaagggtgacgaggaaaacgagcacaaaaagcagcggagtatccccatcggaaccaagatctgtgagttttataacgctcctatcgtgaaattttggttttataccatatcctaccttggctacctgctgctttttaattacgtgatactggtgcggatggacgggtggccaagccttcaagaatggatagtcatctcatacattgtgtctttggcactagaaaagatcagagaaatcttaatgtccgagcctggaaaactctcccaaaaaatcaaagtgtggctgcaggagtattggaatattactgacctggtggctatttctacattcatgattggagcgattttgcgcctgcagaaccagccttacatgggctatggcagagttatctactgcgttgatataatcttctggtacatccgcgttctggacattttcggggtgaacaagtatctgggaccttatgtaatgatgatcggtaaaatgatgatagatatgctgtattttgtggtgatcatgctcgtggtgcttatgtcattcggtgtggcccggcaggccatacttcatcccgaagaaaagccctcatggaaattagccagaaacatcttttacatgccttattggatgatttacggtgaggtgtttgcggatcagatagacctgtacgctatggagatcaaccccccttgcggagaaaacctgtacgacgaggaaggcaagcgtctccctccatgtattccgggggcgtggctgacgcccgctttgatggcatgctatctcctggtcgcaaacatcctgctcgtgaatcttctcatagctgtctttaacaatacttttttcgaggtaaaaagcatttcaaatcaagtgtggaagttccagagatatcagctcatcatgacttttcatgaccgccctgtgctgccacctccaatgattatcctctcccacatttatatcattatcatgcgattgtccggccggtgcaggaaaaagagggagggagaccaggaggaacgagaccgaggcttgaaactgttcctgtctgatgaagagcttaaaaggctgcatgagttcgaagagcagtgcgtgcaggagcactttcgggagaaggaagatgagcagcagtcttcaagcgacgaacggataagggtgaccagcgaaagagtcgagaacatgagcatgcggcttgaagagatcaacgaaagggaaacctttatgaaaacctcccttcagactgtcgatctgaggctggctcaactggaggagctctctaataggatggtgaatgcccttgagaacctggctggcatcgataggagtgacttaatccaagctagatccagggcgagctccgagtgcgaagccacgtatttgctgcggcagtcttctattaattctgcggatggttacagcctatataggtatcacttcaatggtgaagaactcctgtttgaagacaccagtctctctacttcccccggtaccggcgtgagaaagaagacatgcagctttagaataaaggaagaaaaggatgtgaagacacacctcgtgcccgaatgtcagaacagcctgcatctgtccctgggtacgagcacctctgccacaccggatggcagccaccttgctgtggacgacctgaagaatgctgaagagagcaagctgggccccgacatcgggatctcaaaagaagatgatgagcggcagactgatagcaaaaaggaggagactatttctccatccctcaataagactgatgtgatccatgggcagtag

SEQ ID NO: 26775 - DNA, 4584 bp, Artificial Sequence
  Description of Artificial Sequence: Synthetic coding sequence
atgtacatccgggtgagctacgacaccaagcccgacagcctgctgcacctgatggtgaaggattggcagctcgagctgccgaagctgttaatcagcgttcacggagggctacagaattttgaaatgcagccgaaacttaaacaggtctttggaaaaggtcttatcaaagccgccatgaccaccggagcctggattttcactgggggagtcagtaccggcgtcatttcccacgtgggagatgccctgaaggaccactcatcaaagagccggggccgggtctgtgctatcgggattgcaccttgggggattgtggagaataaggaagacttagtcggtaaggacgtgacacgagtgtaccagacaatgtcaaaccccttgagcaagctgtcagtgctgaacaatagtcacacacacttcatcttggccgataacggaacattgggtaaatacggagccgaggtgaagctcagacgcctgctggagaagcatatttccctacaaaaaattaatacccgtttgggtcaaggagtacccctcgtgggtcttgtcgtggagggcggccctaacgtcgtctccattgtccttgagtacttgcaggaggaacctcccatcccggtagtcatctgcgatggctctggccgggcatctgatatcctgagctttgctcataagatcattaatgaatcactgagagagcaactgttggtgaccattcagaaaaccttcaattacaataaggcccagtcacatcagctgttcgctataatcatggaatgtatgaagaagaaagaactggtgacagtattccgcatgggctctgaggggcagcaggatatagagatggctatcttgacagctcttctgaaaggcacaaacgtttccgcacctgatcaactcagcctcgcgctcgcctggaatagggtcgacatcgcacgttctcaaatattcgtgtttgggccccactggccacctctggggagcttagcacctccgacggacagcaaggctacagagaaggaaaagaaaccccctatggccacaaccaagggcggccgtggaaagggaaagggtaaaaagaaagggaaagtgaaagaggaggtcgaggaggagactgatccacggaagatcgaattgcttaactgggtgaacgctttggagcaggccatgctggacgctcttgtgctggaccgggtggattttgtcaagctcctgatcgagaatggcgtgaatatgcagcatttcctgacaattccccgacttgaggagctgtacaacacccggctcggaccacccaataccttacacctgctggtgcgggacgttaagaagtccaatctgccaccagattaccacataagtctgattgacatcgggcttgtgctggaatatctgatgggcggggcctatcgatgcaattatacacgcaagaacttcaggactctttataacaatctgttcggacctaagcgtcccaaggctctcaagctgctcggtatggaagacgatgaaccgccagccaagggtaagaagaaaaagaagaagaaaaaggaagaagagattgacatcgatgtcgatgacccggccgtgtcaaggttccagtacccattccatgagctgatggtgtgggccgttctcatgaagcggcagaaaatggcagttttcctctggcagcgtggggaggaaagtatggctaaggccttggtggcctgcaagctgtacaaggcaatggcgcatgaatcctcagagagcgacttagttgacgacatcagtcaggacctagataacaactcaaaggattttgggcagttagctctggaactgctcgatcagagctataagcacgacgagcagatcgccatgaaactcctaacttacgaactgaaaaactggtctaactctacctgccttaagctagcagtcgccgctaagcaccgagactttatcgcccacacttgcagtcagatgctccttaccgatatgtggatgggtagactgcggatgagaaaaaaccccgggctcaaggtcattatgggcatcctactaccaccgaccatcttgttcctcgagttccgcacttacgatgattttagctaccagaccagtaaagagaacgaagatggcaaggaaaaagaggaagaaaacaccgacgccaatgctgacgcgggctccagaaagggtgacgaggagaatgagcacaaaaaacagagatcaattccaattgggacaaaaatttgcgagttttacaacgccccgatcgtaaagttctggttttacacaatctcctacttgggctatctcctcctctttaactacgtgatactggtcaggatggacggctggcctagcttacaggagtggatcgttatctcctatatagtgagtcttgccttagagaaaattcgcgaaatcctgatgtctgaaccagggaagcttagccaaaagatcaaagtctggctccaggaatattggaatatcacagatctggttgctatcagcactttcatgattggcgctatcctccggctccagaaccagccatacatgggctacggacgcgtgatttattgtgttgatataattttttggtatattcgagttctagatattttcggtgttaataaataccttggcccttatgtaatgatgattggaaaaatgatgatagacatgctatacttcgtagtgatcatgctggtcgttctgatgtcttttggtgtcgcccgccaggccatcttgcacccagaggagaagccctcatggaaactggctcggaatatattttatatgccatactggatgatttatggtgaagtttttgctgatcaaatcgatctgtatgctatggagattaatcctccctgtggagaaaatctatacgacgaggagggtaagcgtctgcctccctgtattccaggtgcttggctgactccagcactcatggcgtgttatcttctagtggcaaacatactgcttgtaaacctgctcattgcggtgtttaataataccttctttgaagtgaagagcatcagcaaccaggtctggaagttccaacggtaccagttgataatgacgttccatgatagaccagtgctgcccccacccatgataattctctctcatatctacatcatcattatgcgcctgagcgggcgttgccgcaaaaaaagggagggcgaccaagaggaacgtgacagaggcctgaagctgtttctgtcagacgaggaactgaagagactccacgagttcgaggaacaatgcgtgcaggagcatttcagagagaaggaagacgaacaacagtcgtcctctgacgaaagaatacgtgtgactagcgagcgggttgagaatatgtctatgcgtctggaggagataaatgaacgggagacattcatgaaaactagcctgcagaccgttgacttaaggctagcccagctggaagagctctccaacagaatggtgaacgccctggagaatctcgctggcatagacagatcggacttaatccaggcccgctcacgcgcaagttctgagtgtgaggcaacttatctgttgcggcaatcatccatcaatagtgctgacggatattcactgtaccgataccatttcaatggcgaagaactcctgtttgaggataccagtctttctacaagccctggaaccggggttcgcaagaagacatgcagctttcggatcaaggaggagaaggacgtgaagacccacctagtccccgagtgtcagaattccctgcatttgagtctgggcactagcacttcggccaccccagatggatcacacttagccgtcgacgatctcaagaacgccgaggagagtaagctcggaccagatattggcatttcgaaggaggacgatgaaaggcaaacagatagcaaaaaggaggagacaatctctccaagtttgaataagaccgacgtgatccatggacaggataaatctgacgtgcaaaacactcagctgacagtggagaccactaacatcgaaggcactattagttaccccctcgaggagacaaagattactagatatttcccagacgagacaatcaatgcctgcaagacaatgaagtctcgcagtttcgtttatagccggggcagaaagctggtaggtggggtgaatcaggatgtagagtactcctctataacggaccagcagcttactactgagtggcagtgtcaggtccagaagattacaaggagccacagtacggacatcccatacattgtgagtgaggcggccgtgcaagccgaacacaaggagcagttcgccgatatgcaagatgaacaccacgtggctgaggcaatcccccgcattccacggcttagcctgacaataaccgaccgtaatggaatggaaaacttgttgagcgtcaagccggaccaaacacttgggttcccgtccctcaggtctaaatcgctgcatggccaccccaggaatgttaagagcatccagggaaagttggacagatctggccatgcaagtagcgtctcatccttggtaatcgtgtccggaatgacagcagaagagaagaaggtgaaaaaagagaaggctagtactgaaactgagtgctag

SEQ ID NO: 26776 - DNA, 1479 bp, Artificial Sequence
  Description of Artificial Sequence: Synthetic coding sequence
atggccctgaacagcggcagcccccccgccatcggcccctactacgagaatcatggctaccagcctgagaatccctacccagcgcagcctactgtggtccccactgtttacgaagtgcaccctgcacagtactacccaagcccagttccccagtacgctccacgggtcctgacacaagctagcaaccccgtcgtgtgcacccagcccaaaagtccctcgggcacagtgtgcacgagtaagacaaagaaggcgctgtgcataacactgacactcgggactttccttgtcggcgccgctctggccgcggggttactgtggaaatttatggggtcaaaatgtagtaattccggcatcgagtgtgatagcagcgggacatgtataaatccgagcaactggtgcgacggcgtgtcacactgtccaggaggagaagacgagaacagatgtgttcggctgtatggacctaatttcatccttcaggtatattcgtcccagcggaagagctggcaccccgtctgccaggacgactggaatgaaaactacggacgcgctgcatgtcgcgacatgggctataaaaataatttctactcctcccagggaatcgtggacgacagtggatccactagcttcatgaaactgaacacttccgcaggaaacgtcgacatatataagaagctgtatcatagcgatgcttgtagctcaaaagccgtcgtcagcctgagatgtattgcgtgtggagtcaacttgaactcctctcgacaaagcagaatagtgggcggggagtccgccttgccaggcgcttggccatggcaggtgagcctgcatgtacagaacgtccatgtgtgcggcgggagcataattacccctgagtggattgtgactgcagcccattgcgtggagaagcccttgaacaacccctggcactggacagcttttgcgggtattctgcgtcagtcctttatgttctacggggctgggtaccaggtggagaaagtcatatcccaccccaactacgacagtaaaaccaaaaacaacgatattgccctgatgaagttacaaaagcctttgacctttaatgatttggtgaagccagtatgtctcccaaatcccggcatgatgttgcagcccgagcagctgtgttggatttctggctggggggccaccgaagagaagggcaagacctccgaagtcttgaatgctgcaaaggtcctgctgatcgaaacccagcggtgcaactctcggtatgtttacgataacctaattactccagcaatgatatgtgccggcttcctgcaggggaatgtggactcttgccagggagattccggaggaccactagtcacctccaagaacaatatatggtggctgataggcgatacctcctgggggagtgggtgcgcaaaagcctaccgacccggcgtgtacgggaatgttatggtctttaccgactggatctaccgccagatgagagcggatggctag

SEQ ID NO: 26777 - DNA, 1590 bp, Artificial Sequence
  Description of Artificial Sequence: Synthetic coding sequence
atgccccccgccccccccggcggcgagagcggctgcgaggagcggggcgcagcaggacatattgagcatagtaggtacttgtccctgctggacgccgtcgataacagtaaaatggcacttaactcaggctcccctcccgcaattgggccttattatgagaatcacggctaccagcccgaaaatccgtatccggcacaaccaacagtggtaccaacggtgtatgaggttcaccctgcccagtattatccatcccctgtcccacaatacgccccacgggttttgacccaggctagcaatccggtggtctgcacccagcccaagtcaccttccggtacagtgtgtacatcaaaaaccaagaaagctctgtgcattactcttaccctgggcacctttctggtgggcgccgctctcgcggccggcctgctctggaagttcatgggttccaaatgctctaatagtggcattgaatgcgacagtagtgggacttgtatcaatcccagcaattggtgcgatggggtctcccattgccccgggggcgaagacgagaatcggtgtgtacgcctgtatggtcctaatttcatcctccaagtctacagtagtcagaggaagagttggcaccctgtgtgtcaggatgactggaacgagaattatgggcgggcagcatgccgcgatatgggctacaaaaataacttttattcctctcaaggcatcgtggacgatagcgggtctacgagcttcatgaaactcaatacttcagccgggaatgtggacatctacaaaaaattgtaccatagtgacgcgtgcagtagtaaggcagtggtgtcactgcggtgtatcgcctgtggggttaatttaaactcaagccgccaaagccggattgtaggaggggagagcgcattgcccggggcctggccatggcaggtaagcctgcatgttcagaacgtgcatgtgtgcgggggtagcattatcacccccgagtggattgttactgctgcccactgcgtggagaagccccttaacaatccttggcactggacagccttcgccggaatacttagacagtcctttatgttctacggtgctgggtaccaagtggaaaaggtgatctcacaccccaattatgactccaagactaagaacaacgacattgcacttatgaaactgcagaagcccctgacattcaacgatctagtaaaacctgtctgcctcccaaaccccggcatgatgttgcagcccgagcagctgtgctggattagtggctggggggcaaccgaggaaaagggcaaaacctccgaagtgctgaacgctgccaaagtgctgctgattgagacccagcggtgtaatagtcggtatgtgtatgacaacctgattacgccggcaatgatctgtgccggatttctccagggtaatgtcgattcatgccagggcgattccggcggcccactggtaactagtaagaacaacatttggtggcttattggagacacctcttgggggtctgggtgtgccaaggcataccgccccggagtttatgggaacgtaatggtcttcaccgattggatctatcgacagatgagagccgacggctag

SEQ ID NO: 26778 - DNA, 1470 bp, Artificial Sequence
  Description of Artificial Sequence: Synthetic coding sequence
atggccctgaacagcggcagcccccccgccatcggcccctactacgaaaatcacgggtatcaacctgaaaatccataccccgcacagccaactgtggttcccaccgtatatgaagtgcatcccgcccagtattatccctcacctgtgccccagtatgctcctcgggtgttaactcaagcctcaaatccagtggtttgcacacaaccaaagtctccctccggcactgtatgtacatccaagacaaagaaagcactgtgcattacattaaccctggggacctttcttgtgggagcggctcttgccgctggcctgctttggaaatttatgggatccaaatgcagtaactcaggaatcgagtgcgattcttccggaacctgcattaacccctccaactggtgtgatggcgtgtcccattgtccagggggggaagacgagaatagatgtgtgaggctgtatggacctaactttattctccaggtgtacagcagtcagcgtaagtcctggcaccccgtgtgtcaggatgactggaacgaaaactatggtcgagcggcctgcagagatatggggtacaagaacaacttctattccagccagggcattgttgatgatagtggttccaccagctttatgaaactgaacacgtcggctggcaacgtggacatctacaaaaagctgtatcacagtgacgcatgtagcagcaaggcagtggtgagcttaagatgtatcgcctgcggcgtgaaccttaacagtagtaggcagtctcgcatcgttgggggcgagtcagcgctccctggagcttggccttggcaggtctcactgcatgtgcagaacgtccatgtctgcggcgggtcgatcatcacacctgagtggattgtgaccgcagctcattgcgtggagaaaccactcaataatccttggcattggactgccttcgcaggcattctaaggcagtctttcatgttctatggtgcagggtaccaggtggagaaagtgatctctcacccaaattacgactccaaaacgaagaacaacgacatcgcactgatgaagctgcaaaaacctttgacgttcaacgatttggttaagcccgtgtgcctgcccaatccgggaatgatgttgcagccagagcagctgtgctggatctctggatggggagctaccgaggagaaggggaagacttctgaggtcctgaacgctgcaaaagtgctgcttattgaaactcaaaggtgcaactctcgatacgtttatgacaatttgattacccccgctatgatttgcgccggctttctccagggcaatgtcgattcgtgtcagggagattctggaggacccctggtcacgtcaaagaacaacatctggtggctgatcggggatacgtcgtggggttcaggctgtgctaaagcttatcgcccgggcgtgtatggaaacgttatggttttcacagactggatatataggcaaatgcgctag

SEQ ID NO: 26779 - DNA, 240 bp, Artificial Sequence
  Description of Artificial Sequence: Synthetic coding sequence
atggccctgaacagcggcagcccccccgccatcggcccctactacgaaaaccacgggtaccaacccgagaatccttatcctgctcaacccacggtggtccccacagtgtatgaagtccatccagctcagtattatcctagtcccgtgccacagtacgcccctcgggtgctgacacaagcaagtaaccccgtggtttgcacacagcctaaatctccctccggtacggtatgcacaagctag

SEQ ID NO: 26780 - DNA, 1479 bp, Artificial Sequence
  Description of Artificial Sequence: Synthetic coding sequence
atggccctgaacagcggcagcccccccgccatcggcccctactacgagaatcacggttatcaacctgagaacccataccccgcacaacccactgtggtgccaaccgtgtatgaggtgcatcctgctcagtactacccctctccggtgccacagtatgctcccagggtgctaacacaggcaagcaatcccgtggtctgtacacagcctaagtctcctagcggaacagtgtgcaccagtaagactaaaaaggctctgtgcatcacactgactctcggcacctttttggtgggtgccgccctcgccgctggcctgctgtggaagtttatggggtcgaagtgctctaacagtggcatagagtgcgattcctcgggcacatgcattaatcctagtaattggtgtgacggcgtgagccactgccccgggggtgaagatgagaacaggtgtgtccgcttatacggtccgaattttatcctacaagtgtatagtagtcagcgtaagagttggcatcccgtgtgccaggacgactggaatgaaaattacggcagggccgcatgtagggatatggggtacaaaaataatttctactcatctcagggaattgtggacgattccgggtcgacctccttcatgaagctgaacaccagtgctggcaacgtcgatatatacaagaagttgtaccactctgacgcctgttcatccaaggcagttgtctctttgcgctgcattgcctgcggcgtcaatcttaactcctcacgccagtcaaggattgtgggaggagaatctgcattgcccggcgcgtggccttggcaggtctccctgcatgtgcagaacgtgcatgtgtgtggcggatctatcatcactcctgaatggattgtgacggcagcacattgcgtggagaaaccccttaataacccgtggcattggacagcattcgccggaatcttgcgtcagtcattcatgttctacggcgccggctaccaggtggaaaaggtgatcagccaccccaattacgacagcaaaactaagaacaatgacatcgccctcatgaagcttcagaagcccctcactttcaacgacctggttaagcctgtctgtttgcccaacccagggatgatgctgcagcctgagcaattgtgttggatctctggctggggtgcaaccgaggagaagggcaagacctctgaggtgttaaacgccgcgaaagtacttttgatagaaactcaaagatgtaacagcaggtacgtctacgataatctcattacgcccgccatgatctgcgcggggtttctccagggtaatgtcgattcatgccagggcgacagcggcggccctctggtgacgtccaagaataatatctggtggttgataggcgacacttcatggggatctgggtgcgccaaggcgtacagaccaggtgtgtacggcaacgttatggtgttcactgactggatctatcggcagatgagagcggatggctag

SEQ ID NO: 26781 - DNA, 717 bp, Artificial Sequence
  Description of Artificial Sequence: Synthetic coding sequence
atgtacgcccccggcggcgccggcctgcccggcggccggcggcggagatcaccgggaggcagtgcactacccaagcagccggaaaggagtttggcaagtgctctcccaggggctctgtcaatcactgccctctgtaccgcactggctgagcccgcatggctacacatccacggcggcacatgttccaggcaggaattgggggtctctgacgttttggggtatgtgcaccccgacctgctcaaagacttctgcatgaacccccaaactgtccttctgctgagagtgattgccgctttttgtttcctcggcatcttgtgttcactctccgcatttctgctggatgtctttggcccaaaacacccagctctgaaaattacgcggaggtatgcattcgctcacatcctcacagtgctgcagtgcgcaaccgtgataggatttagctattgggcttccgagctgattctggcccagcagcagcagcacaaaaagtatcacggttcacaggtgtacgttacgttcgccgtgtcgttctatctcgtggccggtgcgggtggcgctagtatactggccacagctgcgaacctgctgcgacactatccaaccgaagaggaggagcaggccctggaactgctgagcgaaatggaggaaaatgagccctatccagcagagtatgaagtgattaaccagtttcaaccaccgcctgcgtacaccccctag

SEQ ID NO: 26782 - DNA, 717 bp, Artificial Sequence
  Description of Artificial Sequence: Synthetic coding sequence
atgtacgcccccggcggcgccggcctgcccggcggccggcggcggcgcagtcctggcggatccgcacttcctaagcaacctgagaggagcctcgcatccgcactgcctggagctctctctatcaccgccctctgcactgctctggccgagcccgcatggctacatattcacggtggaacctgctctcgtcaggagctgggagtgtccgatgtacttggttatgtgcatccagatctgcttaaagacttttgtatgaaccctcaaaccgtattgctcctgcgggtgattgctgcattctgctttcttgggattctgtgttccttgtctgcctttttactggatgtgttcggaccgaaacatcccgcacttaaaatcacacgcaggtacgcatttgcccacatcctgaccgtgctgcagtgtgccactgttataggttttagctactgggcaagcgagctgattcttgctcagcaacagcaacataaaaagtatcatggcagccaagtgtatgtcacattcgccgtttccttctacctggtggcgggggcggggggtgcttctatactcgccaccgccgccaacctcctgaggcactatccgactgaggaagaagaacaagcactcgaactgctcagtgagatggaagaaaacgagccataccctgcagaatatgaagttataaatcaatttcaacccccgccagcatacaccccatag

SEQ ID NO: 26783 - DNA, 3075 bp, Artificial Sequence
  Description of Artificial Sequence: Synthetic coding sequence
atgtgcgcccggatggccggccggaccaccgccgccccccggggcccatatggcccttggctgtgcctccttgtggcactcgcccttgatgtggttcgtgtggattgcggtcaggcgccgcttgatccagtttatttgccggcggccttggagttgctggacgcccctgaacacttcagggtgcagcaggtgggacactatcccccagctaacagctctctgtccagcaggagcgagacctttctccttctacaaccctggcctagggcgcagcccctgctgcgagcgtcctaccccccctttgccacccagcaggtcgtgccacctcgagtcacagagcctcaccagcggccagtgccctgggacgtgcgagctgtgtccgttgaggcggctgtcaccccagccgaaccctacgccagggtgctcttccatctgaagggccaagactggcccccgggatccgggtccttgccttgcgcacggttacacgcaacacaccccgccggaacagctcaccaggcatgcaggtttcagccaagtctgggtgcttgcgtggtcgagttggaactgccaagccactggttcagccaagccagcactacaagggccgaactggcttacactctggaacctgccgctgaaggacctggaggttgcggatccggtgaagagaacgaccctggagagcaagcgcttcctgtcgggggagtggaactgagaccagctgatcctccgcagtaccaggaagttccacttgatgaggcagttaccttgcgtgtgcccgatatgcccgtccggccaggacagctcttcagcgccacattgctcctgagacacaattttaccgcttctctgctaacactgcgtattaaagttaagaaaggtcttcacgttaccgctgccaggcccgcccagccaaccctctggaccgccaagctggataggtttaaaggcagccgacatcacacaacattgatcacctgccacagagcaggtctgactgagccagactctagctcaccattagaactcagcgagtttctgtgggtggacttcgtggtggagaattccactggcggcggtgtggcagtcacacggccggtgacttggcaattagagtacccgggtcaggctcccgaagccgaaaaagataagatggtgtgggagatcctcgtgtccgagagagatattcgggcacttattcctctggctaaagctgaggaactggtgaatactgctcccctgacaggcgtgccccagcatgtgccagtcaggttagtcacagttgatggaggaggggccctggtcgaggtgactgagcatgttggatgtgagagcgcaaatacccaggtactccaagtttcagaggcttgcgatgccgtgttcgtggccggaaaagagtcaaggggcgctagaggggttcgagtggatttttggtggcgcaggctgcgtgcttcccttcgtctgaccgtgtgggcccctctactccccctccgcattgagttgactgacactactcttgagcaggtcagggggtggcgggtgccaggccctgcagagggcccagccgaacccgccgccgaagcctcggatgaggctgaacgtcgggccaggggttgtcacctgcaataccagagggccggtgtgaggttcctggcaccattcgctgctcatcctctggacggaggtcggcggcttacccatctactgggaccagattggttgttggacgtaagccacctcgtagcccctcatgccagggtgttggattcacgggtagcctcactggagggcggacgggtcgttgttggccgcgaacctggtgtgactagcattgaagtccggagccctctcagtgattccattctgggggagcaggccctagccgtgaccgacgataaagtatccgtccttgaacttagggtgcagccagtgatgggaatttcccttactttaagcagaggaactgctcacccaggagaggttacagccacctgttgggcccagtctgcgttacctgcacctaaacaggaggtcgctctgtctctctggctgtccttttctgaccacactgtggcccccgctgaactttatgatagaagggacttgggcctgagtgtgtcagctgaagaaccaggagccatactgcccgcagaggagcagggggcccagctcggcgttgttgtttctggggcaggggccgagggactacctttacacgttgctttacatccaccggagccgtgtcgccgcggcaggcatcgggtgcctctggcttcaggaaccgcgtggctgggcttacctcccgcatccactcccgcccccgctctgccatcctctccagcctggtccccacccgctacagaggccactatgggcggaaagcggcaggtcgcgggaagcgttggggggaacacgggagtgagaggcaaattcgaacgggccgaggaagaggctcgcaaggaggaaacggaagctagggaagaagaagaggaggaagaggaggagatggttccggctccacagcacgtcacggagctggaactcggaatgtacgcactgctcggagtattttgtgtggctatctttatcttcctagtgaacggggtggtgttcgtgctgaggtaccagcgtaaagagccccctgatagcgccaccgatccaacatcaccacagcctcacaattgggtgtggctggggacggatcaagaggagctgtcacgccagttggaccgtcagagtcccgggccaccgaagggcgagggcagttgtccatgtgagtcagggggggggggagaagcccccactttggctcctggacctccgggcggaacaacatccagctccagcacccttgccagaaaagaagccggcggaagacgcaagagggtcgagttcgtaaccttcgctccagcccccccggctcaatctccggaggaacctgtaggtgctccagccgtgcagtcaatactggtggcgggcgaggaggatattcgatgggtgtgtgaagatatgggtctgaaagaccccgaagaactgcgcaattatatggagcgcatcagaggcagtagctag

SEQ ID NO: 26784 - DNA, 3072 bp, Artificial Sequence
  Description of Artificial Sequence: Synthetic coding sequence
atgtgcgcccggatggccggccggaccaccgccgccccccggggcccttacggaccttggttatgtctcttagtggcccttgctctggatgtcgtcagagtcgattgtggtcaagctccactggatcctgtgtatttgccagcggctttggagctactggacgcaccggagcattttcgtgttcagcaagttggacattatccgcctgctaactcatcattatcaagccgatccgagaccttcttattactgcagccttggccaagagcacagccactgctgcgggctagctatccccctttcgctacccaacaggttgtcccccccagagttactgagccacaccagcgacctgtgccatgggatgtgcgagctgtgagtgtcgaagccgccgtgacacccgctgaaccctatgcaagagtcttgtttcacctgaagggacaggactggccacccggctcagggtcactcccttgtgccaggctgcatgccacgcaccctgctggcaccgcccaccaggcttgtaggtttcaaccctcgctaggcgcctgtgtggtggaactcgagctccccagccattggttctcgcaggcatccaccaccagggccgagctcgcttataccctggaacccgctgcagagggccccggcggctgtggttccggagaagagaatgacccgggggagcaggcccttcccgtgggtggggtcgaactcagaccggcagatcctcctcaataccaagaggttccccttgacgaggcagtgaccttgagagtacccgatatgcctgtaaggccgggccagctgttttccgcgaccctcctgctccgccataattttaccgcatctctgctcaccttgcggattaaggtaaaaaaagggctacatgttacagcagcaaggccagcccagccaaccctgtggaccgcaaaactggacagatttaagggaagtcggcatcacaccaccttgattacctgtcacagagctggtctgactgaaccggactcatcaccccttgagctgtctgagtttttgtgggtagatttcgttgttgaaaactccacgggtggcggcgtcgcagtgacgcgccccgtcacgtggcagctcgagtatccaggtcaggcgcccgaagccgaaaaagacaaaatggtgtgggagattctggtgagtgagcgtgacatccgagctttgataccattggcgaaggcggaagagcttgtgaataccgccccactaactggcgtcccccagcatgtgccagtgcgactggtcacagtggatggcggtggcgccctggtcgaagttaccgaacatgtgggatgtgagagcgctaacacgcaggtactccaagtgagcgaggcctgcgacgctgtgttcgtggcgggaaaggaatctagaggagcccgcggcgtgagggtagacttctggtggcgccgcctgagagcaagcttaagactgacagtttgggcccccctgcttcctttgcgaattgagctgacagatacgacccttgagcaagtgagaggatggcgcgtgcctggtcctgctgaggggcctgcggaacccgccgctgaggcctctgatgaagccgagagacgggcgagaggctgccaccttcagtaccagcgggcaggtgtcagatttctggcgccattcgctgcccatcccctggacggcggtcgccggctaacccacctgctgggccccgactggctgctcgacgtgtctcatttggtggccccacatgctcgcgtcctggattccagagtggcgagccttgaggggggcagggtggttgtgggcagagagcccggtgtcacatccattgaagtacgctcacctctgagtgattccatcctgggagagcaggctctggccgttacagatgataaagtatctgtcctggagctacgggtgcagcccgtgatggggatctctcttaccttgagtaggggcacagcacacccaggcgaggtcactgcaacctgctgggcccagtcagcgctgcccgccccgaagcaggaagtggccctttcgttgtggttatcattttctgaccataccgtggcacctgctgaactgtacgaccgcagggacctgggtctcagcgtttcggccgaagagcccggagctatcctgcccgcagaggagcaaggtgcccagctcggcgtggtggtgtcaggagccggggccgaaggtctcccactccatgtggcccttcaccctcctgaaccctgccggagaggaaggcaccgagtacctctggcctccggcaccgcttggctagggctcccccccgcctcaacacctgcaccggctttaccgtcctcgcccgcgtggtcacctcctgcaaccgaggctaccatgggcgggaagagacaggttgctgggagcgtaggaggtaacacaggagtcaggggaaaatttgaaagagcggaggaagaggcacggaaggaagaaacagaagctcgtgaagaggaggaggaggaggaggaggaaatggtgcccgccccacagcacgtgaccgaactggaactaggtatgtacgcactgctcggagtattctgtgtcgcaattttcatatttctggtgaatggcgttgtttttgttcttaggtatcaaaggaaggagcctcctgacagcgctaccgatcctacgagcccccagccccacaattgggtttggctggggactgatcaggaagaactttcccgtcagttagatcgacagagccctggtccccccaagggggagggatcttgcccatgcgagtccggaggggggggcgaagccccgacacttgcgccaggcccacccggcggcacgacttctagcagttctactcttgctcgcaaggaagctggcgggcggcgcaaaagagttgagttcgtgactttcgcgccagcaccacccgctcagtcccccgaagagcctgtaggggcccccgccgtgcaatcaatcttggtcgctggggaagaggatatccgctgggtgtgcgaagatatgggtctgaaagaccctgaggaactccggaactatatggaaagaatcaggggctcatcctag

SEQ ID NO: 26785 - DNA, 1026 bp, Artificial Sequence
  Description of Artificial Sequence: Synthetic coding sequence
atgctgcccgagcagctgtacttcctgcagagcccccccgaggaggaaccagagtatcaccccgatgccagcgctcaggagctgaatgtccgcgagtcggacgtccgcgtgtgtgacgagtcgagctgtaaatatggcggggtctgtaaagaagatggggatggcctcaagtgcgcctgccagttccaatgccacacaaattacattcctgtgtgcggttctaatggcgatacctatcagaacgagtgttttctgcgccgtgccgcctgcaagcatcagaaggagataacagtgattgcaagagggccatgttatagcgacaatggcagcggatccggcgagggagaagaagagggctctggcgcggaggtccataggaagcactcaaagtgcggtccttgtaagtacaaagccgaatgtgatgaagatgccgagaatgtcggctgtgtgtgcaacatcgactgcagcggctattcatttaatcctgtgtgcgcaagtgacgggagctcttataacaacccatgttttgtgcgagaggcctcctgcattaaacaggagcagatcgatatcagacatcttgggcattgtactgatactgacgatacttctcttctgggcaagaaggatgatgggctgcaatacagaccagacgttaaggacgcttcggaccagcgggaagacgtgtatattggcaatcacatgccatgtccagagaatctgaatggatactgtatccacgggaagtgcgagttcatctactcaacccagaaggcttcttgtaggtgtgagtccggctacactggacagcattgcgagaaaaccgacttctccattctgtatgtggtccccagccgccagaagttaactcacgtgctgattgccgcgattattggtgcagtgcagatcgctattatcgtcgctatcgtaatgtgcataaccaggaagtgtcccaaaaataaccgaggccgccgacagaaacagaatctggggcactttacctctgacaccagtagccgaatggtgtag

SEQ ID NO: 26786 - DNA, 1143 bp, Artificial Sequence
  Description of Artificial Sequence: Synthetic coding sequence
atgggcgccgccgccgccgaggcccccctgcggctgcccgccgccccgcccctcgctttttgctgttatacaagtgtgctattgcttttcgccttcagccttccaggcagccgcgccagcaatcagcctcccggaggagggggtggcagcgggggagattgtcctgggggaaagggaaagtccatcaattgcagtgagctgaatgtgcgggagtctgacgtgcgagtgtgcgacgaatcctcctgcaaatatggcggcgtgtgcaaagaggatggggacggcctaaagtgcgcatgtcagttccagtgccatacaaattatatacctgtgtgtggttctaacggcgatacatatcagaacgaatgttttcttagaagggcggcgtgtaaacaccagaaggagatcactgtgatcgcaaggggtccttgctactctgacaacggctcaggctcgggcgaaggtgaggaggagggttcgggcgctgaggtccaccgtaagcatagcaagtgtggaccctgtaagtacaaagccgaatgcgatgaagatgcagagaacgtgggttgcgtgtgtaacatagactgttcggggtacagctttaaccctgtctgcgcctctgatggctcttcgtataacaacccctgtttcgtgcgggaggcatcctgcattaagcaggaacagatcgacatcagacatttaggccattgtactgatacagatgacacatctctgttggggaagaaagacgatggcctgcagtaccggccggacgtgaaggacgccagtgaccagagggaggacgtttatattggaaaccacatgccctgtcctgaaaatcttaatggctactgcatccacgggaagtgcgaattcatctattcgactcaaaaggcgagttgccgttgcgagtccggctatacaggtcagcattgtgagaagactgactttagtattctgtatgtggtgccatctaggcaaaaactgacccacgtgctgatcgctgccatcattggcgcggtgcaaattgccatcatagtggccatcgttatgtgcattacccgaaagtgtcctaagaataacagggggcggaggcaaaagcagaacttgggacatttcacttccgataccagctccagaatggtctag

SEQ ID NO: 26787 - DNA, 393 bp, Artificial Sequence
  Description of Artificial Sequence: Synthetic coding sequence
atgcaggagcggaccggcgccgccaccgcccggcgggagagcctgccccaggctaataatcccgagcagctttgcaagcagcgatgcatcaacgaggcctcatggactatgaaacgtgtgctgagttgcgttcccgaaccaactgttgttatggcggcgagggccctctgtatgctgggtttagtcctggccctgttgtcctcaagcagtgccgaggaatatgtcggcctatctgccaatcagtgcgctgtgccagcgaaggatagggttgactgtggttacccacacgttactcccaaagaatgcaataaccgagggtgttgtttcgattctagaataccgggcgtcccttggtgcttcaaacccctccaagaggctgagtgcaccttttag

SEQ ID NO: 26788 - DNA, 285 bp, Artificial Sequence
  Description of Artificial Sequence: Synthetic coding sequence
atgaagcgggtgctgagctgcgtgcccgagcccaccgtggtgatggctgctagggcattgtgcatgctgggcctggtgctggcccttttgtcctccagcagcgccgaagaatacgtggggttatctgccaaccagtgtgcagtgcccgctaaggatcgcgttgactgcgggtaccctcatgtaactcccaaagaatgtaacaatcgcggctgttgttttgactccagaatcccaggcgtaccctggtgctttaagccgctccaggaggccgaatgtacattctag

SEQ ID NO: 26789 - DNA, 1497 bp, Artificial Sequence
  Description of Artificial Sequence: Synthetic coding sequence
atggccctgcccaccctgcccagctactggtgcagccagcagcggttgaaccagcagctcgcgcgtcagcgagagcaggaggctagactcagacagcagtgggagcaaaacagccggtactttcgcatgagtgacatatgctccagcaaacaggctgaatggtctagtaagacttcttatcaacgttcgatgcatgcctaccagcgcgagaagatgaaggaggaaaagaggcgctccctggaggctcggagagagaaacttcgacagctgatgcaggaagagcaagatctgctcgcccgggaactggaagagctacggctgagcatgaatcttcaagaacgtaggatccgtgagcaacacgggaagctcaaaagcgcaaaggaagaacagaggaaactcatcgcggagcaactactctatgagcactggaaaaagaataatcctaaattgagagagatggagctcgaccttcaccagaagcacgtggttaattcgtgggaaatgcagaaggaggagaaaaagcagcaggaggctacagctgagcaggagaataagcgctatgagaacgaatacgaacgggcccgtcgggaggctttggagcgcatgaaagcagaggaggaaaggcggcagctcgaagacaaactgcaggcagaagctctcctgcaacagatggaagaactgaagctgaaagaagtggaagctacgaagctcaagaaggaacaggaaaacttgctgaaacagcgctgggagctggaacggctggaagaggaacgcaaacagatggaagctttccggcagaaagcagaactggggcgcttcctgagacaccagtataacgctcagctgagcagaagaacccagcagatccaggaagagcttgaggccgaccggagaattctccaggccctgctggagaaagaagacgagtcccagcgtctacatctggcccgccgggagcaggtcatggccgatgtcgcatggatgaaacaagccatagaagagcagctgcagttggagagagccagagaggccgaacttcagatgctgctgagggaggaggccaaggaaatgtgggaaaagcgtgaggcggaatgggctcgggagagatctgctagggatagacttatgtcggaagtgctgacaggccgtcaacagcaaattcaagagaaaattgagcaaaaccgccgcgcgcaagaagaatctctgaagcacagagagcagctgataaggaacctcgaagaagttcgcgagctggcaaggcgcgagaaagaggaatccgagaagctgaagtctgcgcgcaagcaagaactcgaagcacaggtggcggagaggcgcctgcaagcgtgggaggcagaccagcaggaggaggaggaagaagaggaagcccgacgagtcgaacagctgtccgacgctttacttcagcaggaagcagaaacgatggcagaacagggctacaggcctaagccttacgggcacccaaaaattgcctggaattag

SEQ ID NO: 26790 - DNA, 1497 bp, Artificial Sequence
  Description of Artificial Sequence: Synthetic coding sequence
atggccctgcccaccctgcccagctactggtgcagccagcagcggctgaatcagcagctggcccggcagagggagcaagaagctcgcctgaggcagcagtgggaacaaaattccagatactttaggatgtcagacatatgcagtagtaaacaggcagaatggtccagtaaaacgtcctatcaacggagtatgcacgcctaccagcgggagaaaatgaaagaagagaagagaaggtccctggaagccaggagggagaagcttcggcagctaatgcaggaggaacaggatctccttgcccgggagttagaagaattgcggctttccatgaacctgcaggaaaggcggatcagggagcagcatggaaaactgaaatcagccaaggaggagcagcgtaagttgatagccgaacagctcctttatgagcattggaagaagaacaacccaaagctgcgcgagatggagctcgacctacaccagaaacatgtggtcaattcctgggaaatgcagaaggaagagaagaagcagcaggaggcaactgcggaacaagagaacaagaggtatgaaaacgagtacgagagggcccggagggaggccctcgagagaatgaaagccgaagaggaaagaaggcagctggaggataagctccaggcagaagctctattgcagcaaatggaggaactgaaactcaaagaagtagaagccacaaaactgaagaaagagcaagaaaatctcctgaaacagaggtgggagctagaacgacttgaggaggaaagaaaacaaatggaagcctttcgccagaaagccgagctcggaagattcttgagacaccagtataatgcccaactttctaggagaacgcagcagatccaagaggaacttgaagcagatcgcagaattctacaagcgttacttgaaaaggaggatgaatcccaacgcctacacctggcgagacgtgagcaggtaatggcggatgtcgcatggatgaaacaagctattgaagaacagctccagcttgaaagagcccgggaagctgaactccagatgctccttcgggaagaggccaaggagatgtgggaaaagcgcgaggcagagtgggcgagagagcggtctgcacgcgatcgactcatgtcagaggtgctcactggcagacagcagcagatacaagagaagattgaacaaaatcgccgcgcacaggaagagtccctaaagcacagggagcagctaatcaggaacctggaagaggtccgtgagctggcccgacgagagaaggaggaaagtgagaagttgaaaagcgcaagaaagcaggagctggaggcccaagtcgccgagcggcgattacaggcgtgggaggctgaccagcaagaggaagaggaggaggaagaggccaggagagtggaacaattatccgatgcactgctccagcaggaggctgagaccatggccgagcagggctacaggcctaaaccctacggtcacccaaagattgcttggaactag

SEQ ID NO: 26791 - DNA, 525 bp, Artificial Sequence
  Description of Artificial Sequence: Synthetic coding sequence
atggccctgcccaccctgcccagctactggtgcagccagcagcggctgaaccagcagttggcgagacagcgcgagcaagaggccagattaagacagcaatgggaacagaatagccgctattttagaatgagcgacatctgtagttcgaagcaggctgaatggtccagtaagacgtcatatcagcggtctatgcatgcgtaccaacgagagaaaatgaaggaggagaagcggaggagtttagaagctcgaagggaaaagctgagacagctcatgcaggaagagcaggacttgttggctcgcgagttggaggagttacggctgtcaatgaacctgcaagagcgccggataagggaacagcatgggaagctgaagtcagcgaaagaagaacagcgtaagttgattgcagaacaattgttgtacgagcattggaagaagaacaatcccaaattgcgcgagatggagctggacctccatcagaagcacgtggtgaattcctgggaaatgcaaaaagaggagaaaaaatag

SEQ ID NO: 26792 - DNA, 663 bp, Artificial Sequence
  Description of Artificial Sequence: Synthetic coding sequence
atggccctgcccaccctgcccagctactggtgcagccagcagcggttaaatcagcagttggcaaggcagcgcgagcaggaggccagactgcggcagcagtgggagcagaactctcgatatttccgcatgagcgatatttgcagcagcaaacaggctgagtggtcgagtaagacaagctaccagaggagtatgcatgcctatcagagagagaagatgaaagaggagaaacggcgctccctggaggcccggagggaaaagctgcgccagctgatgcaggaggagcaggacctgttggcacgcgagttggaagaactcaggctgtccatgaacctgcaggaacgacgcatccgggagcagcacggcaaactgaagagcgccaaagaggaacaaagaaagctgattgccgagcagcttctttatgagcattggaaaaaaaataatcccaaactgagggagatggagcttgacctgcatcagaaacacgttgtgaatagttgggaaatgcagaaggaggagaagaagcagcaggaggcgacggctgagcaggaaaataagagatatgagaatgagtatgaaagggcccgcagagaagcactggaacggatgaaggccgaggaagaacggaggctatcgaggaccgacggccacaagcggaacccctag

SEQ ID NO: 26793 - DNA, 1497 bp, Artificial Sequence
  Description of Artificial Sequence: Synthetic coding sequence
atggccctgcccaccctgcccagctactggtgcagccagcagcggcttaatcagcagttagccaggcagcgggagcaggaagcaaggttaagacaacagtgggagcagaatagtcggtactttaggatgagtgatatatgttcctccaagcaagccgagtggtcctccaaaaccagctaccagcgtagtatgcacgcttaccagcgagaaaagatgaaggaggagaagaggcgaagtctcgaggctagacgtgagaagcttagacagctgatgcaggaggagcaggacctactggcccgggagttggaggagctgcgactgtcaatgaacctgcaggaacgcaggatccgggagcaacatgggaaattaaagtcagcgaaggaggaacagaggaaactgattgccgaacagctgctgtacgagcattggaaaaaaaacaacccaaagttgcgcgaaatggagctagacctgcaccagaagcacgtggtgaactcatgggagatgcagaaggaagagaaaaaacagcaggaggccaccgctgagcaagaaaacaagagatatgaaaacgaatacgagcgcgcacgacgggaggccctagagagaatgaaagcagaagaggagaggcgccaattggaagacaaactgcaggccgaggccctactacagcagatggaagagttgaagttgaaggaagttgaggccacaaaactaaagaaggagcaggaaaatctcctgaaacaacgttgggaactcgagaggctggaggaggagcggaagcaaatggaggctttcagacagaaggctgaactggggcgattcttacgccatcagtataatgcccagctgtctagacgaacacagcaaatacaggaggagttagaggcagaccgcagaattctgcaggcgctcctggagaaggaagacgaatcacagcgcctgcatctggcccggcgggagcaggttatggcggacgttgcctggatgaagcaggctattgaggaacagctgcagttggaaagggcccgggaagccgaattgcaaatgcttttacgagaggaagcgaaagaaatgtgggaaaaaagggaggctgagtgggcgagagaaaggtcagctcgagacaggttaatgtcagaagttctcaccgggaggcagcagcagatccaggaaaagatagaacagaaccgccgcgcccaagaagagtcactgaagcaccgcgaacagctcattcgaaatctcgaggaagtgagagagcttgccagaagagagaaagaagagtctgaaaaacttaaatctgcccggaagcaggagttggaagctcaggtggcagagcgtcgactgcaggcgtgggaggctgaccagcaggaagaggaggaagaggaagaagcaagaagagttgagcagctgagtgacgctctgttgcagcaggaggctgaaaccatggctgagcaggggtacagaccaaagccatatggacacccaaagatcgcatggaattag

SEQ ID NO: 26794 - DNA, 3090 bp, Artificial Sequence
  Description of Artificial Sequence: Synthetic coding sequence
atgcagaccaacgagggcgaggtgagcgaggagagcagcagcaaggtagagcaggaagatttcgtgatggaggggcacggcaaaacgcccccgcccggagaagagtcaaagcaggagaaggagcaagagagggaagaacagctgatggaggataaaaaacgcaagaaggaggataaaaaaaagaaagaagctacacagaaggtcaccgaacagaaaaccaaggtcccagaggttaccaaaccatccctgagccagcccactgcagcatcaccaattggaagctcaccctcccctcctgtcaatggtggcaataatgccaaaagggtggctgtccccaacggccagccgccatcagccgctaggtacatgccccgtgaagtgccacctaggtttcgctgccagcaggaccataaggtgctgttgaaaaggggccagcctccgcccccttcatgcatgctactgggaggtggagcaggccccccaccatgcacggctccaggagccaacccgaataatgcccaagtaaccggggcgttactccagagtgaatctggcacagccccagtatggagtaagagcacgccccctgcccccgataacgggacaagtgcatggggcgaacctaacgagagtagccccggctggggcgagatggacgatacaggagcctcgactaccggctggggcaacacccccgccaacgctccaaatgccatgaagcccaacagtaagagcatgcaagacggttggggtgagtcggacggtcccgtgacaggcgccaggcacccatcctgggaggaggaggaagatggaggggtatggaacactaccgggagtcagggtagtgcttcttctcacaactccgcttcttgggggcagggaggcaaaaaacagatgaaatgttcgctgaagggcggaaacaatgattcctggatgaatcccttggcaaaacaattcagtaacatgggccttttaagccaaaccgaagacaaccccagttccaagatggacctctctgtgggaagccttagcgataaaaaatttgatgttgataagcgagctatgaatttaggcgatttcaatgatatcatgcggaaagataggtctgggttccgccccccaaactccaaagacatgggtaccactgacagtgggccctattttgagaagggagggagccacggcttgtttggcaactctacagcacaatctcggggccttcatacccctgtgcagcctctgaactctagccccagcctacgggcccaggtgcctcctcagttcattagtcctcaggtgagtgccagtatgttgaagcagttcccaaattcgggactgtcccccggtttgtttaatgtgggaccacaattgagtcctcagcaaatagcgatgctcagccagctgccccagattccccagttccagttggcctgccagctgctgctccagcagcagcaacagcagcagttactgcagaaccagagaaagattagtcaggccgtgcggcaacagcaggaacaacagctggccagaatggtgagtgccttacagcagcagcagcagcagcaacaacgacagccgggaatgaaacacagtcccagccatcctgtcggacctaagcctcacctggataacatggtccccaacgccttgaatgtggggctgcccgacctgcaaaccaaggggcccattccgggatatggctccgggttcagctccggcgggatggactatggcatggtcggaggtaaagaagccggaactgaaagccgcttcaaacaatggacctccatgatggaggggctaccctctgtggctacacaggaggccaatatgcacaaaaatggtgccattgtggcccccggcaagactcgtggaggcagtccgtacaaccagttcgatatcatccctggggacactttggggggacacactggtccagccggggacagctggctgcctgcaaagtctccccccactaataaaattggcagcaagtcatccaatgctagctggccgccagagtttcaaccgggggtgccatggaaaggtatacagaacatcgacccagaatcggatccttatgttactcctggaagtgtccttggcggcaccgctacttccccaatcgtcgacacagaccaccagctgctccgggataacaccaccggctccaactcttcgttgaacacatctctgccaagccctggcgcgtggccatacagtgctagtgataattcctttacaaatgttcatagcactagcgctaaatttcctgattacaagagcacttggtcacctgatcctattggccataaccctacccatctgagcaacaaaatgtggaaaaaccacatctccagtcgcaacacaacgcccctgcctagaccaccccccggactcaccaaccccaaaccttcatccccctggagtagcaccgctcctaggtcagttagaggctgggggacccaggactcaaggctggccagtgcttctacttggtccgatggcggatctgtaagaccgtcatactggcttgtgcttcataatctcacacctcaaatagatggttctacactcaggacaatctgtatgcagcacggaccgctcttaacattccatctcaacctcacccagggcaccgccctgatccgctactcaaccaagcaagaggcagctaaagcccagactgcccttcacatgtgcgtccttgggaacacaacgatacttgcagagttcgcgactgacgatgaggtaagtcgttttctagctcaggcccagccccctactccagccgccactcccagcgcccctgcagccggttggcaaagtctggagaccggccagaatcagtccgaccctgtgggtcccgccctcaatctattcggggggtctaccgggctgggccagtggtccagctctgccggcggcagttcaggagcagatctcgccggcgccagcctgtgggggcccccaaactactcctctagtttgtggggagtgccaactgtcgaagacccccatcggatgggcagccctgcacccctgctgccaggggatcttctaggcggaggttctgattcgatatag

SEQ ID NO: 26795 - DNA, 5172 bp, Artificial Sequence
  Description of Artificial Sequence: Synthetic coding sequence
atgcgggagaaggagcaggagcgggaggagcagctgatggaggacaagaagcgcaagaaggaagacaagaaaaagaaagaggctactcagaaggtcactgaacaaaaaaccaaggtgccagaggtaaccaagccttccctgagtcaacctactgcagccagcccaatagggagcagcccgtcccctccagtaaacggtggaaacaacgcaaagcgggtggccgttcccaacgggcagccaccaagcgccgcacggtatatgcctagggaggtgccccctcgcttccgatgtcagcaggaccacaaagtgttgctgaaacggggccagccaccaccaccttcctgtatgctcctgggcggcggagcgggacctccaccatgcacagccccgggtgcaaatcctaataatgcgcaggtcactggagccctgttgcagtccgagagcgggacggccccagattcaactcttggaggcgccgctgcatctaattacgctaacagcacatggggaagcggagcctctagcaataacggcaccagtccgaacccaattcatatttgggataaagtcattgttgatggatcagatatggaggagtggccttgtatcgctagcaaggacactgaatcttcatccgaaaatacaaccgacaacaactcagcctccaaccctggcagtgagaagtcaaccctccccgggtcaaccacttcaaacaagggcaagggatcccagtgtcagagcgcttccagcggcaacgaatgcaatctcggagtgtggaaaagtgatccaaaggctaagagtgtgcagagtagcaattcgactactgaaaacaataacggtctgggaaattggagaaatgtgagtgggcaggataggatcgggccaggatctgggttcagcaactttaacccgaattctaatccatctgcctggcccgcattagttcaggagggaacctctcgaaagggggccctggagacagacaattcaaattcctctgcacaggtttcaaccgtgggccagaccagtcgtgaacagcaatcgaagatggaaaatgccggagtgaatttcgtggtatcaggcagagagcaagcccagattcacaacacagacgggcctaagaacggaaatacaaactccctgaatctatccagccccaaccccatggagaataaaggcatgccctttggcatgggactgggtaacacctcaagatccacagacgcaccaagtcagagcaccggggacagaaagaccggcagtgtcggaagctggggggcagctaggggacctagcggtacagacacagtgtccgggcagagtaatagtgggaacaatggtaataacggtaaggagcgcgaggattcctggaaaggagctagcgtccagaaatctactggcagcaagaatgacagctgggataataacaaccgtagcaccggtggctcttggaattttggcccacaggattctaacgacaacaagtggggggaaggaaataagatgacctcaggtgtctctcaaggcgagtggaaacaaccaaccgggagcgatgagctcaagatcggggaatggtctggacctaaccagcctaattcctctacaggtgcatgggataaccaaaagggtcaccccctgcccgagaatcagggcaatgcgcaagctccttgctggggcagatccagctctagtacgggctctgaagtcgggggacaatccaccggctctaaccataaggctggttcctccgattctcacaactccggcagacgctcatatcgcccaacgcacccagactgccaagcagtgttgcaaacactgcttagccgcaccgatctggatcctcgcgtcctgagcaacactgggtggggacagactcagataaaacaggacactgtatgggacatcgaagaggtgccgcgcccagaaggaaaaagcgacaagggcaccgagggatgggagagcgcagccacacagacgaagaatagtggagggtggggcgacgctccgtcccagtccaatcagatgaaatccggttggggggagttgagcgccagcaccgaatggaaggatcctaaaaacacaggcggctggaatgattataagaacaataacagcagtaattggggagggggacgcccggatgagaaaacaccttcatcctggaatgaaaatccctcaaaggaccagggatggggcggcggcagacagcccaaccaggggtggtcctccggtaaaaacggatggggggaagaagtcgaccagactaagaactcaaattgggagagctcagccagcaaaccagtgagcgggtggggggagggggggcagaacgaaattgggacttggggcaacggagggaacgcctcgctggcctctaaaggggggtgggaagactgcaaacgttccccagcctggaacgagaccgggcgtcagcctaactcttggaacaaacagcatcagcaacagcagcccccccagcaacctcccccaccgcagcccgaagcctccggcagctggggaggtcctcccccaccacctcccggtaacgttaggccgagcaatagctcatggtcttcaggtccacagcctgcaactccaaaggatgaagagcccagcggatgggaagaaccatctccacagagcatcagtcgaaaaatggatatagatgatggcacaagtgcttggggcgaccctaactcttataactacaagaacgtgaatctttgggacaagaatagccagggagggcccgcaccacgtgagcccaacctcccgactccgatgacatctaagagtgcgtcggactctaagagcatgcaggacgggtggggagagagcgacggcccagtgacaggagcaagacacccatcctgggaggaggaagaggacgggggggtctggaatactacaggatctcagggatcggccagcagccacaatagcgcgagctgggggcagggaggcaaaaaacaaatgaagtgctccctcaagggaggtaataatgattcttggatgaatccactcgccaagcaattctccaacatggggttgctctcgcaaaccgaagataatccatcatcaaagatggatctgtctgttggatccctcagtgacaagaagtttgacgtcgataagagagcaatgaatttgggcgattttaacgacataatgcggaaggaccgatccggattcaggcctccaaattctaaagatatgggcacgactgactctggcccctattttgagaaaggggggagccacggactctttggcaattctacagcacagtcccgcggtctgcacacacctgtgcagcccctcaatagttcgccatcacttagagcacaggtgccgccccaattcatatccccacaggtctctgctagtatgctgaagcagtttccaaattctggccttagccctggtctctttaacgtcggcccacagctttccccacaacagatagccatgctcagccagttgccccagatcccgcagtttcagctcgcgtgtcaactgctcctgcagcagcagcagcagcaacaactcttacagaaccagaggaagatatcccaggcagtaagacagcagcaagaacagcagctcgcccgaatggtttcagcactccagcagcagcagcaacagcagcagaggcagccaggtatgaaacacagtccaagccaccccgtcggacccaagcctcacctggacaatatggtccctaacgccctcaatgtgggtctccccgatctgcaaacgaaaggaccaattccaggctatggatcaggtttcagctctggtgggatggactatgggatggtaggtgggaaagaagcgggaacagaatctaggtttaagcagtggacctcaatgatggaaggactgccaagtgtggctactcaggaagctaacatgcacaaaaatggcgccattgtggcccccggaaagacacgaggaggttcaccttataatcagtttgatattatacccggcgatactctcggaggccacacagggccggccggggacagttggttgcccgccaaatcacccccaaccaataaaatcggatctaagagttcaaacgccagctggccccccgagtttcagcccggtgtgccttggaaaggaatccagaacatcgatccagaaagcgatccctacgtcactccaggctcagtgctgggaggaacggcaacttcccctattgtcgacacggatcatcagttactccgtgataacacgaccggcagcaactcatcactgaatacatctttgccaagcccaggggcctggccctactctgcctccgacaactcattcaccaacgttcatagtaccagtgctaaattccccgattataaaagcacttggtcaccagacccaattggccataatcccacgcacctgtccaacaagatgtggaagaatcatatcagctctcggaatacaacccctctgccgcggccaccccctggcctgaccaatccaaaaccctcatcgccttggagttcgacagcgcctcgcagcgtcagaggctggggcacccaagactctagactcgcctccgcctctacgtggagtgatggcggatcagtgagaccctcttactggctggtcctgcacaaccttacaccccagatcgatggcagcacccttagaactatctgtatgcaacacggtcctcttctgactttccacctgaatttgactcaggggaccgccctgattcggtatagtacaaagcaggaagccgcgaaggcacagaccgcgctccacatgtgcgttttaggcaacaccaccatcttggccgaattcgctacagatgacgaggtgtcgcgattcctcgcccaggctcagccacccacccctgccgcaacccccagtgcgcccgctgccgggtggcagtctttggagaccggtcagaaccaatcggaccctgtgggcccggccctcaatttgtttggtggctctactggcctcggacaatggtctagctccgcagggggaagctccggcgcggatttggccggcgcaagtttatggggcccccccaactactcttcctctttgtggggcgttcccaccgtggaagacccacataggatgggttcacccgcacctctgctgcctggggacctcttaggtggaggatcagactccatctag

SEQ ID NO: 26796 - DNA, 5172 bp, Artificial Sequence
  Description of Artificial Sequence: Synthetic coding sequence
atgcgggagaaggagcaggagcgggaggagcagctgatggaggacaaaaagaggaaaaaggaagataaaaagaagaaggaagccacacagaagcatagtaaccagaagaccgccatgcccgaggtgaccaaaccatctctgagccagccaacagcggcctcccctattggaagcagccccagtcctcccgttaatggcggtaacaatgctaaaagagtggcagtccccaatggacagccaccttcagcagctaggtacatgccaagggaggtacccccccggtttaggtgccagcaggaccacaaggtattgctaaaaagaggacagcctccgccaccctcctgcatgctgttgggaggtggggctggccctcctccatgcacagcccccggagccaatcccaacaatgcacaagtgactggggccctattgcagtctgagagcgggactgctcccgattccaccttaggcggcgctgctgcgagtaactatgctaacagcacttggggctcaggagcctcgagcaataatgggacttctcccaacccaatccacatctgggataaagtcatcgtggatggttccgatatggaagaatggccctgtattgcaagcaaagacactgaatcaagttctgaaaataccacagacaataacagcgccagtaaccctggatctgaaaagtccacattgcctggaagcacgacgtccaataaggggaagggatcccagtgtcaaagcgccagctccggcaacgagtgcaatctcggcgtctggaaaagtgatccaaaagccaaatccgttcagagcagtaacagcaccaccgagaataacaacggactgggaaactggaggaacgtctccggtcaggatcggatcggtcccggaagtggcttctctaactttaatccgaatagcaatccatcagcatggccagcattagtccaggaaggaactagccgcaaaggagcccttgagaccgacaatagtaactcctcagcccaagtaagtactgtgggccagacctcccgagagcaacagagtaaaatggagaacgctggcgtcaattttgtggtgtcaggaagagaacaggctcagatacataatacagacggccccaaaaatggaaacaccaactctttgaacctaagttctcccaatcctatggaaaataagggcatgccatttggcatggggctggggaatacctctagaagcactgacgcacctagtcagagcactggggatagaaagacagggagcgtcggctcgtggggggcagctcgagggcccagcggtaccgacaccgtgtctggacagtccaacagcggaaataatggcaacaacgggaaggaacgggaggacagttggaaaggagcttcagtccagaaaagcactgggtctaaaaacgattcatgggataacaataatcggtcaaccggcggcagctggaacttcggcccccaagattctaatgataataaatggggcgaagggaataaaatgacatcgggagtgtctcagggtgaatggaaacaacccaccggttcggacgaactgaaaattggcgaatggtcaggacccaaccagcccaactcatccactggagcttgggataaccagaagggacatccccttccagaaaatcaggggaacgcacaggccccatgctggggaagaagctctagttccactggttctgaggtgggagggcaatccactggttctaaccataaagcggggagcagcgacagccacaatagcggtcggcgttcctatcgcccaacccaccccgattgccaggcagtgctgcagaccttattgagccggacagacctggatccgcgagtgctcagcaatactggctggggacagacacaaataaagcaggataccgtatgggatatcgaagaggtgcccaggcctgagggaaagtccgacaaggggaccgagggctgggaatccgcagccacccagaccaaaaactccgggggttggggggatgcaccctcacagtcgaaccagatgaagtctggctggggtgaactgagcgcctccacggagtggaaggatccaaagaataccggagggtggaatgactacaagaacaacaattctagcaactggggtggcggccgtcccgacgagaaaacccccagttcttggaacgaaaatccgagtaaagatcagggttggggcggaggcagacagccgaaccaggggtggtcttccggcaagaatggctggggcgaggaggtggatcagaccaagaattcaaattgggaatcctcagcaagtaagccggtgtctggctggggcgaagggggtcagaacgagattggcacctggggcaacggcggaaatgcctctctggcctcgaaggggggctgggaggactgtaagcggagccccgcctggaatgaaacaggaagacaacccaacagttggaataagcagcaccagcagcagcagccgcctcagcagccgcctcccccccaaccagaggcttcggggtcatgggggggtcctcctcctccaccacccgggaacgtaagaccatctaacagtagttggtcctccggcccacaacccgctaccccaaaagatgaggagcccagcggttgggaagagccctcaccccagtcaataagcagaaaaatggatatcgatgatggcactagcgcctggggggacccaaacagctataattacaaaaacgttaacttgtgggataagaactctcaggggggccctgcaccgcgtgagcctaatctgccaacccctatgacgagtaaatcagcttcagatagcaagagcatgcaggatgggtggggtgaatccgatggccctgttacaggggctagacacccttcctgggaagaagaggaggatggaggagtctggaataccacaggttcccaaggttctgctagttcccataactccgcgagctgggggcagggagggaaaaagcagatgaaatgcagccttaaggggggtaacaacgatagctggatgaaccctctagccaagcagttcagcaatatgggtttgctctcccagacagaagataatcccagtagcaaaatggatctgtcagtgggctccctgagtgataaaaagttcgacgtggataagcgagcgatgaacttaggcgactttaacgacatcatgcgaaaagacaggagcggattccggccccccaactccaaagacatgggtaccaccgatagcggaccctatttcgaaaaggggggatcccatggcttgttcgggaactccacggctcagagccggggcctgcacacccctgtgcaacctttaaactcaagcccttcacttagggctcaagtgccaccccagtttatttcacctcaagtgtccgcatcaatgcttaaacagttcccgaattcaggcttatccccggggctgtttaacgtgggtccccagttgtcccctcagcagatagcaatgctctctcagttaccacagattccccagttccagctggcgtgccagctattactgcagcagcagcaacagcaacagcttctccagaaccagcgaaaaattagccaggcagtccggcaacagcaggaacaacagttggcgcgcatggtgtccgccttgcaacagcaacagcagcagcaacagcggcagccaggaatgaagcattctccttcgcaccccgtgggtcctaagccccacttagataatatggtacccaacgcactgaacgtcgggttgcctgacctgcaaacgaaaggtcctattccgggttacggcagtgggttttcctctgggggaatggattatggcatggtggggggcaaggaggcaggcacagaatcaagatttaagcaatggacttctatgatggaggggctccccagcgtggccacccaggaagccaatatgcacaagaatggggccatcgtcgcgccgggtaaaacgagaggcggcagtccatacaatcaattcgatatcatcccgggagacacgctgggagggcacaccggccccgccggcgattcttggctacccgctaagtctcctccgaccaataaaatcggctcgaaatcttctaatgcttcatggccccccgagttccagcccggggtgccttggaaggggattcagaacatagatcctgagagcgatccctacgtgacgcccgggtctgtgctgggcggaaccgccactagtccgatcgtggataccgaccatcagctcctgcgcgataacacaacaggctcaaacagctcgctgaatacatcactcccttctcccggggcatggccttactccgcttctgacaattccttcaccaatgttcacagtacaagtgccaagttccccgactataagagtacctggtcccccgatcctatcggccacaaccccacccacctaagtaacaagatgtggaagaatcacattagcagtagaaatactacccccctgcccagacccccaccaggactgaccaaccctaagccctcctcgccttggagtagcacagcccctcggtccgtgcgtgggtggggaacacaagatagccgactcgcaagtgcttccacatggtctgacggaggctcagtgcggccttcctattggttggtgctgcataatctgactccgcaaattgatgggtcaactctgcgaactatatgtatgcagcacgggcccttgctcacctttcacctgaacctaactcaaggaacggcactcatccgctactctacaaaacaggaggccgctaaggcccagacggctctacatatgtgcgtcctggggaataccactatactagccgaatttgccacggatgacgaagtgtcacggtttcttgcacaagcccagccccccacaccagctgctacccccagcgcgcctgcagcaggctggcagtcactggaaaccggccaaaaccagtctgacccagttggacccgcactgaatcttttcgggggtagcacgggactgggtcagtggtcaagcagtgccggtggtagctctggagctgacctggctggcgccagtctatggggaccgccaaactatagttctagtctgtggggagtacccacagtcgaggatccccaccgcatggggagtcctgccccacttctccctggggaccttctcgggggcggctcggattcaatctag

SEQ ID NO: 26797 - DNA, 3090 bp, Artificial Sequence
  Description of Artificial Sequence: Synthetic coding sequence
atgcagaccaacgagggcgaggtgagcgaggagagcagcagcaaggtagagcaggaggatttcgtgatggagggtcacggcaaaactcctccaccaggggaagagagcaagcaggaaaaagagcaggagcgagaagagcagctgatggaagacaagaagcgaaagaaagaggataagaaaaaaaaggaggcgacacagaaagtcactgaacagaagaccaaggtgccagaagtgaccaagcccagcctaagtcagcccaccgccgccagccctattgggagctcaccttctcccccggtgaacggtggcaacaatgctaaacgtgtcgccgttcccaacggtcagccaccttccgccgcccgctacatgccccgcgaagtgccaccccggttccgctgtcagcaagatcacaaagtgctgttgaagcgaggtcagcccccccccccctcctgcatgctccttggaggaggagccggacctccaccttgcacagctcccggcgccaaccccaacaatgcccaagtaaccggtgctctgttgcagtctgagtctggcactgccccagtgtggtccaagtccacacccccagcccctgacaacgggacctctgcttggggagaacctaatgaatcttcacccgggtggggggaaatggatgacactggagcttcaacaactgggtggggcaataccccagctaacgcacccaacgccatgaagccgaactctaaaagtatgcaagacgggtggggagagagtgacggaccagttactggcgccaggcatccaagttgggaagaggaggaggatgggggcgtctggaacactacggggtcacaaggttccgcttcctcccataactccgcgagttgggggcagggtggaaaaaagcagatgaaatgttcgctgaaaggtggtaataatgattcctggatgaatcctttagcaaagcagttctctaatatggggctgctgtctcagaccgaggacaaccctagtagcaaaatggacctctctgttggcagcctctctgacaaaaagttcgacgtagacaaacgggcgatgaatctcggtgactttaacgacataatgcggaaagacagaagcggctttcgtccaccaaatagcaaagatatgggtactacagacagcggcccctatttcgagaaaggagggtcacacggtctgtttggcaacagcaccgcacagtcaagaggtctccatacaccagtgcaaccgctgaattcatccccatcacttcgggcgcaggtaccaccccagttcattagccctcaggtgagtgcaagcatgcttaagcagttccccaacagcgggcttagcccaggcctttttaacgtgggtccccaactttctccccagcagatcgctatgctaagtcagctgccccagatcccacaatttcagttggcctgccaactcctgttacaacagcaacagcagcagcagctgctccaaaatcaacgaaaaattagccaagctgtaagacagcagcaggaacaacagctggccagaatggtttccgccctgcagcagcaacaacagcagcagcagagacagcccggaatgaagcactctcccagccatccggtagggccgaagcctcacttagataatatggttccgaacgccttaaacgtgggtttgcccgacctgcagacaaaagggcccataccaggctacggctcgggtttcagctcaggagggatggattatggaatggtaggggggaaggaggctggtaccgagtcgcgtttcaagcaatggaccagtatgatggagggtctgccctctgtcgccactcaggaagccaatatgcacaaaaacggcgcaatcgttgcgcccgggaaaacgagaggaggtagcccatacaatcagtttgacattattcctggagataccctgggaggccacaccggcccggctggcgactcttggctcccagccaagagcccacctacgaataaaattggctcgaaaagctcaaacgcatcatggccgcccgaattccagcctggtgtgccatggaagggtattcagaatatcgaccctgagtctgatccttacgttactcccggaagcgttctggggggaacagccacatctcccatcgtggacacggatcaccagctcctaagggataacaccactggctctaactcctcactgaacacttcgcttccaagccccggcgcatggccctacagtgccagcgacaatagttttactaacgtgcacagtacaagtgctaagtttccagactacaagtctacatggtcaccagatccgatcggccacaaccccacccacttatcaaacaagatgtggaagaaccacatttcttcccgtaacacaacaccgttgccacggcccccaccaggactgactaacccaaagcccagtagcccatggtcgagtaccgctccgaggtccgtacgaggttgggggacccaagactctaggctggctagcgcctcaacgtggagcgatggcggctctgtgcgtccttcctactggcttgtgcttcacaatctgacacctcagatagacgggtcaaccctgcggacgatctgtatgcagcatggcccattactgactttccatctgaatcttacccaggggaccgctcttatccggtatagcaccaagcaggaagctgcaaaggcgcagaccgctctacacatgtgtgtgctgggcaatacaaccatcttagccgaatttgccacagacgatgaagttagcagattcctagcacaagcacagcctcccacccctgccgcgacacccagtgcaccggccgcaggctggcagtctcttgagaccgggcagaaccagagtgatccagtagggcccgccctcaacttgtttggcggatctaccgggctaggccagtggagcagctccgctggcggatccagcggcgccgatttggccggagcctctctctgggggccgcccaattactcctcttctttatggggagttccgacagttgaggacccccaccgcatgggttcacccgcacctctgctacctggagatttgttgggaggaggttcagacagcatatag

SEQ ID NO: 26798 - DNA, 114 bp, Artificial Sequence
  Description of Artificial Sequence: Synthetic coding sequence
atgcagaccaacgagggcgaggtgagcgaggagagcagcagcaaggtagaacaggaggactttgtcatggaaggacatggtaaaacgccacctccaggggaagagtcaaaatag

SEQ ID NO: 26799 - DNA, 5502 bp, Artificial Sequence
  Description of Artificial Sequence: Synthetic coding sequence
atgcgggagaaggagcaggagcgggaggagcagctgatggaggacaagaagaggaagaaggaagataagaagaaaaaggaagccacccaaaaagtcacagaacaaaagaccaaggtgcccgaagtgaccaagccaagcttgtcacagccgactgccgcctcgccaattggcagctcaccttcacctcccgtcaacggcggaaacaatgccaagcgtgtggccgtcccgaacggacagcctccgtctgcggcccgttacatgcccagagaggtgcccccccggtttcgctgtcaacaggatcacaaagtcctactcaaacgcgggcagccacccccgcccagctgtatgctgctaggaggtggtgccggtccccccccttgcacggcccccggcgctaacccaaacaatgcccaagtaacgggtgccctcttgcagagcgaaagtgggacggcacctgactccacacttggaggcgcagcagcctccaattacgccaattcgacctggggatcaggagcatcaagtaacaacggcacctctcccaaccctatccatatttgggataaggtgattgtcgatgggtctgacatggaggaatggccctgcatcgcatccaaagacacagaatcgagtagtgagaataccacagacaacaattccgcctcaaatcccggaagtgagaagtctacactgccgggaagcactacgtcaaataaagggaaaggaagccagtgtcagtcggcaagtagcggcaacgagtgtaatttgggcgtctggaagagcgatccaaaggccaaatccgtgcagagctctaacagcactactgaaaacaacaatggcttaggtaactggcgcaacgtgtctggacaagatcggatcggaccgggaagcggctttagcaactttaaccctaactcaaatccttcggcttggcccgctctagtgcaggagggcacatcccgaaagggagccctggaaaccgataatagtaacagttcggcgcaggtgtctacagtgggacagacttctcgcgagcagcagtccaagatggaaaacgcaggggtcaacttcgtggtgtctggacgtgagcaggcgcagattcacaatacagacgggccaaagaacggcaatacaaacagcttaaatctcagctccccaaacccaatggagaacaaagggatgcccttcgggatgggactcgggaacacgagtagatccacagatgccccctcgcagagcactggagatagaaagacaggctctgtgggaagctggggagctgctcggggcccctctggcaccgataccgtctctggtcagtccaactccggcaacaatgggaacaacggtaaagagagagaagacagctggaaaggggcctctgtacagaaaagtacgggcagcaagaatgattcatgggataataataaccgaagcacgggcggctcgtggaacttcggtccacaggatagtaatgacaacaagtggggcgagggaaataagatgacctctggggtctctcagggggagtggaagcagcctaccggatctgatgagctaaagattggggaatggagtggccccaaccagcctaacagctcaacaggcgcctgggacaaccagaagggacaccctctgcccgaaaaccagggtaatgctcaggctccctgttggggcagaagcagctccagcactggctctgaggtcggaggccagtcgaccgggagcaaccacaaagcgggcagttccgactctcacaatagcgggagaagatcctaccggccaactcaccctgactgtcaggccgtgctacaaacattgctgtcacgtacggacttggacccaagagtgctatcaaacacaggctggggacagactcagatcaagcaagatacggtctgggacattgaggaggttcctaggcccgagggcaaaagcgacaaaggcaccgaggggtgggagtcagctgcaacacagacaaagaacagcggcggatggggcgatgcaccatctcagtccaaccagatgaaaagcggatggggggaactcagtgcgtccaccgagtggaaggatcctaaaaacactggtggttggaatgactataagaacaacaattcctccaattggggcggcggaaggcctgatgagaagacccctagtagctggaatgagaacccatccaaggatcagggatggggcgggggaaggcagcctaatcagggctggtcaagcggcaaaaatggttggggagaggaggtggaccaaaccaagaattctaactgggagagctctgcgtcgaagccagtcagcggctggggagagggaggacagaacgagatcggcacttggggaaacggcgggaacgccagcctggccagcaagggggggtgggaagactgtaaacgttcacccgcgtggaatgagaccggcagacagcccaactcctggaataagcaacaccagcagcaacagcccccacaacagcctcctcccccccagcctgaggcgagcggcagctggggcggccctccccctcctcctcctggcaacgtgagaccatccaattcaagttggtcgtcggggcctcagcccgccacccctaaagacgaggagccaagtggctgggaagagccctcaccacaaagcattagcagaaagatggatattgacgacggtacatctgcatggggcgacccaaactcatacaactataagaacgtcaacttatgggacaagaacagccagggtggtcctgcgccccgcgagcctaacctgccaactccaatgacaagcaaaagcgcctctgtgtggagcaaaagcacacctccagcgccagacaacggcactagcgcatggggagagcccaacgaatccagtcctggttggggtgaaatggacgataccggggcaagcaccaccggctggggaaatacaccagccaatgcccctaatgctatgaagcccaacagtaagtcaatgcaggatggatggggcgaatccgacggaccagtcacaggagcacggcatccaagttgggaagaagaagaggatggaggtgtctggaatactaccggctcacagggttcagccagtagccacaatagtgcatcttggggccagggcgggaagaagcagatgaaatgctccttaaagggcggaaataacgactcctggatgaatcccctggccaaacaattctccaatatggggctcctttcccagaccgaagacaatccgtcatctaagatggacctgtctgtggggagcctgtccgataaaaaattcgatgtagataaaagagcaatgaatctgggggattttaatgacattatgaggaaagatagatcaggtttcaggccaccgaattccaaagatatgggcactaccgattctggcccctactttgagaagcttaccctgccgttcagtaaccaggacggatgtcttggcgacgaagctccttgttcccccttttcaccttcaccgagctacaaattatccccaagcgggtctaccctccctaacgtctccttaggcgccatcgggactggtctgaatcctcagaattttgctgcgaggcagggaggctcacacggcctgttcggaaattccactgcccagtccagaggcctccacaccccagtgcagcctcttaattctagcccctccctgcgagctcaagtgccaccgcagttcatctctcctcaggtctctgccagtatgctgaagcagtttcctaacagcggattgagccccgggctatttaacgtcggcccccagttgtctcctcagcagatcgccatgctgtctcagctccctcaaatacctcagttccagctggcctgccaactactcctgcagcagcagcaacaacagcagctgttgcagaaccagcgaaagatatctcaggcagtacggcagcaacaggaacaacagttggcccgtatggtgtccgctctccaacagcagcagcagcagcagcagcgacaacctggcatgaagcactctccgtctcatccggtaggaccaaaacctcacctggataatatggtgccaaatgctctaaacgtaggcttgcctgacctgcaaaccaagggcccaatccccggatacggtagcggttttagttctggcggcatggactacggcatggtcggtggcaaggaggcaggaacagaatcccgcttcaaacaatggaccagcatgatggaaggactcccatcagtggctacgcaagaggccaatatgcataagaatggtgctattgtcgcgcccggcaagacaagaggcggtagcccatacaatcaattcgacattatacccggggacactttgggcggacacaccggtcccgcaggcgatagttggttgcccgcaaagtcacccccaaccaataaaatcggatcaaaatcatcaaacgcaagctggcctcctgagttccagccaggggtgccttggaaagggatccagaacatcgaccccgaatctgacccttatgtgaccccagggtctgttctgggcggaacagccaccagccccatagtcgacacagatcaccagctgctgagagacaacactacgggctctaactcttcactaaacacctcgctgccaagtccaggtgcctggccttattctgcctctgacaacagcttcaccaatgtccatagcacttccgcgaagttccctgactataagagcacatggtccccggatccgatcggccataatccaacacacttaagtaataagatgtggaagaatcatattagctcgcgcaacacgacgccgctcccccgccctccccctggtctaaccaatcccaaaccttcctccccgtggtcgtcaactgctccacgatctgtgcgtggctggggtacacaggactcgagactggcctccgcgagtacttggagtgacggcggctccgtgaggccctcctattggctagtgctacataacttaacccctcagattgatggctcaactctcagaaccatctgtatgcagcacgggccactgctgacctttcatctgaatcttacccaagggaccgccttgataagatactcaacaaaacaggaggctgctaaagcccaaaccgctcttcacatgtgtgtcttagggaataccacgattttagccgagttcgccacagatgacgaggtctcacggtttttagctcaggcgcaaccacccacccccgctgccactccatccgcgccggctgcaggttggcaatccctagaaactggccaaaaccagtccgatcctgtgggacccgctttaaatctgtttggaggatccacaggactgggacaatggtcctcctccgccggaggcagctcaggggctgacctggcaggcgccagtctgtggggcccccccaactattcctctagcttatggggggtgccaacggtggaagatccgcataggatgggcagtcctgcaccactgttgcccggcgatttactggggggcggatccgatagtatttag

SEQ ID NO: 26800 - DNA, 3153 bp, Artificial Sequence
  Description of Artificial Sequence: Synthetic coding sequence
atggaggtggccgtggagaaggccgtggccgccgccgccgccgccagtgcagctgccagcggcggtccatctgctgcgccgtcaggcgaaaatgaagctgagagtcgccagggtcctgactcagagagaggcggcgaagcggccagactgaatctcctggatacatgcgccgtttgccatcagaacatccagtccagggccccaaagttacttccctgcctgcattccttctgtcagcggtgcctccccgcaccccagcggtacttgatgctgccagccccaatgctgggcagcgccgagacacccccacccgtgccagcccccggcagccctgtatccggttccagcccttttgccactcaggtgggtgtgataagatgcccagtgtgctcgcaggagtgcgctgaaaggcatattattgataacttcttcgtcaaagacacgacagaggtgcccagctccacggtggaaaagtcgaaccaagtttgcacctcgtgtgaagacaatgctgaagcgaatggattctgcgtggagtgtgttgagtggctatgcaaaacctgcattcgcgcccaccagcgcgtgaaatttaccaaggaccacaccgtgagacaaaaggaagaagtttcccccgaggccgttggcgtgacctcgcagcgtcctgtcttctgccctttccacaaaaaagagcagttgaagctctactgcgaaacatgcgacaaattgacctgtagagattgccagttgctggaacacaaggagcaccggtatcagttcatcgaggaagcctttcaaaaccagaaggtcattatcgataccctgatcacaaaactgatggagaaaacgaagtacattaaatttactggtaaccagattcagaatcgaatcatcgaggtgaaccagaaccagaagcaggtggaacaggatatcaaggtagcaatattcaccttgatggtcgaaatcaacaaaaaggggaaagctcttctgcatcagcttgagtccttagcgaaagatcatagaatgaaactgatgcagcagcagcaagaagtcgccggactgagcaagcaactcgaacatgttatgcatttctccaagtgggcagtcagtagcggcagttctacagcactgctctattctaaacgcctcattacttatcggcttagacacctgctgcgagccagatgcgatgctagccccgtgactaataacaccattcaatttcattgcgatcccagtttctgggcacagaacattatcaacctgggcagcttggttattgaggataaggagagtcaacctcagatgcccaaacagaaccctgtggttgagcagaactcccaaccacctagtggcctatccagcaaccagctgagcaagttcccaacccagatcagtctcgcacagctgagactccagcatatgcaacagcaggtgatggctcagcggcaacaagtccagagaagacccgctccggtggggctgcccaaccctagaatgcagggtcctattcagcagccttctatcagtcatcagcagccaccgcctcggctaattaatttccaaaaccactcccctaaaccaaatggacccgtacttccgccccacccccagcagttgagatacccccccaaccagaacatacctcgccaggccattaaacccaacccgctacagatggcttttctggcccagcaggcaatcaaacagtggcagattagcagcggacagggcacaccatctactacaaatagcacaagttcaacgcccagctcccccacaataacgagcgccgctgggtacgacggcaaggcgtttggctctccgatgatcgacctgtcttccccagtgggtggaagttataacttgcccagcctgcctgacattgattgtagcagcacaatcatgctcgataacatcgttagaaaggacactaacattgaccacggccaaccacggccaccatccaacaggactgttcagtccccaaactcatcggtgcctagccctgggttggcaggcccggtcaccatgacttcagtacacccccccataagaagtccctctgcctccagtgtcggcagtagaggatcgtctgggtcctcctccaaacccgccggggccgattccacacataaagtccctgtggttatgctggagccaattagaattaagcaagagaactcaggtccgcctgaaaattacgactttcctgtcgtgattgtcaagcaagaatcagatgaggagagtcggcctcagaatgcaaactaccccaggtcaattctaacatccctcctcctgaactcctctcagagttccaccagcgaagagacagtgctccgatccgatgcgcccgattccaccggtgaccagccgggactgcatcaggacaattcttcaaacggcaagtccgagtggctggacccatcccagaaatcccccctgcatgtcggtgagaccaggaaggaagacgatccgaatgaggattggtgcgctgtgtgccagaacgggggagaactgctgtgctgtgaaaagtgtcctaaagtcttccatctgagctgccacgtacccacattgaccaatttcccaagtggggagtggatatgcaccttctgtagggatctgtcaaaacctgaagtagaatatgattgtgacgccccctcacataactctgaaaagaaaaaaaccgaagggcttgtgaaactcacacctatcgataaaaggaaatgtgagagactgttgctctttctatactgccacgaaatgagcctggcatttcaagatcctgtgccactgactgttcccgactactacaaaatcattaagaatcctatggacctctcaactattaagaagcgattacaggaggattattctatgtattcgaaacctgaagacttcgtggctgacttccgtttgatctttcaaaactgcgccgagtttaacgaaccagactctgaggtcgctaacgccggaattaagctcgaaaactacttcgaagaactgctcaaaaatctatacccggagaaaaggtttcccaagcctgagttccgaaacgaaagtgaggacaataagtttagcgatgacagcgatgatgattttgtgcaacccagaaaaaaacgcctgaaaagtatcgaggaaaggcagctccttaagtag

SEQ ID NO: 26801 - DNA, 1650 bp, Artificial Sequence
  Description of Artificial Sequence: Synthetic coding sequence
atggagggcccccggagcgccgcctgccgggcccggcccgccaccagccctggggccgtcgacttgacagccccacccccacccccactgttgcgcattctgaacagcagggctgcacctgcaactcgcacgtttgcggacctatgccgctcattgttgcaacccgaatcaagagtgttatgtcgtctgcagccagtgaattgttacccaccagccgcttctaccaagttgtgccccgtgggggtcatccggtgcccagtgtgctcacaggagtgcgccgaaagacatatcatagataacttctttgtaaaggacactaccgaggtgccatcttctacagtcgaaaaatcaaaccaggtgtgcacatcatgcgaggacaatgccgaggcaaatggcttttgtgtggaatgcgttgagtggctgtgtaaaacttgcatcagggcacaccaaagggtgaagttcacaaaggatcatacagtgcgtcagaaggaggaagtgagtcctgaggccgtcggcgtgaccagtcagagacctgttttttgtccatttcacaaaaaagagcagcttaaactatactgtgagacctgtgataaactcacttgccgagactgtcaattattggaacacaaggaacatagataccagtttatcgaagaggctttccagaaccaaaaagtcattatagataccttaattaccaagctgatggagaaaacaaagtatatcaagtttaccggtaaccagattcagaacagaatcatcgaggtgaaccagaaccaaaagcaagttgaacaggacatcaaagtggccatattcactctcatggtagagatcaataagaagggcaaagccctgctccatcagctggaatccctcgcaaaggatcaccgcatgaaacttatgcaacaacagcaggaagtggctgggctcagtaaacagctggagcatgtcatgcatttctcgaagtgggccgtgagcagcggaagcagtacagccctcctgtatagtaaacgtctgatcacctatcgactacggcatttgctcagagctcgctgtgatgcttctcccgttacaaataatactatccaatttcactgcgacccgtctttctgggcccagaatatcattaatctggggagcctcgtcatagaagacaaggaatctcagccccagatgccgaagcagaaccctgtagtggagcagaattcccagccaccctccgggctatccagcaatcagctttccaaattccccacccagattagtcttgcccagttgcgcctgcagcatatgcagcaacagcagccacccccacgactgatcaacttccagaaccatagtcccaaaccgaatggacccgttctgccaccccacccccaacaactaaggtacccgcccaatcagaacattccaagacaggccatcaaaccaaatcccctccagatggcgtttctcgctcagcaggcaataaagcaatggcaaattagctcaggtcaaggtacacccagtaccacacagaacatcaacactgcggcttgtactgtgttcgacgtacgcgtgcttcaccacatcccgtattgggcactaaacataagctcctccgaaagagactccttcctgtggttttctagcgtgtataacctggaatag

SEQ ID NO: 26802 - DNA, 3051 bp, Artificial Sequence
  Description of Artificial Sequence: Synthetic coding sequence
atggaggtggccgtggagaaggccgtggccgccgccgccgccgcctcagcagcggccagtgggggaccctcggccgccccttcgggagagaacgaggcagagtcccgtcagggccccgattccgagcgggggggggaagccgccaggctaaacctgctcgacacctgcgccgtgtgtcatcagaacatccaatctcgagccccaaagctgctgccctgtctccattctttctgccagcgctgcctacccgcacctcaacggtacctcatgctccctgcaccgatgctgggttcagccgagacccctccgcccgtcccggccccaggatctccagtgtcaggctctagcccattcgctacacaagtgggcgttatcaggtgtcctgtttgctcccaggagtgcgcggaacgtcatatcatcgacaacttcttcgtgaaagatacgaccgaagtcccaagtagcacagtggagaaaagcaaccaggtctgtaccagctgtgaagacaacgctgaggcaaatggattctgtgtcgagtgcgtagaatggctgtgcaaaacatgcatcagagcacaccaacgggtgaaatttaccaaagatcacacagtgcgtcagaaggaagaagtgagtcctgaagccgtgggtgtaacaagccagagacctgttttttgccctttccacaaaaaagaacagctcaagctgtattgcgagacctgcgacaaattgacttgcagagactgtcaattactggagcacaaggaacaccgctatcagttcattgaggaggctttccagaaccagaaggtgataattgacactctgattaccaagttgatggagaagactaagtacatcaaattcaccggcaaccaaatccagaataggattattgaggtgaaccaaaaccaaaaacaggtagagcaagatatcaaggtggccatcttcaccctgatggttgagattaacaaaaagggtaaggccctgttgcaccagctggagtctctagctaaggaccatcggatgaagcttatgcagcagcagcaagaagtggcgggcctcagcaaacagctggaacacgtaatgcatttttcaaagtgggctgtcagttcaggatcgagcacggccctcctgtatagtaagagacttatcacataccgcctccggcatctgcttcgcgcaaggtgtgacgcatcccccgtgaccaacaacaccattcagtttcactgcgatccttctttctgggcacaaaacattattaacctgggctctctggtgatcgaagataaggaatcgcaacctcagatgccaaagcagaacccagtggttgaacagaacagccaacctccttccggacttagtagcaatcagctgtctaagttcccgactcagataagtctcgcccagctcaggttacaacatatgcaacagcagcagcccccgcctcgtctcatcaatttccagaatcactctccaaagccaaatggccccgtgttgcctcctcaccctcaacagctgaggtacccacctaatcagaatatccccagacaggccataaaacctaatcccttacagatggcatttctggcccagcaagcaatcaagcagtggcaaattagctccggccaaggcaccccaagcactacaaattccacttcctccacgccttccagcccgaccatcacttcagctgccggatatgacggaaaagcatttggctcgcctatgattgatctgtctagccctgttggaggaagctacaacctaccctcgctgcccgacattgactgctctagcacaatcatgctggacaacatcgtgagaaaggatactaatattgaccatggtcagccaaggccacccagcaacagaacagtgcagagcccaaactccagtgtcccaagccctggccttgccggcccagttactatgactagcgtacatccacccatcagatcacctagcgcctcctctgtaggaagcaggggttcctctgggtcgtcatcaaagcctgccggagctgacagcacacacaaggtgcctgtggtgatgttagaacctatcaggatcaaacaggagaacagcggaccccctgaaaactacgacttcccagtcgttattgttaagcaggaatccgacgaagagtcccgccctcagaacgccaattacccaaggtccattttgacctccctgctgttgaattcctcacagtccagtaccagcgaggagacagtcctgagatcggacgcccctgattcaacaggagatcagccgggcttgcatcaagacaattccagcaatggaaaatcagaatggctggacccatctcagaaatccccattgcacgtcggcgaaactcgtaaagaagacgacccgaacgaagactggtgcgctgtatgtcagaatggcggcgagctgttgtgttgtgagaagtgccccaaggtgttccacctttcatgtcatgtccccactctgaccaattttccctctggagagtggatctgcactttctgccgggacttgagcaagcctgaagttgagtacgattgcgacgctccctcccacaactcggagaaaaagaaaacagaggggttagtgaaactcacacctattgataagagaaagtgtgaaaggctgctgctgtttctttactgtcacgagatgagtctggcctttcaggatcccgtgcctctcacagtgccggattactataagattatcaagaaccctatggacctctccactatcaaaaaaagactccaagaggactattctatgtattctaagccagaagattttgtggccgactttcgactcatattccagaattgcgctgagtttaatgaacccgactcagaagtcgctaatgctggaattaagctcgaaaactactttgaagagctcctaaaaaacctctaccccgagaagcgattccctaagcccgagtttcgtaacgagtctgaggacaacaaattctcagacgactccgacgacgacttcgtgcagccacgtaagaaacggttaaaaagcatcgaagaaaggcagctgcttaagtag

SEQ ID NO: 26803 - DNA, 2886 bp, Artificial Sequence
  Description of Artificial Sequence: Synthetic coding sequence
atgctgcccgcccccatgctgggcagcgccgagacccccccccccgttcccgcccccggaagtccagtctctggaagttcaccctttgctacccaggtcggcgttatccggtgcccggtctgtagccaagagtgtgcagaaaggcacattatagataacttcttcgtaaaggacacaaccgaagtcccgagctctacggtagagaaaagcaaccaagtttgcacatcatgtgaggataacgctgaagcgaacggattttgcgtggaatgcgttgagtggttgtgtaagacctgcatccgggcccaccaacgtgtcaagttcactaaggatcatacagtgagacagaaagaggaggtgagtcccgaagccgtgggggtcacgagtcagaggcccgtcttttgtccttttcataagaaagaacagctgaaattgtactgtgagacttgtgacaagctgacttgcagggactgccagttgctggagcacaaggagcaccggtaccagtttatagaggaggcctttcagaatcagaaggtcatcatagacacacttataaccaagctgatggagaaaaccaagtacataaaatttacaggcaaccagatccagaataggattatcgaggtcaaccagaatcagaagcaagtggaacaggacattaaagtcgccatcttcaccctcatggtcgagattaataagaagggaaaggcgctgctgcaccagctcgaatccctggcaaaggaccatcggatgaaactgatgcaacaacagcaggaagtggctggactaagtaaacagcttgaacacgtaatgcacttttccaaatgggctgtcagcagcggcagctctacagcactgctatactcgaaacggctcattacctaccggctgagacatctcctgcgggcccggtgcgatgcctctcccgtgaccaacaatacaatccagttccactgtgatccatccttctgggcacagaacataataaatttgggcagtctagtgatcgaggataaagagtctcagccacagatgccaaagcagaaccctgtggtcgaacagaattctcagccaccctctggactgagctcaaatcagctcagtaaatttcctacgcagatatcgctggctcagctgagactacagcacatgcagcagcaggtaatggctcaaagacagcaggtgcaacggcgcccagctcccgtgggactgcctaatcctcgaatgcaaggccctattcagcagccctccatttcacaccagcagcccccacctcgtttgataaattttcagaaccactcaccgaagcctaacggccccgttctgccgccgcacccgcagcaactccgctatcccccgaaccaaaacattccccggcaagcgatcaaaccgaacccacttcagatggcatttttggcacagcaggctatcaagcagtggcaaatttcgagcggacagggaacaccgtctacgaccaatagcactagttctacccccagcagcccaacgattacaagtgctgctggctatgacggcaaagccttcggctcccctatgattgacctcagttctcccgtagggggtagctacaatttaccatcccttcccgatatcgattgttcttcaaccattatgctggacaacatcgtgcgcaaggacacaaatatcgaccatggccagcctcgaccgccaagtaaccgcaccgtgcagtctcccaattcttccgtgccttcgcccggccttgccggacccgtgacgatgacatccgttcaccctccgataaggtctcctagtgccagcagcgtgggctcccgaggctcctctggctcttctagtaagccagccggagctgattctactcataaggtgcccgtggtcatgctcgagcccatcaggatcaagcaggaaaactcaggacctccagaaaattacgacttcccagtggttatcgtcaagcaggagagcgacgaagagtcaagacctcaaaacgccaactatcctcgcagcattctaactagtctcctgctgaattcatcgcagtcctctacctcggaggagactgtccttaggtctgacgcgccagacagcactggagatcagccaggcctccatcaggacaattccagcaatgggaagtccgagtggctggaccctagccaaaagtcccccttgcatgttggcgagacacgcaaggaggacgatcctaatgaggactggtgtgcagtgtgtcagaacggcggagaattgctctgctgtgagaagtgtcctaaggttttccacttatcctgccacgttcccaccctgacaaatttcccctccggcgagtggatatgtactttttgtcgggatctatcaaaacccgaagtcgagtatgattgcgatgcccccagccacaacagcgagaaaaagaagacagaaggacttgtgaaacttaccccgattgacaagcgaaagtgtgaacgcctactgctgtttctgtattgtcacgaaatgtccctcgccttccaggatccagtgccgttgactgtcccagattattacaagatcattaaaaatccaatggatttgtccaccatcaagaaaagacttcaggaggactactcaatgtactcaaagccagaagatttcgtggctgactttcggttaatcttccagaactgcgctgagttcaatgagccagactcagaagtggctaacgccggcattaaactcgagaactatttcgaggaactcctaaaaaatctttaccctgagaaaaggttccctaagccagagtttcgcaatgaaagcgaagacaataaatttagtgacgatagcgatgatgactttgtccagccccggaaaaaaaggttaaaatcaatcgaagagaggcagctgcttaaatag

SEQ ID NO: 26804 - DNA, 1692 bp, Artificial Sequence
  Description of Artificial Sequence: Synthetic coding sequence
atgggcctgcaggcctgcctgctgggcctgttcgccctgatcctgagcggcaaatgttcctattccccagagcccgaccagcgtcgcaccctcccccccggctgggtgtccctgggaagggctgatcccgaagaggagctcagcctgacattcgccttaagacagcagaacgtggaacggctctctgaattggttcaggcagtcagcgacccatcctcaccccagtacggcaaatacctgacccttgaaaacgttgctgatctcgtgagaccctctcctctgacccttcacacagttcagaaatggctgctagcagcgggcgcccagaaatgccatagtgtgatcactcaagacttcctgacctgctggctgtcaatccgtcaggccgaactactgcttcccggtgcagagtttcaccactacgtgggcggccccacagaaactcacgtagtgcgctccccccacccataccaactgccccaggcactcgctccacacgttgactttgtcggaggcctacaccgtttccctcccacctcgagtttgcgccagaggcctgagccccaggtgacggggaccgtaggcttgcacttaggggtgactccaagtgtgatcagaaaacgttacaatcttacgagccaggacgtgggttccggcacctccaataactcacaggcctgcgctcagttcctggagcagtattttcatgatagtgatctggcccaatttatgaggctatttgggggcaactttgcccatcaggcttctgtggcaagagtggtcggccaacagggacgcggtcgggcgggaatagaggcctctcttgatgtgcagtatctcatgtcagctggtgccaacatctcaacttgggtttacagcagccccggacgtcatgaaggccaggagccttttcttcagtggctcatgctgttaagcaacgagtccgcactcccccacgtgcacacagttagctatggcgacgacgaagatagcttatcctccgcgtatattcagcgcgtcaatacagagctgatgaaggccgccgcgagggggctgaccctgctcttcgcttccggagacagcggggccgggtgctggtccgtgtccggcagacaccaattcaggcctacattcccagccagtagtccctatgtaacaactgtgggcgggacatcctttcaggaacccttcttgattactaatgaaatcgtggattacattagcggcggaggcttttcgaacgttttccctagacctagctaccaggaggaggccgttacaaaattcctgtcttctagcccccatctgcccccgagctcatattttaatgctagtggccgggcttatcctgacgtggcagccctgtcagacggatattgggttgtctcaaatcgagtgcccattccatgggtttccggtaccagtgcatctacccctgtgttcggagggattttgtcactgataaatgaacaccgcatcctgtctggccgaccacccctggggttcttaaaccctaggctgtatcaacagcatggagcgggcctgtttgacgtcaccagggggtgccacgaaagctgtctggacgaggaagtggagggacaggggttttgtagcggacccggctgggatccagtgacgggatgggggacccccaacttccctgccctgttgaagactctgctgaacccttag

SEQ ID NO: 26805 - DNA, 1041 bp, Artificial Sequence
  Description of Artificial Sequence: Synthetic coding sequence
atgggcctgcaggcctgcctgctgggcctgttcgccctgatcctgagtggcaagtgttcttacagccctgagccagatcaaaggaggaccttgcctcccgggtgggtctccctgggacgagcagatcctgaggaggaactgagtttgacattcgcactgcggcagcagaatgtggagcgtctgagcgaactggttcaggccgtgagtgatcccagtagcccacagtacgggaagtatcttactctggagaatgtggctgatcttgttaggccctcacctcttaccttacacaccgtgcagaagtggctactggccgctggagcccagaaatgccattcagtgatcacccaggactttcttacctgctggctgtctattagacaggccgagctcctgttacccggcgctgagtttcaccattatgttggcggaccgaccgagacacatgtagtgagatctcctcatccctaccagctaccgcatattttagaagtgccatacgtgacaaccgtcggtggtaccagctttcaggagccgtttctgatcaccaatgaaatcgttgactacattagtggcgggggcttcagcaacgtcttccctcgcccctcctatcaggaagaagcagtgacaaagtttctctcctcaagcccccacctgccaccatcctcctactttaacgctagcggtagagcctatcccgatgttgctgctctgagtgatggctactgggtggtgtccaaccgggtgcccatcccatgggtctctggtacttccgcctccacccccgtgtttggcggcatcctgtcactgatcaacgagcatcgcatcttaagtggcaggcctccactcggatttcttaacccccggctatatcagcagcacggcgccgggctcttcgatgttacgcgcggctgtcatgaatcttgtctggacgaggaggtagaagggcaagggttctgttctggaccagggtgggacccagtcacagggtggggcacccctaatttcccagcactgttgaagaccctgctgaatccttag

SEQ ID NO: 26806 - DNA, 3495 bp, Artificial Sequence
  Description of Artificial Sequence: Synthetic coding sequence
atggcccagcaggccaacgtgggcgagctgctggccatgctggactcccccatgttgggggtacgggatgatgtcacagctgtatttaaagagaatttaaacagtgaccgcggtccaatgctggtgaacacactcgttgactactacctggagactagctctcaaccggccctacatatcctgaccaccctccaagaaccacacgacaagcatctactggatcggatcaacgaatatgtgggaaaagccgccaccaggctgagtattctgagtctcttggggcacgtcatcagactgcagccttcttggaaacataaactgagtcaggcacctctgctcccgagcctcttgaagtgtctgaaaatggataccgatgtggtcgtgcttactaccggtgtcctagtgctgattacgatgttacctatgattcctcagtcaggtaagcaacacttgcttgatttctttgacatttttggaagactgtcctcctggtgcctaaagaaacccggtcacgtcgcagaggtgtaccttgtccacctgcacgctagcgtgtacgccctctttcatagactgtatggtatgtacccttgcaactttgtgtccttcttgcgctctcattattcgatgaaagaaaatttagaaacctttgaggaggtagtcaagcccatgatggagcacgttcgaatacatcctgaattggtgactggatctaaggatcacgagttggaccccagaagatggaaaagactggaaacccatgatgtggtcatcgaatgcgccaagattagccttgacccaacagaggcctcatatgaggacggctattccgtaagccaccagatttccgcaaggttcccacaccgatctgccgacgtgactacctccccatacgccgacacacagaactcgtacggctgtgctacatctactccatatagcaccagtagactcatgctgctgaacatgcccggtcaacttccccagacacttagttccccctctacccgcttgattaccgagcccccacaagccaccctatggagcccatcgatggtgtgtggaatgaccacgccccccacctcccctggcaacgtccctcctgacttaagccacccttattcaaaagtcttcggaacaactgctggcggaaaaggaacgcccttgggcacacctgcaactagtccccccccagcccccctctgccactctgatgactacgtgcacatctcgctcccccaagccaccgtgacacccccaagaaaggaagaacggatggattcagctagaccatgtctgcacaggcagcatcacctactgaacgaccgcggaagcgaagaaccacctgggagcaaaggatccgtaaccctcagcgatctgcctggctttcttggagacctggcttctgaagaggactcaatagagaaggataaggaggaagcagccatctcaagagagctaagcgagatcacgacagctgaagcagagccagtcgtcccacgtggcggcttcgacagtcctttctacagagactcactacccggatcccagagaaagacacattccgctgcaagttcatcacagggtgctagtgtcaacccagaacctctccactccagtctggacaagcttggccctgacacccctaagcaagccttcactcctattgacctgccttgcggtagcgccgatgaaagccccgcgggggaccgggagtgccagacctctctggagacatcgatctttactcccagcccctgtaagattccccctccaacacgcgtcggatttggatctgggcagccaccgccttacgaccatctgttcgaggttgctctgcctaagaccgcacaccattttgtcattcggaagactgaggagttgctgaaaaaggctaagggcaatactgaagaggacggggtaccttctacgtccccaatggaggtgttggataggttgattcaacagggggcggacgcacatagtaaggagcttaacaagctcccactgcctagcaagtcagtggattggacacacttcggcgggtctcctccttctgatgaaatacggacgctcagagatcagttgctgttattgcataaccagctgttgtatgaacgctttaagcgccagcagcacgctctcagaaatagacggctccttcgtaaggtcataaaggccgctgctctcgaggaacacaatgcagccatgaaggatcagttgaagctccaagagaaggatattcagatgtggaaggttagtctgcaaaaggagcaagcacgctacaaccagctgcaggagcagcgagataccatggtgactaagttgcactctcagattcggcagctgcaacacgatagagaagagttttataaccagtcccaggagctgcagacaaagctggaggactgccgtaacatgattgcggaactgcgtattgagttgaaaaaagcaaataacaaggtgtgtcacaccgaactgctgttatctcaggtttctcagaaactatctaacagtgagtcagtgcagcagcagatggaattcctaaatcggcagctgctagtgcttggagaagtgaacgaactctatctggagcagctgcagaacaaacacagcgacaccaccaaggaagtagaaatgatgaaagcggcttatagaaaggaattggagaaaaacagaagccacgtcttgcaacagactcagcggctcgatacctcccaaaaaagaatactggagcttgagtcccatctcgcgaagaaggaccacctgcttctcgaacagaaaaagtacctcgaggatgtaaagctgcaagcaagaggacaactacaagctgctgagagccggtatgaggcgcagaagcggattacacaggtctttgaattggaaatcctagatttgtatggacgcctcgaaaaggatggcctgctgaaaaaactggaggaagaaaaggctgaagcagcggaagcggctgaggagcgtctcgattgctgcaatgatgggtgctctgattccatggtgggccacaacgaagaggcttcgggccacaatggcgagacaaagaccccccgcccaagttcagcacggggctcaagtggctctcggggtggggggggatcaagctccagttcgtctgagctgtctactcccgaaaaacctccacaccagagggctggcccgttttcttcaaggtgggagactacaatgggagaggcgagtgcttctattcccaccacagtcggaagtctgccaagcagtaaaagcttccttggcatgaaggcgcgtgaactattccgtaataaatcagaatctcagtgtgatgaagatggcatgacatctagcctcagtgaaagcctgaagactgagctgggcaaagatcttggcgtggaggccaagatccctctcaacctggatggcccacacccatcaccccccacgcctgactcagtggggcagctgcacattatggactataatgagacacaccacgaacactcttag

SEQ ID NO: 26807 - DNA, 1101 bp, Artificial Sequence
  Description of Artificial Sequence: Synthetic coding sequence
atggcccagcaggccaacgtgggcgagctgctggccatgctggactctccaatgctgggcgtgcgcgatgatgttacagctgtgtttaaggaaaacctcaacagtgacagaggtcccatgctggtaaacactcttgtcgactactatctggaaacaagcagccagcctgctctgcacatcctgacgacgctgcaggaaccccacgataaacatctcctcgatcgaattaacgagtatgtagggaaagctgccacccggttgtctatattgtctttgttgggccatgtgattagacttcagccatcttggaagcacaaactctctcaagcccccttgctcccctcattgcttaaatgcttgaagatggatacagatgtcgtggtgctaacaactggtgttcttgtgctgattaccatgctgcctatgatcccccagtccggcaaacagcatctgttggactttttcgatattttcggacgcctcagctcttggtgtctcaaaaagccagggcacgtggctgaggtatacttagtgcacctgcacgcctctgtgtacgcgttgttccatcgtttatacgggatgtacccgtgcaacttcgtgagtttcctccgatctcattacagtatgaaggagaatctggagacctttgaggaagtggtaaaaccaatgatggagcatgtgaggattcatcccgagctcgtgaccgggtctaaggaccatgagctggatcctcgccggtggaaacgccttgaaacccacgatgtggttatcgagtgcgcaaaaatctctctggaccctacagaggcttcctacgaagatggttacagcgtcagccatcaaatctccgcccgattcccccacaggtcagcagacgtcacaacaagcccttatgccgacacgcaaaactcttatgggtgcgctacctccaccccctacagcacaagccggttaatgcttctgaacatgccggggcagctgccgcagacactgtcctcccctagtactaggttaattacggaaccaccccaggtatggtgccagcttgtgtgtctgttatcaccactgctgagtggcgaggccgatcctctcggacagatttag

SEQ ID NO: 26808 - DNA, 954 bp, Artificial Sequence
  Description of Artificial Sequence: Synthetic coding sequence
atggacaccgacgtggtggtgctgaccaccggcgtgctggtgctgattacaatgctgcctatgatcccacagtccggcaagcaacacctgctggactttttcgatatcttcggacggctaagcagctggtgcctcaaaaaacccggacacgttgccgaggtctacctcgtgcacttgcacgcctctgtgtacgccctcttccacaggctgtatggcatgtatccatgtaatttcgtctcctttctgcgctcccactattctatgaaggaaaacctggaaacttttgaggaggtggtcaagccgatgatggagcatgtgcgcatccaccccgaattagtaaccgggtccaaagaccacgaactggacccccgaagatggaagcggttggagacacatgatgtcgtgatcgaatgtgcaaaaatttcactggaccctaccgaggcgtcttatgaggatgggtacagcgtctcacaccagatatcggcccgctttccacaccgctccgctgatgtgaccacctctccctatgcagatactcagaattcgtacggctgtgccaccagtactccctacagcactagcagattgatgctgctgaatatgccaggacagctgcctcaaacactgtctagcccatcaacacggttgatcaccgaacccccgcaagcgacgttatggagcccatccatggtttgtgggatgaccacaccaccgacatcacctggcaatgtaccgcctgatctgtcccacccttactctaaggtcttcggtacaacggccggcggaaagggtacccctctgggtacgccggctacgtcgccccctcctgcccccagcgtaattcggatgacaacatgtaccttccactcaccccgccctcagtcccaccctccaggtcgtaagagggagtggattttacaggatcacgtgtatacggataacactattttctag

SEQ ID NO: 26809 - DNA, 3495 bp, Artificial Sequence
  Description of Artificial Sequence: Synthetic coding sequence
atggcccagcaggccaacgtgggcgagctgctggccatgctggactcacctatgctgggtgtcagagatgacgtaaccgctgtatttaaggagaatctgaacagtgaccggggcccgatgctggtgaacactctggtagattactatctagagacgtcctcgcagcccgccctgcatattttgaccacactccaagaaccccacgacaagcatctgttggataggattaatgaatatgtcggtaaagctgctacacgcctctccatcctgagccttctcgggcacgtgatcagactgcagccgagttggaaacataaattatcgcaagccccattgctgcccagtcttctgaagtgtctcaagatggataccgacgtggttgtgcttacaactggagtactagtgctcattacgatgctgcccatgattccgcagtccgggaaacagcaccttttggatttttttgatatttttggccgcttgagctcctggtgccttaagaaacccggccatgtggctgaggtttacctggtgcacctgcatgcttcagtctacgccctgttccaccgcctgtatggaatgtatccttgcaatttcgtgagttttctgcgcagccattactctatgaaagaaaacctcgagactttcgaagaagtcgtgaaacctatgatggagcacgtgcgaatacaccccgaactggtcacaggaagcaaggatcacgagctggaccctcgcaggtggaagcgactggagacacacgacgttgtgatcgagtgtgccaagatctcacttgatccaactgaagcttcctacgaagatggctattccgtgtctcatcagattagcgcccgtttcccccataggtctgccgacgtgaccacatccccatatgctgatactcagaactcctatgggtgtgccacttccaccccctattctacgagtcgacttatgctcttgaacatgcctggtcagctcccccagacactgtcatccccttctacccgcctgattaccgaaccaccgcaggctaccctttggtcaccgtcaatggtatgtggcatgaccactcccccaacgtctccaggtaatgtgccaccagatctctcgcacccgtattccaaagtctttggcacaacggcaggtggaaaaggaacgccactcggcactccagcaacgagccctccacccgcacccctgtgccactcagatgactacgtgcatatcagcttgccccaggcaacagtaactcccccacggaaggaggaaaggatggatagtgctaggccctgcctccaccgccagcaccacctgctcaacgacagaggaagtgaggagcccccagggtctaaaggaagtgtgactctgtcggacttgccaggctttttaggggatttggcgtccgaagaagactcaatcgagaaggataaagaagaggcagcgatctcccgagagctctctgaaattaccactgcagaggctgagcccgtggtccctcggggcgggttcgattcgcctttttaccgcgattcgcttcctgggtctcaacgtaagacacattctgcagcctcatcctctcagggcgcaagcgtcaacccagagccattacattctagcctcgataagctgggacctgacacaccaaaacaggcgtttactcccatcgacctcccctgtggtagcgctgatgagtcacccgctggggacagggagtgtcaaacatctctggagacttcaatcttcacaccctcaccctgtaagatccctcctcccaccagggttggctttgggagcggtcagcctccaccgtatgaccacctgttcgaagtcgccttgccaaagactgcgcaccacttcgtcatcagaaagaccgaagagctactaaagaaggccaaagggaataccgaggaggacggcgttccatctacatccccaatggaagtcctggataggctgatccagcagggagccgacgcccactccaaggagctgaataagcttccgcttccctccaagtccgtggattggacacacttcggcggatctcctccctccgacgagattagaacccttcgcgatcaattgctgctgctacacaaccaacttctgtacgagaggtttaagcgacagcaacacgctctaaggaataggcgccttctgagaaaagtgatcaaggccgctgccttggaggaacataacgcagccatgaaggaccagctcaagcttcaagaaaaggacattcagatgtggaaggtcagcctccagaaggagcaggcaagatacaaccagttgcaggagcaacgcgacacgatggtgactaaactacactcacagatacggcagctccagcacgaccgagaagagttttacaatcaatcacaggagctgcagactaagctcgaagattgcaggaacatgatagctgagctgagaattgagctgaaaaaggccaacaataaagtatgtcacacagaactgctcctctcgcaagtcagccaaaagttaagcaacagcgaatcagtgcaacagcaaatggaattcctgaaccggcagctgctggtcttaggagaggttaatgagctctacctggaacagttgcagaataagcattccgatacaaccaaggaagtggagatgatgaaggcggcataccggaaagagttggagaagaatcgctctcatgtccttcagcagacccagaggcttgacaccagccaaaaaagaattcttgaactggagtcccacttggctaaaaaggaccatttattgctggaacagaagaaatacttagaggacgttaagctgcaggcgcgcggacaactgcaggccgctgagtcaagatacgaggctcagaaaaggatcacacaagtgttcgagctggaaatactggatctctacggtcggcttgagaaggacgggcttctgaaaaagttggaggaagagaaggcggaagccgcagaagccgccgaggaaaggttggactgttgtaacgacggatgttcggatagcatggtaggccacaacgaagaggcatcagggcacaacggcgagactaaaacccctcgcccttccagtgcacgcggctccagtggctcccgggggggtggtggatccagtagcagctcttccgagctgtcaacaccagaaaaaccgccacaccagagagccggccctttcagcagccgctgggaaaccaccatgggtgaggcgtcggctagtatacccaccacggtagggagcctgccgtccagcaagtccttcctgggcatgaaggctagagagctgttcaggaacaaatctgagtcccaatgcgatgaagatgggatgaccagttcactgagcgagtcactaaaaactgagctcggcaaggacctgggggttgaagccaaaatccccctgaatctcgacggacctcatccaagtcctcctacccccgattctgtcggtcagctccacatcatggattacaatgagacccaccacgagcattcctag

SEQ ID NO: 26810 - DNA, 849 bp, Artificial Sequence
  Description of Artificial Sequence: Synthetic coding sequence
atggacaccgacgtggtggtgctgaccaccggcgtgctggtgctgatcacaatgttaccgatgattcctcaaagcggaaagcaacatctcctcgacttttttgatatattcggtcgattgtccagttggtgcctgaagaaaccgggccatgtggctgaggtgtacctcgtacatctgcacgctagcgtgtacgcactcttccatagattgtatggcatgtatccctgtaacttcgtgtcattcctccgctcccactatagcatgaaagaaaacttggagacattcgaagaggtggtcaaacctatgatggagcacgtacggatacacccagagctcgttactgggtcaaaggaccatgaattagaccctcgcagatggaagcggctggagacccacgatgtggtgattgaatgcgcaaagattagcttggatcccacggaggccagttacgaggatgggtacagcgtgtcccatcagatctccgcaaggtttcctcaccgttctgccgacgtgactacctctccctatgctgacactcaaaactcgtacgggtgcgctaccagcactccctatagcaccagcaggctgatgctcctgaatatgccaggtcatctggctaccacagtcagacctagacccccaggccccgccgcccccggcgcggtagttgaggccgaagtggtggaggctgctgcagctgccgctgcctcctttctgcctcaacgaaatcctcacacaagaggccaggcccattccgccgtcggtgggcgccggctgtgggaaaagagattgccagcttccccgcctctgtgggcacactttccggttcaaaaggccagctgggtgtag

SEQ ID NO: 26811 - DNA, 3342 bp, Artificial Sequence
  Description of Artificial Sequence: Synthetic coding sequence
atggcccagcaggccaacgtgggcgagctgctggccatgctggacagtcccatgctgggcgtgcgcgacgacgtcacagccgtatttaaagaaaatcttaattcagaccgcggtcccatgctcgtcaacactttggtggattattatctggaaacgagtagccagcctgccctgcacattttgaccaccttgcaggagccccacgataagatggataccgatgtggtggtgctcactactggcgtgctagtgctgatcactatgctcccaatgattccacagtcaggaaagcagcacctgctcgacttcttcgatatttttgggcggctatcaagctggtgcttaaaaaagcctggccacgtggcggaggtatatctggttcacttacacgctagcgtgtacgcactctttcaccggctctacggaatgtacccttgtaatttcgtgtctttcctgagatcacactactctatgaaagaaaacctggaaacgtttgaggaggtggttaagcccatgatggagcatgtgcggatccaccccgagctggtgacaggttccaaagatcacgaactggaccctagacgctggaagcggctcgagacccatgacgttgtcattgaatgcgcaaaaattagtctcgatccaaccgaagccagctacgaggacggttattcagtttcgcaccaaattagcgccaggttcccgcaccggagtgccgacgttactacgtctccttatgccgacacccagaactcatacggatgtgccacgagcaccccatacagcacaagtcggctgatgcttctaaacatgcccgggcagcttccccagacgctctcaagcccttcaacacggttgatcacagaacctccccaggctacactctggtctccatcaatggtttgtggaatgaccacccccccgacaagccccggcaacgtcccccctgatttgagtcatccttactcaaaggtgtttggaacaactgctggaggcaaaggtacccccctggggacgccagcaacaagtccgccccccgccccactatgtcattcagacgactacgtgcacatatcccttcctcaggccacagtcactccaccaaggaaagaggagagaatggacagcgcccgcccatgcctgcaccgccagcaccacctgttgaacgaccgcggaagcgaagagccacccgggagcaagggctcagtgacactttcagacctcccagggttcttaggggaccttgcgagcgaggaggactccatcgaaaaggacaaggaggaagccgctatcagccgggaattgagcgaaatcacaacggccgaggcagagccggtagtcccccggggaggatttgattcgcctttttaccgagattcacttccggggtctcagcggaagacccactccgcggcttcctcaagccagggcgccagcgtgaatccagagccattacactcctctcttgataagctgggcccggatacccctaagcaggccttcactcccatcgacctgccttgcggaagcgcggacgaaagcccagctggagaccgggagtgtcagactagcctggagacttctattttcacccccagcccatgcaaaataccgccgcctacccgtgtcggctttggctccggccagcccccaccatatgatcatctctttgaagtggccctgccgaaaactgcacatcacttcgtgatccgtaagacagaagaactgctcaaaaaggccaaggggaacactgaggaggacggggtgccctctacttcccctatggaggtcctggacagacttattcagcagggggcagatgctcactccaaggaacttaacaagctgccattaccaagtaaaagcgtggactggacccatttcgggggtagccccccctctgatgagatcagaacattgagggaccaattgctgttgctccataatcaactcttgtacgaaagatttaaacgccagcagcacgccctaaggaacaggagactgctgaggaaggtgataaaggctgccgcgttagaggaacataatgctgcgatgaaggatcagctcaaattgcaggagaaggatattcagatgtggaaggtgtctttacaaaaagagcaagccagatataatcagctccaagagcagcgagataccatggtgacaaaattacattcccagataaggcagctgcagcacgaccgagaggaattttacaaccagagtcaagaactacagacgaaacttgaagattgccggaacatgattgccgaactgagaatagagctgaaaaaagctaacaataaagtctgtcacaccgagcttcttttgtcgcaggtcagccagaagctgagtaacagtgaatcggtgcagcagcaaatggaatttcttaataggcagttattggtgcttggtgaggtgaacgaactttatctggagcagctccagaacaaacactctgatactacaaaagaagtcgaaatgatgaaagccgcttacagaaaggaacttgagaagaatcggagtcatgtgctccagcagactcagagactggacacgagtcagaaaagaatactagagcttgaaagtcatctggcaaagaaggatcaccttctattggaacagaagaagtaccttgaagatgtgaaacttcaggctcgcggacagttgcaggccgcagagtcccggtacgaagcccaaaaacgcattacgcaggtatttgagctggagatcctcgacctgtacggtagacttgaaaaggatggcctgcttaagaaactggaggaggaaaaagcagaggcagctgaagccgctgaagagcggctcgattgttgcaacgacggatgttccgatagtatggtaggacacaatgaggaagccagcggacataacggggaaactaaaaccccccgacccagcagcgctcggggaagctccgggtcccgcggtggcggcggatccagctcatctagttccgaactgagtacaccagaaaagccaccacatcagagggccggcccctttagctcacggtgggagacaaccatgggtgaagctagcgcgagtattcccactacagtgggctctctgcctagcagcaagtcattcctgggtatgaaggcaagggaactctttagaaataagagcgagtctcagtgcgatgaagacgggatgacctcatcactgtccgagtctctcaaaaccgagctgggtaaagatctgggggttgaggccaagatccctctgaacctggacggacctcatccctcaccacccacacccgactcagttgggcagctccacatcatggattacaacgagacccaccatgagcactcttag

SEQ ID NO: 26812 - DNA, 2397 bp, Artificial Sequence
  Description of Artificial Sequence: Synthetic coding sequence
atggccctgcacagcccccagtacatcttcggcgacttcagccccgatgaattcaatcagttcttcgtgacccctcgttcctcggttgagctacctccctactccgggacagtcctctgtgggacccaggccgtagacaaactccctgacggacaggaatatcagcgcattgagttcggcgtcgacgaggtgattgagccaagcgacacactgccaaggacaccctcctatagcatttctagcaccttaaacccgcaggcccctgaatttattctcggctgtacagcttccaagattacccctgatgggattaccaaagaggcatcttatgggtctatcgattgccagtacccaggaagcgccctagccctggatggttcgtcaaatgtggaggcagaggtgcttgagaatgacggcgttagcggagggctcggccagcgtgaacgcaagaaaaaaaaaaaaagacctcctggctattattcgtatctcaaggacggcggcgacgactcaattagcacagaggccctcgtgaacggccatgctaactctgccgtaccaaacagcgtttctgccgaagacgccgaattcatgggcgacatgccccctagcgtaaccccccggacatgcaattctccccagaactctaccgattccgtttccgacatcgtccccgatagcccattcccgggagcactgggctcggacacaagaacagcaggccagccagaggggggccccggtgccgactttggccagtcttgtttccctgctgaggctggacgcgacacactgagcaggaccgcgggtgcacagccttgcgtgggcaccgacaccacggagaacctgggcgtggccaatgggcaaatcctggagtcttcaggcgaaggaacggctactaatggtgtggagctccacacaactgagagcatcgacctggaccccaccaagcctgaatctgccagcccccctgccgacgggacaggaagcgcctctggtacccttccagttagccaacccaagtcctgggctagcctgtttcacgattcgaagccttcatcctctagtcccgtggcctacgtggaaacaaaatactcaccaccagccatcagcccactggtgagcgagaagcaggtcgaggtcaaagagggtctggtgccagtgagtgaagaccccgtcgcaataaaaatcgctgagcttctggagaacgttactttgatccacaaacccgtgagcttgcagccaaggggcctgattaataaaggcaactggtgttatatcaacgccacgctgcaggccttggtggcgtgccctcctatgtaccacctgatgaaattcattcctttgtatagcaaggtgcagcgaccttgtacttctacacctatgattgatagtttcgtgaggctgatgaacgagttcaccaacatgcctgtccctcccaaaccacgacaggcattaggggacaagattgtgagagatatcaggcccggcgctgccttcgagcccacctacatatatcggctgctgaccgtcaataaatctagcctgtccgaaaaaggcagacaggaggatgctgaggagtacctgggcttcatcctaaacgggctgcatgaggagatgctaaatctcaagaaactactatcaccaagcaatgaaaaactaacgatatcgaatggtccaaaaaatcactccgtgaacgaggaggagcaagaggagcagggcgagggatccgaggatgagtgggagcaggtcggccccagaaataagacatcagtgactcgacaagctgacttcgtccaaacaccaattaccggtatattcggtggccacatccgctctgtcgtatatcagcagtcgtctaaggagagtgcgactctgcagcctttcttcacattgcagttggatatccagtctgataaaatccgaacggtgcaggacgccctagaaagtttggtcgcgagggagtctgtccaaggttacacaaccaaaacgaagcaggaagttgaaatatctcgccgggtgacactggaaaaactgcccccagtgcttgtactgcaccttaagcgcttcgtctatgaaaagactggcggatgtcagaaactgattaaaaacattgagtaccccgtggatcttgaaatcagcaaagagttactgtctcctggggtcaaaaacaagaattttaaatgtcaccgcacataccggctgttcgccgtcgtgtaccaccatggtaacagcgcaactgggggacattatacgaccgatgtgtttcagattggtctcaacggctggctgcggatcgacgaccagacagttaaggttattaatcaataccaagttgttaagccgacggccgagcggaccgcctacttgctctattaccgccgcgtggacctcctctag

SEQ ID NO: 26813 - DNA, 5355 bp, Artificial Sequence
  Description of Artificial Sequence: Synthetic coding sequence
atggccaagcccaccagcaaggacagcggcctgaaggagaagttcaaaatattactcgggttgggaaccccacgtcctaatccccgctcagccgaggggaagcagactgagttcattatcaccgccgaaatcttgcgcgaactcagcatggaatgcggcttaaataatcggattcggatgatcggccagatttgcgaggtagccaaaactaaaaagtttgaggagcacgccgtcgaagctctgtggaaggccgtcgccgatctactccaacccgagcgtcctttagaagcaagacacgctgtgttggcccttctaaaggcaatcgtccagggacagggcgagcgcctgggggtgctgcgggccctgttctttaaagttatcaaagattacccctccaacgaggatctgcatgagaggctggaggtattcaaggcactgaccgacaacggacgccatatcacctacctggaagaggagcttgccgacttcgtgcttcagtggatggacgtgggactgtcatccgaatttttgctcgtgctggtgaatctggtgaaattcaatagttgctatctggacgaatatatcgcccggatggtgcagatgatctgccttctgtgtgtgaggacagcttcaagtgtcgacatcgaggtttcactgcaggtccttgatgctgtggtgtgttataactgtcttcccgcggagtctctgcctttgttcatcgtcaccttgtgccgtacaattaatgtgaaggaactttgcgaaccctgctggaagcttatgagaaatttactcggcacccacttgggacactccgccatctacaacatgtgtcatctcatggaagatcgggcttacatggaggacgcacccctgttaagaggagctgtgttcttcgtcggcatggccctttggggagcccaccggctctatagtttgcgcaactctcccacctcagtcctcccatccttctaccaggctatggcatgcccaaatgaagtcgtgtcgtacgagattgttctctctatcaccagactgatcaaaaagtatagaaaggaactccaagtggtggcttgggacattctgctgaacattatcgagagactcctgcagcaactacaaaccttggattccccagagctgaggaccatcgtgcacgacttgctgaccactgtagaggagctatgtgatcaaaatgaattccacggctcccaagagcggtactttgagctcgtcgagcgttgcgccgaccagagacctgagagctctctgttaaatctgattagctacagagcccaatcaatccacccagcgaaggatgggtggatccaaaacctgcaggccctcatggaaaggtttttccgttcggagtccaggggcgcagtgaggattaaagtattggacgtcctgtctttcgtgctcctgattaaccgtcagttctacgaagaggagctgattaactccgtcgtaattagccagttgtctcacattccggaagataaggatcaccaagtacggaagctagcaacccagctcttggtcgatctcgctgagggttgccacactcatcactttaatagtctccttgatatcatcgaaaaggtgatggcgcgatccctttctccgcctcccgaactggaggaaagggacgtcgccgcctacagcgcatcacttgaagacgtcaaaactgcagtcctggggcttcttgtaattctccagactaagctgtacacgctgcctgcttcgcacgctacgagagtgtacgaaatgttggtatcccacattcagctccactataaacattcctatacgctgcccattgcctcctcaattcgactgcaggctttcgattttctgctgctcctgagagctgactctctccacaggctcgggttgccaaataaggatggcgtcgtccggttcagtccctattgcgtttgcgactacatggagcctgaaaggggttctgagaaaaagaccagcggacccttgtctccacctactgggcccccgggaccagcacctgcgggacccgctgtgcggcttggaagtgtcccatactccctgctctttcgcgtcctgctccagtgtctaaaacaagaatctgattggaaagtcctaaaactagtgctgggacggttacccgagtctctccgctataaggtgctgatcttcaccagcccttgttcggtggatcaactttgtagcgccctgtgcagcatgttgtctggacccaaaaccctggagcgtctgaggggcgcccccgaaggattttccaggacggatctgcacttagctgttgtgccagtccttacagccctgattagttatcacaattacttggacaaaacaaagcagcgagagatggtatattgtctcgagcaggggctcattcacagatgtgcaagccagtgcgttgtggctctgagtatctgctcagtagagatgccagacattataatcaaagccttgcctgtgttggtagtgaagctgacccacatcagcgccacagcatcgatggccgtgcccctgctcgaattccttagcaccctcgctcgattaccccatctctacagaaactttgcggctgagcaatatgccagtgtgttcgccatcagcctcccatacaccaacccctccaaatttaatcagtacattgtatgtcttgctcaccacgtcatcgccatgtggttcatccggtgtcgtcttccttttaggaaggacttcgtgccctttataactaagggcctgcgtagcaatgttctgctgtcttttgacgatacacctgagaaggactcctttcgtgcccgatctacatccctgaatgagagacccaaatctttgcgcattgcccgccccccgaaacaaggcctgaacaactctcctccggtcaaagaatttaaggagtctagcgccgctgaggcttttcgatgccgcagcattagcgttagtgaacatgtcgtgaggtctaggatccagacatctttaacgagcgcttctctcggatcggcagatgaaaacagcgtcgcacaggccgacgatagtctgaaaaacctgcatctcgagctgactgagacatgcttagacatgatggccagatatgtctttagcaactttacagccgtccctaaacgcagtcccgtgggtgaatttctcctggctggcggccgtaccaaaacctggcttgtcggaaataaactggtcaccgtcacaacctctgtcgggacagggacaagatcactccttggattggactcaggagagctgcagagcgggccagagagcagttcgagcccaggcgtgcatgtgcgccagacaaaagaagcccccgccaagctggaaagtcaggccggccagcaggttagtcgtggtgcccgggaccgcgtacgatctatgtctggtgggcacgggctccgagtgggcgctctcgacgtgccagcatcccagttcctcggtagtgccacctccccaggacctagaactgcaccagcagcgaaacccgagaaagcgagtgcgggcacccgggtgcccgtccaggaaaaaaccaatctcgcggcttatgtacccctgctgacccagggctgggcggaaatcctggttagaaggccaaccggcaatacttcttggctcatgagtctggagaacccgctcagcccattttcctcagacatcaacaacatgccactccaagagctctcgaacgcgctgatggctgcagaaaggttcaaagagcatagggacacagcactctataaatctctcagcgtgccagccgctagtacggccaaacctccgcctctgccacgatctaataccgattctgccgtggtgatggaagagggctcgcccggcgaagttcctgttttggtagagcctcctgggctggaggatgtcgaagccgccctggggatggaccgtagaaccgacgcttacagcagaagctcttcggtgtctagccaggaggagaaaagccttcacgcagaggaactggtaggccgaggaattcccatagagagagtggtttctagcgaggggggccgtccttcagttgacctgtccttccagccgtcccagccactctccaagtcttcaagttccccggagctgcagactcttcaggacattttgggggaccctggagataaggccgatgtcggccgactctcccccgaagtaaaggccagaagccagtctggcacactggacggagagtctgccgcctggtcggcgtcaggcgaggattccaggggtcagccagaaggtcctttgccatctagctcccctcggtctccaagcggactccggcctagggggtacaccattagcgactcggctccttctagaaggggtaagagggtcgagcgcgatgctctcaagagtagggctacggcttctaacgctgaaaaggtgcctggcatcaacccctccttcgtctttctccagctctatcactcccccttcttcggcgacgaatccaataaacccatcttgctaccgaacgagtcacagagcttcgagagatccgttcagttgctggaccagattccctcatacgacacccacaagattgcagttctgtatgttggcgagggccaaagcaactcagagctggcaatcctgtcaaatgagcacggcagctaccgctacactgagttcctgaccggcctcggacgtctaatcgaattaaaagactgccagcccgataaggtgtacttgggaggtctggacgtttgcggagaagatggccagttcacatactgctggcatgacgacattatgcaggccgtatttcatatcgccaccctcatgcccaccaaagatgttgacaagcacaggtgcgataagaagcggcacttaggtaacgacttcgtgtccattgtgtacaacgacagcggtgaggattttaagcttggcacaatcaaggggcaatttaatttcgtccatgttatagtgaccccgttagattatgagtgcaatctggtgagcctgcagtgccgcaaagacatggaaggcctggtggatactagcgtcgcaaagatagtcagcgaccggaatctgccattcgtcgcgaggcagatggcactgcatgccaatatggcttcacaggtgcaccactctagaagtaaccctacggatatttacccaagtaagtggattgcccggctgcgccacatcaagagactgagacaaagaatttgcgaagaggctgcatactctaaccccagtctgcctttggtacaccctccatcccacagtaaagcacccgcgcagactcctgcagaacccacacccggttatgaagtggggcagcgaaagcgactgatctcgtctgtcgaagattttaccgaattcgtgtag

SEQ ID NO: 26814 - DNA, 5295 bp, Artificial Sequence
  Description of Artificial Sequence: Synthetic coding sequence
atggccaagcccaccagcaaggacagcggcctgaaggagaagttcaagatcctactcgggcttggtacacccaggcccaacccaaggtccgccgagggtaagcaaaccgagttcattataaccgctgagatcttgagggagctgagcatggagtgcgggctcaataacagaattagaatgattggccagatttgcgaggtggccaagactaaaaagtttgaagaacacgccgtggaagcactctggaaggctgtggccgaccttctccagcctgagcgtccactggaggctagacatgccgtcctggcactcctgaaggcaattgtgcagggccagggagaacgacttggcgttctgcgagcgctctttttcaaggtcataaaagactatccttcaaacgaagacctgcacgagaggctggaggtttttaaagccctcaccgataacggtcgacacatcacatatctggaagaggagttagcggacttcgttctgcagtggatggacgtggggttgagctctgagtttctcctcgttctggtgaatctcgtgaagttcaatagctgctatctggacgagtacatcgcccgcatggtgcagatgatctgtcttctgtgtgtgcgcaccgcgtctagcgttgatatcgaggtaagccttcaggtgctggacgcagtcgtgtgttacaactgcctgcccgctgaaagcctacccctattcattgtgactctttgcaggactatcaatgttaaggagctgtgcgagccgtgctggaaactcatgagaaacttgttgggcacacacctgggacactctgcgatctacaacatgtgccacctgatggaggatagagcttacatggaggacgctccgctgttgagaggggctgtgttttttgtcggtatggctctgtggggggcgcaccggttgtattcattaagaaacagccccacaagtgtgctcccatctttttaccaggcaatggcatgtccaaacgaggtggtgagctacgaaattgtactgtctattaccagactgattaagaagtatcggaaggaacttcaggtggtcgcctgggacatcctcctcaacattatcgagagactgctgcagcagctccaaacactggattcccccgagcttcgaacaattgtgcatgacttgctcacaacagtagaggagctctgcgaccagaatgagttccatggctcacaagagcggtacttcgagctggtagagaggtgtgccgaccagcgcccggaatcctcacttctgaatcttatcagctacagagcccaatctatccaccccgctaaggatggctggatacagaacctgcaggcccttatggaacggttcttcagaagcgaatcacgcggcgctgttcggatcaaagtactggacgtcttgagctttgtactgcttatcaaccggcaattttacgaagaagagctgatcaactccgtggtcatctctcagctgagccacattcccgaggacaaagatcatcaggtcaggaagctggccacccaactgctcgttgatttagcggaaggatgccatacacatcattttaattcactgctggatataatagaaaaggttatggccaggtcattgtcacctcctcctgagcttgaggagagagatgtcgcggcttattctgcctctttagaagacgtgaagacagcggtcctcggtctgctggttatactgcagaccaaactgtataccttgcctgcgtcacatgctaccagagtctatgagatgttagttagtcatatccagctacattataagcacagctatacactccctatcgccagctctatccgcctccaggcgttcgacttcttgcttttgttgagagccgactcacttcatcggttggggcttccaaacaaggacggggtcgtgcggtttagcccttactgcgtatgcgattacatggagccggagagaggcagtgaaaagaaaacttccgggcctctgagtccacccaccggcccccccggcccggcccctgctggccccgccgtgagattaggaagcgtgccttactccctcttattcagagtgctgttgcagtgtctcaaacaggaatccgattggaaggtgctgaagctggtacttggtaggctgcctgaaagccttagatataaggtcctgatctttaccagtccttgttctgtggatcagctgtgttccgcgctgtgctctatgttatccggacctaagaccctggaaagactcagaggagccccagaaggcttctctaggactgacttgcacttggcagtggtgcctgtccttacagctctgatcagttaccataattatctggataagacaaagcaacgcgaaatggtatactgcctggaacagggcctcatccatagatgcgcatcccaatgcgtcgtggccctcagcatctgctctgtcgagatgcccgacataataatcaaggccctacctgtgctggtggtcaagctcactcatatctcggcaaccgcctcaatggccgtgcctttgttggaatttctgtctacgctggcacggctgccacacttatacaggaattttgccgccgaacagtacgccagcgtgtttgcgatctctttgccatacactaatccaagtaagttcaaccagtacatcgtttgcctggcccaccatgtgattgctatgtggtttatccggtgtcgtcttccatttcggaaggacttcgtcccttttattaccaaaggcctgcgttctaacgttttgctgtctttcgacgacactcccgaaaaggattccttccgcgccagaagcacatccctaaacgaacgacccaagagtcgtattcagaccagtctcactagcgccagcctcgggtctgctgatgaaaattccgttgcccaggcagatgacagtctgaaaaacttacatctggaactgaccgaaacctgcctggacatgatggccagatacgtgttttcgaatttcacggctgtccccaaacgctcccctgtaggggaatttttgctagctggcggccgaactaagacatggttagttggaaacaaactcgtgactgttactacctcggtcgggaccggcactcgatcgttgcttgggcttgattcaggcgagttacagtccggacctgagagtagctctagcccgggggtgcacgttcgccaaaccaaagaggcccctgccaagctggagtcccaggccggccagcaggtgagtcgcggtgcccgggaccgggtgcgtagtatgtcaggaggccatggactgcgggtgggcgcactcgacgttcccgcctcccagttcttgggctccgcaacaagtccggggcccaggaccgctcccgcggcaaagccagagaaggcttccgcaggaacacgggtcccagtccaggagaaaacaaacttggcagcgtacgtgccattgttaacccaggggtgggccgaaattctagtgcggcggcccacaggaaatactagttggctcatgtctctggaaaaccctctcagtcccttcagtagcgatattaacaatatgccactgcaggagctgagtaatgccctcatggccgctgagagatttaaagagcatcgcgacaccgccctttataagagtctttcagtgcctgccgcctctactgcaaagccgcctcctctaccacggagtaacacagtagcctccttctcttccctatatcagtcatcttgccagggtcagctgcatcgttctgtgtcatgggccgatagcgccgtggtgatggaggagggcagccccggcgaggtgcctgttctagtggagccacccgggctggaggatgtggaggccgcactcggcatggacaggcgcactgacgcttactccagatcaagctccgtctcgtctcaggaggagaaatctttgcacgctgaagaattagtgggccggggaataccaattgagagagtcgtctcaagtgagggagggcgcccaagcgtggatctgtccttccagccttcacagcctctgagcaaatccagcagcagccctgaactacagacgctgcaggacattctgggagatccaggtgataaggcagacgtcggcaggttatcccccgaggttaaagcaagatcccagtctggtactctggatggggaatcggctgcgtggtccgcttctggggaggacagtagagggcagccagagggccccctcccgtcttccagtccgaggagcccctcaggactccggcctcgtggatacacaattagtgatagtgctcccagccggagaggaaaaagggtcgagagggatgcacttaagtccagggccaccgcatctaatgccgaaaaagtgcccggaatcaacccttccttcgtcttccttcaactgtatcattcaccctttttcggtgatgaatccaataaacctattttactgcctaacgagagccaatctttcgaacgatcggtccagttgctcgatcagattccctcctatgatacccacaaaattgcagtcttgtatgtaggggagggccaaagcaacagtgaactcgctattctgtctaatgagcatgggtcctaccgttacaccgaattcctgactggcctgggccgactgatcgaactgaaggattgccagcccgataaggtgtacttaggagggctcgacgtgtgcggcgaggacggccagttcacttactgctggcatgacgacatcatgcaggccgtgttccacatagcaacactcatgcccactaaggatgttgacaaacaccgctgtgataagaaacgccatctggggaatgatttcgtgagcatcgtgtacaatgactctggggaggattttaaactgggaactatcaaggggcagttcaattttgtccatgtaatcgtcacacctttagactacgagtgtaaccttgtgtcactccaatgtcggaaagacatggagggtctcgtcgatacttcagtcgccaagattgtttcggacagaaatttacctttcgtcgcgcgtcaaatggctctccatgctaatatggcgtctcaggtgcaccattctaggtccaatcctacagatatatatccatccaagtggattgctcgcctgcggcacataaagcggctcagacagaggatctgtgaggaggcagcctattccaatccctccctgccactcgttcatcccccatctcactctaaggctcctgcacagacacctgccgagcctacaccagggtacgaagtggggcagaggaagcggctcataagttccgtggaagacttcaccgagtttgtctag

SEQ ID NO: 26815 - DNA, 5079 bp, Artificial Sequence
  Description of Artificial Sequence: Synthetic coding sequence
atggagtgcggcctgaacaaccggatccggatgatcggccagatctgtgaagtggccaagactaagaagtttgaggagcatgcggtggaggccctgtggaaagctgtagcagatcttctgcagccagagcgtccgctggaagcgcggcacgctgtacttgcattgcttaaggctatcgtccaaggtcagggcgaacggttgggggtgctcagggcgctgttctttaaggttattaaagattatccctctaacgaagacctccatgaacggctggaggtgtttaaggccctgaccgacaacgggcgccacatcacatacctcgaagaagaacttgccgacttcgtgcttcaatggatggacgttggcctgtcttctgaattcctcctggtccttgtgaaccttgtcaaattcaacagctgctatttagacgaatacatcgctcgaatggtgcagatgatctgcctactttgcgtgcgtaccgccagcagcgtcgacatagaggtttctctccaggttctggatgccgtggtatgctacaactgtttgccagcagagagcctacctcttttcatcgtgacactctgcagaaccattaatgtgaaagagctttgcgagccttgctggaaactgatgcgcaacctgctaggcactcacttaggccactccgctatatacaacatgtgtcacttaatggaagatcgcgcctatatggaagatgcgcccttgttaaggggagctgtgtttttcgttgggatggccttatggggcgcacataggctgtactccctgcgcaattctcctacctctgttctgcctagcttctaccaagcgatggcttgccctaatgaggttgttagctatgagatcgtgctctctatcacacggctcatcaagaaataccgcaaagagctgcaggttgtggcttgggacatcctcttgaatataattgagcgtctcttgcagcagctgcagaccctggatagtcccgagctgagaactatcgttcacgacctcctcactacggttgaggaattatgtgatcagaacgagttccatgggagccaggagaggtatttcgaactggtggagagatgtgcagatcaaagacctgaatcatccttgctgaatctgatctcttatagagcacaatcgatccatccagctaaagacgggtggattcaaaacctacaagcactcatggagagattcttcagatcggagtcaaggggcgccgtccgcatcaaagtcctggacgttctctcatttgttctgcttatcaacagacagttctacgaggaggaattaattaactcagtcgtgatttcccagttgtcccacatccccgaggataaagaccatcaggtccgcaagctggccacgcagcttctagtggatctggcagaagggtgccacacacaccattttaacagcctcctcgacataatagagaaagttatggccaggtctttgagtccaccccccgagctggaggaacgagacgttgccgcttacagcgccagcctggaagatgtgaagacagctgtccttgggctgcttgtcatccttcagactaaactgtatacactgccagctagtcacgccaccagggtgtacgaaatgctggtgtctcacattcaattgcactataaacattcttataccctccccatagccagctctatccgtttgcaagcctttgacttccttttgctcctgcgtgctgactcccttcaccgcctgggactgccgaacaaggacggagtggtccggttctctccatattgcgtgtgcgactacatggagcctgagagaggcagtgaaaagaagacaagtggacccctgtcgcctcctactggcccaccggggcccgcacctgctggacctgccgtacgacttggtagtgttccatactctctcctatttcgcgttttgctgcaatgcttaaagcaagagtcagactggaaagtattaaaactggttctaggacggctgcctgaatctctgagatacaaagtgctgattttcacgagcccctgttccgtggaccaactatgcagtgccctgtgcagcatgctgtcggggccaaagaccctcgaacgccttcgtggggctcctgaaggcttctcccgcaccgatctacatctggctgtggtgcccgtccttactgctctgatctcttaccataactacctggacaagacaaagcagcgagaaatggtatactgcctggaacaaggcctcattcataggtgcgcgagtcagtgcgtcgtggctctgtcgatttgcagcgtggagatgcccgatattatcatcaaagctctgcccgtgctggtagtgaaattgactcatataagcgccacggcgtccatggccgtcccactactggagttcttgtctacgctagcgcgcctgccacatctgtaccgcaacttcgcagcggagcagtatgcctctgtctttgcaatcagcttaccatacacgaatccttcaaaattcaaccagtacattgtctgcttggcacaccacgttatcgccatgtggttcatcaggtgccgcttaccattcagaaaggacttcgtccccttcatcactaaggggcttcgctccaatgtactgttgtcattcgacgacacgcccgaaaaagattcattccgagcccgttctacatccctcaacgaacgtccaaagtcacggatccaaacttctctgacctctgcttccctgggtagtgccgatgagaactccgtggctcaagcagatgactccctcaaaaatttacatctggagctgaccgagacttgtttggatatgatggctcgctacgtgttttccaactttacggcagtcccaaaaaggagcccggtgggtgagttcctgcttgccggtggaaggaccaaaacatggctggttgggaacaagctcgtgactgtcacaacctccgttggcactggcacgcgcagtctgttaggcctcgactctggcgaactacagagtggccccgagtcctctagctccccaggggttcatgtgcgacaaaccaaagaagcccccgccaagctggagtcacaggcagggcagcaagtgtcgcgcggcgctagggacagagttcggtccatgtctgggggccatggcctccgcgtgggcgcgcttgatgtccccgcctctcaatttcttggctccgccaccagccccggaccccggacggcgccggctgcaaaacccgagaaagcgtccgccgggactcgcgtacccgtgcaggaaaagaccaatctggcagcctatgtgccactgctcacacaaggctgggccgagatcctagttcggagaccgacgggtaacacatcatggctcatgtcactggaaaatcctttatcgcctttcagcagtgacattaacaatatgccactgcaggagctttctaatgctttgatggctgccgaacggttcaaggagcatagggacaccgcgctctataagtccctgtctgtaccagcagcttcaaccgccaagcctcctcctcttccacgttcaaatactgatagcgcggtcgttatggaagaggggtccccgggcgaggtgcccgtgctggtggagccgccaggacttgaggacgtggaagccgccttgggtatggataggcgtaccgatgcctattcccgcagttcaagcgtgtccagccaagaagagaaaagcctgcatgcagaagagctcgttggccggggaattcccattgagcgggtcgtgagttctgaggggggacgtccttccgtagatctctccttccaaccaagccagccattatctaagagcagtagcagcccagaactccagactttgcaggatattctgggggacccaggcgacaaggcagatgtagggcggcttagtcctgaagtcaaagccaggtcacagagtggtacactcgacggcgaatcagccgcgtggagcgcaagcggcgaggactccaggggtcagccagaaggtcccttgccgagctctagtcctcgcagtccaagtggcttgcgaccccggggctatactatttccgatagcgcacccagcagaagaggcaaacgagtggaaagggacgctcttaaatcgcgtgcaaccgcttccaatgctgagaaagttcccggtatcaacccaagcttcgtgtttctacagctataccacagtcccttcttcggcgacgaatctaacaaaccaattctgctgcctaatgagtcacagtcatttgagcgaagcgtccagctccttgatcagatcccgagctacgatacccacaagatcgcggtgctgtacgtgggagaaggccagtccaattccgagctggcaatcctcagtaatgagcatggatcgtatcgatatacagagtttctgacggggcttggtcgcctgattgagctcaaagattgtcagccagacaaagtctatctggggggacttgacgtttgtggcgaggacggtcagttcacttactgctggcatgacgatatcatgcaggccgttttccatattgccaccttaatgccaactaaagatgtcgacaagcaccgctgtgataagaagcggcatttaggcaacgacttcgtctcaattgtttataacgatagcggggaggactttaaattagggaccattaagggccagtttaatttcgtgcacgttatagttaccccactggattacgagtgtaacctggtctcccttcagtgccgtaaagacatggagggactggtcgatacaagcgtggccaagatagtgtccgatcggaatcttcctttcgtggcacggcagatggccctgcacgctaacatggcttcccaagtccatcattcgcgcagtaaccctacagacatctacccatccaaatggatagcccgattgaggcatatcaagaggcttaggcagcgtatctgtgaggaggctgcttattctaatccttccctgcctcttgttcacccgcccagccactcaaaagctcccgctcagaccccagcagagccgaccccagggtacgaagtgggacagagaaagcgcctcatcagcagcgtggaggactttaccgaattcgtgtag

SEQ ID NO: 26816 - DNA, 5226 bp, Artificial Sequence
  Description of Artificial Sequence: Synthetic coding sequence
atggccaagcccaccagcaaggacagcggcctgaaggagaagttcaaaatcttgctgggcctgggcactccgaggccaaatcctaggtccgctgaaggcaagcagactgagttcattatcaccgcggaaattttaagggaactcagcatggaatgtgggctgaataataggatcagaatgattggtcagatctgcgaagtggcaaaaaccaagaagtttgaggaacatgctgtagaggctctttggaaagcggtggcagatctcttgcaacctgaaagacccttggaagcccggcatgccgtgctggccctactgaaagccattgtccaaggccagggcgaacgacttggtgtcttacgtgctttattctttaaagttattaaagactatccttctaacgaggatctgcacgagcgcctcgaggtatttaaagccttaaccgataatggacgccacatcacttatctcgaggaggaactggctgactttgtcctgcagtggatggatgtcgggctttcaagcgagttcctcctcgtgcttgtcaacttagtaaagtttaacagttgttaccttgacgaatatatcgccagaatggtgcagatgatatgtctgctgtgcgtgcggaccgcttccagtgtggatattgaagtgagcttacaagtgttggacgctgtcgtatgctacaactgcctcccagctgagtccctgcctctcttcattgttaccctgtgtaggaccatcaatgttaaggagttgtgcgagccttgttggaaattgatgagaaatctgttgggaacccatttaggccattccgccatctacaatatgtgtcacttaatggaggatcgggcttatatggaagatgctccactgttgcgaggcgccgtgttctttgtggggatggccttgtggggggctcatcggctctattccttgagaaattcccctactagtgttctaccatctttttatcaagctatggcgtgtccaaacgaagtggtgtcctacgagattgtcctctctattacccgtctgataaagaaataccggaaggaactccaggttgtagcatgggatatcctgctgaacattatcgaaaggctgctgcagcaactgcagactctggactccccggaactacgcaccatagtgcacgatcttctcaccacagtggaggaactgtgtgatcagaatgagttccatggcagtcaggaaagatactttgaactcgtagagcgctgtgctgaccaaagaccggagtctagcctactgaatctgatctcatatcgagctcagagtatccacccggctaaggacggctggatccaaaacttgcaggccctgatggaaaggtttttcaggagtgaatcccgtggggccgtccgcatcaaggtgctcgacgtgctttcgttcgtgctcttgataaaccggcagttttatgaagaggaactgatcaatagcgtggtgatcagccagctatctcacatacctgaggataaggatcaccaagtccgtaaactcgccactcagttgctggtggatctcgcagagggttgccacactcaccacttcaattcactgctggacattatcgaaaaggttatggctaggtcattatccccaccgcccgagctggaggaacgggacgtggctgcttatagcgcaagcttagaggacgtgaagacagcggtcttgggattgcttgtgatactgcagacgaagctttacacgttgcctgcctcccacgccacacgagtgtatgaaatgctggtcagccacatacagctgcattacaaacacagttatacccttcctatagccagctctatacggctgcaagcttttgactttctgctgctgcttagggccgattccctgcacagactggggctgcctaataaggatggtgtggttaggtttagtccgtattgtgtctgcgactacatggaacccgaacgaggtagcgagaaaaagactagtggtccactcagcccacccaccgggccccccggaccggccccagctggtccagcagtcagactgggctccgtgccttactctctactttttcgagtcctgctgcagtgcctgaagcaggagagtgattggaaggtgctgaagctggtgttgggaagactgccagagagcttaaggtacaaggtgttgatctttacatctccctgcagcgtggaccagctttgcagcgcactgtgttcaatgctctccggacccaagacgcttgagagactgaggggagcgccggagggtttctcccgaaccgatctgcacctcgcagtggttcctgttttaaccgcgctgatttcataccacaattatctggataaaacgaaacaaagggagatggtctactgtctcgaacagggcctgattcaccgctgcgccagtcagtgcgtggtcgctctctccatttgcagcgtcgagatgcctgacattattatcaaggctctgcccgtgttggttgtcaagctgacccacatctctgctaccgcatccatggcagtccccttactagagttcctgagcactcttgcgcgtctgccgcacctgtatcggaactttgcagccgaacagtacgcctccgttttcgctatctctctcccctacacgaacccctccaagtttaaccaatatatcgtgtgcttagctcaccatgtaatcgcgatgtggttcatccgttgccggctcccttttagaaaggattttgtgcccttcatcaccaagggcctccggagtaatgtgttacttagcttcgacgacacccccgagaaagacagcttcagagcacgctctacctccctcaatgaacgccccaagtctcgtatccagacctctctgacctccgccagtcttggatctgcggatgaaaattccgttgctcaggcagacgacagcttgaaaaacctgcatctcgaactgacagagacttgcctggatatgatggctcggtatgtgttttccaacttcaccgctgtgcctaaaaggtcaccagtgggtgagtttttgctggccggcggccggacaaaaacatggttggtgggcaataaattggtgacggttacaacatctgtcggaactggaacacggagtttgcttggtctggactcaggggagctgcagtctggccccgaaagctcctcttctcctggtgtgcacgtacgacaaactaaggaggctcccgccaagcttgagtctcaggcaggacagcaggtgtccagaggcgctcgtgaccgggtgagatctatgtccgggggccatggcctgagggtcggcgcactggatgtacccgcatcacagttcctcgggtcggcaacgtctccaggccccaggaccgctccagctgccaaaccagagaaggctagcgcaggcaccagagtcccggtgcaagaaaaaaccaatctggccgcatacgtccctttgttaacccaaggatgggccgaaattttagtacgacgcccgactggtaacacatcctggttgatgtcactggagaaccctctctctccattctcctctgacatcaataatatgcctctgcaggaactgtccaatgccctaatggctgcggaaaggttcaaagagcatcgcgatacagcactgtataaaagcctgtccgtacctgccgcctcaaccgcaaaacccccccccttgccacggtccaacactgactcagctgtggtgatggaggaggggagcccgggggaggtccccgtccttgtagaacctcctggcctcgaggacgtcgaggccgcactgggtatggatcgcagaaccgacgcatactccaggtctagtagcgtctcttcccaggaggagaaaagtttgcatgctgaggagctcgtcgggagaggcattccgattgagcgggtagtctccagtgagggggggcgccccagcgttgacctgtctttccagcccagtcaacccttatcaaaaagcagctcgagtcctgagctgcagactctccaggacatactcggggaccccggtgataaggccgatgtcggccgtctctctcccgaagttaaggctagatcccagtccggtactctcgacggcgaatcagccgcctggagcgctagtggcgaggactcccgcggacagccagagggaccccttccctctagcagtccgcgaagccctagcgggttacgcccccggggatatacaatctctgattcagcccctagcaggcggggcaagagggtggagcgtgacgctctgaaaagtagagctactgccagcaatgccgaaaaagttcctggcatcaacccctcttttgtgtttctgcaactgtatcacagccccttcttcggggacgagtccaataagcccatcctcctgcctaacgaaagccagagtttcgaacggagtgttcagttacttgatcaaatcccttcttatgacacgcacaaaatcgccgtcctctacgtgggagagggtcagtcaaactccgagctcgccatcctttccaacgagcatggctcataccgatacaccgaattcctgaccggtctgggcaggttaatagagcttaaagactgtcagccagacaaagtgtatctgggaggcctggatgtctgcggcgaggatgggcagttcacatattgttggcatgacgacataatgcaggccgtattccacatcgccacgctcatgcccaccaaggatgtagataagcatcggtgtgacaagaagaggcacctaggcaatgactttgttagcatcgtttataatgacagtggtgaagactttaagctgggcaccattaaagggcagtttaactttgtgcacgtcatcgtcactcccttagactatgaatgcaatctggtttcacttcagtgtagaaaagacatggaggggcttgtggatacgtccgtcgcgaagatagtgtcagatcgaaatctgcctttcgttgcccgacagatggccctccatgctaacatggcctcacaggttcaccactccaggtctaatccaaccgatatctacccaagcaaatggatagcacgcctgcgacatattaagcgtttacgacagcggatctgcgaggaggccgcttattctaatccaagccttcctctcgtgcatccaccttctcactcgaaagcccctgctcagacccctgctgaacccactcccggatacgaggttgggcagcggaagcgattaatttctagcgttgaagattttacggagtttgtctag

SEQ ID NO: 26817 - DNA, 5115 bp, Artificial Sequence
  Description of Artificial Sequence: Synthetic coding sequence
atggccaagcccaccagcaaggacagcggcctgaaggagaagttcaagatcctactgggactgggtacacctcgccctaaccctagatcagctgaaggaaagcagacagagttcattattacggccgagattctgcgtgagctgtcaatggagtgcggactgaacaacaggattcggatgattgggcaaatttgtgaagttgccaaaaccaagaaatttgaggaaggcgaaagactaggtgtgttgcgcgcattgttcttcaaagtgataaaggactaccctagtaatgaggatctccacgagagactcgaagtctttaaggctctgactgacaacgggcggcacattacctacctcgaagaagagttggctgatttcgttttacagtggatggatgtgggtctctcttcagaatttctgttagtgttggtgaacctagtgaagttcaactcgtgctacctggatgaatatatagcacggatggttcagatgatatgccttctttgcgtcaggactgcttctagcgtcgacatagaggtctccttgcaggtgctggatgcagtggtttgctacaattgtctccccgctgagagcctccccctttttatcgtgaccctgtgtaggaccattaatgtgaaagagctgtgtgagccctgctggaagttgatgcggaacctgctgggcactcatctaggacattctgccatatataatatgtgtcaccttatggaggatcgcgcttatatggaggatgcccctctactgagaggggctgtgttcttcgttgggatggctctgtggggcgcacacagactatactcactgcgcaacagccccacaagtgtcctccctagtttttaccaggcaatggcctgccccaacgaagtggtgagctatgagattgtcctcagcatcacccgactcatcaagaaataccgcaaggagctgcaggtagtcgcttgggatatcctgctgaacattatagaacggctgttacaacagctgcagaccttggattcccctgaattacggaccattgtgcacgatcttctgacaacagtggaggagctctgtgatcagaacgaatttcacgggtcccaagagcgctattttgagctggtggagaggtgtgcggatcagagaccagaaagcagcttgttgaacctgatttcgtacagagcccaaagtatccacccagccaaagacggatggattcagaatcttcaggcccttatggagaggttcttccgatctgaatccagaggggccgtgaggatcaaggtacttgacgtcttgtctttcgtgcttctgattaatagacagttctacgaagaagagcttatcaatagtgtggtgatatctcaactgagccacatcccggaggataaagatcatcaggtgagaaagctagccacccagctcttggttgatctcgccgaaggttgccatacccatcacttcaactctctgctcgacatcattgaaaaagtgatggctcggtcactgtctccccctccggagctggaggagcgagatgtggcagcatattctgcttccctggaggacgtgaagactgctgtgctcggtctgctagttatcttacaaaccaaattatacacgttgccagcatcacacgccacaagggtctacgagatgctggtgagccacatccagctgcactataaacacagttacaccttgccgatcgcctccagcattcggctacaggctttcgattttctcctgctcttgagagccgactctctgcaccggttaggcctccccaacaaagatggcgtcgtgagattcagcccctattgcgtgtgcgactacatggaacccgagcggggctctgaaaagaaaacttccggtccattatcccccccaaccgggccacccggtccagcccctgcaggtcctgcagtcaggttagggtccgtgccttattcactcctgttcagagtcctcctgcaatgtctgaaacaggagagcgattggaaggtcttaaaactcgtgctcggacgtctccccgaatcgctgcggtataaagtgttgatatttaccagtccttgctccgttgatcaactgtgctcagccctttgctcaatgctatcagggcccaaaaccttggagagactgcgtggcgcaccggaaggtttttcaaggacggacttgcatcttgccgttgtcccggtccttacagccctgatttcctatcataactatctggacaagacgaagcagcgcgagatggtctattgcttggagcaaggcctaatccacagatgcgcatcgcaatgcgtggttgcgctgagcatttgttccgtggagatgcccgacattattatcaaggccctgcctgtgctggtcgtcaagctgacgcatatctcggccacggcatccatggccgtaccactgctcgagttcctctcaaccctagcacggctcccccacctctacagaaattttgccgccgagcagtacgccagcgtgtttgctatctcgctgccctacaccaaccctagcaagttcaatcagtatatcgtttgtttagcacatcatgtcatcgcaatgtggttcattcggtgccggctccccttccgcaaggatttcgtgccctttattacaaaaggattgaggtcaaatgttctgctgagcttcgatgacacgcccgagaaggattcgtttcgcgcccgtagcacttccctaaacgaaaggcccaaatcccggattcagacttcactgacctcggcgtcacttggatccgctgacgagaattccgttgctcaggcagacgacagtctcaaaaacctgcacctggagttaacagagacgtgcctggatatgatggcccgatacgtgttcagtaactttacagccgttcctaagcgctccccagtgggcgaattcctactggcaggtgggcggaccaagacctggctggtaggaaacaagctggttaccgttaccactagcgtgggaaccggcaccaggagcttactgggattggacagcggtgagctgcagtccgggcccgaatctagctctagccccggcgtgcacgtgaggcaaaccaaggaggccccagctaaactggaatcacaggcgggccagcaagtgtccaggggtgccagggatcgcgtgcggtcaatgtcgggagggcatgggctgagagtgggtgctcttgacgtgccggcaagccagtttcttgggtccgccacatctcctggtcctcgcaccgctccagccgctaagccagagaaggccagtgccggaacgagggtgcccgtgcaggagaaaactaatctggccgcctacgtacctctgctgacccaggggtgggcagaaattctggtgaggagaccgactggcaataccagctggttaatgtccctcgaaaatcccttgtctccattttcgtcggatatcaacaatatgcctttgcaggagctgtccaatgctttgatggctgcagagagattcaaggagcacagggacacggctttgtataagtccttatccgtgcctgcagcctcgacagcgaagcctcctccgctgccacgcagtaacacagacagtgccgtcgtgatggaggagggcagccccggagaagttcctgtgctcgtggaacctcccgggctcgaagacgtggaggccgcgctagggatggacagacgtactgacgcctattcaagatcctcttctgtgtccagccaggaggaaaagtctcttcatgcggaagagttggtggggcgcggcatccccattgaacgagtggtgagcagcgagggggggcgccctagcgtggatctttcattccagccctcacagccactttctaagtctagctcttccccagagcttcagacccttcaggatattcttggcgacccgggcgacaaggcagacgtcggccgcctgagcccggaggtaaaggctagatcgcagagtgggactttagatggagaaagtgccgcctggagtgcctcaggggaagactctcgcggtcagccagagggccccctgcctagcagtagtcctcggagcccaagtgggctcaggcctcgcgggtacactataagcgactctgccccatcaaggagaggtaaacgcgtggagagagacgcgctcaagtcccgggccactgcctcaaacgctgaaaaggtgcctggaatcaatcctagctttgtgtttctccagctgtatcattcaccgttcttcggtgacgaaagcaataagccaattctcctcccaaatgagtcccagtcattcgagcgctcggtccagctgctggaccagatcccatcgtatgatactcataaaattgccgttctttacgtaggagaaggacagagcaatagcgaactagcgatactctctaatgagcacggaagttacagatataccgagtttttgactggcctcggccggttaatcgaactcaaggactgtcagccagacaaagtctatcttggtggactcgacgtgtgtggtgaagacggtcaattcacttactgttggcatgatgacataatgcaggctgtctttcacatcgccacactgatgcccacgaaggacgtggacaaacatcgctgcgacaaaaagagacacctcggcaatgatttcgtttccattgtctacaatgacagcggcgaggactttaagctgggcaccattaagggacagtttaacttcgtgcacgtcattgtgacccctctggattatgagtgcaaccttgtgagcttgcaatgtcggaaggatatggagggtttggtcgatactagcgtggccaagatcgtgtcagaccggaatttgccatttgttgcaaggcagatggctttacatgccaatatggcgagccaggtccaccattcaagatcaaaccccacagacatctaccctagcaaatggattgcaaggctccggcatattaaacgcctccgtcagcgcatctgtgaggaagccgcatacagcaatccctcgctccctttggttcacccccccagtcactcaaaggctccagcccagacacccgctgaacccacccctgggtacgaagtggggcaaaggaagcggcttatcagctctgtggaagatttcactgagtttgtctag

SEQ ID NO: 26818 - DNA, 516 bp, Artificial Sequence
  Description of Artificial Sequence: Synthetic coding sequence
ttcccccgggacctgagcctgatcagccccctggcccaggccgtgagaagctcctcccgcacgcccagcgacaagccagtggcacatgtggttgcaaacccacaggctgagggtcagctccagtggttgaatcgcagggctaacgctttattggcgaatggcgtcgagctgagagacaaccaacttgttgtcccttcagaagggttgtaccttatttatagccaggttctgttcaaaggacagggatgcccaagtacgcacgtgttactcactcacaccatctcgaggatcgccgtaagttatcagactaaagtaaaccttctgtctgctatcaaaagtccatgccagagagagacaccggagggagcggaagctaaaccatggtacgaaccaatttacctggggggcgtttttcaactggagaaaggagatcggctaagtgccgagatcaatcggcctgattatctggacttcgcagaaagcgggcaggtgtatttcgggatcatcgcactctag

SEQ ID NO: 26819 - DNA, 306 bp, Artificial Sequence
  Description of Artificial Sequence: Synthetic coding sequence
atggccatgatggaggtgcagggcggccccagcctgggccagacctgtgtgctgattgtaatctttacggttctattgcagagcctgtgtgtcgcggtgacctacgtatatttcactaacgagctgaaacagatgcaggataagtactcaaaatccggaatcgcctgttttctgaaagaggacgatagttactgggacccaaatgacgaggagagcatgaactccccttgctggcaggtcaagtggcagttgcgccagcttgtgagaaaaaccccccgtatgaaaaggctgtgggcagcaaaatag

SEQ ID NO: 26820 - DNA, 846 bp, Artificial Sequence
  Description of Artificial Sequence: Synthetic coding sequence
atggccatgatggaggtgcagggcggccccagcctgggccagacctgcgtgctcatcgtgatctttactgttttgctgcagtccttgtgtgtggccgttacatacgtttactttacaaatgagctcaaacaaatgcaggacaagtattctaagagtggcatcgcctgttttctcaaggaggatgatagctactgggacccgaacgacgaggagtcaatgaacagtccttgttggcaggtgaagtggcagcttagacagttggtgagaaaaatgatcctacgaacgtcagaggaaaccatttccacagtccaggagaagcagcagaatattagtcccttggtgcgcgagaggggtccccagcgggtcgcagctcacattacaggaacccgcgggcgatcaaatactctctcaagccccaattccaagaatgaaaaagccctgggacgaaagattaattcttgggaatcctcccggtccggacatagcttcctgtcaaatctgcacctgcgaaacggtgagctggtgattcatgagaagggtttttactatatctactcccagacctatttccggttccaagaggaaattaaggagaacacgaaaaatgataaacagatggtgcaatacatttataagtacacctcctatcccgatccgatccttttgatgaagagcgctcgcaactcatgttggtcaaaggatgccgaatacggcctttactcaatctatcaagggggcatttttgagctcaaagaaaatgaccggatttttgttagcgtgactaacgagcacctgattgatatggaccatgaggcctccttctttggggctttcctggtgggctag

SEQ ID NO: 26821 - DNA, 858 bp, Artificial Sequence
  Description of Artificial Sequence: Synthetic coding sequence
atggacgacagcaccgagcgggagcagagccggctgaccagctgcctgaagaaacgagaggagatgaagctgaaagaatgcgtatcaattctccccagaaaggagagcccaagtgtgcgttcctccaaagacgggaaacttctagctgcaacccttctgcttgctcttctgagctgctgcctgacagtcgtctccttttaccaagtggccgctttgcagggtgacctggcctccttaagagctgaactgcagggccatcatgcagaaaaactgcccgctggtgctggagcacctaaggccgggctggaggaagcaccagccgtgacggccggccttaaaattttcgagccacctgctccgggagagggtaatagctcacagaactcccggaacaagcgagcagtgcagggccccgaggagactgttacccaggactgcttgcagctcatcgcggactctgagaccccaaccatccagaagggttcctatacattcgtcccgtggctactctcattcaagaggggatccgcactggaggagaaggagaataagatcctcgttaaggaaaccggatacttttttatttacggacaagttctgtatacggacaaaacctacgctatgggccatctgatccagagaaagaaggtgcacgtattcggcgacgaacttagcctagtcacactgttcaggtgcattcaaaatatgccagagactctgcctaataacagctgttatagcgcgggcattgccaagttggaggagggggatgagctgcagctggctatcccccgcgagaacgctcagatcagtttagatggcgacgtgactttctttggagctctgaaattactgtag

SEQ ID NO: 26822 - DNA, 801 bp, Artificial Sequence
  Description of Artificial Sequence: Synthetic coding sequence
atggacgacagcaccgagcgggagcagagccggctgaccagctgcctaaagaagcgggaggaaatgaagctcaaggaatgcgttagcattctccctagaaaggaatcgccttccgtcagaagtagcaaggacggcaagctcctcgctgctactttgttactcgccctgctgtcctgctgcctcaccgttgtgagtttctatcaggtggcagctcttcagggagacctagcctctctgagagcagagctgcagggccaccacgcggaaaaacttcccgcaggcgcgggcgctcctaaggcagggctggaggaggcaccggccgtgaccgcgggcctcaaaatctttgagcctcctgctcctggggaaggaaatagttcccagaatagccgaaacaagagggccgtgcagggcccggaggaaacaggctcatacacatttgtcccatggctattgtctttcaagaggggatccgccctcgaggagaaggaaaacaaaatcttggtgaaggagacggggtacttttttatttatgggcaagtcctctataccgacaaaacctacgcaatggggcacctgatccagaggaagaaagtccatgtctttggtgatgaacttagcctcgtgacactctttcgctgtatccagaacatgccagaaacactgcctaataacagctgttactctgccgggattgccaaactcgaggaaggcgatgaactgcagctggcaatacccagggagaacgctcaaatctctttggacggagacgtgacgttctttggggccctgaaactgctttag

SEQ ID NO: 26823 - DNA, 495 bp, Artificial Sequence
  Description of Artificial Sequence: Synthetic coding sequence
atggacgacagcaccgagcgggagcagagccggctgaccagctgcctgaagaagagggaggaaatgaaactcaaggagtgcgtgagtattctaccccggaaagaatctccctcggtgcggtcctctaaggacggcaaactgcttgctgccactctgctcctggccttattgagttgttgtctcacagtcgtgtccttctatcaggtcgctgccctgcaaggagacctcgcttcgctacgggctgagttacaggggcatcatgcggagaaactgccagccggagctggcgctcctaaggccgggctggaagaggccccagctgtaacggcaggcctgaagatattcgagccgccggcgcccggagaggggaactctagccagaattccaggaataaaagggcagtgcaagggcctgaagagaccgtgacccaggattgtctccagttgatcgccgactccgagaccccgacaatccagaaaggtttcatctactag

SEQ ID NO: 26824 - DNA, 2700 bp, Artificial Sequence
  Description of Artificial Sequence: Synthetic coding sequence
atgcccaccctgggctggctgcccgagaaccgggacatcagcgaggaccaaagttcagccgagcaaacacaggccttggcaagtcaagctagtcagttcttggctaaagtcgagtcttttgaacggcttattcaggccggacgtctgatgccacaggatcaggtgaaagggttccaaaggctgaaagcagcccacgccgctctagaggaagaatatctaaaggcctgtagagaacagcacccagcacagcctctcgcgggttccaaaggcactccaggtaggttcgatccccgcagagagctggaagccgagatctacagactcggctcatgcctggaggagctgaaggagcacattgaccagacacagcaggaacctgaaccgccaggcagcgattctgcactcgactctactcctgcactaccctgtctccatcaaccgacacatctgcccgcccccagtggacaggccccgatgcctgcaataaaaacctcctgcccagagcctgccacaactaccgcagctgcttccactggcccttgcccacttcacgtaaacgtcgaagtaagtagcgggaacagcgaagtggaagatcgcccccaggacccgctcgcgcgcttaagacataaagaactccagatggagcaggtgtatcacggactcatggaacgatacttgtccgtcaaatctctaccggaggccatgaggatggaggaggaagaagagggggaagaggaagaagaggaggagggtggaggtgattcacttgaagtcgacggtgttgcagctaccccaggcaaagccgaagcaacacgcgtcttgcctaggcagtgcccggttcaagctgaaaaatctcacggtgcgcctctagaggaagccacagaaaaaatggtctctatgaagccaccagggttccaggcgtcactggcccgtgacggccatatgagcgggctcgggaaggcagaagccgcaccccccgggcctggagtgccgcctcaccctcctgggaccaagtctgccgctagccatcaatccagcatgactagtctggagggctctggaatatcggaacgattgccccagaaaccactccaccgtgggggtggcccacaccttgaggaaacttggatggcctctcctgaaaccgactcgggcttcgtgggatctgagactagccgtgtttcccccctgacccagaccccagagcatcgactctcgcatatcagtacagctggaaccctggcacagcccttcgctgctagtgtccctcgcgacggtgcctcgtaccccaaggctcgcgggagcctgattccccggcgggctaccgagccttccacacctcgcagccaggcccaacggtacctctcatcaccaagcgggcctctgagacagagagcccccaatttcagcctcgagaggacccttgccgctgaaatggcagtgccagggtcggaatttgagggacataaaaggatctcagagcagccgctgcctaataaaacgatctcaccaccccccgctcccgcacctgccgcggccccgctcccctgtggccccacagaaactattccaagcttcctcttaaccagggccggcagagatcaagccatctgcgaacttcaggaagaagttagcagactgagactcaggctcgaagattccctgcaccaaccactccagggctcccccaccaggccagcaagtgcctttgatcgacccgccaggaccaggggcagacctgcagattcacccgccacttggggctcacattatggttccaagagcactgaacgtcttcctggcgagccccgaggggaagaacaaattgtgcccccgggccgacagagagccaggtcaagtagcgtgcccagagaagtgctgcggttgtcattgagcagtgagtcagagctccctagtctgccccttttctcagagaagtcgaaaactactaaggatagccctcaagcggcacgcgacggcaagagaggggtgggatctgcgggttggcctgatcgggtaacttttcgcgggcaatataccggacacgaataccatgtgctcagtcctaaggcagtgcccaagggaaatggaaccgtgtcctgtccgcactgccgacccatcagaacccaggacgccggtggtgcagtcacgggcgatccattgggaccccctcctgccgatacactacagtgcccgttatgcgggcaggtgggaagccctccggaagctgatgggcccggctctgctacctcgggagccgagaaggctactaccagacggaaggcatcctcaacaccgtcccccaagcagaggtctaagcaggctggctctagcccgaggcctccaccgggactctggtacttagcaacggccccccctgctccagcccctcccgccttcgcctatatctcaagtgtgcccatcatgccttatccgcccgcagctgtctactatgcacccgccggtcctaccagtgctcaaccggccgcaaagtggccaccaaccgcatctcctcctccggcccgtaggcaccggcactccatccagctggatctcggcgacttagaggaactcaacaaagcgctgtctcgtgcagtgcaggccgctgaaagcgtgcgatcaacaacacgccagatgaggtcctctctgtcagcggacctccgccaggcccatagcctacggggctcctgcctgttctag

SEQ ID NO: 26825 - DNA, 1569 bp, Artificial Sequence
  Description of Artificial Sequence: Synthetic coding sequence
atggccctgctgccccgggccctgagcgccggcgccggccccagctggagaagggccgcaagggcgttcagaggattcctgctgttattgccagaaccggctgccctgacgcgagcactttcccgcgcaatggcgtgtaggcaggagcctcagccacaagggcccccgcctgctgcgggcgcagttgcgtcctacgattacttagttattggcggaggcagcgggggactcgcctcggctcggcgcgccgctgagctgggcgcgagggcggctgttgttgagtcccataagctgggggggacatgtgttaatgtggggtgcgttccaaagaaggtgatgtggaacaccgccgtgcattctgaatttatgcacgaccatgcagattatggatttccctcatgcgaagggaagtttaactggcgtgtcataaaggaaaaaagagacgcttacgtcagccgcttgaacgcgatctaccaaaacaacctcactaagagtcatatcgaaatcataaggggtcacgccgcgtttacaagtgatcccaaacctaccatcgaggtgtcaggtaaaaaatatacggcaccacacatccttatcgcgaccggcgggatgccgtccacgccccacgaaagccaaattccgggtgcatccttaggaatcacaagcgacggattcttccaattggaagaactgcccggacggagcgttatcgtgggtgccggttatatcgctgtagaaatggcaggtattcttagtgcactcgggtcaaaaacaagtttgatgattagacacgataaagtcctgcgaagttttgactcgatgatcagtacaaactgtaccgaggaactcgagaatgctggagtggaagtgctaaaattctctcaagtgaaggaggtcaagaagaccttgtctggtcttgaggtaagtatggttaccgccgtcccaggccgtctcccagtgatgacaatgatccctgacgtagactgtttactgtgggcaattggccgggttcctaacaccaaggatctgtctttgaacaaactcggcatacagacagatgacaaagggcatatcattgtggacgagtttcagaacacaaacgtgaagggcatctacgcagtgggagacgtctgtggaaaggcactgctcacacctgttgccatcgctgcagggagaaagctggcccacaggcttttcgagtacaaggaagactctaaactggactataataacatccccacagttgtattttctcacccccccattggaactgttggcctcaccgaggacgaagctatccacaagtacgggatcgaaaacgtcaaaacgtactccacatctttcacaccaatgtatcacgcagtgaccaaaagaaagactaagtgcgtaatgaaaatggtatgcgcaaataaggaagagaaggttgtggggatacacatgcaggggttagggtgtgatgagatgctacaaggattcgccgtagccgtgaagatgggcgcaactaaggcagatttcgataatacagtggccatccatccgacatcatctgaggaattggtaactcttcgatag

SEQ ID NO: 26826 - DNA, 1323 bp, Artificial Sequence
  Description of Artificial Sequence: Synthetic coding sequence
atggagcagcggggccagaacgcccccgccgccagcggcgcccggaagcggcacgggcccgggccgagagaagctcggggcgccaggcccggcccgagagttcccaaaactttagtgcttgttgtcgccgccgtactcctactcgtgtcagccgagagcgccctgataacccagcaggatctggcccctcagcaaagggccgcaccacagcagaagcgatccagtcccagcgaggggctctgcccccccggccaccacatctctgaagatggccgcgactgcatcagctgcaaatatgggcaggattatagtacccattggaacgatttgctgttctgtctgcggtgcacacgctgcgactccggggaggttgagttgtcaccctgtaccaccacccgtaacacagtgtgccagtgtgaggaaggcacattccgagaagaggacagccccgagatgtgcagaaagtgcagaaccgggtgccctcgcggcatggtgaaggtgggggattgtactccctggtctgatattgaatgtgtacacaaggagtcaggcacaaaacacagcggggaggttcccgcagtggaggagacggtgacttcgtctccgggaacccccgccagtccctgcagtctgagcggaattatcatcggtgtgacagttgccgcggtcgtgctcatcgtcgccgtgtttgtatgtaagagcctcttatggaagaaggtgttgccttaccttaaggggatttgttctggcggtggaggagatccggagcgagtagacaggtcctcacagagacctggagccgaggataacgtccttaacgaaatagtgagcatcttgcagcctacccaggtacccgaacaggaaatggaggttcaggaaccagctgaaccaactggcgtgaatatgctaagccctggagagtccgaacacctgcttgaaccagcagaagcggagagatcccagaggcgtagactcctggtccctgctaatgaaggggaccctaccgagactctcaggcagtgctttgacgactttgctgatctggtcccgtttgattcctgggagcctctaatgcgtaagctgggactgatggataatgagatcaaagttgccaaggctgaggcagccggccatcgggacaccctctatactatgctgataaaatgggtgaacaaaaccggacgcgacgcatctgtgcacactttgctggacgccctggagacccttggagaacgacttgctaagcaaaagattgaggatcacttgctgtctagcggcaagttcatgtatctcgagggaaatgcagattctgcgatgagctag

SEQ ID NO: 26827 - DNA, 1236 bp, Artificial Sequence
  Description of Artificial Sequence: Synthetic coding sequence
atggagcagcggggccagaacgcccccgccgccagcggcgcccggaagaggcacggaccagggccgagggaagcaagaggagcgaggcccgggccacgtgtgccgaagaccctggttctggtggtggcagcggtgctcctgcttgtatccgctgaatccgcactgatcactcagcaggacctcgcacctcagcagcgcgcagcaccccaacagaagcggagttcacctagcgagggtctttgcccccctgggcaccacatcagcgaggacggccgtgactgcatcagctgtaaatatggtcaggactattcgacccattggaacgatctgctgttctgcttgaggtgtacccggtgtgatagcggggaggtggagttatccccctgcacaactaccaggaacaccgtatgccagtgcgaggaagggaccttccgcgaagaagactcgcccgagatgtgtcggaagtgtcgcacaggatgcccccgcggcatggtcaaggtgggcgactgtactccgtggtctgatatcgaatgtgttcacaaagagtccgggataattattggcgtgacagtggccgcagttgtcctcatcgtagccgtttttgtttgtaagagtttactgtggaagaaggtactgccttatttgaagggaatctgtagtggcggagggggcgacccagagagagtggatagaagttcccagagaccaggggcagaagataatgtgttaaacgagattgtaagcattctgcagcccacacaggtacctgagcaggagatggaggttcaggaacctgccgaaccaaccggtgtgaatatgctgtcgcccggagagtcagagcacctattggagcctgcagaagctgaacgcagtcagcgacgaaggttactggttcccgctaatgagggggatcccactgagacccttaggcagtgcttcgatgattttgctgacctggtgccattcgattcatgggaacccctgatgcggaagctgggactgatggataacgagattaaggtcgctaaggccgaggccgcggggcatcgtgacaccctctatacaatgctgatcaaatgggtgaacaaaacaggtagggatgcttccgtacacacgctcttggacgccctggagaccctcggggaacggctggcaaagcagaaaattgaggatcatctgctatcctctggtaaatttatgtacttagagggcaacgctgactccgcaatgtcttag

SEQ ID NO: 26828 - DNA, 783 bp, Artificial Sequence
  Description of Artificial Sequence: Synthetic coding sequence
atgtgccggaagtgccggaccggctgcccccggggcatggtgaaggtcggagactgcactccttggtccgatattgagtgtgtccacaaagagtcaggtattattattggcgtcaccgtagcggccgttgtccttatcgtggccgtgtttgtctgcaagagtttactgtggaagaaagtgcttccctatcttaaaggcatctgctcaggggggggaggtgatccggagcgagtcgaccggtcaagccaacgacccggtgccgaggacaacgttttaaatgaaattgtcagtattctccagcccacgcaggtccctgagcaggagatggaggtgcaggaacctgctgagccaaccggcgtcaacatgctgtcgcctggcgaatcggagcatcttctggagcccgcagaggcggagagaagccagaggaggcgactgctggtgccagcaaacgagggtgatccgactgagacgctcaggcagtgttttgacgatttcgcagatctggttccttttgactcctgggagccgctcatgagaaaactaggcctaatggacaacgagattaaagtcgcgaaggctgaagccgctggccaccgggacactctctacactatgctcatcaagtgggtcaataaaacggggcgagatgctagtgttcacactctgctggacgcgcttgagacactgggagaaagactggccaaacagaagatcgaagatcatctcctgtctagtgggaaattcatgtacctggaaggcaatgccgattctgctatgtcatag

SEQ ID NO: 26829 - DNA, 1161 bp, Artificial Sequence
  Description of Artificial Sequence: Synthetic coding sequence
atgggcctgtggggccagagcgtgcccaccgccagcagcgcccgggcaggtaggtaccctggcgctaggacagcttcaggtacccgaccgtggctattagatcctaaaattctgaaattcgtagtttttattgtcgcggtgcttctacccgtccgtgttgacagtgccactatcccacgacaagacgaggtgccacaacagacagtggctccccaacagcagcggagaagcctaaaagaggaggagtgccccgcaggatctcacagatcagagtataccggagcatgcaatccatgcacggagggggtcgattacacgattgcctctaataaccttccttcctgtctcttgtgtacagtctgcaaatccggacagacaaacaaatcatcttgcacaactaccagggataccgtgtgccagtgtgaaaagggtagcttccaggacaagaattcacccgaaatgtgccgcacctgccggacaggctgtccaaggggtatggtcaaggtgagcaactgcacgcccagatccgacattaagtgcaagaatgagagcgctgcaagcagtactgggaagacccccgccgctgaggaaactgttacaaccatactggggatgttagcttccccctatcactatcttataatcatcgtcgtgctggtgatcatcctggccgtcgtggtcgtcggattttcctgtcgtaagaagtttataagctacctgaagggaatctgcagcggcggaggcgggggacccgagcgcgtccaccgagtactcttcaggcggcggagctgtccctcacgagttccaggcgctgaggataatgcccgcaatgaaacgctgtccaataggtatctgcaaccaactcaggtatctgaacaggagattcaggggcaagaattggccgaactgacaggtgtgactgtggagcttcccgaagagccccagcgcctacttgaacaagccgaagctgagggatgccagcgcaggcgcctgcttgtgccggtgaatgacgctgactcagccgacatctccactcttctggatgccagcgctaccctggaagagggccatgccaaagaaacgatccaagaccaactagtcggatcggagaagctcttttatgaggaggatgaggccgggtctgccactagctgtctgtag

SEQ ID NO: 26830 - DNA, 1368 bp, Artificial Sequence
  Description of Artificial Sequence: Synthetic coding sequence
atgggcctgagcaccgtgcccgacctgctgctgcccctggtgctgctggaactgctcgtcgggatttatccaagtggggttataggcttagtgccacatcttggcgatcgtgaaaaacgcgatagcgtttgcccacagggcaagtatattcacccacaaaataacagcatctgttgtactaaatgccacaagggcacatatctttataatgactgccctggacccggccaagatacggactgcagagagtgcgaaagcggctctttcactgcgtcagaaaaccacttgcgccattgcctgtcttgcagcaaatgtcgaaaggagatgggtcaagtggagattagctcctgcaccgtggaccgcgacacagtgtgcggctgccggaagaaccagtatcgccactactggtccgaaaacctgttccaatgtttcaactgcagcctttgtctgaatggtaccgttcatttgagttgtcaagagaaacagaataccgtttgcacttgccatgctgggttttttttacgggagaacgaatgtgtatcctgttccaattgtaaaaaaagtctggaatgcaccaagctgtgtttgcctcagattgagaatgtcaaaggcacagaagatagtggcacaacagtcctgctacctctagtcatattcttcggactctgtctactgtccctgctgtttattggactaatgtatcgctatcagcgatggaaaagcaagctatactccatcgtatgcggcaaatccaccccagagaaggagggtgaactggaaggcaccactacgaagcccttagccccgaaccctagcttctctcctactcctggattcacgcccacgctgggattctcccccgtcccatcctctacatttacctcaagctccacatacaccccgggggactgcccaaactttgccgccccccggcgcgaggtggcgcctccctatcagggcgccgatcctatcttggccaccgctttggccagcgatcctatccctaatccgctgcagaagtgggaagattctgcgcacaagccccagtctcttgataccgatgatcctgccactctttatgcagtggtcgagaacgtcccccctctgcggtggaaggagtttgtgagaagactgggactgagcgaccatgaaatagatcgcctggagttgcagaacggtcgctgcctccgagaagctcaatactccatgctggcgacatggagacgcagaacacctaggcgcgaagctacccttgaactcctgggaagggtattgagagatatggacctgctgggttgtctagaggatattgaggaggctctatgtggccccgccgcactacctcccgcgccgtcattactgcggtag

SEQ ID NO: 26831 - DNA, 657 bp, Artificial Sequence
  Description of Artificial Sequence: Synthetic coding sequence
atgggcctgagcaccgtgcccgacctgctgctgcccctggtgctgcttgaactactggttggcatatatccttcaggagtgatcggactggtcccccatttaggagaccgggagaagcgagactccgtttgccctcagggtaagtatatccatccacagaataattccatctgttgtactaagtgtcacaagggtacatacctctataacgactgtcccggcccaggccaggatacggattgtcgggagtgcgagtctggcagctttacagcaagtgaaaaccacctgcgccattgcttgagttgttcaaagtgtagaaaagagatggggcaagtcgagatctcatcatgtacagtggaccgcgacaccgtgtgcggctgcagaaaaaaccagtaccgacactattggtcggagaatctgttccagtgctttaattgctctctctgcctgaacggcacagtgcacctatcctgccaggagaaacagaacaccgtgtgtacctgccacgctggttttttcctgcgcgaaaacgagtgtgtgtcatgctctaaagttctcttgtgcagaccagggtggaatgcagttgctagatcaaggctgacagccacctctgcatcgcagattcaggcgattctgctgttgcagcctcccaaatag

SEQ ID NO: 26832 - DNA, 1386 bp, Artificial Sequence
  Description of Artificial Sequence: Synthetic coding sequence
atggcccccgtggccgtgtgggccgccctggccgtgggcctggagttgtgggccgcagcccacgcccttccagctcaggtagctttcactccatacgcacccgagcctggatctacctgtcggctgagagagtactatgaccagacagcccagatgtgctgcagtaagtgttctcctggtcagcacgctaaggttttctgtaccaagacttctgatacagtttgcgactcctgtgaagactctacctatacacagctatggaactgggtaccggaatgtcttagctgtggttcaaggtgtagctccgaccaggtcgagacacaagcttgcacaagggagcagaacaggatttgcacttgcaggccagggtggtactgcgccctgtccaaacaagaaggatgtcgcctgtgtgctcctctgcggaagtgtcgccccgggtttggcgtggccagacccggcactgagacttccgacgtggtgtgtaagccatgcgctccgggtaccttctcgaacaccacttccagcacagatatctgtcgaccccaccaaatctgtaacgttgtggcgattcccggtaatgcctccatggatgccgtgtgtacttcaactagtcccacccgtagcatggcccccggtgcggttcatctgcctcaaccggtgagtactagatcacaacatacacagcctaccccagaaccctctaccgccccaagtacctcattcctgctgccgatgggccctagcccacccgccgaaggctccacgggcgattttgccctgcctgtgggtctcatcgtgggtgtgactgctctgggcctgctgattattggagtcgttaattgcgtcatcatgactcaggtgaagaaaaagcccctctgcctccaacgcgaggctaaggttccgcatttgcccgcagacaaagctcgcgggacccagggcccggaacaacagcacctgctgatcaccgcgccatccagcagctcctcaagtttagagagctccgctagtgccttagatcgtcgtgcacctacgagaaaccagccacaggcccctggggtggaagctagcggggctggtgaagccagggcttccacaggctctagtgacagcagcccaggcgggcacggaactcaggtgaatgttacatgcatcgtaaacgtgtgctcctcctccgaccacagcagccagtgttcttcccaggcgtccagtaccatgggagacaccgactcttcacccagcgagtccccaaaagatgaacaggtgcccttctccaaagaggagtgtgcattccgatcacagctggagacccccgaaactcttttgggcagcactgaggaaaaaccactgccgttgggggtcccagatgccggcatgaagccttcttag

SEQ ID NO: 26833 - DNA, 807 bp, Artificial Sequence
  Description of Artificial Sequence: Synthetic coding sequence
atggcccccgtggccgtgtgggccgccctggccgtgggcctggagctctgggctgctgcacacgcactgccagcgcaggtggcgttcacaccttatgccccggagccaggaagtacatgtcgccttcgggaatattacgaccagacagctcagatgtgttgtagcaaatgctcgcccggccagcacgcaaaagtattctgtacaaaaacgagcgacaccgtgtgtgactcctgtgaagactcgacttacactcaactgtggaattgggttcctgaatgcctaagctgtggaagcagatgctcgagcgatcaagtagaaactcaggcatgtacaagagagcaaaaccgaatctgtacgtgtcgaccaggctggtattgcgccctctcaaagcaggaggggtgccgactgtgcgccccacttcggaaatgtcggccaggttttggggtggccaggcctgggacagagacttctgacgtggtgtgcaaaccctgtgcaccaggaaccttcagcaataccacctcttccaccgacatatgccgaccacatcagatttgtaatgtggttgccatacctgggaatgcaagtatggacgccgtttgcaccagcacgagccctactagatcaatggcccctggtgccgttcacttaccccagcctgtgtctacgcgttcacaacacacacagcccactcccgaaccctccactgcaccaagtacctcttttttgctccccatgggacccagtccaccagctgaaggcagcacgggagacttcgcgctgcctgttgtttcgttgtcttccagttag

SEQ ID NO: 26834 - DNA, 468 bp, Artificial Sequence
  Description of Artificial Sequence: Synthetic coding sequence
atggcccccgtggccgtgtgggccgccctggccgtgggcctggagctttgggctgccgcacacgcacttcccgcacaagtagccttcaccccatatgcgcctgagcccggtagtacgtgtcgtctacgcgagtactatgatcagaccgcacagatgtgctgctctaaatgctcccccggacagcacgccaaagttttctgcacaaagacgtctgacacagtctgcgattcttgtgaagattccacttacacccagctgtggaattgggttccagagtgtctcagctgcggcagtcggtgctcaagcgatcaggtcgagacacaggcgtgcacacgcgaacagaatcggatttgcacctgtcgacccggctggtactgtgcactgtctaagcaggaagggtgtcgtctgtgtgccccactgagaaaatgcagacccggattcggggtggcaaggcccgatctttcatag

SEQ ID NO: 26835 - DNA, 114 bp, Artificial Sequence
  Description of Artificial Sequence: Synthetic coding sequence
atggcccccgtggccgtgtgggccgccctggccgtgggcctggagctgtgggctgccgcccacgccctaccagcccaagtggatcctggacctctttttcctcaccccggatag

SEQ ID NO: 26836 - DNA, 1968 bp, Artificial Sequence
  Description of Artificial Sequence: Synthetic coding sequence
atgggcaccagccccagcagcagcaccgccctggccagctgcagccgcatcgcccggcgcgccactgcgacaatgattgccggatcgctgttgttacttggatttcttagcactacaacggctcaaccggagcaaaaagcttccaacctgattggaacctaccgtcatgtggaccgcgccactggccaagtgctgacttgcgataaatgtcccgcaggcacctatgtctccgagcactgtaccaacacctcactccgggtctgctcttcttgcccggtgggtacattcactcgccatgagaatggcatagaaaagtgtcacgactgcagtcagccctgtccatggccgatgatcgagaagctgccatgtgccgctctgactgacagagagtgcacctgtcctcctgggatgttccaatctaacgcaacatgtgcaccccacaccgtgtgccccgtgggctggggtgttcgcaaaaaaggtacagagacagaggacgtgaggtgcaagcagtgtgcgcggggaacattttccgatgtgccttcctccgtaatgaagtgtaaggcctataccgactgtctgagccagaacctagtggtgataaaaccaggtactaaggaaactgataacgtgtgcggtacactgccatcatttagctcttcaacctctccctccccaggcaccgctatcttcccacgaccggagcatatggaaacacacgaggttccctccagtacatacgtaccaaagggaatgaattctacagagtctaatagctctgcatctgtgcgcccgaaagtgctgtcttctattcaggagggcacggtcccagataatacttcctctgccagaggcaaggaggacgtcaataagactttgcccaacctacaggttgtgaaccaccagcaaggaccacaccataggcatatcctgaaactgctcccttccatggaggccacaggcggagaaaaaagctccacacctattaagggacctaagcgcggacatcctagacagaatctgcataagcattttgatataaatgaacatttaccatggatgatcgtgctttttctgctgctggtgctcgtggtaatcgtggtgtgttcaataagaaagagctctcgcaccctcaagaagggtccacgccaggatccctcagctattgtggaaaaggccggcctgaaaaagagcatgacccctacacagaaccgcgagaagtggatttattactgtaatggccatggtatcgacatcctgaagctcgtagcggcacaagtcggctcacagtggaaggacatctaccagttcttatgtaacgcaagtgaaagagaggtcgccgcattttccaacggttacaccgctgatcacgaacgtgcctacgccgcgctgcagcattggactattcggggaccagaggcctcgttggcccagctaattagcgctctgcgccagcatcgccgaaatgacgtggttgaaaagatcagaggcctcatggaggatactacccagctggagacagacaaactggcgctaccaatgtccccatctcccctctctccatcccccattccttcgcccaatgctaagctcgagaattccgccctgctgactgtagagccaagcccgcaggataagaacaaagggttttttgtggacgaatcagagcctctccttaggtgtgacagtacatcatctgggagtagtgccctctccaggaatggaagctttattactaaggaaaagaaagacaccgttctgcgacaggttcggttggatccatgtgacctgcagcctattttcgatgatatgttgcacttccttaatcccgaagagctccgcgtgattgaggagattcctcaggccgaagacaaactggacaggctgttcgagattattggtgtgaagtcccaggaagcctctcagacactgctggactcagtttactcacacctgcctgacttgttatag

SEQ ID NO: 26837 - DNA, 1035 bp, Artificial Sequence
  Description of Artificial Sequence: Synthetic coding sequence
agctgctgccggccctggcggcccctgggcgcccggagccccgcccgcccttcccggcccaagcgcggccacccaagacaaaatctgcacaaacattttgacatcaacgagcatctgccatggatgattgtcttgtttctgctgctcgtcctagtcgtcattgtcgtctgtagtattcggaaatcaagccgaacactgaaaaaaggcccgcgccaggatcccagtgcgatcgtggaaaaagcaggacttaaaaaaagcatgacgcccactcagaatcgagagaagtggatttactattgtaacggacacgggatagatattctgaaactggtcgccgctcaggtgggtagccagtggaaagacatctatcagtttctatgtaacgccagtgagcgagaagtcgcagctttttccaatgggtatacagccgatcacgagcgtgcctatgctgcactacagcattggacaatccgcggacccgaagcgagccttgcccagcttatcagcgctctcaggcagcatagacgcaatgacgttgtcgagaaaatccgcggcctcatggaggataccactcagcttgagacagacaagttggccttaccaatgagcccttcccctctttcacctagtcccattccttcacctaatgcgaagcttgaaaattccgcgctgcttacagtggagcccagtccccaggacaagaataaggggttttttgtcgacgaatccgagccactgctgaggtgcgactctacatcatccggcagctctgccctgagtcgaaacgggtcctttattactaaagagaagaaagacacagtcctaagacaggtaaggctggacccctgtgatttacagcctattttcgacgatatgctacatttcttgaacccagaagagcttcgggttatcgaggaaatcccccaagcggaggataagctggacaggttgtttgagattatcggcgtgaagtcccaagaagcctcgcagactctgctggactctgtatacagtcatctgcctgacctgctgtag

SEQ ID NO: 26838 - DNA, 1119 bp, Artificial Sequence
  Description of Artificial Sequence: Synthetic coding sequence
atggagcagcggccccggggctgcgccgccgtggccgccgccctgcttctggtactccttggggcccgggcccaagggggcacaagaagcccacggtgcgattgcgcaggcgatttccataagaaaatcggtctgttctgttgtcgcggatgccccgccgccagtcaggtggccctggagaactgctccgccgtcgcagataccaggtgcggttgtaaacccggatggttcgtagaatgtcaggtctcccagtgcgtcagttcttcccctttctactgtcagccctgtcttgactgcggcgcccttcacagacacacccgactcctatgctccagacgagatacagactgcggtacatgtctgccaggcttttatgaacatggcgatggatgtgtgagctgcccaaccagcacattggggagttgccctgaaaggtgcgcagccgtgtgtggatggaggcagatgttctgggtgcaggttctgctagccggtcttgtggtgcccctcctcctgggtgccaccctcacgtacacttatcgccactgttggcctcataaaccactggtgactgccgatgaggccggcatggaggccctgacccccccccccgctactcatctgtctcccctggacagcgcccacacgcttttagcgcctccagattcctcggagaagatctgtaccgtccaactggtgggtaattcatggactcctggatacccagaaacccaggaagctctctgcccacaagtgacttggtcttgggaccagctcccatccagggcactaggtccagctgctgcgccaactctgtccccagagagccctgctggctccccagctatgatgcttcagcctggtccgcaactgtacgacgtcatggacgctgtgcctgctaggcgctggaaggagtttgttagaacccttggcttgagggaagcagaaatcgaagcagtggaagttgaaatagggaggttccgtgatcaacagtacgaaatgttgaagcggtggagacagcagcagcccgccggcctcggtgcggtgtatgccgcccttgagagaatggggttagacggatgcgtggaggacctgcggagccggcttcagcggggcccctag

SEQ ID NO: 26839 - DNA, 705 bp, Artificial Sequence
  Description of Artificial Sequence: Synthetic coding sequence
atggagcagcggccccggggctgcgccgccgtggccgccgccctgttgctggtcctcttgggggccagggctcaaggcggcacgcggtccccccgctgcgattgtgctggcgactttcataaaaagatcgggctattctgttgccggggctgtcctgccgacgaggccgggatggaagcgctgaccccaccacccgccactcacttgtctccgctggattccgctcatacactattggccccgccagattccagcgagaaaatctgcacagtgcagttagtggggaacagctggacgcccggctaccccgagacacaggaggcactgtgtccccaggtcacatggagctgggatcagctcccttccagggcactcggccccgccgccgcaccaactctctctccggaatcgcccgccggctctcctgccatgatgctccagccagggccacagctgtacgacgtgatggatgccgtcccagcgcgtcgatggaaagaatttgtaaggactctgggtctacgcgaggcagagattgaggcagttgaggtcgaaatcggacgttttcgggatcaacagtacgagatgcttaaacgttggcgccagcagcagcccgctggcttgggggccgtctatgccgctcttgagcgcatgggactggatggctgtgttgaggaccttcggagcagactgcaacgggggccatag

SEQ ID NO: 26840 - DNA, 1143 bp, Artificial Sequence
  Description of Artificial Sequence: Synthetic coding sequence
atggagcagcggccccggggctgcgccgccgtggccgccgccctgctgttagtgctgctgggggcccgcgctcagggggggacaaggtccccaagatgtgactgcgcaggagacttccacaaaaagatcggtttgttttgctgccgaggatgtcccgccgggcattacctgaaagccccatgcaccgagccatgcggcaactctacctgcctcgtgtgcccacaggatacttttttggcttgggaaaaccatcataatagcgagtgtgccaggtgtcaagcctgcgacgagcaggccagccaggttgccctggaaaattgtagcgccgtcgcggacacgcgctgtggttgcaagcccggttggtttgtcgaatgccaggtgagccagtgcgtgagctcctcacctttctactgtcagccttgtctggactgtggcgcgttgcaccgccatactcgcttgttgtgctcccgacgagatacagactgcggcacctgcctccccggcttctatgagcacggcgacggttgtgtttcttgccccacgagtacactaggttcgtgccctgaaagatgtgctgcagtgtgtgggtggcggcaaaacgaggccgggatggaggctctgacaccccctccagcgactcatttatcgccactggacagcgctcacacactattggccccccccgacagctccgagaaaatctgtaccgtgcagttagtaggcaattcctggactcctgggtatcccgagacacaagaggccctgtgcccgcaagttacctggtcctgggaccagttgcctagtcgtgccctgggacccgcggcggcccccacactgtctccagagtcccctgccggaagccctgcaatgatgttgcagccaggaccacagctgtatgacgtgatggatgccgtgccagcacgtcgttggaaagagtttgtccgcacacttggactcagagaagcagagattgaggcagtggaagtggagataggacgctttagagaccagcaatatgagatgctcaagcgttggcgccagcaacaacccgcgggcctcggagccgtatatgcggcacttgaaagaatggggctggacggatgtgttgaagacttaagaagcagactgcagagggggccctag

SEQ ID NO: 26841 - DNA, 1254 bp, Artificial Sequence
  Description of Artificial Sequence: Synthetic coding sequence
atggagcagcggccccggggctgcgccgccgtggccgccgccctgttgctagtccttctgggggctcgagcccagggcgggactaggtctccaaggtgcgattgcgctggtgatttccacaagaagatcggcctcttttgctgtaggggatgtccagccggtcattacctgaaagctccctgcactgagccctgtggaaatagtacgtgccttgtgtgcccacaggatacatttctagcgtgggagaaccaccacaactcagaatgtgcccgctgccaggcttgtgacgaacaagccagtcaggtggccctcgaaaattgcagcgcagtggccgacactcgctgcggatgcaagcccggttggtttgtcgaatgtcaggtgtcccagtgcgtgtccagcagccctttttattgtcagccatgcctcgactgcggggccttgcaccgtcacactagacttctttgttcccggcgtgacactgactgtgggacttgtctccctggattctacgagcatggggatggatgcgtgtcatgcccaacatctaccctagggtcgtgtcccgaaaggtgcgctgctgtgtgcggatggaggcagatgttctgggtacaggtgttgctggccggtctggtggtccctctgctgctcggggcaactttaacatatacctacagacattgttggcctcataaacctctggtcacagccgacgaggcgggcatggaagcccttacaccacctcctgcgacccacctctccccccttgactctgctcacacgctcctggcgccacctgatagttccgaaaagatttgcaccgttcagctcgtgggcaactcatggacacctggctacccagaaactcaggaggctctatgtcctcaggtgacttggtcctgggatcagctacctagtcgagctctcggccccgctgccgcgcccacactgtcacccgaatcacctgcaggttcgcccgcgatgatgttgcaaccaggaccacagctgtacgacgtcatggacgctgtgcctgcccgccgctggaaggagtttgtgcgtaccttggggctcagggaagcagagatcgaagctgtggaagtagagataggaaggtttagagatcagcagtatgagatgctgaaaagatggaggcaacagcaaccagcaggcctcggagctgtgtacgcagcactcgagcgaatggggcttgacggttgtgtggaggatctacgatctaggttacagaggggcccatag

SEQ ID NO: 26842 - DNA, 1281 bp, Artificial Sequence
  Description of Artificial Sequence: Synthetic coding sequence
atggagcagcggccccggggctgcgccgccgtggccgccgccctgttgctggtgttgctgggagcccgggcccagggaggaactcggtcacccaggtgtgactgcgctggcgattttcacaaaaagatcgggctgttttgttgcaggggctgtccagccggccactatctgaaagctccatgcaccgaaccttgcggcaattctacttgcttggtatgcccccaagataccttcctcgcatgggagaaccaccacaattcagagtgcgccagatgccaggcttgcgatgagcaggccagccaagtggcattggaaaactgctccgctgtagccgatactcggtgcggctgtaaacctggatggtttgtcgaatgccaagtaagccagtgtgtcagttcctcccctttctactgccagccgtgtttagactgtggggcccttcaccggcacactcgcctgctctgctctagaagagacacagactgcggtacatgcctccccggcttttacgaacatggagatggttgcgtgtcctgtcctactcctccgcctagcctcgctggggctccatggggggctgtgcagtccgcagtgcctctgtcagtggcaggtggccgcgtgggcgtgttctgggtccaggtgctcctcgctggactcgtcgtaccactcctgctcggcgccacccttacatacacctatcggcactgctggcctcacaagcctctcgtgacagccgacgaagcgggcatggaggccctgactccgcccccagccacccatctaagtccgctggacagtgcacacaccctcctggccccacctgattcatctgagaaaatctgcacagtacagctagtgggcaattcctggaccccaggttacccggaaacccaggaagccctgtgcccccaggtgacctggtcttgggatcagctgccgagccgggcattgggcccagcagccgcacctacattatcaccagagtctccagcaggttccccagccatgatgcttcagcccggcccgcaattatatgatgtgatggatgccgttcctgctcgccgttggaaggaatttgtgcgtaccctggggctcagggaggcagaaatcgaagcggtggaggtggaaataggcaggtttcgagaccagcagtatgagatgctgaagaggtggcgacaacagcaacctgccgggctgggggcggtctatgcggcactggagagaatgggccttgatggctgcgttgaggacctgcgttcccgccttcagaggggcccatag

SEQ ID NO: 26843 - DNA, 768 bp, Artificial Sequence
  Description of Artificial Sequence: Synthetic coding sequence
atgggcaacagctgctacaacatcgtggccaccctgctgctggtgcttaactttgagcgaaccaggagtctccaagacccttgcagcaattgtcccgccggcactttctgtgacaacaaccgaaatcagatctgttcaccatgtcctcccaactccttctcgtccgcaggagggcagaggacttgcgatatatgtaggcaatgtaagggtgtgttccgaacccggaaggaatgctcatctacttctaacgctgaatgcgattgtacacccgggttccattgccttggtgcaggctgctctatgtgtgagcaggattgcaaacaagggcaggagctaacaaaaaagggatgcaaagactgttgctttggtacatttaacgatcaaaaacggggaatttgtcgaccttggaccaattgctccctggatggcaagtctgttctcgtaaacggaactaaagaacgggacgtggtctgcggaccatcccccgctgacttgtcccccggggcctcaagtgtgacaccgccggctcccgccagagaaccggggcatagcccacagattatttcattctttttggccttgactagcaccgctttgttgtttcttctgttctttctgaccctcaggttttctgtggtaaagcgcggtaggaagaagctcctttatattttcaaacaacctttcatgcggcctgtgcagaccactcaggaggaagacggctgttcttgtcggtttcccgaggaggaagagggcggttgcgaactgtag

SEQ ID NO: 26844 - DNA, 5919 bp, Artificial Sequence
  Description of Artificial Sequence: Synthetic coding sequence
atggaccccaccggcagccagctggacagcgacttcagccagcaggatacaccatgcctcattattgaagattctcaaccagaaagtcaggtgctggaagacgactcaggatctcacttctctatgctgagccgccacttgccaaatctacagacacataaagagaaccccgtacttgatgtggtctcaaatcccgaacagacagccggagaagagcgcggagacggaaactccggatttaatgaacacctcaaagaaaataaggtggcagacccggtggacagtagcaatctggatacgtgcggatccatcagtcaggtgatagaacagctgcctcaacctaacaggacctctagcgtactaggaatgtccgtggagtcagcccctgccgtggaagaggagaagggcgaggagctagagcagaaggagaaggaaaaagaggaagatacctcaggaaataccactcatagtttgggtgctgaggacaccgctagctcccagttgggctttggggtgttagaactaagccagtcccaggatgtggaggaaaacaccgtgccgtacgaagtggataaggagcaattacagtcagttacgacgaattcagggtacactaggctttccgatgttgacgcgaacaccgcaatcaaacacgaagagcagtccaatgaagatatcccaatcgccgagcagtctagcaaggacattcccgtgacagctcagcctagcaaagacgtgcatgtcgtgaaggaacagaaccctcctcccgcgcgtagtgaagacatgccattctctcctaaggcttctgtcgcggcgatggaggccaaggaacaactttccgcccaagaactgatggagtctggcctccagatacagaaatcccctgaacctgaggtgctctctacccaggaggacctgtttgaccagtctaataagacggtgagcagtgacggctgctcaaccccttccagagaagaggggggatgctctctcgcttctaccccagctactacccttcatctcttgcaactatccggtcagcgatcccttgtgcaggattctctatcgacaaactccagcgacctcgtcgctccatcaccagatgcatttcgatccacaccatttattgtaccctcctcccctacggagcaggaaggtaggcaggacaagcccatggatacaagcgtgctgagcgaagagggaggagaaccatttcagaaaaaactgcagtctggcgaacccgtggagctggagaatccaccacttttgcctgaatctacagtctccccacaggcctcaactccaatttcccaaagcaccccggtctttccccctggctcgctgccaatcccaagtcagcctcagttttcacacgacattttcattccaagccccagcctggaggaacagagcaatgacggcaagaaggacggggacatgcactcaagttcactgactgtggagtgtagcaagacctccgaaatcgaaccgaagaattcgccagaagacctcggtctatcgttgacaggtgatagctgcaaactgatgctgagtacctcagaatacagccagagcccaaagatggagagcttgagttcacaccggatagacgaagacggggaaaacacccagattgaggatactgaacccatgtctccagtgctgaacagtaagtttgtgccagcggagaacgactccatcctcatgaatcccgctcaggatggcgaggtgcagttgtcgcagaacgacgacaagactaagggagacgatactgacacccgcgacgacatctccattctggcaactggctgtaaaggcagagaagagactgttgctgaggacgtgtgcatagacctcacctgcgactctggaagccaggccgtcccctcccccgcaactcggtctgaggccctgtcttctgttctcgatcaggaggaggcgatggaaatcaaggagcaccaccctgaggaaggatcttcaggctccgaggtggaagagataccagaaaccccgtgcgagtctcagggggaggagctcaaagaggagaatatggaatcagtgcctttgcacctcagtcttaccgagacccagtcccagggcctttgtctccagaaggaaatgcctaagaaggaatgtagtgaggccatggaggtggagacaagcgtgatcagtatcgacagtccacagaagctagcaattctcgatcaggaactggagcacaaggagcaggaagcgtgggaggaagcgacgagcgaggattcttcagtagtgatcgttgacgtgaaagaacccagtcctagagttgacgtcagctgcgaaccactcgagggtgttgagaaatgtagtgattcacagtcctgggaggatatcgccccggagatcgaaccctgtgctgagaatcgtctggataccaaggaagaaaaatcagttgagtacgaaggcgatctgaaaagcgggaccgcagaaacggaacctgtggagcaagacagtagtcagccatctctccccttggtgcgtgctgatgacccacttagactggatcaggagctgcagcagccccagacacaggaaaaaacctcgaacagcctaaccgaagattccaaaatggcgaacgcaaagcaactgtccagcgacgccgaagctcagaagcttggtaaacctagcgcacatgcttcacaatcgttctgcgagagtagctccgagacaccattccactttaccttgcctaaggaaggcgatatcatcccgccacttacaggagccaccccgcccctgattgggcatctgaaattagagccgaagaggcatagcacacctattgggatctccaactatcccgagtcaaccatcgcaacatccgatgtcatgtcagagtcaatggtcgagacccatgaccctattcttgggtctggaaaaggggacagtggcgcagcacccgacgttgatgacaagttgtgtctcagaatgaaattggtttccccagagaccgaggcttctgaggaatccctccagtttaatctggagaagccagcgacaggggagcgcaagaacggaagcactgcagtcgcagagagcgtcgcatcaccccagaaaactatgtctgtcctgtcatgcatttgcgaagctcgccaggaaaatgaggcacggagcgaagatccgcccactactcccatccgtggtaatctgctccatttcccttcaagccagggggaagaagaaaaagaaaagctggagggagatcataccatccgacagtcccagcaacccatgaagcctatttcccctgtgaaggaccctgtcagcccagcctcacagaagatggtgatacagggtccaagtagtccccagggagaagccatggtgactgacgttctcgaggaccagaaagaaggaagatccactaacaaagaaaatccctccaaggccctgatagaacgccctagtcagaataacattggaatccagacaatggagtgttctctgcgggtgcccgagaccgtgtcagccgctacccaaactattaagaatgtgtgtgaacagggaacctctactgtggatcagaattttggcaagcaagacgccaccgttcagacagagcgtggaagtggggagaaacccgtgagcgccccaggagatgataccgagtctctccactcccaaggcgaggaggagttcgatatgccccagccacctcacggacacgtgcttcataggcatatgagaaccattcgggaagttcgcaccctagtgacacgcgtgatcaccgacgtgtattatgtggatgggaccgaggttgaaagaaaagtgacagaggagactgaggaacctatcgtggaatgtcaggagtgtgagacagaagtctcaccctcccagacaggcgggagctccggcgaccttggtgacatcagcagcttctcatccaaggcttcaagtctgcaccggacctcctcaggaacatccctctcagcaatgcactctagcggatcctcgggaaagggggccggtcctctccggggtaagacctctggcacagaacctgccgattttgcattaccctccagtagggggggacccgggaaactgtccccacgaaagggggtcagccaaaccgggacaccagtttgtgaggaggatggggatgcaggactggggatacgacaaggtgggaaagctccggtcaccccacggggtagaggcaggcggggacgaccgccatctaggactacgggtactagagagaccgccgtaccaggacctttaggaatagaagatatttcccctaatctttcccctgatgacaagtcttttagccgggtcgtgcctagagtccccgatagtacccgtcgcactgatgtcggtgctggcgcgctgcgccgtagtgattcacctgaaattccctttcaggccgctgcaggtccctccgatggcctcgacgcgtcctcccctggcaactccttcgtggggcttcgcgtagtcgccaagtggtcgtctaatggctatttctattctgggaaaatcacaagagatgtcggcgccggaaaatataaactgctttttgatgatggctacgagtgtgatgtgctgggaaaggatattttgctatgtgaccctatcccactggatacagaggtgaccgctcttagcgaggacgaatatttcagcgcaggggtggttaaggggcatagaaaagagtccggggaactgtattacagtattgaaaaagagggccagaggaaatggtataagaggatggccgtgatcctctctctggagcagggcaatcgcttaagagagcagtatggcctggggccatacgaggccgttaccccactgaccaaagctgctgatataagccttgataatctcgtggagggaaaaaggaagcgacggagcaacgttagctcccctgccacccccaccgcctcctcctcaagctctacaacccctaccaggaagattacagaatccccacgcgccagcatgggcgttctctctgggaagcggaagctgatcactagcgaagaggaaagatcaccagcaaagcgggggaggaagtctgccactgtcaaacctggagccgtgggcgcaggcgagtttgtttctccctgcgagtcgggggacaacacgggtgagccatccgccctggaggaacagagaggccccttaccccttaacaaaacactgtttttgggctacgctttcctgttaactatggctaccacttcagacaagctggcttcacggagcaagctacccgatggccccaccggctcatccgaagaggaggaggagttcctggagatccctccctttaacaagcaatacactgagtcacagctgcgggccggagccggctacatattggaggacttcaatgaggctcagtgtaacacggcctatcagtgtctcctcatcgccgaccagcattgtcgcacccgaaaatacttcctgtgcctcgcgagtgggattccgtgtgtgagccacgtgtgggtgcacgacagctgccacgctaatcagttgcagaactataggaactacctgctgcctgccggctactctttggaggaacaacgcatcctggactggcagcccagagagaacccttttcaaaacttaaaagtgctcctggtttcagaccaacaacaaaacttcttagagctgtggtcggagattcttatgacaggcggagctgccagcgtcaagcaacatcattcttccgctcataataaagatatcgcgttgggagtgtttgacgtggtcgtgactgaccccagttgccctgcctctgtattgaaatgcgctgaggctcttcaattgcccgtggtttcccaggaatgggttattcagtgtctgatcgtcggtgagcgaatcgggttcaagcagcaccccaagtataagcatgattacgtgtcccattag

SEQ ID NO: 26845 - DNA, 5784 bp, Artificial Sequence
  Description of Artificial Sequence: Synthetic coding sequence
atgcccggcgagcagatggaccccaccggcagccagctggacagcgattttagccagcaggacactccttgcctgatcattgaggacagtcagccagagagtcaggtgctcgaggacgactctggctcccacttctccatgctgtcccgtcacctgcctaacttacaaactcacaaagaaaacccggtgctggatgtagtctccaaccccgagcagacggccggagaagagcgcggggacgggaattctgggttcaatgaacacttaaaggagaacaaagttgccgatcccgttgactctagtaatctggacacttgcgggtccatttcacaggttatcgaacagctgccacagccaaaccgaaccagctcagtgctggggatgtctgttgaatcggcacctgctgtcgaggaggaaaaaggggaagagctggagcagaaagaaaaagaaaaggaggaagacaccagcggcaacacaacccatagcctgggggcagaggacaccgcttcctctcaattagggtttggagtgctggagctctcacaatcccaggatgtagaggaaaacactgtcccttacgaagtggacaaagaacaactgcaaagcgtgacaacaaactccggatacacacggctcagcgatgtggatgctaacactgcaatcaagcatgaagagcagtcaaacgaagatatccccatcgctgagcagagctctaaagatatccctgtcaccgcccaaccttctaaggacgtgcacgtcgtgaaagaacagaacccacctcccgcccggagtgaggacatgccgttctcccccaaagccagcgtggctgcaatggaagccaaggagcagctgtccgctcaggaactcatggaatctggattgcagatccagaaaagccccgaacctgaagtcctatctacacaggaggatttattcgaccagtccaataagacggtctcctctgatggttgttcgaccccgtcacgggaggagggtggttgttccttggcctcaaccccagcgactaccctccatctgttgcagctctccggacagaggagcctggttcaagactctctctctaccaactctagtgaccttgtagccccttcccccgacgcttttcgctccaccccattcatcgtgccttcaagtcccacagaacaagagggcagacaagataaaccaatggatacctcagttctgagcgaggagggcggcgaaccctttcagaaaaagttgcagtcaggcgaacccgtcgaactcgaaaaccctccactgttgcctgaatcaacagtctccccccaggcatccacccccatcagccagtctacaccagtgtttccaccaggcagcctgccaattccgagccagccacagttttcgcacgacatctttatcccttccccctcactagaggaacagagtaatgatgggaagaaggatggcgatatgcattcctcctctctcactgtggagtgctccaagacaagcgaaatcgagcccaaaaacagccctgaagatctcggcctgtcactgactggagactcatgcaagctgatgctatccacatcagaatatagccagagtcctaagatggagtctctgagctcccatagaatcgacgaggatggcgagaatacacagatcgaggacaccgagccgatgtcaccagtgttaaattccaaatttgtcccggctgagaatgactctatcctgatgaacccagcccaggatggcgaggtgcaattgtcccagaatgacgataagaccaagggagatgacactgataccagagacgacatttccattttagccacgggatgcaaaggacgagaagagacagtggctgaagatgtctgcattgatctgacttgtgattccgggtcgcaggctgtgccaagccccgccacccgctccgaggcactcagttccgtgttagaccaggaggaggccatggagatcaaggagcatcaccccgaggagggatcaagcggctccgaagtcgaagagatcccggagacaccctgcgagtcacagggagaagaactcaaggaagagaacatggagtcagttcccctgcatctgtctctgacagagacacagtcccagggtctgtgtttgcagaaggaaatgcccaaaaaagaatgttccgaggctatggaggttgagacatcggtgatctccattgattccccacagaagcttgccatcctcgatcaggaattggaacacaaagaacaggaggcttgggaggaggccacctcagaagactcctcagtggtgatcgtggacgtgaaggagccttcaccacgggtcgatgtaagctgtgaaccgctggaaggagtcgaaaaatgctccgatagtcagagctgggaggacattgcgcctgaaattgagccttgcgccgagaacagacttgatactaaggaagagaagtctgtagaatacgagggggaccttaaatcaggtaccgcggaaactgagcctgtggagcaggatagttcacagccctctctcccactagtaagagctgacgatccgttgcggctagatcaggaactacagcaaccccaaacacaggaaaagaccagcaacagcctcactgaagactctaaaatggctaatgccaaacagttgagctccgacgcagaggcacagaagctcggtaagcccagtgctcatgcctcacaatctttttgcgaatcatcttccgaaacgcctttccacttcaccctacctaaggagggagatataattccgccactgaccggagcaacccctcccctgataggccacttgaaactggaacccaaacggcattctacgccgattggtatctctaactacccagaatcaacaatcgctacatctgacgtgatgtcagaaagcatggtggaaacccacgaccccattctgggttcggggaagggggattctggagccgcaccggacgtcgatgataagttatgcttaaggatgaagttagtgagtccggagacagaagcttccgaagaatcgttacaattcaatctggagaagccagccacaggggagcgtaagaacggctccaccgccgttgcggaatccgtggcctcccctcaaaagactatgagcgtattatcctgcatatgtgaagcccgccaggaaaacgaggcacgctccgaggacccgccgaccacgcctattcgaggaaatctgctgcatttcccgagtagccagggagaggaggagaaggaaaaactggaaggagaccatactataagacagagtcaacagccaatgaaacccatttcccccgtgaaggacccggtaagtccagcatcacagaaaatggtaattcaggggccaagttcaccacagggtgaggctatggtcacagatgtgctcgaagaccagaaagaaggcagaagcacaaacaaagaaaatccttctaaggcactcatagagcgcccatcccaaaataatattggtatccagacaatggagtgttccctcagggtgccagaaacagtgagtgctgctacccagactatcaaaaacgtgtgcgagcaggggacatcaaccgtggaccagaattttgggaaacaggatgcgacggtgcaaactgagcgagggtctggagagaagcctgtctcggcaccaggcgatgacactgagtctttgcactcgcagggtgaagaagagttcgacatgccacagccgccacacggccatgtcctgcatcggcacatgcggaccatacgggaggtgaggactctagtgactcgagtcatcaccgacgtgtattacgtcgatggaactgaagtggagcggaaagtgactgaagagaccgaagagccgatcgtcgagtgtcaggaatgcgaaacagaagtgtctccatcccagaccggagggtctagtggcgatctcggggacatttcctcattcagtagtaaagcatcctcactgcataggacaagctcaggcaccagtttgtccgcgatgcacagtagcggaagttccggtaaaggcgccggtccactgcggggaaaaacgagtggcactgagcctgctgatttcgccctgcctagcagcagaggcggacctggcaaacttagggagacagccgtgcctggccccctgggaatagaggacatctctccaaacttgtctccagacgacaaatctttctctcgagtggtgccgagggtgcccgatagcactcggcgcaccgacgttggcgcaggagctctcaggaggtctgatagcccagagatccccttccaagctgcagcagggccatcagacggcctggatgcttccagccccggtaactcttttgttggactgcgggtggtcgcgaagtggtcttccaacggctacttctactccggcaagataaccagagacgtcggcgctggaaagtacaagctgttgtttgacgatggttacgagtgcgatgtgctggggaaagacatactactctgtgatcctataccattggacaccgaggttaccgcactcagcgaggatgagtacttcagtgcaggggtggtcaagggtcaccggaaagaatctggagagctgtactactcgatagaaaaagaaggccaaaggaaatggtataaaaggatggctgttattttaagccttgaacagggtaaccggctgagagagcagtacggcttgggaccatatgaagctgtgaccccattaaccaaggcagctgatatttcgttagacaatcttgtcgagggaaagagaaaacggcgctcgaatgtttcatcccccgccacaccaacagcctcctcatcgagttctacaacgcctacacgcaagatcaccgagagtccgagagcctctatgggagtcctgtctggcaagaggaaacttatcacaagtgaggaggagagaagccccgccaagcgcgggagaaaatcggcaaccgtaaagcctggtgctgttggcgccggggagtttgttagcccttgcgaaagcggagacaataccggggagccatctgctctagaggagcagaggggcccactgcctcttaacaagacattatttctcggctacgcatttcttttgaccatggctacaacttccgacaaattggccagcaggtccaagctgccagatggaccgaccggctcctcagaagaagaggaggagttcctggaaatccctccattcaataagcaatataccgaaagtcagttaagagctggcgccggctacatcttggaggacttcaatgaggcccagtgtaacaccgcctaccagtgcctgttgatagctgatcagcattgcagaacacggaaatacttcctctgcctcgcttcgggtataccctgcgtatcacatgtatgggtacatgacagttgccatgccaatcagttgcagaattacaggaactacctcctccccgccggctattccctggaagaacagcgcatactagactggcagcccagagaaaacccctttcagaacctcaaggtcctgttagtgagcgaccagcagcagaattttctcgaactatggagcgagatactgatgacaggcggggccgcctctgtgaaacagcatcattcaagtgctcacaacaaggatattgcgttaggtgtgttcgacgtggtagtcacagatccctcatgccctgcatcagtgctgaagtgtgcagaagcgttacagctgccagttgtgagccaggaatgggtgatccagtgtctcatagtaggcgaaaggattggattcaagcagcaccccaaatataagcacgactacgttagccactag

SEQ ID NO: 26846 - DNA, 5934 bp, Artificial Sequence
  Description of Artificial Sequence: Synthetic coding sequence
atgcccggcgagcagatggaccccaccggcagccagctggacagcgacttctcacaacaggacacaccctgtctgatcattgaggatagccaacctgagtctcaagtgttagaggacgattcaggatctcacttttcaatgctgtcccgacatttgcctaacttacagacacacaaggagaatcccgtactcgacgtggtatctaaccccgaacagactgccggtgaggagcgcggggatggaaacagcgggtttaatgaacacctgaaagaaaataaggtggctgacccggtcgatagctccaacctcgacacttgcggatccatctcgcaggtgatcgaacaacttccccagccaaacaggacgtcttccgtccttggcatgagcgttgagagcgcccctgcagtggaagaagagaagggcgaggaattagaacagaaagagaaagaaaaggaagaggatacaagtggaaacaccacccacagtctcggtgctgaagacaccgcttcctctcagctcggattcggcgtactggagctctctcagagtcaggatgtggaggagaacactgttccctatgaggtagataaagaacaattgcaatctgtcacaacaaatagcggctacactaggctttctgatgtagatgctaataccgctataaagcatgaagaacagagtaacgaggacataccaatcgccgaacagtcatctaaagatatccccgttaccgcccagccttcaaaagatgtgcacgtagtcaaggaacaaaatccgccacccgcccggagcgaggatatgcctttttcccccaaggcatccgtagccgcaatggaggccaaggagcaattatctgcccaggaattaatggagagtgggctccagatacagaaaagcccggagccagaggtactgtcgacacaggaggaccttttcgatcagagtaataaaaccgttagttctgacgggtgcagcactccgtcccgtgaggaaggtggctgctctctggctagcactccggctactacattgcacctcctccaattgtccggccaaaggtctctggtccaggattccctgtctacaaactcttcagatttggttgctccatctccggatgcatttcgatccactccctttattgtgcctagttcacctacagagcaggagggccgtcaggacaagcctatggacacctccgtgctgagtgaggaggggggagaaccattccagaagaaactacagtctggcgaacctgttgagctcgaaaacccaccactgctacccgaatccacagtgtcaccgcaggcttccactcccatatcacagtccacaccagtcttcccacctggttcactccctattccgagccagcctcagtttagccacgacatattcattccatcaccatccttggaggagcagagcaacgacggtaaaaaggatggcgacatgcacagctcgtcactgactgtagagtgtagtaaaacgagtgagatagagcctaaaaacagcccagaagacctggggttaagtctgactggcgactcatgcaagctgatgctaagcacctccgagtactctcagtcgccgaagatggagagcttgtcgtctcatagaatcgacgaagacggtgaaaacacacagatcgaggacacagagcccatgagtcccgtgttaaacagcaagtttgtgccagccgagaatgattcaatactgatgaacccagcccaggacggagaagtgcagctaagccagaatgacgataagacgaagggtgatgacaccgacactcgagacgatatctccattctcgcgaccggctgtaaaggacgcgaggagacagtggccgaagacgtgtgtatcgacctgacctgcgatagtggctcccaggctgtgccatcccccgctactagatcagaagcgctcagcagcgtactcgaccaggaggaagctatggagatcaaggaacatcatcctgaagagggctcctcagggtcagaggtggaggaaattcctgagacaccctgtgaaagccagggagaggagcttaaggaggaaaatatggagagtgtgcccctgcacctgagcctaactgaaacccagagtcaagggctgtgcttgcaaaaggagatgcccaagaaagaatgctcagaggccatggaggtggagactagtgtgatttcaatcgactctccgcagaagctggctattctagaccaggagctggaacacaaagagcaggaggcttgggaggaagctaccagtgaggattcatctgtcgttattgttgatgtcaaagagcctagcccccgggtagacgtgtcatgcgaacccctggaaggagtcgagaagtgctctgacagccagtcttgggaggacatcgctcctgagatagaaccatgtgcggagaatcgcttggacacaaaggaggaaaaatcggtggagtacgagggcgatcttaagtccgggacggcagagaccgagcctgttgaacaggattctagccagccatcgctgcccttggtgagggctgacgaccccttgaggttagaccaggagctccaacagcctcagacccaggagaaaaccagtaactcactgaccgaagactccaagatggctaacgcaaagcaattgagttctgatgcggaagcgcagaaattggggaaaccaagtgcacacgcctcacagtcgttttgcgagagcagttctgagaccccattccacttcacacttccaaaggaaggcgatattatacctccattaacaggggccacgcctccgctgatcggtcacttgaagttggaacctaagaggcattcgacccctattggaatctctaactatcctgaatcaactatcgccacctcagacgtaatgtcagagtccatggtggaaacccatgaccccatcctgggatccggcaaaggcgattccggagccgcccctgatgtcgatgacaaactatgtttaagaatgaagctcgttagcccggaaacagaggccagcgaggagagcctgcagttcaacctggagaagcctgcgactggagaacggaagaacggatcaacagccgtggctgagagcgtcgcaagcccgcagaaaacaatgagtgtgctttcctgtatttgtgaagctcgccaggagaacgaggctaggagcgaggacccaccaaccacccccattagagggaatctgctgcacttcccctctagccagggcgaggaagaaaaagagaaactggaaggcgatcacaccatcagacagtcccagcagcccatgaaaccaatttctccagtgaaagatccagtttcccctgccagtcagaaaatggtcattcagggtcccagctccccccagggtgaagccatggtgacagacgttctggaggaccagaaagaggggcgatccacgaacaaggaaaatcctagtaaagccttaattgagcggccctcacagaacaacatcggcatccagacaatggagtgcagtctccgggtgccagagactgtgtcggccgcaacccaaacaatcaaaaacgtgtgtgaacagggtacatccaccgtagatcagaacttcggtaagcaagacgctaccgtccagaccgaacggggctctggcgagaaacctgttagcgctcctggcgatgatacggagtccttgcattcacaaggagaagaggaatttgacatgccccaacctcctcacgggcatgttctgcatcggcacatgagaaccatccgtgaagtacgcacgcttgtcacacgagtcatcacagatgtctactacgtggacggcaccgaagttgagaggaaggtcacagaagagacggaggaaccaatagttgaatgccaggaatgcgaaactgaggtctcacctagccagacagggggatcctcgggcgacctgggggatatctcaagcttctcctccaaggcatcaagcttacacaggacttcctctggaaccagcctgtccgccatgcacagctcggggagcagcggtaaaggcgcagggcctctccggggaaagactagcggaacagagccagcagactttgccctccctagctctcgtggtgggcccggtaaactgagtcccagaaaaggtgtctcccagactgggactcccgtttgtgaagaggacggagacgcaggcctcggcattaggcagggagggaaggccccagtaacgccacgaggacggggaaggcggggccgcccaccgtcacgaactaccgggactagagagacagcagtcccagggcctcttggcatagaggacatcagtcccaaccttagtccagatgacaagtctttctcgagagtcgtaccccgggtcccggattctaccaggagaaccgacgttggagccggcgccctgagaaggtctgactcaccagagattccctttcaggcagcggcaggaccatctgacggtctagatgcgtctagcccagggaattcctttgtgggactgcgagtggtcgcaaaatggagcagcaatggatacttctacagcgggaaaattacccgagacgtcggggccggcaagtacaaactgctgtttgatgacgggtacgagtgcgacgtacttgggaaggacatcctgttgtgtgatcctatcccgctggacacagaagtcacagccctctcagaggatgagtacttcagcgccggggtggtgaaagggcaccgtaaagaatctggagagctgtactattcaattgaaaaagagggccaacgcaaatggtacaagcgaatggccgttattctgtctttggagcaaggcaatcggctgcgtgaacagtatggcctagggccctacgaggccgtgacacccctgacaaaagccgccgatatcagcctggataacctcgtggagggcaaaaggaaacgaaggagcaacgttagttctcctgccactcctacagctagcagtagtagttccacaaccccaaccaggaagataaccgaatctcctcgggccagtatgggcgtgttaagtggcaagaggaagcttattacaagcgaggaagaaagatctcctgccaagagggggcggaaatccgcgacagtaaagcccggtgcagtgggggccggggaatttgtctctccatgcgaaagtggcgacaacaccggtgaaccaagcgctctcgaagaacagcggggtcccctgccattgaacaagacccttttccttgggtacgccttcctgctcactatggctacaacctcagataagctagccagtagatctaagcttcctgatgggcccaccggaagctctgaagaagaagaggagttcctggagatcccacctttcaataagcaatatacagagtcccagcttagggcgggggccggctacatactggaggatttcaatgaggcgcaatgtaacacagcgtaccaatgtctgctgatagccgatcagcattgtcggacacgaaagtactttctgtgcttggccagtggtattccttgcgtgagtcatgtctgggtgcacgattcttgtcatgctaaccaactgcagaattatcggaactatctcctgccggccggttattctctggaggagcagaggatcctggactggcaaccgcgggaaaacccgtttcaaaatttaaaagtacttttagtcagtgatcaacagcaaaacttcctggagctgtggagcgagatcttgatgacgggtggcgcagcctccgtaaaacagcaccacagcagcgctcacaacaaggatattgccctgggtgttttcgacgtcgtggttacagatccttcatgccccgcctcagttctcaagtgcgcggaggcgctgcagctgcccgtagtttcacaggaatgggtgattcagtgcctgattgttggcgaaaggattggattcaagcaacacccaaagtataagcatgactatgtgagtcattag

SEQ ID NO: 26847 - DNA, 5928 bp, Artificial Sequence
  Description of Artificial Sequence: Synthetic coding sequence
atgcccggcgagcagatggaccccaccggcagccagctggacagcgacttttcacagcaggatacaccatgcttgattatcgaggattcgcagcccgaaagccaggttttagaggatgatagtgggtcacatttctccatgctctctcggcacctccctaacctccagacccataaagaaaatcctgtgctggacgttgtgagcaatcccgagcagaccgctggagaagaacgcggcgatggaaactccggctttaacgaacatttgaaagagaataaagtagctgaccccgtagactcctctaatctggatacctgcggtagcatctctcaggtgattgaacagctgccccagcccaatagaaccagcagtgtgttgggaatgtcagtggagtccgcacccgcggtggaggaggagaagggagaggaattagagcagaaggagaaggagaaagaagaagatactagcggtaataccactcattcactgggcgccgaagacaccgctagctcccagctagggttcggcgtcttagagctaagtcaatcacaggatgtggaagagaacactgtgccctatgaggtggacaaagagcagttgcagtcagttacaacaaactcaggctacacgcgcttgtcagacgtggatgctaacaccgcgatcaaacacgaagagcagtccaatgaagacatccctattgcggaacagtcttctaaggatattccggttactgcccagccatctaaagatgtgcacgtggtaaaagagcaaaatcctcctccagctcggtctgaggacatgcccttcagccccaaggccagtgtggctgcaatggaagctaaggagcaattgtccgcccaggagcttatggagtcaggtcttcaaattcaaaaaagtccagaaccagaagtgctgtcaacccaggaagacctgttcgaccagagcaacaaaacggtgagctctgacgggtgcagtacacctagtcgcgaggagggagggtgttcgttggctagcacaccagcaaccaccctccaccttctgcagctgtcgggccagcggtcccttgtacaagacagcctgtctactaactcctccgacctggtggctccttccccggatgcatttaggtccaccccgtttatcgtcccctccagtccaacagaacaggaggggcgtcaggacaagcctatggacaccagcgtgctgtccgaggagggcggcgagccctttcaaaaaaagctccaatccggtgaaccggtcgagctggagaacccacctttactcccggagtctaccgtttcgccccaagcctctacgcctatcagccagtcaacccccgtgttccccccaggcagcttaccaatcccatcccagccccaattttcacacgacatcttcatcccatccccgtcactcgaggagcagtccaacgacggtaagaaggatggggatatgcattcatcaagcctgaccgtcgaatgctccaagacatccgagatagagccgaagaattcaccggaggacttaggactaagtttgacaggcgactcctgtaagttgatgctcagcactagcgagtactctcagtctccgaagatggaaagcctgtcctcccacaggattgatgaggatggggagaatacccaaattgaggacaccgaacctatgagccctgtactcaactcgaagttcgtgcccgctgaaaacgattccatacttatgaatcccgcacaagacggggaggttcaactttctcagaacgacgataagactaagggggacgacactgatacccgggacgacatctctatccttgccacgggctgtaagggacgggaggagacggtggctgaggatgtgtgcattgacttgacctgtgactccggtagccaggctgtcccctctcctgcgacccggtctgaggcactttcttctgtgttagaccaagaggaggctatggagattaaggagcaccaccccgaagaggggagtagcggcagtgaggtggaggagattcccgagaccccctgcgagtcccagggagaggaactgaaggaagaaaatatggagagcgtgcctctgcatttgtccctgaccgaaacacaatcgcagggcctgtgtctgcagaaagagatgcccaaaaaagaatgtagtgaggccatggaggtggaaaccagcgttataagcatcgattcgccgcagaaactcgcaatcctggatcaggaactggagcacaaggagcaagaggcttgggaagaggctacatcagaggactcatccgtagtgatcgtggacgtgaaggagccctccccaagggttgacgtgagctgcgagccgttagagggggtggagaaatgctccgactcccaaagctgggaggatatagctcctgagattgagccctgtgctgagaacaggctggatactaaggaagaaaagtctgtggagtatgagggcgacctgaaatcaggtaccgctgagaccgaaccagtggagcaggattctagccagccatccctgccgctggtgagggccgacgaccctttgcgcttggatcaggagctgcagcagcctcagacccaggaaaagacatccaactctctcaccgaggattctaagatggctaatgcaaaacagctttcgagcgacgcagaggcccagaaactcggcaaaccgagtgcccacgccagccagagcttttgcgagagcagtagcgaaacccccttccacttcactttacccaaggaaggagatattatccctccactcaccggtgccacaccccctctgatcgggcatctgaagttggaaccaaaaagacattccactcctatcggaatatctaattaccctgagtccaccatcgctaccagcgacgtgatgtcagaatctatggttgagacacatgatcccatacttgggagcggaaagggcgattcaggagccgctcccgacgtggatgataagctgtgtctccggatgaaactggtttcaccagaaacggaggcaagcgaagagtcgctgcagttcaatctggaaaagcccgccacgggtgaacgtaagaatggatcgaccgcagtggctgagagcgtcgcatctccacaaaagacaatgtcggtactgtcttgtatatgcgaggccagacaggagaatgaagccaggtcagaagatcctcctactactcctattagaggaaatctcctgcattttccttcaagccagggtgaagaggaaaaggagaagctggaaggtgatcatactattcgccagtctcagcagccaatgaagcccatcagccctgttaaggatccagtgagtccagcttcgcagaagatggtgattcaaggaccatccagcccacagggggaggccatggtgacagatgtgctagaagatcaaaaagaagggagaagtaccaataaagaaaacccaagtaaagcccttattgagcggccatcccagaataacatcggaatccagaccatggagtgcagcctgcgtgtcccagagaccgtcagcgctgcgacacagaccatcaagaatgtctgcgagcaagggacctctacagtcgaccagaacttcggcaagcaggatgcgaccgtgcagactgagagggggtccggagagaagcctgtttccgctcctggcgatgatactgagtccctccactcccagggcgaagaagaattcgacatgccgcagcctcctcatggacacgtcctccacagacatatgcgtaccataagagaagttagaactctggtgacaagggtgattaccgacgtgtactacgtggacggtactgaggtggagagaaaggtgaccgaagaaacggaggaaccgatcgtcgaatgtcaggaatgtgaaacagaagtgtccccatcacagacggggggcagcagcggcgacctgggtgatatcagctctttcagctctaaggcttccagccttcatagaaccagcagtgggacctccctcagcgcaatgcacagctctggtagcagtggcaaaggcgcaggcccgttacgggggaagactagcggaacggaacccgctgacttcgccctgccttcaagccgtggcgggcccgggaaactgagccctagaaaaggggtttcccagactggaactcctgtctgtgaagaggatggcgatgctggcctaggaatccgccagggtggcaaggcccccgtcaccccaagaggccgggggaggcgcgggaggccgccttccaggacaacaggcactagggagactgcagtacctggcccgttagggatcgaggacatcagcccaaatttgtcaccagacgacaagtccttttcgagagtggtcccacgagtccccgattcgacacggcgcacggatgtgggcgcaggagccttgcgcagatccgacagcccagaaattccttttcaagcggcagccggtccctccgatgggttagacgcctcgagtcctgggaatagctttgtggggctgagagtcgtagcaaaatggagctccaacgggtacttttatagcggcaaaataacaagagacgtgggagctggcaagtataaattactgttcgacgacggctacgagtgtgacgttctcggcaaggacattttattgtgtgacccaatccctctggacactgaggtaaccgccctgagtgaagatgagtactttagcgccggtgtcgtcaaaggccacagaaaggagtcaggtgagctgtactactcgattgaaaaagagggacaacgaaaatggtataagcgcatggccgtaatcttgagcctggagcagggaaatagacttagagaacaatacggattgggcccgtatgaagctgtaactcctcttaccaaagccgcagacatttccctagataacttggttgagggcaagcgcaagcgacggtcaaacgtcagttcgcccgcgacaccaactgcaagttccagcagcagtaccacgcccacacgaaagatcaccgagtccccacgtgcatccatgggcgtgctgtcagggaagcggaaactgataacttctgaagaagaacggagccccgccaaaagagggcggaaaagcgcaacagtgaagcccgtaggcgcaggggaatttgtatctccctgtgagtctggtgacaacactggtgagccctccgctctggaggagcagcggggccctttacctttaaacaagaccctattcctcggctatgcctttctgcttaccatggcgacgacgtctgataagttggcctcccggtccaagctgccagacgggccaactggaagctctgaggaagaagaagaattcctcgaaatacctcccttcaataagcagtacaccgagtcacaattgcgggccggggccgggtacattctggaggatttcaacgaggcccaatgcaatacagcgtatcaatgtttgctaatcgcagatcaacattgtcgtacccgaaagtattttttgtgtttggctagcggaataccttgcgtttctcatgtgtgggtgcacgactcctgccacgctaaccaactccagaactatagaaattatctgctccctgcaggctattctctggaagaacagagaattctggattggcagcctcgcgagaaccctttccaaaatctcaaggtgctgctagtgtccgatcaacagcagaactttcttgagttgtggtcggagatcttgatgacaggcggagcggcatcagtgaaacaacatcatagtagcgcccacaacaaagacatcgcccttggggtcttcgatgtcgtggttacggacccctcctgtccagcctctgtgctaaagtgcgcagaagcactgcagctgccggtcgtgtctcaggaatgggtgatccagtgtttaattgttggggagagaattgggttcaagcagcaccctaagtacaaacacgattatgtgtcccactag

SEQ ID NO: 26848 - DNA, 1623 bp, Artificial Sequence
  Description of Artificial Sequence: Synthetic coding sequence
atggcccagagcaccgccaccagccccgacggcggcaccaccttcgagcatctgtggagttctcttgagcccgatagtacttatttcgatctgccacagtcttcaagaggcaataacgaagttgtcggaggaacagattcaagcatggacgtatttcacctggagggcatgacaaccagtgtcatggctcagttcaacctcctttcttctacgatggaccagatgtcctccagagcggcctctgcgtccccatatactcctgagcacgccgcaagcgtccctactcacagcccgtacgctcagcccagcagcacctttgatacaatgtcacctgccccggtgatccctagcaataccgattaccctgggccgcaccactttgaagtaaccttccagcagagctctaccgcgaaatcggctacttggacctattcccccctgttgaaaaagctgtattgccagatcgcaaagacatgtccaatccaaattaaagtgagcacaccacccccaccggggacagctattcgggcaatgcccgtctacaagaaggcggaacacgtgaccgatgtcgtgaaacgctgccctaaccacgagctagggagggacttcaatgaaggccaaagcgcgcccgcaagccatctgatccgcgtggaagggaacaatttgagtcagtacgtggacgaccctgtcaccggccggcagagcgtggtagttccctatgaaccaccgcaggttggaaccgagttcaccacgattttgtataatttcatgtgcaacagtagctgcgtggggggaatgaacagaagacctatccttatcatcatcacattagaaatgcgagacgggcaggtgctgggccgacggtctttcgagggcagaatttgtgcctgtccgggtagagacagaaaggcggatgaggatcattatcgagagcagcaggcactgaacgaatcaagtgcaaaaaatggagcagccagcaaacgagccttcaagcaaagtcctcccgccgtccccgccctgggtgccggcgtgaagaagaggcgccatggtgatgaggatacgtattaccttcaagtgagaggtagggagaattttgaaattctcatgaaactgaaggagagcctggagttaatggagctggtgccccagcccctggtcgactcctatcgccagcagcagcagctgctacagagaccttttctgacggggctggggtgccccaattgtattgagtattttacatcgcagggacttcaatcgatttaccacttgcagaacctcaccatcgaggacctgggagccctcaagattcccgagcagtaccggatgaccatctggaggggtctgcaggacctgaaacagggtcacgactacagcacagcccagcaattactgcgcagctccaatgcggcaactatttcaattggcggatccggtgaactccagaggcagcgggtgatggaggccgtgcactttagggtacggcatacaataacaataccaaatcggggcgggcccggtggcgggcccgatgaatgggctgatttcgggtttgatctgccagattgtaaggcgcgcaagcaacctattaaagaggaatttaccgaagccgagattcactag

SEQ ID NO: 26849 - DNA, 1500 bp, Artificial Sequence
  Description of Artificial Sequence: Synthetic coding sequence
atggcccagagcaccgccaccagccccgacggcggcaccaccttcgaacatttatggtcatccctggaaccagactcaacttattttgacctgccccagtcatcccgtggcaataacgaagttgtcggcgggaccgactcgagcatggatgtgtttcatctggaaggaatgactacatctgtgatggcgcagtttaaccttctctccagcaccatggatcagatgtcctcccgggccgcgtctgcttcaccatacacccccgaacacgctgccagtgttcctactcactcaccttacgctcagccctcatcgacttttgacacgatgtcccctgcccctgtaataccctccaataccgactatcccggaccacaccatttcgaggtgaccttccagcaatcctcgacggctaaatccgctacctggacatacagccctttgttaaagaagctgtactgccagatagcaaagacttgccctattcagatcaaagtttctacccccccgcctccaggaaccgcgatcagggccatgcctgtctataagaaagccgaacatgtcaccgatgtggtaaaacggtgcccgaatcatgagctcggccgagacttcaacgagggccaatccgcacctgccagtcatcttatccgcgttgaggggaacaatctgtcccagtatgtggatgacccggtgacaggccgtcagagcgttgtagtaccatatgaaccaccccaggtaggcaccgagtttaccacaattttatacaatttcatgtgtaacagcagctgtgtgggtggaatgaaccgccgacccatacttataatcatcactctggagatgagggatggacaggtgctcggacgtcgctcttttgaaggccggatttgtgcttgccccggtcgggacagaaaggctgatgaagatcattatcgcgagcagcaggcactgaatgagagcagcgccaagaatggtgccgccagcaaacgcgccttcaagcaatcaccaccggctgtacctgccctaggagccggggttaagaagcgccgccacggggatgaagatacatactacctgcaggttaggggaagggaaaactttgagatcctgatgaaactgaaggagtcgcttgagctgatggagcttgtgccgcagccactcgttgattcgtacaggcagcagcaacagttgctgcagcggcccagtcacctgcagcccccctcgtacggccccgtgctgagcccaatgaataaggttcacgggggaatgaataagctgccatccgttaaccagctggtcggccaacccccacctcattcctcggccgccaccccaaatttgggccctgtgggtcccggcatgctgaataaccacggccacgcagtccccgcgaatggtgagatgtcaagtagccacagtgcccagtccatggtgagtggatcccattgcacaccccccccaccttaccatgcggatccatctctggtcaggacctggggcccctag

SEQ ID NO: 26850 - DNA, 1668 bp, Artificial Sequence
  Description of Artificial Sequence: Synthetic coding sequence
atggcccagagcaccgccaccagccccgacggcggcaccaccttcgagcatctgtggtcgagtctggagcctgacagcacgtacttcgacctcccacagtcatctagagggaataatgaggtcgttgggggtacagacagctctatggacgtgttccacctggaggggatgaccacatcggtaatggcccagtttaacctgctgtcatccaccatggatcagatgagcagtagagcagccagcgcgtcaccatacacgcccgaacacgccgcatctgtgcccactcattctccatatgcccagccctcgtccacctttgacacgatgtcaccagcgccagtgatcccatcaaacaccgactaccccggaccgcaccacttcgaggtcaccttccagcagtcttctacggccaagagtgcgacttggacctactcacctttgttgaagaagttatactgtcagattgcaaagacatgccccatacaaattaaggtgtccactcccccgccgcccggaaccgcgatcagggccatgccagtgtacaaaaaagcagagcacgtgactgacgttgtcaagcgctgccccaaccatgaacttgggcgggattttaatgaaggccaatctgctccagcctcgcatctcattcgcgttgagggcaacaacctttcacagtatgtggacgaccctgtgacaggccggcagagcgttgtggtcccctacgagccgccgcaggttggaaccgagttcacaacaatactatataatttcatgtgtaacagctcctgcgtaggtgggatgaatcgtcggcctattctgatcattattacgttggaaatgagagacggtcaggtgctaggcagaaggtctttcgagggccgcatttgtgcttgccccggccgagataggaaggctgatgaagaccattacagagagcagcaagctctcaacgagtctagcgcaaaaaacggggccgcatcaaagcgggcatttaagcagtcccctcccgccgtgcccgctctaggtgctggagtaaagaaaagacgacacggggacgaggatacttactatctccaggttcggggccgcgagaattttgagatcttgatgaagctaaaagagtctctcgagctgatggaactggtgccacagcccctggtggattcgtaccggcaacaacagcagctgctccagagacctcctcgcgacgctcagcaaccctggccgaggagtgcaagtcaaaggagggacgaacagcagccgcagcgtcccgtccatggactcggcgtcccactacacagcgcaacccccttgcccaggcggccccagccgaggcaggatcttggggccctgaaaattcccgagcagtatagaatgacaatttggcgtggactccaggacctgaagcagggccatgactactccactgcccagcagctgttgcgaagctccaatgctgccactatatcaataggaggatccggagagctgcagcggcagcgagtcatggaggcggtccacttccgtgtacgccacactataaccatccctaataggggtggccctggtggtgggcctgatgagtgggctgatttcggtttcgacctgcctgactgtaaggcgcgcaagcagcctattaaggaggaatttacagaggccgagatccactag

SEQ ID NO: 26851 - DNA, 1281 bp, Artificial Sequence
  Description of Artificial Sequence: Synthetic coding sequence
atgctgtacgtgggcgaccccgcccggcacctggccaccgcccagttcaaccttctgagcagtacaatggatcaaatgagcagccgcgcggcttctgcttccccctacactccagaacacgctgcgtccgttccgactcacagtccgtatgctcaaccgtccagtacttttgacactatgtcccccgcacccgtcattccctcaaatacagattacccaggtcctcatcacttcgaggtaactttccaacaaagctctacagccaagtcagccacttggacatacagccctctactgaaaaaactgtattgccaaatcgctaagacctgcccaatccagatcaaggtcagcaccccccccccccccggcaccgctattcgggccatgcccgtctacaaaaaagcggagcacgtgaccgacgtggtgaaacggtgtccgaatcacgagctgggtcgagacttcaatgaaggccaatctgcacctgcaagccacttgatcagagtcgaaggtaacaatttatcacagtacgtcgacgatcccgtcacggggcggcagtccgtggtcgttccctacgagcctccccaggtggggacggaattcaccacgattctctacaacttcatgtgtaattcttcctgcgtcggcgggatgaatcgtagacccattctaattataatcacactggagatgagagatggtcaggtgctgggacggagaagctttgagggccggatctgtgcttgtccaggccgggataggaaggccgacgaggaccattatcgcgagcagcaggccctcaatgagagctctgcaaaaaatggcgctgcttccaaacgtgcgtttaagcagtccccacccgctgtgccagcactcggcgcaggtgtgaagaaaagaaggcatggcgatgaggatacctactacctccaggtcagggggcgcgagaacttcgaaatcctgatgaaactaaaagaaagtctggagctcatggagctcgtccctcagcctctggtggacagttataggcaacagcagcagttactgcagcgcccaccgcgcgacgctcagcaaccttggccgcggagcgcctcccaacgcagagatgagcagcagccacagaggccagtgcacgggcttggggtccccctgcactcagcaaccccgctgcctcgaaggccccagcctcggcaatttttcaaccggattggggtgagcaagctacatcgggtttttcatctgccacgcgtgacagagcacctcccaccagctgagccagatcactag

SEQ ID NO: 26852 - DNA, 1353 bp, Artificial Sequence
  Description of Artificial Sequence: Synthetic coding sequence
atgctgtacgtgggcgaccccgcccggcacctggccaccgcccagtttaaccttctgtcctcaaccatggaccagatgtcatctcgggctgcctctgcatccccctacacacccgagcatgcagccagtgtaccaactcacagcccgtatgcgcagccctcttcaacctttgatacgatgtcccccgccccagtgattccttccaataccgactaccccggtccccaccactttgaggtaaccttccagcagagctcgaccgccaagagtgccacatggacctactcaccattactgaaaaaactctactgtcagattgcaaaaacgtgccctatccagatcaaggtcagcacacctccaccacccggaaccgccattagagccatgccagtgtacaaaaaggctgaacatgtgactgatgtcgttaagcgatgccccaaccatgaactgggcagagacttcaacgagggtcagagtgccccagcgagccaccttataagagtggaaggcaacaatctctcccagtacgtcgacgaccctgttactgggaggcagtcagtcgtggtgccgtacgaaccaccgcaggtcggtacagaattcacaaccatcctgtataatttcatgtgtaattctagctgcgtgggcggcatgaatcgcagacctattttgataatcattactctggagatgcgcgacggccaggtactcggacggaggagtttcgagggtcgcatctgtgcgtgtcccggcagagatcgaaaggcagatgaggaccattatcgggagcaacaggcacttaacgagagtagtgcgaagaatggcgccgcctcaaagagagccttcaagcaatctccacctgccgtgcctgcactgggggcaggcgtaaaaaagcgcaggcacggtgatgaagatacatattacctacaggttcgcggcagggagaactttgaaatcttgatgaagctaaaggaatcactagagcttatggagctggtgccacagccgctggtggattcttaccgtcagcaacagcagctcttgcagcgaccttctcatctacagcccccgagttacgggcccgttttgtcccctatgaacaaagtgcacggcggaatgaataagttgccatcagtgaaccaactggttggccagccgcccccacattctagtgcggccactcctaacttagggccagtgggaccagggatgctcaataatcatggacacgcggtgcccgcgaatggagaaatgtcttccagccatagcgcacagagcatggtttccggctcccattgtacgcctccacccccttatcatgcagacccctcccttgtgcggacatggggcccgtag

SEQ ID NO: 26853 - DNA, 1764 bp, Artificial Sequence
  Description of Artificial Sequence: Synthetic coding sequence
atgctgtacgtgggcgaccccgcccggcacctggccaccgcccagttcaaccttctctctagcactatggaccagatgagtagcagagccgcctcggctagcccttacacccccgaacatgctgcatcagtcccaacccatagcccgtatgctcaaccttcctctacatttgacactatgagtcccgcacctgtgattcccagcaacacggattatccgggaccacatcacttcgaagtcacgtttcagcagagtagcacagccaaatccgctacatggacatactctcctctcctaaagaagctatactgccaaatagcaaaaacctgtcctattcaaatcaaggtttctactccccccccacccggtaccgcaattcgggccatgcccgtttataaaaaggctgaacacgttactgacgtggtgaaacggtgtccaaatcacgagctcggccgggatttcaacgagggtcagagtgcgccggcttcacacttgattcgagtggaaggcaacaatttgtcccagtatgtggatgatccagtcacaggacgacagtctgttgtagtcccttacgagcccccccaggtgggaacagaatttaccacgattctgtataacttcatgtgcaattcgagttgtgtggggggaatgaatcggcgtcctattttgatcattattaccctggagatgagggatggacaggtgttaggccgtagaagctttgagggacgaatttgcgcgtgtcctggtagagaccgtaaagcagacgaagatcactaccgggaacagcaagccctgaatgaatcttccgccaaaaatggagccgcgtcaaagcgggcttttaagcagtcccctcccgccgtccctgctctgggcgctggtgtgaagaaaagacgtcacggagatgaggacacttattatctacaggtgcgcggtagagagaactttgagattctaatgaagttgaaagagagcctcgagctgatggaactggtgccgcaaccacttgtggactcttacagacaacaacaacagctgctgcagcgtccttctcatctgcagcccccctcctatggccccgtgttaagccctatgaacaaagtgcacggagggatgaacaagttgccatccgtcaatcagttggttggccagcctccccctcattctagcgcagccactcctaacctgggccctgttggcccaggcatgttgaacaatcatgggcacgctgtgccagctaacggcgaaatgtcatcctctcatagcgcgcaatccatggtatctggctcgcactgtaccccaccgcctccgtaccacgccgacccctctctcgtgagctttctcacagggcttggatgcccaaactgcatcgagtactttacatcccagggcctccagtcaatttatcacttacaaaatctaacaatagaggatctcggcgcactgaagattccagaacagtataggatgacaatctggagaggcctccaggatctgaagcagggtcacgactatagtactgcgcagcaacttctcagaagtagtaacgcagcaactatttctatcgggggcagcggggagctgcagcggcaacgggtgatggaggccgtgcactttagggtgcggcacacaattaccattcctaacagaggcggccctggcggcggtcctgacgagtgggccgattttggtttcgacttacccgactgcaaagccagaaaacagcccataaaagaggagttcaccgaggccgagatccactag

SEQ ID NO: 26854 - DNA, 1698 bp, Artificial Sequence
  Description of Artificial Sequence: Synthetic coding sequence
atggaccagatgagcagccgggccgccagcgccagcccctacacccccgaacacgccgcaagtgtgccgacgcacagcccttacgcccaaccatctagcacctttgacactatgagccccgcccctgtaataccttccaataccgattatccaggcccccaccactttgaggtcacctttcagcagtcaagcaccgcaaaatccgccacttggacatacagtccgctactcaaaaaactctactgccagattgccaagacctgcccaattcagataaaagttagtaccccaccccctcctggaactgccataagagcaatgcctgtatataagaaagcagaacatgtcactgacgttgtaaagcggtgccctaaccacgagctgggccgcgattttaatgaggggcaatctgcaccagcgagtcacttgatacgcgtagagggtaataatttatcccagtatgtcgacgaccctgtaacaggcagacagagcgtggtggtgccctacgagcctccgcaggtgggaactgaattcacaactatattgtacaactttatgtgtaactccagctgcgttgggggcatgaaccggcgcccgattctcattatcataaccctcgagatgagggatggccaagttctcggaagacggtcgtttgagggaagaatctgcgcctgccctggtcgtgacagaaaggccgacgaggaccactacagagagcagcaggcactgaatgagagtagcgcgaaaaacggggccgccagtaaaagggcttttaaacagagtccgcctgctgtccctgctctgggcgctggcgtgaagaaaagaagacacggggacgaggatacgtactacttgcaggtgcggggcagagagaactttgaaattctgatgaaattgaaagagagcctggagctgatggagctggtcccacagcctctggtggacagttatcgccaacagcagcaactgcttcagcgacccagtcacttacaacctcccagttacgggccagtactgtccccaatgaacaaagtacacggcggtatgaataaactgccttccgttaatcagcttgtgggacagccacccccacacagttccgctgcaaccccaaacctgggccctgttggtccaggaatgctcaataatcacggacatgcagttcccgccaacggggagatgtcaagttcacatagcgcgcagtctatggtatcgggatcccattgcaccccccctcccccataccacgcggacccatcgttggtgtctttcctgaccggactcggctgccccaactgcattgagtactttacatctcaaggattgcagagtatttatcatctacagaacctcaccattgaagaccttggtgccctgaagatccctgaacagtaccgcatgaccatctggcggggcctacaggacctgaagcaaggtcatgattattctactgcacagcagctcctgcggagctcaaacgcggccacgatatccattggcggatcaggggagctgcaacggcagagggtcatggaggcggtacattttcgagtcagacatactattaccattccaaatagagggggaccaggaggaggaccagatgaatgggcagacttcggctttgatttgcctgattgtaaagccaggaagcaacctattaaggaggaatttaccgaagccgaaatacactag

SEQ ID NO: 26855 - DNA, 1911 bp, Artificial Sequence
  Description of Artificial Sequence: Synthetic coding sequence
atggcccagagcaccgccaccagccccgacggcggcaccaccttcgagcacctgtggtcatccctcgaacctgacagcacatatttcgaccttccacagagctctagggggaacaatgaggtcgtcggcggcacggactctagtatggatgtctttcacttggagggcatgactacttccgtcatggctcagtttaatctgcttagctccactatggatcaaatgtcttctcgcgcggcgtccgcctccccttatactcctgagcatgcagcctccgtcccaactcactccccatatgcccagccatcctctacattcgatacaatgagtcctgcaccagtgattccgtctaacaccgactaccccggcccccaccattttgaggtgacatttcagcagagctcaaccgctaaatcggcaacctggacctactccccgttgctcaaaaagctttactgccagattgctaaaacgtgcccaatccagatcaaggtgtctaccccccccccaccgggcactgctatcagggccatgccagtttataaaaaagctgaacatgttaccgatgtggtgaagcggtgccctaatcacgagctgggtagagactttaatgaaggtcagagcgcaccagcttcacaccttatcagagtcgaaggcaacaacctgagtcaatatgtggacgaccctgtgactggtcgacagtcagttgtcgtgccttatgagccgcctcaggttggcacggaattcaccactattctgtacaattttatgtgtaacagcagctgcgttggaggcatgaatcgacggcccatcctcatcatcataactcttgagatgcgggacggccaggttttgggccggcggagcttcgagggtcgtatctgcgcctgtccggggagagaccgcaaagcagatgaggatcactatcgcgagcagcaggcactcaatgaatcatctgccaagaatggggcggcctccaagagagcctttaaacaaagcccacctgccgtgcctgccttaggcgccggcgtgaagaaaaggaggcatggagacgaggatacctattatctgcaggtacgaggtcgggaaaactttgaaattcttatgaagcttaaagaaagcctggagctgatggaactggtgccccaaccattagtggattcctaccggcaacagcagcaactgctgcaaaggccaagccatctgcagccacccagttacggaccggtgctgagtcctatgaataaagttcacgggggcatgaataagttaccttcggtcaatcagctcgtcggacagcctcctcctcactcctcggctgcgacccctaaccttggcccagtgggtccaggcatgctcaacaatcatggccacgctgttccggccaacggagaaatgtcatcaagccatagcgcacagagtatggtgtccggctcacactgcactcctccgcctccctaccacgccgacccatcactcgtaagtttcctaactgggctgggctgtcctaactgtattgagtattttacctcgcagggcctgcagtcaatctatcacctccaaaatctcacaatcgaggacctgggagcattgaaaatccccgaacagtaccggatgactatctggcgaggtctacaggatctgaagcagggccatgactatagcactgctcagcaactacttagatccagtaacgctgctaccatcagtattggcggaagtggcgaattacagcggcaacgcgtgatggaagcagtacacttcagagtgcgacacaccatcaccatacccaatcgaggtggtcccggtggtgggcccgatgagtgggccgattttggctttgacctaccggactgcaaagctcgtaagcagcccatcaaagaagagtttacagaggctgagattcattag

SEQ ID NO: 26856 - DNA, 1053 bp, Artificial Sequence
  Description of Artificial Sequence: Synthetic coding sequence
atgggcgccggcgccagcgccgaggagaagcacagccgggagctggagaaaaagctgaaggaggatgccgaaaaggacgccaggacggtgaaactgctactccttggtgctggcgaatctggcaaatctacaattgtgaaacagatgaaaatcatacaccaggatggctacagtctggaggagtgccttgaatttattgcgattatctacggcaatacactgcagtcaatcctggcaatcgtgagagccatgacaacattaaatatccagtacggcgactccgcccgccaggacgacgcaaggaagcttatgcacatggctgacaccatcgaggagggaaccatgcctaaggaaatgtccgatatcatccaacgcctgtggaaggattctggcattcaggcctgtttcgaaagggctagtgagtatcaactgaatgatagtgctggctattacctcagcgatctggagcgcctggtaactccggggtacgtgccaacggagcaagatgtgttacggagccgggtgaaaaccacaggcattatcgaaacccagtttagcttcaaggacctgaacttccgcatgttcgacgtggggggccagagatccgagcgcaagaagtggattcattgtttcgagggtgtaacatgtattatctttatcgctgcactgagcgcatacgacatggtgctcgtggaagacgatgaggttaatagaatgcatgagtcgctgcacctatttaatagcatctgtaaccatcgctacttcgcaacaactagcatagtgttgttcctgaataaaaaagacgtgtttttcgagaagatcaagaaggcccatctgagtatctgtttcccggactacgacgggcctaacacctacgaagatgctgggaattacatcaaggttcagttcctggaactgaatatgaggagggacgtcaaagagatctatagccacatgacctgtgcaaccgacacccagaacgtgaaattcgtgtttgacgccgtaactgacataatcataaaggagaacctgaaggactgtggactcttctag

SEQ ID NO: 26857 - DNA, 609 bp, Artificial Sequence
  Description of Artificial Sequence: Synthetic coding sequence
atgatgcaggacgtgagcagcagccccgtgagccccgccgacgactctctgagtaactctgaggaagagccggaccggcaacagcctcccagcggcaaaaggggggggcggaagcgaaggtcaagtagacggtccgctggtggaggagcagggccaggcggcgctgccggtggtggggtcggcggtggagacgaaccaggatcgccagctcagggcaaaagaggaaaaaagagcgccggctgcggtggaggtgggggcgccgggggcggcggtggatcctcctctggaggcggcagtccgcagtcctacgaagagttacagacacagcgtgtcatggccaatgttcgagaaaggcagagaacacagagcttgaatgaggcattcgccgccctccgcaagattatacccactcttccctccgacaagttgtctaagattcaaacattgaagctagcggccagatacatcgacttcctgtaccaggtactgcaatccgatgagctcgactcaaagatggccagttgcagttacgtggcacacgaacgcctgagctacgcgttctctgtctggcggatggaaggggcatggtcaatgtccgcctcgcattag

SEQ ID NO: 26858 - DNA, 741 bp, Artificial Sequence
  Description of Artificial Sequence: Synthetic coding sequence
atgggcgaccgggagcagctgctgcagcgggcccggctggccgagcaggcagagcgctatgatgacatggcctcagccatgaaagccgtaacagaattgaacgaacccctttccaatgaagacagaaatctactgtccgtggcctacaagaacgttgtaggcgcccgaagaagttcctggagagtgatctcctctatcgaacaaaaaacgatggctgatggtaatgaaaagaaactcgaaaaggtgaaagcttacagagagaaaatcgagaaagagcttgagacggtgtgcaacgatgtcctttccctcctggataaatttctcatcaaaaactgtaacgattttcaatatgagagtaaagtgttctatcttaaaatgaagggggactactacaggtatctggcagaggtcgccagtggcgagaagaaaaattccgtggtggaggcttcagaagccgcctataaggaggcattcgagatctctaaagaacagatgcagccaacccacccaattcggctgggtctcgcccttaatttctctgttttttattacgaaatccagaacgccccagagcaagcctgtctcctcgcgaagcaggcctttgacgacgccatcgccgagttggataccctaaacgaggactcttacaaggactccaccctcattatgcagttactccgagacaatttaaccctgtggaccagcgatcagcaggacgaggaggcaggcgaaggaaattag

SEQ ID NO: 26859 - DNA, 1626 bp, Artificial Sequence
  Description of Artificial Sequence: Synthetic coding sequence
atggtgtggcgggtgccccccttcctgctgcccatcctgttcctgggtacgcactaccagctggatgtacagttgtaccactgtacccttctgggcccagcaagcccacccgcccatgtcctgttgccccccagtggcccccctgcacctcgacatctccatgcccaggccctgtctgattccgaaatccagcttacttggaaacaccccgaggcgctgcccgggcctatttccaaatacgtggtcgaagtccaggtagcaggcggcgcaggcgaccctctgtggatcgacgtcgataggccagaggagaccagcaccataattcgcggcttgaacgcctccactaggtacttattccgaatgcgtgcgagcatccagggtcttggtgactggagtaataccgtggaggaaagtacgctgggcaatgggcttcaagccgagggacctgttcaggagtcccgcgccgccgaggagggactggatcagcaacttatcttggccgtcgttggaagcgtctcggcgacctgtctgactatcctggccgcccttcttactctggtgtgcatccgccggtcttgtctacacagaaggaggaccttcacctatcagtccggtagcggtgaagagacaatcctgcagttctcttccggtacgctgacgctgacaaggagacctaaactgcagcccgagcctttaagttaccccgtcctcgaatgggaggacattacgtttgaggacctgatcggagaaggcaactttgggcaggtgatcagagcaatgattaagaaggacggcttgaagatgaacgccgccatcaaaatgcttaaagagtatgcctccgagaatgaccaccgggacttcgccggggagctcgaagtcctgtgcaaacttggacaccacccaaacattataaatctcttgggcgcatgtaagaatagaggttacttgtatatcgctatagagtacgcgccttatggaaatctgctcgacttcctccgcaagtccagggttttggaaacggaccctgcatttgcgcgtgagcatgggacagcatccacactttccagtaggcagctgctgagatttgcatccgacgccgcgaacggtatgcagtatctgtctgagaagcagtttatacatcgtgacttagcagctcgcaatgtcctggtgggcgagaacctggcgtccaagattgctgattttggactgtcccggggcgaagaggtgtatgttaaaaagaccatgggtcggctccccgtccggtggatggcgatagagtctctgaactacagcgtgtatactaccaagtcagatgtctggagtttcggcgtgctgctgtgggaaatcgtgagcctggggggcactccgtactgcggtatgacctgcgccgaactgtatgagaaacttccacaaggctaccggatggagcagccgcggaactgtgacgatgaggtgtatgagctgatgaggcagtgttggcgggaccggccctacgagaggccacccttcgcacagatcgcgctgcagctaggccggatgctggaggcacgaaaggcatatgtgaatatgtcactgtttgagaactttacttatgcgggcatcgatgctacggctgaggaagcttag

SEQ ID NO: 26860 - DNA, 3417 bp, Artificial Sequence
  Description of Artificial Sequence: Synthetic coding sequence
atggtgtggcgggtgccccccttcctgctgcccatcctgttcctggcctcacatgtgggcgccgcagttgatctgactcttctggccaatctcaggctcaccgaccctcagcgcttcttcctgacctgcgtgagtggggaagccggcgccgggagggggtccgacgcatggggcccccctctgttattggaaaaagacgatagaatcgtgcgtacgccacctgggcctccgttgcgccttgcaagaaatggcagtcaccaggtaactctgaggggtttctccaagcccagtgatcttgtgggcgtttttagctgtgtggggggtgcaggagcaaggagaactagggttatctacgtccataatagcccaggtgcgcacctgctgccagacaaggtgacacacactgtcaataaaggagacacagcggtgctgagcgcacgggtgcacaaggaaaagcagaccgacgtcatatggaagtccaacggcagctatttctataccctggattggcacgaagcccaggatgggcggttcctcctgcagctgcctaacgttcagccaccctccagtggtatctatagcgcaacttatctggaagctagccctctgggaagcgcattcttcaggctgatcgttagagggtgcggtgccgggaggtggggaccaggatgcaccaaagagtgcccaggctgcttgcatgggggtgtgtgtcatgatcacgacggagagtgcgtttgccctccagggtttacggggaccaggtgcgagcaagcctgtagggagggcaggtttggccagtcctgccaggagcagtgtccaggtatttcagggtgtcggggattgacgttctgtttgccagatccctatggatgctcttgcgggagtggttggaggggctctcagtgccaggaagcctgtgctcctgggcacttcggagctgactgtcgcctacagtgccaatgccaaaatggagggacctgcgacaggtttagtggttgcgtgtgcccctccggctggcatggagtccactgtgaaaaatccgatcgcattccccaaatcctcaacatggcgtcagaactggaattcaacttggagaccatgcctcgtatcaattgtgctgctgccggaaaccccttccccgtccggggctccatcgagctcaggaaacccgacggcacagtactgctctctactaaagccatcgtggaacctgaaaagactacggcagagtttgaggttccaaggctagttttagccgatagcgggttctgggagtgccgcgtgagtacctcaggggggcaagactctcggaggttcaaagtgaacgtaaaggtgcctcctgtgcccttggcggcccccagactcttgaccaagcagtcgcgccagctggtggtttctccactggtgtcatttagtggggacggcccaatttcgaccgtgcgtctacactacaggccccaagatagtactatggactggagtactatcgtggtggatccctccgaaaatgtaacattgatgaatcttcgaccaaaaaccggatactctgtacgagtccagctgagcagaccaggcgagggcggcgagggagcctggggaccaccaactttaatgactacagactgcccggagcccttgctgcagccatggctcgagggctggcacgttgaaggaacagataggctgagggtctcctggagcttacccctcgtgcccggccccctagtgggggatggatttctacttcgcctctgggacggcacgaggggccaggaacggagggagaacgtgtcttcccctcaggccaggacagccttactcaccgggttgactcctgggacacattatcaattggatgtccagctgtaccattgtacgctgcttgggcctgcatctccacctgcccatgtgctgctaccaccctcgggcccgcctgcccctcgccacctccacgcccaggccctgtctgatagcgagatccaattaacttggaagcatcctgaagcactgccggggccaatctccaaatatgtcgtggaggtgcaagtggccggaggagccggggatcctctttggattgatgtggacaggcctgaagagacctccacaatcatcaggggcctcaacgcaagtacccgctacctctttcgcatgcgcgcgtccattcagggtctgggagactggagcaacaccgtggaggagtccacattgggaaatgggctccaagccgaaggccccgtgcaggagagtcgcgccgcggaggaaggacttgaccagcagctcatactagcggttgtggggtccgtgtcggctacctgtctgacgatactcgctgctctgcttacccttgtttgcattcgtaggagctgtttgcaccgcagacggaccttcacgtaccaatcaggcagcggcgaggaaaccatcctgcagttttctagtggtacgctcacgctcacaagacgtcccaagctgcaacccgaacctctcagttatccagtactcgagtgggaagatataaccttcgaagatctgatcggcgaagggaactttggacaggttatccgtgctatgatcaagaaggacggcctaaagatgaatgccgccattaaaatgctgaaggagtacgccagcgagaatgaccaccgagactttgccggcgagctggaggtgctgtgcaagctgggacaccacccgaacataattaatctgctgggcgcgtgcaagaaccgaggctacctgtacatcgccattgagtacgccccatatggtaatctgctggactttctgcggaagtctagagttctggaaaccgatcctgcctttgccagggagcatggcaccgcgtccactctatcatccagacagctgcttaggtttgcatccgatgccgctaatggcatgcagtacttaagtgaaaagcagtttatccacagagacttggccgcacgtaatgtcttggtcggggagaacctggcttccaagatcgcggattttggcctgtcaaggggagaggaggtttatgtcaaaaagaccatgggccgcttgcctgtgaggtggatggcgatcgaaagtctgaattactccgtatatacgacaaaatccgatgtctggtcctttggcgtgttgctgtgggagattgtgtcgttgggcggcactccgtactgcggtatgacctgtgccgaactgtacgagaaattaccacagggctaccgcatggaacaaccgagaaattgcgacgacgaggtctacgagctgatgaggcagtgttggagagataggccgtacgagcgcccaccatttgcccagattgcactgcagcttgggaggatgttagaagctagaaaagcatacgtcaatatgagtctgttcgagaactttacgtatgctggaatcgacgctacagcggaagaggcttag

SEQ ID NO: 26861 - DNA, 2352 bp, Artificial Sequence
  Description of Artificial Sequence: Synthetic coding sequence
atggccagcgagctggagttcaacctggagaccatgccccggatcaactgtgcagcggcagggaatcctttccctgtgaggggctcaatcgaactgcgtaaacccgacggtacagtgctgttatcaaccaaggctatcgtggaaccagaaaaaaccactgcggaatttgaagtcccaaggctggtgctagctgactcagggttctgggagtgcagggtctctactagcggcgggcaggacagtcggcgtttcaaagtgaacgtgaaggtaccgcctgttccgttagcagcccctaggctcttgactaagcaaagcaggcagctcgtagtttcaccactggtgtctttctcgggggacggtccaattagtacagtccggctccattatagacctcaggatagcaccatggactggtcgactatcgtggttgacccctccgagaacgtgacactgatgaatttgcggcccaaaactggctatagtgttcgagtgcaactctcccgtcccggagagggcggcgagggagcctggggcccccctacactcatgaccactgactgccccgaaccactgcttcagccctggctggaaggctggcacgttgaagggacagaccgcctccgggtcagttggtcactacctttggtgccgggaccactggtgggagatgggttcctgctccggctttgggacggcacacgtggccaggagagacgggagaacgtgagcagtccacaggcccgcaccgcactgctcacaggcctgacccccggcacacactaccagttggatgtgcagctctaccactgtaccctgctggggcctgcttctccccctgcccacgtcttgctgcctcctagcggtcctccagctcctcggcacctgcatgcacaggctctatcagactcagagatacagctaacctggaaacatccggaggccctgccgggaccaatatcaaaatacgtggtcgaagtgcaggtagctggcggggctggcgacccactgtggatcgacgtcgaccgacccgaggagacctctaccattatcaggggcctgaacgcttccacgcgttatctgttccgcatgagggccagcattcaggggctgggagactggagcaacaccgttgaagaatctacgctgggtaatggcctgcaagcagaagggccagttcaagaaagccgggccgcagaagaaggactcgaccagcaactgattttagccgtggtgggatcagtcagcgccacctgcttgacaattctcgccgcgctgctcactttggtgtgcatccggcgctcctgcctgcaccgacgaaggacctttacataccagagcggaagcggagaagaaactatcctgcagttttctagtggcactctgacgttaactcgtcgtcccaaactacagcctgagccactctcgtaccccgttctcgaatgggaggacataacctttgaggatctgattggggaggggaactttggacaagtgatccgggcgatgatcaagaaggatggacttaaaatgaacgccgccatcaaaatgttaaaggagtacgcttcagaaaacgaccaccgggacttcgcaggggagctggaggttttgtgcaaacttggccatcacccgaacatcatcaacctcttaggggcgtgcaagaatcgcgggtacttgtacatcgctattgagtatgccccatatgggaatctgctcgacttcctgagaaaaagtcgggtgctggagactgaccccgccttcgcaagagaacacggaacagcaagtacccttagctcgaggcagctcctccgctttgcctcagatgctgcgaatgggatgcagtatttatccgaaaaacagttcattcatcgggacctggcagcaaggaacgttttggtcggagagaacctggcctcaaagatcgccgattttggtctttctagaggagaagaggtctatgtgaaaaaaaccatgggcaggctccccgtgaggtggatggctatcgaaagtctgaactatagtgtctacaccactaaaagcgatgtctggtccttcggcgttctcttatgggaaatagtgtctctgggcggaacaccttattgcgggatgacctgcgccgaactgtacgaaaaactgccccaggggtataggatggagcagcccagaaactgcgacgatgaagtgtacgaattaatgcgtcagtgttggcgggatcgcccgtatgagcggccaccttttgcccagatagcactgcagttggggcgaatgctggaggctcgtaaggcttatgtgaacatgtctctcttcgagaacttcacatacgctgggatcgatgctacagctgaggaagcttag

SEQ ID NO: 26862 - DNA, 954 bp, Artificial Sequence
  Description of Artificial Sequence: Synthetic coding sequence
atggtgtggcgggtgccccccttcctgctgcccatcctgttcctggcctcacacgtcggcgccgccgttgacctcaccctgctggccaacctgcggctcaccgacccgcagaggttcttcctgacttgcgtgtccggggaagcaggtgccggccgcggcagtgacgcatgggggcccccacttctgcttgaaaaagatgacaggatagtgagaacccccccagggcccccattgcgactggctcgaaatggaagccaccaggtcacccttaggggattcagcaagcccagtgacttagtcggtgttttttcttgcgtgggcggagccggagcacgacggaccagagtgatctacgtgcacaactccccaggagcccatctgctgcctgacaaagtgacacacactgtcaacaaaggggacaccgccgtcctatcagcaagagttcacaaggagaaacaaacagatgtaatctggaagtctaacgggagttacttttatacgctggactggcacgaagcccaagatggtagatttttgttgcaactgcccaacgttcagcctccgagttccggcatttactcagccacttatttagaggcgagtcctctgggttccgcttttttccggctgatagtgcgggggtgtggcgccgggaggtggggtccaggctgcacgaaagaatgtcctggatgtctgcacggtggcgtttgccacgaccacgacggagagtgtgtctgccctcccggcttcactggaactcgatgcgagcaagcctgcagagaggggaggttcggacagagttgccaagaacaatgtccagggatcagtggctgccgtggtctgactttctgtctgcctgacccctacggctgttcatgtggatcaggctggcgcggctcacagtgccaggaggtgcaccagggccactgcggggctagggaagaccatagctag

SEQ ID NO: 26863 - DNA, 1266 bp, Artificial Sequence
  Description of Artificial Sequence: Synthetic coding sequence
atgcgggccagcatccagggcctgggcgactggagcaacaccgtggaggagtctactctgggtaacggcttgcaggctgaaggaccagtgcaagagagtagggcagccgaagagggacttgatcagcagttgatactcgcggtcgtgggctctgttagtgcaacatgcctaacaattctcgctgctctgctcacactggtctgcatccgaagatcctgtctgcataggcgacggacatttacataccagtctggcagtggcgaagaaacaatcctgcagttctctagcgggactctgacactgactcgccgccccaaactccaacccgaaccattgagctatcccgtgctcgagtgggaggatattacttttgaagacctgattggggaaggtaatttcggtcaggtgattcgggccatgatcaagaaggacggcctgaaaatgaacgcagctatcaaaatgctgaaggagtacgcctctgaaaacgatcacagagattttgcaggcgaactggaggtgctttgcaaattgggtcatcaccctaacataattaatctactgggagcttgtaaaaatcggggttatctgtacattgccatcgagtacgccccgtacggaaatctgcttgactttctgaggaagtccagagttctggaaacagaccctgctttcgcaagggagcacggcactgcttctactctaagctctcgccagctattgcggttcgccagcgatgccgccaacggcatgcagtatctgtcagaaaagcagtttatccatcgggacctggcagcccgcaatgtgctcgtcggagaaaacctagcaagtaaaatcgccgatttcgggctgtccagaggggaggaggtgtacgtcaagaaaacaatgggccgcttgccagtgagatggatggccattgagagcctgaattactccgtgtacacgacaaaatctgatgtttggtccttcggcgtgttgctctgggagattgtctccttgggaggcaccccatactgtgggatgacttgcgccgaactgtacgagaaactaccccagggctacagaatggagcagccaaggaattgtgacgatgaagtctacgaactgatgcggcaatgctggcgcgacagaccctatgaaagacctcccttcgctcaaattgctcttcagctgggtcggatgttggaagctaggaaggcctacgtaaacatgtcacttttcgagaatttcacctacgcaggcatcgacgctaccgccgaagaggcctag

SEQ ID NO: 26864 - DNA, 1140 bp, Artificial Sequence
  Description of Artificial Sequence: Synthetic coding sequence
atggtgtggcgggtgccccccttcctgctgcccatcctgttcctggcctcccatgtcggtgcagccgtcgatctgactctcttggccaatctgaggctgactgacccccagagattttttctgacttgtgtgagcggcgaggctggggcgggacgtggaagtgacgcttggggcccccccctattgctagaaaaggacgaccggatagtgcgcacacctcccgggcccccattacgcttagctagaaatggaagccaccaggtcacgttaaggggcttttctaagccaagtgatctggtgggagtgttttcctgcgtcggaggggcaggagcccggcgtactagagtaatctacgtacataattctcctggggctcatcttctgcccgataaggttacgcataccgtgaacaaaggtgacacagccgttttatccgcacgcgtgcacaaagaaaaacagacagatgtgatttggaagagcaacgggagttatttctacacgcttgattggcatgaggcacaagatgggcgctttttactgcagcttccaaatgtgcaacctccctcctctggcatttactctgctacttacctggaagcctctccactcggatccgcattttttcgcctcattgttagaggttgcggagccggcaggtggggccctggttgtactaaagagtgcccaggctgcttacacggtggggtttgtcatgaccatgacggagaatgtgtgtgcccacccggttttaccggtacacgctgtgagcaagcatgcagggaaggccggttcggccagtcttgtcaagaacagtgccctgggatatccggctgtcgggggctgaccttctgtttgcccgacccctacggctgttcctgcggctccggatggcgcgggtcccagtgtcaggaagcatgtgcccctggacatttcggcgccgactgtcgcctacagtgccagtgccaaaacggcggcacgtgtgatagattctctggctgcgtctgcccaagcggctggcacggcgtccactgcgaaaagtcaggctggagagattgggtcgatacctccacagagaaacagaatactgatgagggaaggtttgggggacatgtcagcgcccctgtaggggctcccggttag

SEQ ID NO: 26865 - DNA, 819 bp, Artificial Sequence
  Description of Artificial Sequence: Synthetic coding sequence
atggccctgctggtgcgggtgctgcggaaccagaccagcatcagccagtgggtccctgtatgcagccgcctcatccctgtgagccctactcaggggcagggggatcgagctctgagcagaacttcccagtggcctcagatgtcccaatctagagcctgcggaggatccgaacagatcccaggtatagatatccaattgaatcgaaagtaccataccacccggaagttatcaaccaccaaggacagtcctcagcccgtggaagaaaaggtcggggccttcacaaagattattgaggctatgggcttcaccggccccctgaagtaccgctgccagatgccagatacctttaacagctggttcctgatcactttactgcacgtgtggatgtgcctggtgagaatgaagcaggaagggcggtctggcaaatatatgtgccgaatcatcgtgcactttatgtgggaagacgttcaacaaaggggccgggtcatgggggtgaacccatacatattgaagaagaatatgatcttgatgactaaccacttttatgccgccattctcgggtatgatgaaggcattttgtctgatgaccacggtctggcagccgctctgtggcgaacatttttcaatcggaaatgtgaggatcctagacaccttgagttgcttgtggaatacgttcgcaaacagattcaatacttggactccatgaacggtgaggatctccttctcacgggtgaggtgtcctggcgccctctggtggaaaagaatccgcagtccattttgaagccgcatagcccaacctacaacgacgagggcttgtag

SEQ ID NO: 26866 - DNA, 564 bp, Artificial Sequence
  Description of Artificial Sequence: Synthetic coding sequence
atgcagcccatcgacacctgcgtgagctacccccggaccggcggccagggatccgtgtcccactttcccggctgccaaatgcccgatacctttaactcatggtttctgattaccctcctacatgtgtggatgtgcctcgtgcggatgaagcaggaaggcagatctgggaagtatatgtgtcgaattattgtacacttcatgtgggaggatgtccaacagcggggacgcgtgatgggcgttaacccttatatccttaaaaagaatatgatcctcatgaccaaccatttctatgcagctatcctgggatacgacgagggaatcctctccgacgatcatggactggcagctgccctgtggcgcactttctttaatagaaagtgcgaagatccccggcacttagagctactggtagaatatgtgagaaaacagattcagtatctagatagtatgaatggagaagatctcctgctaacgggcgaagtgagctggaggccgctcgtcgaaaaaaaccctcagagtatccttaaaccacatagccctacatacaatgatgagggtctctag

SEQ ID NO: 26867 - DNA, 696 bp, Artificial Sequence
  Description of Artificial Sequence: Synthetic coding sequence
atggccctgctggtgcgggtgctgcggaaccagaccagcatcagccaatgggtacccgtgtgttcacggctgataccggtatccccaacccaggggcagggcgacagggctctgtccagaaccagtcagaaaatcaagattgctgctttgcggatgtatactagctgcgttgaaaaaactgatttcgaagaatttttcctcaggtgtcagatgcccgatacttttaacagctggttcttaataaccctccttcacgtgtggatgtgcctcgttagaatgaagcaggaaggacgtagtggcaaatatatgtgtcggataattgtgcatttcatgtgggaggatgtccagcagcgggggagagtaatgggtgttaacccgtacatcctgaaaaaaaatatgatcctcatgaccaaccatttctacgccgctatcctcggctacgatgaagggatactttcagatgatcacggcctggcagctgccttgtggcgcacttttttcaacagaaagtgtgaggatccacgtcacctggaactactggtggaatacgttaggaagcagatccaatatcttgacagtatgaatggcgaggatctgcttctgaccggcgaggtttcttggaggcccttggtggagaagaaccctcagtccattttaaagccccactctcccacttataatgacgaaggcctgtag

SEQ ID NO: 26868 - DNA, 822 bp, Artificial Sequence
  Description of Artificial Sequence: Synthetic coding sequence
atggccctgctggtgcgggtgctgcggaaccagaccagcatcagccagtgggtacccgtctgttccaggctgatcccagtcagccccacccagggccaaggggatagagctctgtcgcggacttctcagtggccccagatgagccaatccagggcctgcggaggttctgaacaaattccgggcatcgacatccaactgaatagaaagtaccacacgacgcggaaactttccactactaaagactcaccccagcccgttgaggagaaggtgggtgcgttcaccaagatcatagaggctatgggatttactggtcctctgaagtatagtaaatggaagatcaagatcgccgcgcttagaatgtatacatcatgtgtggagaagaccgacttcgaagaattcttccttaggtgccagatgccagacacctttaatagctggtttctcatcaccctccttcatgtgtggatgtgtctggtgagaatgaagcaagagggtcggagtgggaagtatatgtgccgcatcatcgtgcacttcatgtgggaggatgtgcagcagcgcggtcgggttatgggtggaattctttccgacgatcacgggctggctgctgcactctggagaactttcttcaatcgcaagtgtgaggacccaaggcacttggagctgctcgtggaatacgtgcggaaacaaatccagtacttggacagcatgaacggcgaggaccttctgctgaccggagaagtttcctggaggccactggttgaaaagaacccccagtccatattaaagcctcattcccctacttacaatgacgagggtctgtag

SEQ ID NO: 26869 - DNA, 900 bp, Artificial Sequence
  Description of Artificial Sequence: Synthetic coding sequence
atggccctgctggtgcgggtgctgcggaaccagaccagcatcagccagtgggttcccgtgtgctctcgacttatccccgtgagccctacacagggtcaaggtgatcgagctctctccaggacctcacagtggccccagatgagtcagtcacgtgcttgtggaggctcagagcaaatcccgggtattgatatccaactaaatcgaaaataccacactacacgaaagttgtcgacaacaaaggattccccccagcccgtggaagagaaggtgggcgcgtttacaaagataatcgaggctatgggtttcacggggcccctcaaatactctaagtggaagattaaaatcgctgcccttagaatgtacacaagttgcgtggagaagaccgatttcgaagaattcttcctcagatgtcagatgcctgacactttcaacagctggttcttgatcacactgctgcacgtgtggatgtgcctcgtcaggatgaagcaggaaggtcggtctgggaaatacatgtgcaggatcattgtgcatttcatgtgggaagacgtgcagcagcggggcagagtgatgggtgtcaacccatatatccttaaaaaaaacatgatactaatgaccaatcacttctatgctgcaatcctggggtacgatgagggtatcctgagcgacgatcatgggctcgcagccgccctctggagaacattctttaacagaaaatgcgaagaccccagacacctggagctccttgtcgagtacgtgagaaagcaaatccagtacctagattccatgaacggggaagacctcctcctgaccggggaagtcagttggcggcctctcgtggaaaaaaatcctcagagcattctaaagccgcactcacctacctacaatgacgaaggcctgtag

SEQ ID NO: 26870 - DNA, 603 bp, Artificial Sequence
  Description of Artificial Sequence: Synthetic coding sequence
atgggcttcaccggccccctgaagtacagcaagtggaagatcaagattgcagccctgagaatgtacacctcctgtgtcgagaagactgactttgaagaattttttctgagatgccagatgcccgacaccttcaactcttggtttctcattaccctgctgcacgtgtggatgtgtctggtgaggatgaagcaagagggaaggtccgggaaatatatgtgtaggataatcgtacattttatgtgggaagatgtccagcaaagaggcagggtcatgggcgtgaacccatacatactcaaaaaaaacatgatcctgatgactaaccacttctacgcagcaatcctgggctatgacgaaggtattctttccgatgatcacggacttgccgccgcattatggcgaacgttcttcaatcgtaagtgtgaggaccctcggcatctcgaactgctggtggagtacgtgcgcaaacaaatccagtatcttgacagtatgaacggtgaagatttgttgttaacgggagaggtgagttggcgtcccctcgtcgaaaagaatccacagagtatcctgaagccccatagccctacttacaacgatgaggggctctag

SEQ ID NO: 26871 - DNA, 489 bp, Artificial Sequence
  Description of Artificial Sequence: Synthetic coding sequence
atggccctgctggtgcgggtgctgcggaaccagaccagcatcagccagtgggtgccagtatgcagcagattgatcccagtgtctccgacccagggccaaggagacagggcgctgagccgcacttcccagtggccccagatgagccagagcagagcatgtggaggatctgagcaaatccccggcattgatattcagctgaataggaagtaccataccactccaatcctaggctacgatgagggtatcctctcagatgaccatggtctggctgcagcactttggagaactttctttaaccgcaagtgcgaggacccccgtcacctggagcttctggtagagtatgtgcgaaagcaaatccagtatctcgactctatgaatggagaagatctgctgttgaccggtgaagtttcatggcgaccactagtggaaaagaacccccagtcaattttaaaaccccactcgccaacatacaatgacgagggactctag

SEQ ID NO: 26872 - DNA, 435 bp, Artificial Sequence
  Description of Artificial Sequence: Synthetic coding sequence
atgtgcctggtgcggatgaagcaggagggccggagcggcaagtacatgtgtcgaattatcgtccattttatgtgggaggatgtgcagcaaagaggaagggtaatgggtgttaatccttacattttgaaaaaaaatatgattctgatgactaatcacttctatgcagcgatcctcgggtatgatgaggggattctgtccgatgatcacggactggcagctgccctgtggcgaacctttttcaacagaaagtgtgaggatcctaggcacctagaattattagtcgagtacgtcaggaaacaaatacagtacttggactccatgaacggcgaggacctcttgctgaccggcgaagtcagttggcgacctctcgtggagaagaatccccagtccattctgaagccacactcccctacctacaacgacgaaggactctag

SEQ ID NO: 26873 - DNA, 447 bp, Artificial Sequence
  Description of Artificial Sequence: Synthetic coding sequence
atggccctgctggtgcgggtgctgcggaaccagaccagcatcagccagtgggtgccggtgtgttcccggctgatccccgtcagcccgacccagggacagggagaccgagccctatctcggacctctcagtggccacagatgagccaatcccgggcttgtggtggatcggaacagattccaggcatagatatccagctgaaccgaaagtaccacaccaccaggaaactctccacaaccaaagattcaccccagccggtggaagaaaaggtaggcgcattcacaaaaattatcgaggccatggggtttactggaccactgaagtacagcaagtgggacgtcagttcacccaacgaggccggacgacctgaatgggaggtgcacgtctcctaccactccagtttctatgtgggtggatgctccgcagcacggcagagccatggcggctag

SEQ ID NO: 26874 - DNA, 825 bp, Artificial Sequence
  Description of Artificial Sequence: Synthetic coding sequence
atgctgagcgtggccagccggagcggccccttcgcccccgtgctgtcagccacctcccgtggagtggcgggcgccctcagaccgctggtgcaggctacggtccccgctaccccggagcagcccgttctcgaccttaagcggccatttctgtctagagaaagcctcagcgggcaggcggtgcgacgccctttggtggcgagtgtaggactcaacgtgcctgcatctgtatgctattcacacactgatataaaggtgccagatttctctgagtaccgaagactagaagtgttagactctacaaagagctcacgtgagagctccgaggctcgcaagggtttcagttacctcgtgacaggcgtcactacggttggggtggcatatgcagctaagaatgccgtcactcagtttgtgtcatctatgtcagccagcgccgatgtcctggctttggctaagattgaaattaagctttccgacattcccgaagggaagaatatggctttcaaatggcgagggaagcccctgtttgttaggcacaggacccagaaagaaattgagcaagaggcagcggtggaattgagccaattgagggatccccaacacgacttagatagagtgaagaagccggaatgggtgattctcatcggggtgtgtactcatcttggctgcgtcccgatcgcgaacgccggggatttcggagggtattattgtccgtgccatggatcgcactacgacgcaagcggcaggatccgactaggccccgcccctctgaatttggaggtgccaacttacgagttcaccagtgacgatatggttatcgtcggttag

SEQ ID NO: 26875 - DNA, 1221 bp, Artificial Sequence
  Description of Artificial Sequence: Synthetic coding sequence
atggccgccggcgccggcgccggcagcgccccccggtggctgcgggctcttagcgaaccactgagcgcagcgcaattacgacggctggaggaacacagatactccgctgccggcgtgtctctgctggaaccccccctgcagctgtactggacttggctccttcaatggatacccttatggatggcccctaatagcataacgctgttggggctggctgtgaatgtggtgactactctcgtgctgattagctactgtcctacagcaactgaggaagctccatattggacctatctgctttgtgccctgggtctcttcatctaccagtcacttgatgcaatagacgggaagcaggctagacggaccaactcttgctcgcctctgggagaactcttcgaccatggttgtgacagtttaagtaccgtgttcatggcagtgggcgcttccatcgcagcccgtttgggcacatatcctgactggttttttttctgctccttcatcggtatgttcgtcttttattgtgctcattggcagacctatgtgagcggcatgctccgatttggtaaagtggatgtgacagagatacagattgcccttgtaattgtattcgtgctgtcggcctttgggggcgccaccatgtgggattataccatccctatcttagagattaaactcaagatactgccagttctggggttcctgggcggtgtaatatttagctgctctaactattttcatgtgatactacatgggggagtcggaaagaatggtagtaccattgccggcacctcagtgctctcacctgggctacatattggcttgattatcattctcgcaatcatgatctataagaaatctgctacagatgtgttcgagaaacacccgtgcctttatattctgatgttcggctgtgtgttcgctaaagtgagccagaaactcgtagtggctcacatgacaaagtcggaactgtacctccaagatacagtgtttctcggaccaggcctcctatttctggatcaatattttaacaactttatcgacgagtacgtggttctctggatggctatggtgatctcaagcttcgacatggttatctacttctcggctctgtgcctgcagatcagtcgccacttgcatctgaacatctttaagactgcgtgccatcaagcgccagagcaggtccaggtcctctcctctaaaagtcatcaaaacaacatggactag

SEQ ID NO: 26876 - DNA, 2508 bp, Artificial Sequence
  Description of Artificial Sequence: Synthetic coding sequence
atggccgagctgagcgaggaggccctgctgagcgtgctgcccaccattcgggtccccaaggccggcgaccgggtgcacaaggatgagtgtgcctttagctttgataccccagagagtgaaggcggtctgtacatctgcatgaatacatttttgggtttcggcaagcagtatgtcgagagacattttaacaagacaggacaacgggtgtatctccacttgcgcaggacgaggagaccgaaagaagaggatcctgctactggaacgggcgacccgccacgcaagaagccaactaggctggccattggcgtagagggaggtttcgacctttctgaagagaaattcgagttagacgaggatgtcaagatcgtgatactgccggattatttggagattgctagagacgggctcggcggcctccccgatatcgttcgagaccgggtgactagcgccgtggaggccctcttgtcggccgattctgcaagtcggaaacaagaagtgcaggcctgggacggggaagtgcgccaggtgagcaagcacgcctttagtctgaagcagttggataacccagcgcggatcccgccctgcggatggaagtgttccaaatgtgacatgagagaaaatctttggctgaacctgaccgatgggagcattctttgtgggcgccgttactttgacggaagcggagggaacaatcatgctgttgaacactaccgggagaccggataccccctcgccgtcaagctgggcaccatcacacccgatggcgcggacgtgtatagctacgacgaggatgatatggtgcttgacccctcactcgcggaacacctgagtcactttggaattgatatgctcaagatgcaaaagaccgataagactatgactgaacttgagatcgacatgaaccagagaatcggagagtgggagctcatacaggagtcaggcgtgccactaaaaccgctattcggaccaggatatacaggcatccgcaacctcggtaacagctgttatctgaattccgtcgtacaggtgctgttctccatccctgacttccagcgcaagtacgtcgacaaacttgagaagatctttcagaatgcccccacggacccgacccaggattttagtacccaagtggctaagttaggacatggactgctgagcggcgaatattcaaaaccagtgcctgagtctggagatggagagcgggtgcctgagcagaaagaagttcaggatggaattgccccacgaatgttcaaggcccttatcggcaaaggtcaccccgagttcagcactaaccgccagcaggatgctcaggaatttttcctgcacttgatcaacatggtggagaggaattgccggtctagcgaaaaccctaacgaggtatttagattcttggtagaggaaaaaataaagtgcctggccacggagaaggtcaaatacactcagcgagtcgattacattatgcagctgcctgtgcctatggacgcagccttaaataaggaggagctgctagagtacgaggagaaaaagcggcaagcagaggaggagaagatggccctgcctgaactggtgagggctcaagtgccattcagctcctgcttggaggcatatggtgctcctgaacaggtggatgacttttggtccacagctctccaggccaagtccgtggctgtgaagactaccaggtttgctagttttcctgactacctggtcatacagattaaaaaattcacctttggtcttgactgggtgcccaaaaagctcgacgtaagtattgagatgcctgaggaattggatatcagtcagctgaggggaactgggttgcaaccaggagaggaagagttgcccgacattgccccacccctggtgactcccgatgaacctaaagcacctatgctggatgaatcagtaatcattcagctggtagaaatgggctttcctatggatgcctgtcgaaaagccgtgtactacacagggaatagtggagccgaagcagctatgaactgggtcatgagccacatggacgatccagacttcgctaatcctctgattttacctggatcttcgggcccgggctccacctctgctgctgctgaccccccacctgaggactgcgtcacaaccatcgtgtccatgggcttctccagagaccaagccctcaaggctctcagagcgaccaataactctctggaaagggccgttgactggatctttagccacatagacgacctggatgcagaagccgctatggatatatccgaggggagatcagccgccgattcaatcagcgagtctgtgccggtagggcccaaggtgcgggatggacccggcaaataccagctgtttgctttcatctctcatatgggaacgtccacgatgtgtggccattacgtctgccatataaagaaagagggcagatgggtgatatataacgaccagaaggtgtgcgccagcgaaaagccacccaaagacctgggctacatatatttttaccagcgtgtggcttcctag

SEQ ID NO: 26877 - DNA, 2385 bp, Artificial Sequence
  Description of Artificial Sequence: Synthetic coding sequence
atggccgacgcctgggaggagatccggcggctggccgccgacttccaacgggctcagttcgctgaagccacacaacgcctcagcgagagaaactgtattgagatcgtgaataaactgattgcacaaaagcagctggaagtagtccacaccctcgacggcaaagaatacataactccggctcaaatcagtaaagagatgagagatgaattgcacgtgcgcggcggtcgtgtcaatattgtcgatctccagcaggtgattaatgtcgatctgatacacatcgaaaatcgcatcggggatatcatcaagtcggaaaagcacgtccagctcgtgctcggccagctaatcgatgagaattacctggatcggttagccgaggaggtgaacgataagctgcaggaatccggacaggtgactatctctgaactgtgtaagacctatgatctgcctggcaactttttgacccaggccctgacccagagactgggaagaatcatttccgggcacattgatctcgataatcgcggagtaatctttaccgaagcgtttgtagctaggcataaggctaggattcgcggcttgttctcagctattactagaccaactgctgtgaactcgctcattagcaaatatggctttcaagaacagttactctacagcgttctggaggagctcgttaacagcggccgtttaaggggcactgtggtcggggggcggcaggacaaagcagtgtttgttccagatatttactcccgcacccagtctacgtgggtggatagtttttttaggcagaacgggtatctcgaatttgacgccctgtctagactcggaatccccgacgccgtaagctatatcaaaaagcgatacaagaccactcagctgctgtttctcaaggctgcctgtgtcgggcagggcctggttgaccaagtggaggcctccgtggaagaggcgatttcctccggtacctgggtcgacatcgcaccactgcttcctacatccctgtcggtcgaggatgcggcaatactgctgcagcaggttatgcgggccttctcaaaacaggcatctaccgtggttttctctgacactgtggtggtctcagagaagtttatcaatgattgtaccgagctgttcagggagcttatgcaccagaaggctgagaaagaaatgaaaaataaccctgtccacttgattaccgaagaagacctcaaacaaatcagcacactggagtcagtctccaccagtaagaaagataagaaggacgagcgcaggagaaaggcaaccgaggggtcgggatctatgagaggggggggtggtgggaatgctcgcgagtacaagattaagaaggtgaaaaagaagggcagaaaggatgatgactccgacgacgagtctcaatctagccataccggcaagaagaagccggaaatcagctttatgttccaggatgaaatcgaggactttctacgcaaacacatacaggatgccccagaagaattcatttccgagttggcggaatacctgattaagcccctgaacaagacttatttagaggtagtgagatctgtatttatgtcttccacgactagcgccagcggaactggccggaaacgaactatcaaagatctgcaggaggaggtttctaacttatacaacaatatccggctgtttgagaaaggcatgaaatttttcgcagacgacactcaggccgcgctgacaaagcacctgctgaaatcagtatgcactgatattaccaatttaattttcaattttttggccagcgatctgatgatggcagttgacgatcctgcagccattacctccgaaatcagaaaaaagatcctgagcaagttatctgaggaaaccaaagtggccctcacaaaactacacaacagcctcaatgagaaaagcatcgaggatttcattagctgcttagactcagcagcagaggcttgtgacatcatggtcaaaaggggggacaagaaacgcgagcggcagattctctttcagcatagacaggcattggccgagcagttaaaggttactgaggatccagcactgatcttacacttgacgtcagtgttactgttccagttcagcacccattccatgctccatgccccaggtagatgcgtaccccagataattgccttcctaaattcaaaaatccctgaagatcagcacgccctactggtaaagtatcagggtttggtagtaaagcaactggtgtcccagtccaagaaaacaggacagggtgactatcccttaaacaacgaactggacaaagagcaggaggatgtggcctctactacaagaaaagagctgcaagagctaagcagctcaataaaagacctggttttaaagtcaagaaagagtagcgtgaccgaggagtag

SEQ ID NO: 26878 - DNA, 942 bp, Artificial Sequence
  Description of Artificial Sequence: Synthetic coding sequence
atgatcggccagaagaccctgtacagcttcttcagccccagccccgcaagaaagcgccatgccccgagccctgaacctgccgtgcagggaactggtgtggcaggtgtccctgaagagtctggggacgccgccgcgattccggcgaaaaaagcccctgccggccaagaggaaccgggtacacccccgagtagtcctttgtctgccgaacagttagacaggatacagcgtaacaaagccgctgcactccttcggctcgcagctcgaaacgtcccagtgggcttcggagagtcgtggaagaaacacctgtccggagagttcgggaaaccatacttcataaagctgatgggtttcgtggccgaagaaaggaaacactatactgtgtacccacctcctcatcaggtgtttacttggacccagatgtgcgacattaaggacgtgaaggtggtgatactcggccaggacccctatcacggtccgaaccaggctcatggcctttgttttagtgtgcaacgacccgtcccgcctcctccctcactggagaatatttataaagagctctcaactgacatcgaagattttgtccacccaggacacggagatctcagtggctgggccaagcagggagtgctgttactcaacgcggtgctgaccgtcagggcccatcaggcaaacagtcataaggagcgcggctgggagcagttcactgacgcagttgtatcttggctgaaccagaacagtaatggcctagtgtttctcctatgggggtcatatgctcagaagaaagggtctgctattgaccgtaagcggcaccacgtgctccagaccgctcatccatcgcctctctcagtttaccgagggttcttcggatgcaggcacttcagcaagacgaatgagttgctgcagaagtcagggaagaagcccatagattggaaggaactatag

SEQ ID NO: 26879 - DNA, 915 bp, Artificial Sequence
  Description of Artificial Sequence: Synthetic coding sequence
atgggcgtgttctgcctgggcccctggggcctgggccggaagctgcggaccccaggtaaggggccacttcagctgctgagcaggctctgtggagaccatctgcaggctatccctgccaaaaaggcacctgccgggcaggaggaacccggtacccctccttcatcccctttatccgccgaacagttggatagaatacaaaggaacaaagccgccgccctgctgcggctggcagcgcggaatgtccccgtcggatttggcgagtcttggaagaaacacttgtctggggagtttggcaaaccttacttcatcaaacttatggggttcgttgcagaggaacgcaaacactacactgtgtaccccccccctcatcaggtgtttacatggacacagatgtgtgacattaaggacgtaaaagtcgtaatccttggacaggacccgtaccacgggcccaaccaggcccacggcttatgcttctctgtgcagcggcccgtaccaccacctccaagcctagagaatatatacaaggagctgtccactgatatagaggatttcgttcatcccgggcatggagacttgtccggttgggcaaaacagggggtgttactgctgaatgctgtgctgactgtgcgggcgcatcaggccaattcccataaggagcgcggttgggagcagttcaccgatgccgtcgtgagctggctgaatcaaaacagtaatggtctggtgtttctgctgtggggctcttatgcacagaagaaggggagcgcaatcgatcggaaaagacatcacgtactgcaaactgcccacccctcccctctgagtgtttatcggggattctttggatgccgccacttttctaagacaaatgagttgctccaaaaatccggaaagaaaccaatcgactggaaggagctgtag

SEQ ID NO: 26880 - DNA, 813 bp, Artificial Sequence
  Description of Artificial Sequence: Synthetic coding sequence
atgggcgtgttctgcctgggcccctggggcctgggccggaagctgagaactcccggcaagggacccttgtcagctgagcaattagataggatccagcggaacaaggcagctgctctgctcagacttgctgctagaaatgtgcccgtcggctttggcgagtcatggaagaagcatctcagcggcgaatttgggaagccctattttatcaaactgatgggctttgtggctgaggaacggaagcattatacggtttatccccccccccaccaagtcttcacttggacacagatgtgtgatattaaagacgtgaaggtggtgatcctgggccaggacccctaccatggccccaaccaagcacacggtttgtgcttctccgtccagcggccagtgcctcctccaccaagcttggagaacatatacaaggaattgagtactgacatcgaagacttcgtacatcctggacacggggacctaagtgggtgggccaagcaaggagtgcttctgctaaacgccgttctgaccgtgagggcccatcaggctaattcgcataaagaacgaggctgggaacagttcacagatgcggtggtgtcgtggctcaaccagaactcaaacggacttgtttttctgctttggggcagctatgcccagaagaagggttcagcaattgatcgaaaaagacaccacgtgctccagacagcacatccctcaccattgtccgtgtatcggggattttttggttgccgacacttctcaaaaactaacgagttgctgcagaagtctggaaagaagcccatagactggaaggagctctag

SEQ ID NO: 26881 - DNA, 9288 bp, Artificial Sequence
  Description of Artificial Sequence: Synthetic coding sequence
atggtgttcgagagcgtggtggtggacgtgctgaaccggttcctgggtgactatgtagtagacctcgatacttctcaactgagtttgggcatctggaagggcgccgtcgccttgaagaaccttcagatcaaagaaaatgccctgagtcagctggatgtgcccttcaaagtgaaggtgggccatattggcaatctgaagcttataatcccttggaagaacctatatacccagccagtggaggccgtgctcgaagagatctatctgctaattgtgccaagctctcgcatcaagtacgatcccctgaaagaggagaagcaactgatggaagccaaacagcaggagttgaaacggatcgaagaagctaagcaaaaggtggtcgaccaggagcagcatctcccggagaaacaggacacctttgccgagaaacttgtcacccaaatcatcaagaacctgcaggtgaagatcagctcaatacatattcgttatgaagatgacataaccaaccgggacaagcctctatcattcggtattagtctccagaacctgtcgatgcagactaccgatcagtactgggtaccctgcttacacgacgagacggagaaacttgtgaggaagcttatccgcttagacaatctctttgcttactggaacgttaagagtcaaatgttctatctgtcagactatgacaatagcctcgatgatttgaaaaacgggattgtaaatgaaaacatcgtgcccgaaggatacgatttcgtttttcgccctatctcagcaaacgctaaactggtcatgaaccggcgctcagatttcgacttctcggcccctaagattaacctggaaattgagctgcacaatatcgccatcgagttcaacaagccacagtatttctccattatggagttgctagagtccgtggatatgatggcacagaacctgccttacaggaaattcaaacccgacgtgccgttacaccaccacgctcgggagtggtgggcttatgcgatccacggcgtgcttgaagttaacgtttgtccccgactgtggatgtggtcttggaagcacattcggaagcacagacaaaaggtaaaacagtacaaagaactgtacaaaaagaaactcacttctaagaagccccctggcgaactgctagtgagcctggaggaactggaaaagaccctcgacgtctttaatataactatcgcccgccagaccgccgaagttgaagtaaagaaggcaggttataagatttacaaagagggtgtcaaagaccccgaggacaataaagggtggttttcttggctgtggtcctggagtgagcagaatacaaacgaacagcaaccagacgtccagccagaaacactggaggagatgctgacaccagaagagaaggctctgctctacgaagccatcgggtatagcgagaccgccgtggaccccactctgctgaagacattcgaggctttgaagtttttcgtgcatctaaagtctatgtctatcgtcttaagagagaaccatcagaagcccgagctagtggatatcgtgatcgaggagttttccaccctgattgtgcagcggccaggggcccaagctatcaagtttgaaaccaagattgattctttccacattacaggacttcccgataactccgagaagccccggcttttgtcttctttggacgatgctatgtccctctttcagatcaccttcgaaattaaccccctggatgagactgtgtcccagagatgtatcattgaagctgaaccgctcgaaataatctacgacgccaggacagtgaatagtatcgtggagttttttcgccctcctaaagaagtgcacctggcgcagctgacagcggcaacactgactaaactcgaagagttccgctctaagacagccaccggtctactctatatcatcgaaacccagaaggtcctcgacttgaagatcaacttgaaggcatcatacatcatcgtacctcaggacggtattttttcgccaacctccaatcttctgctgctggatctaggtcatcttaaagtcacaagcaaaagcaggtccgaactgcctgatgtgaaacagggcgaagctaatctgaaggagatcatggacagggcatatgattcattcgacatccagctcacctctgttcagttgctgtatagcagggttggtgacaactggcgcgaggcccggaagttgagtgtgagcacgcagcacatacttgtccccatgcatttcaatttagagcttagcaaggccatggtgtttatggatgtgaggatgcctaaattcaagatctatggaaagctaccgctcattagcctgaggatcagcgataaaaaattgcagggcatcatggagctgatagagtccataccgaaaccagagccagtgaccgaggtgagtgctcctgtgaagtcctttcagattcagacatccacaagcctgggtacatcgcagatctctcagaagattattcccctgctggagctccccagtgtatccgaagacgactctgaggaagagtttttcgatgcaccttgctctccattagaagagcccctccaattccctactggtgtaaaatctattaggactcgtaaattacagaagcaggattgctctgtcaatatgacaacatttaagattcgcttcgaggtccctaaggtcctgatagagttttaccatcttgtgggagactgcgagttatctgtcgtggagatactagtcctagggcttggagctgagatcgagattagaacctacgatcttaaggccaacgcgtttttaaaggagttctgtttgaaatgcccagaatacctggatgagaacaagaaacccgtctacctggtgacaaccctggataacaccatggaggatcttctgacgttggagtacgtgaaggccgaaaagaacgtcccagacctgaagtccacctacaataatgtgctgcaactgatcaaggtcaacttttctagtctggatatccacctccacacagaagctttgctaaacactatcaattatctccataacatcctgcctcagtctgaagaaaagagcgctccagtgtcgacaacagagaccgaggacaagggcgacgtgatcaagaagttggcccttaagctgtctactaatgaagatatcattacactgcagatcctagcggagctaagttgtctgcagatttttattcaggaccagaaatgcaatatcagcgagatcaaaattgaaggactcgactctgaaatgatcatgcgcccttctgaaacggagattaacgctaagctgcggaacataattgtgctggattccgacatcacggccatctacaaaaaggccgtgtatatcacgggtaaggaagtgttttcctttaaaatggtcagctatatggatgctaccgccggctctgcctacacggacatgaacgtcgtggatattcaggtcaacctgatcgtgggctgcattgaggttgtgtttgtgacgaagtttctgtacagcattctggctttcatcgataactttcaggccgccaaacaggctctagctgaagccactgtccaggctgccgggatggccgccacgggcgttaaagagctcgcccagcgctcctcccgcatggcactcgacatcaacatcaaagcccctgtcgtggtaattccacagtccccagtgagcgaaaatgtcttcgtggcagactttggactaatcaccatgacaaacactttccacatgatcacagagagtcagagttcccccccacctgtgatcgatctgatcactataaaactctctgagatgcgattgtatcggagccgattcataaatgatgcataccaggaggttctggatctactgctgccactgaacctggaggtggttgttgagcgcaacctgtgctgggaatggtatcaggaagtgccctgcttcaacgtaaatgctcagttaaaaccaatggagttcatcctatcccaggaggatataacaaccattttcaaaacactgcatggtaacatctggtacgaaaaggatggatcagcctcgcccgcagtgactaaagaccaatatagcgctacctccggcgtgactaccaatgccagtcatcatagcggtggagccactgtcgttacagccgcggtcgtagaggtgcattcgcgggctttactggtaaagacgaccctcaatatttcttttaaaactgacgacctgaccatggtactatactcgccgggaccaaagcaggcaagttttactgatgtgcgggacccctctctcaagctcgccgagttcaagctggagaacatcataagcactttgaagatgtacaccgacggctcaacatttagctcattttcactgaaaaactgcatactggatgataagcgaccgcatgttaagaaggcaacccctaggatgatcggcttgacagtgggctttgacaagaaagatatgatggatattaagtaccggaaggtcagagacggttgcgtcacggacgctgttttccaggagatgtatatctgcgcctctgtggagtttttgcagaccgtagcaaatgtgtttctcgaggcctataccaccggcactgctgtggagacctccgtgcagacgtggactgccaaagaggaagtgcccacgcaggagtcagtcaagtgggagatcaacgtgatcattaagaacccagaaatagtgtttgtcgccgacatgaccaagaacgacgccccagcgctggtcattaccacgcagtgtgaaatctgttataaggggaatcttgagaactctaccatgaccgcagcaatcaaggacttgcaggtccgcgcttgtccgtttctccctgtgaagaggaagggcaagattaccactgtgctgcagccttgcgatctcttctaccagaccacgcagaaggggacagatcctcaggtcatcgacatgagcgtcaagtcactgacccttaaagtctctcccgtcatcataaacactatgattacaatcacatctgccctctacaccactaaggagaccataccagaggagactgcttcatcaacagcccacctgtgggagaagaaggataccaaaacactcaagatgtggttcttagaagagagtaacgaaactgagaaaattgctccaaccaccgaactggttccgaaaggcgagatgattaaaatgaacatcgattctatttttattgtcctcgaagccggaattgggcaccgcacagtgcccatgctgctagcgaaatccagatttagcggggaggggaagaattggtcctctctgattaacctgcactgtcagctcgagctagaagtacattactacaatgagatgttcggcgtttgggagccccttctggagccattggaaatagatcagactgaggatttccgcccctggaacttgggaataaagatgaaaaaaaaggcaaaaatggcaatagtggaaagcgatcccgaggaagagaactacaaagtacccgaatacaaaactgtgatttcattccactctaaggaccaactgaatatcactctcagcaagtgtgggctggtaatgttgaacaacctcgttaaggcattcactgaagccgcgacgggttctagcgccgattttgtgaaggacctggccccatttatgatactcaatagtctgggactcaccatcagcgtctctccatctgattctttctccgttctcaatatccccatggctaagagttacgtgttaaagaatggcgagtcactttcaatggattacattaggactaaagacaatgaccacttcaacgctatgacctctctgagtagtaagcttttcttcattctgcttactcccgtgaaccactccacagcagacaaaataccgctcaccaaagttggcaggcgcctttacaccgtgcggcaccgggagtccggcgttgagcgctccatcgtctgccagatcgacaccgtggaagggtccaagaaagtgacaatccgatcccccgtccaaatccggaatcatttcagtgtgcctctgtcagtgtacgagggcgatacactcctgggcaccgccagcccagaaaacgagtttaatatacctctcggctcttacagatcgttcatattcctgaagccagaagatgagaactaccagatgtgcgagggaattgactttgaggaaattattaagaacgatggggccttgctgaaaaagaaatgtagaagcaagaatccttccaaggaaagcttcctcattaacatcgtgcctgagaaggacaacctcaccagtttgagcgtgtactccgaggatgggtgggatctgccatatattatgcatctttggcctcctattctccttcggaatctgcttccgtacaagatcgcttactatatcgaaggcatcgagaacagtgtttttacactgtcagaaggacattcagctcagatttgcactgcgcagttggggaaggcccggttgcatctaaagctactcgactacctgaaccatgattggaaatcagagtatcacatcaaacctaaccagcaagatatttcttttgtgtccttcacctgcgtcacagaaatggaaaaaacagacctggacatcgccgtgcacatgacctacaacaccggccagactgtggtggcattccattccccgtactggatggttaacaagacaggacgcatgcttcagtacaaggctgacggtatccaccgcaagcaccctcccaactacaaaaagccggtgctctttagcttccagccaaaccatttcttcaacaataacaaggtccagcttatggttacagatagcgagttatcaaatcagtttagtattgatacagtgggatcacacggagctgtcaaatgtaaggggctgaagatggactaccaagttggagttactatcgacctgtcatcatttaacataactagaatcgtcaccttcactcccttttacatgatcaaaaacaaaagtaagtaccatatttccgtggccgaagaagggaatgacaaatggctaagtcttgacttggaacaatgtatccctttctggccagagtacgccagttccaaactgctcatccaggtggaacggagcgaggacccccctaagagaatctacttcaacaagcaagagaactgtattttactcagactcgataacgaattaggcgggatcatcgcagaagtgaacctcgctgaacattccacggttatcacgttcttggactatcacgacggagctgccaccttcttgttgattaatcacaccaaaaacgaactggtccagtataatcaatcttccctgagtgaaatcgaagactctctgccgcccggcaaagcagtattttatacgtgggcggatccagtcggctccagaaggctcaagtggcggtgccggaaaagccatggcgaggttacacagaaggatgatatgatgatgcctatcgatctgggcgaaaagaccatatatctcgtctctttctttgagggattacagcgcatcatattattcacagaagaccctagagtgttcaaagtgacctatgagagcgagaaggcggagctcgctgaacaggagatcgccgtggcgctgcaggacgtggggattagtttggttaacaattacaccaaacaggaagtcgcgtacattgggatcacctcctctgatgtcgtgtgggagacgaagcccaagaagaaagcccgctggaaacctatgagcgtgaagcatacagagaagcttgagcgcgagttcaaagaatacactgaatcttcccccagtgaagataaggtaatccagctggacactaacgtgcctgtccgcctgaccccgaccgggcataatatgaagattctgcaaccccatgtgatagcactgcgccgcaactatctccctgccttaaaggtcgagtacaataccagtgcccaccagtcaagtttccgaatacaaatttatcggattcaaatacaaaaccagatccacggtgcggtcttcccattcgtgttttaccccgtaaaacccccaaagtctgtcaccatggatagcgctcctaagccctttacagatgtgtctattgtgatgcggagcgccgggcattcccagattagcagaatcaagtattttaaggtgctcatccaggaaatggaccttcggctggaccttggcttcatatatgccctgacggatttaatgaccgaagcggaagtgacagagaatactgaggtggagctcttccataaggacatagaagctttcaaagaagagtataagaccgccagtctagtcgaccagtcacaggtctccctctacgaatattttcacatttcgcctatcaaactccacctgtcggtgtcactgagttcaggcagggaagaagcaaaagatagcaagcagaatgggggtctgatcccggtacactcattgaatctcttactaaaatctatcggagcaactcttacagatgttcaagatgtggtatttaaacttgctttcttcgaactcaactatcagttccacacaacaagcgacctgcagtctgaggtaatacgacactatagcaagcaggccatcaaacagatgtatgtgcttattctgggcctggacgtgttaggcaatccttttggtctcatcagagaatttagcgagggcgtcgaagcattcttctacgagccttaccagggggcgatccagggacccgaggaatttgtggaaggcatggcgttggggcttaaagccctcgttgggggggctgttggagggctcgccggggctgcctctaagataaccggggcaatggcaaaaggggtggcagcaatgacgatggatgaggattaccagcagaagaggcgcgaggctatgaataaacaaccagcaggcttccgggagggcatcactcgaggaggtaaagggttggtttcagggttcgtgtccggaattaccggcatcgttaccaagcccattaaaggcgcccagaaggggggcgcggccggcttttttaagggcgtcgggaaggggctcgtgggtgctgtggctcgacccacaggcgggatcatcgatatggccagtagcacatttcaggggatcaaaagagccactgagactagcgaagtggagtctcttagacccccccgattttttaacgaggacggcgtgatacgcccatatagactaagggacggcaccgggaaccagatgctacagaaaattcagttttatcgagagtggataatgacccactccagttcgagcgatgacgacgacgatgacgacgacgatgacgaatctgatctaaatcactag

SEQ ID NO: 26882 - DNA, 9525 bp, Artificial Sequence
  Description of Artificial Sequence: Synthetic coding sequence
atggtgttcgagagcgtggtggtggacgtgctgaaccggttcctgggagattacgttgtggacctggatacctcacagctaagcctgggaatctggaagggtgccgtcgcacttaaaaatctgcagatcaaggaaaatgccttaagccagttggatgtccccttcaaagttaaagtgggacatatcgggaatctgaagcttatcataccttggaagaacctttatactcaacctgtcgaggcagtgctggaggagatttatcttttgattgtgcccagttctcgcatcaaatacgatcccctcaaggaggagaagcagctgatggaggctaagcagcaggagctcaagcggatcgaggaagccaagcagaaagtggtagatcaggaacagcatctacccgaaaaacaggatacctttgcagagaagttggtcacacaaatcatcaagaacctgcaggttaaaatatcatcgattcacattagatatgaggacgacattaccaatagagataagccactgagctttggaatctcactgcagaacctctccatgcaaaccacagatcagtattgggttccctgcctgcatgatgagactgagaaactggtcaggaagttgatcagactggataatctgtttgcctactggaatgtgaagtctcagatgttctatctcagcgactacgataatagcttagacgatctcaaaaatggcatcgtgaacgaaaatattgtgcctgaggggtacgacttcgtgttcaggccaatttctgctaatgccaaactggtgatgaataggaggagcgatttcgatttcagcgcaccaaaaattaacctagaaatagaactgcataacattgcaatagagttcaacaaaccacaatatttttcaattatggagctgttagaatccgtggacatgatggctcagaacctgccctaccgtaaatttaagccagatgtcccactacaccaccacgcacgcgaatggtgggcctatgcaatacacggagttctggaggttaatgtttgcccaagactttggatgtggagctggaaacacatccgaaaacatcggcagaaggtgaagcagtataaagaactctacaaaaaaaagctaaccagcaagaaacccccgggggagctcttggtttcgctggaagagctcgaaaagacactggacgtctttaacatcacgatagcacggcagacagccgaagtcgaagttaagaaggcaggctataaaatttataaggaaggcgtcaaagatccggaagacaataaaggttggtttagttggctgtggtcctggagtgaacagaacaccaatgagcaacagccagatgttcaaccagagacattggaagaaatgcttacccccgaggagaaggcccttctttatgaggctatcggatattccgaaactgcagtagaccctacgcttctgaagaccttcgaggccctcaaattcttcgttcatctcaaaagtatgtccatcgttctccgggaaaatcatcaaaaaccagagttggtagacattgtaatcgaggagtttagtacactgatcgtccagaggcctggggcacaggccatcaagttcgaaaccaagatagactccttccacattacaggcctccctgataacagcgaaaagcccaggctcctgagcagccttgatgacgctatgagcctcttccaaattacatttgagatcaatccactagatgagaccgtgagccagcgctgcattatcgaggcagagcccctggagatcatatatgatgcacgcacggtaaacagtatcgttgaatttttccgcccacctaaggaagtccatctggcccaactaacagctgctactcttacgaaacttgaagagttccgttcaaagactgccacagggctgttgtacattatcgagacgcagaaggtactggacttgaaaatcaacctgaaagcctcctatataatagttccacaggacggcatcttttccccaacaagcaacctattgctgctggacctaggccacctgaaggtaaccagtaaatcccgcagtgagctcccagacgtgaagcagggagaggctaaccttaaggagatcatggatcgagcctatgactctttcgacatccagctaacctcggttcaactgctctatagtcgggttggtgataactggcgggaagcaaggaaactgagtgtttccacacagcatatcctggttcccatgcattttaaccttgagttgagcaaggccatggtgttcatggacgttagaatgcctaaattcaaaatctatggcaagcttccgctcatttccctgcggatctctgataaaaagctgcaggggatcatggaactcatcgagtctattccaaaaccggaacccgtaaccgaagtctccgctcctgtgaaatccttccagatacagacgagtacatctttaggcactagccagatttctcagaagattatccccctgttggagttgccctccgtgtcagaagatgacagcgaggaagagtttttcgacgctccctgtagtcccctcgaagagcctctgcagtttccgacaggcgtgaaatccatcagaacacgaaaactgcagaagcaggattgcagtgtaaacatgacaaccttcaagatcagattcgaagtccccaaagtgctgattgagttctaccatctggtgggggattgtgaactgtccgtggttgagatcctcgttctggggctgggtgcagagattgaaatccgaacctatgacttgaaagcaaacgccttcctgaaggagttctgccttaaatgtccagaatatcttgacgagaacaaaaaaccagtctacctggttacgaccctggacaacactatggaagatctcttgactctcgagtatgtgaaggctgaaaagaatgtccccgacctcaaaagtacttacaataacgtgctacaactcatcaaggtgaacttctcctcgttagatattcatctccacaccgaggcgctgctcaacacaataaactatctccacaatattctcccacagtcagaagaaaaaagcgcccctgtgagcacaactgagacggaggacaagggggacgttatcaagaagctggcgctgaaactaagtactaatgaagacataattacactgcagattctggctgagctgtcttgcctgcagattttcatccaggatcaaaaatgtaacatcagcgaaattaaaatcgagggattggattccgagatgattatgagaccttccgaaacagagattaatgccaagttaaggaatatcatcgtcctggactctgacattaccgcaatttacaagaaggcagtgtacataactggaaaggaggttttttccttcaagatggtgtcatatatggacgccaccgccgggtcagcgtacacggatatgaatgttgtggacattcaggttaatctgatcgtgggatgtatagaagtggttttcgtgactaaattcctttactctatcctggctttcatcgacaattttcaagccgccaagcaggcactggcagaggctactgtccaggctgctgggatggccgccaccggggttaaggaattagcgcagcgcagcagtaggatggctctagatatcaacatcaaggccccagtggtggtgataccccagtcccctgtttctgaaaatgtcttcgtggccgactttggtctgattacaatgactaataccttccatatgattactgagagtcagtcaagccccccacccgtgattgacttaattactataaaactaagcgagatgcgactatataggagccggttcatcaatgatgcctaccaggaggttcttgacctgctgctccctcttaacttggaagttgtggttgagcggaatttgtgttgggagtggtatcaggaggtaccttgcttcaacgtgaacgcacaactcaagccaatggaattcatactctcccaggaagacatcacgaccattttcaaaacattacacggtaatatttggtacgagaaggacggctctgcgtcccctgcagttacgaaagatcaatactcagctactagcggagtgacaaccaacgcgtcacatcattcagggggggcaacagtcgtgacggcagcagtcgtggaagtgcactcacgagcgctgctagtgaaaaccactctgaatatcagcttcaaaacggatgatctgaccatggtgctgtattcccctggccctaagcaggcatccttcacagacgtacgtgacccctcactgaagctggcagagttcaagctcgaaaatattataagcaccctcaagatgtataccgacgggtccaccttctcctctttttctttaaagaactgtatcctggatgataagaggcctcacgttaagaaagccaccccccggatgatcggcctgacggttggcttcgataagaaagacatgatggacatcaagtaccgtaaggtgagggatggatgcgtgacagacgccgtgtttcaggaaatgtacatatgcgcatcagtggagttcctgcagaccgttgcaaacgtctttctcgaggcatacactacgggcaccgcagtggaaacctccgtgcagacatggacagctaaggaggaagtccccacacaggaatccgtgaaatgggaaatcaacgtgataataaagaaccctgagatagtgtttgtagccgacatgaccaagaacgatgccccggccctggttataaccacgcagtgtgagatctgctataaagggaatctcgagaactccactatgactgctgctataaaagatttgcaagtgcgagcttgtccattccttcccgtcaaaaggaaggggaagatcaccacggtcctgcaaccctgtgacctgttttaccagacgactcagaagggcaccgaccctcaggttatcgatatgagcgttaaatcccttacactcaaagttagccccgtgatcatcaataccatgatcacaataacatccgcactgtatacaactaaagagacaatccctgaggagactgcatccagcaccgctcatctgtgggagaaaaaggatacgaagaccttgaagatgtggtttttagaagaatcaaatgaaaccgagaaaatcgctccaacaaccgagcttgtgccaaagggcgaaatgatcaaaatgaacattgattcaattttcatagttcttgaagccgggatcgggcacaggaccgtaccaatgctgctggccaagtccaggttctccggagaagggaagaactggtcatccctaattaacctgcattgccagttggagctagaggttcattactataatgaaatgtttggtgtgtgggaacccctcctcgagcccctagaaattgatcagactgaggactttaggccttggaaccttggtatcaagatgaagaagaaggccaagatggccatcgtcgaatcagatccagaagaggaaaattataaagtgcctgagtacaagactgttatctcttttcactcaaaagatcagctcaatataactctatccaagtgcggcttggtgatgcttaacaacctggtcaaggcttttaccgaagcagctacaggttctagtgcggatttcgtgaaagacttagctcccttcatgattctgaactccctgggtctaaccatcagcgtaagcccctctgacagcttctccgtcttgaatataccaatggccaaaagttacgtgctgaaaaacggcgagagcctgtccatggactatatcagaactaaggataatgaccacttcaatgctatgactagtctgtctagtaaattgtttttcatcttgctgacccccgtgaaccactcaaccgccgacaaaatcccgctgacgaaagtggggagaaggctatacaccgtgcgacacagggagagcggcgttgaaaggtcaatcgtgtgccagatagacaccgttgaagggtcaaagaaggtcactatccgcagtcctgttcaaatcaggaatcacttctctgtccctctgtcagtttacgagggcgacactcttttgggcaccgcctctcccgagaacgaattcaacatccctctaggttcttaccgcagttttatctttctcaaacctgaagacgagaattatcaaatgtgcgagggaatcgattttgaggaaataattaagaacgatggagccctcttgaagaagaaatgccgctcgaaaaatccttccaaggagtcttttctcatcaatatcgttcccgaaaaggataacctgacatctctttccgtatatagtgaggacggctgggacctcccttacattatgcatctgtggccccctattctgcttcgtaatctcctgccctataagatcgcgtattacatcgagggcatcgagaacagtgtgttcacactgtctgaaggccattctgcacagatctgtactgctcagctcggaaaggctcggttacatctaaaactcctggattacctcaatcacgattggaaaagcgaataccacattaagcccaaccaacaggatatctctttcgtgtcattcacgtgcgtaacagagatggaaaaaacggacctggatatcgcagtccacatgacatacaacactggccagactgttgttgccttccattctccatactggatggtcaacaaaacaggaagaatgctacagtacaaagccgacggtatccatcgaaagcatccccctaactataagaagcctgtgcttttctccttccagcccaaccacttctttaataacaataaggttcagctcatggtgaccgactccgaactttctaaccagtttagtatcgataccgtcggctcccatggcgccgtcaagtgcaagggcctcaagatggattatcaggtgggcgttacaattgatcttagcagcttcaacatcaccaggattgttacttttactcccttttacatgattaagaacaaaagtaagtaccacatttcagtcgcagaagaaggcaacgataagtggctttcactagatttagagcagtgtattccgttctggcctgaatatgcctcttcaaagctgctgatccaggtggagaggagcgaggaccctccaaagagaatatactttaataagcaggagaattgtatactcctaagattggacaacgagctcggcggaatcatcgccgaagtcaacctagcggaacattctacagtgattaccttcctggattaccacgatggggccgccactttccttcttattaaccacaccaaaaacgaacttgtccagtataaccagagtagtctcagcgaaattgaggacagcctgcctccagggaaggctgtcttttacacctgggccgacccagtcggatcaaggcgattgaaatggcggtgtaggaagagccacggggaagtgacccagaaagacgatatgatgatgcccatcgacctgggggagaaaaccatctatctagtctccttttttgaaggtctccaaaggattatcctcttcactgaagatcccagggtgtttaaagttacctacgaatccgaaaaagccgagctggccgagcaggaaatagctgtggctctgcaagacgtgggaatcagtctggtgaataattacaccaaacaggaagtggcgtacatcggcataacctccagcgatgtggtttgggaaacaaagcctaaaaaaaaggccaggtggaaacctatgtctgttaagcacactgagaagctggaaagagagtttaaggagtatacggagtctagcccatccgaggacaaagttatccagctggataccaatgttcccgtccgccttacacccacaggtcataatatgaaaatactccagccccacgtgatagctctgcgtaggaattatctccccgctctgaaggtcgagtataatacaagcgcgcatcagtccagtttcaggattcagatttacaggattcagattcagaatcagatccatggtgctgttttccctttcgttttctaccccgtaaagcctccaaaatcggtcactatggactctgcgcccaagccattcaccgacgtaagcatcgttatgcggtccgccggccacagccagatctctaggataaagtacttcaaggtcctgattcaggagatggacctgcgccttgacctcggattcatttacgccttgacagatcttatgaccgaggccgaagttaccgagaacacagaggtggaattgttccacaaggatatcgaggcgtttaaggaagaatataaaactgcgagtctggtggaccaaagccaagtgtcactctacgaatattttcatatctctccaattaaactccatctgagcgtctcgctctcatcagggcgggaggaagcaaaggactcaaagcagaatggcggcttgattcccgttcattcactgaatctgctgcttaaaagcattggcgcaacgctgacagatgtgcaggacgtggtttttaaactcgcattttttgagttgaactaccagttccataccacctcagatcttcaatctgaggtgatcagacattattccaagcaggccatcaaacagatgtacgttctcatcctcgggttagacgtgctggggaacccgttcgggctgattagggaattctcagagggcgtggaagcttttttctatgaaccctatcaaggtgctattcagggacctgaggaatttgtcgaaggcatggccctcggcttgaaagccctggtcggtggcgccgtcggcggcctggccggcgcagccagcaaaatcacaggagccatggcgaaaggagtagcagctatgactatggatgaggattatcagcagaaacggcgggaagccatgaataagcagccggctggcttcagagagggcatcacaaggggcggcaagggcctggtctccgggttcgtaagtgggattacaggcatcgttaccaagcctatcaaaggggctcaaaaaggcggagccgcgggtttctttaaaggcgtgggcaagggactggttggcgcggtggcccgaccaacaggcggcatcatcgacatggcaagttctaccttccaaggcatcaaaagagccacagaaacctccgaggtggagtccttgcgtccaccaaggttttttaacgaggacggcgttatccgaccttatcggcttagggacgggaccggaaaccagatgctccaggtgatggaaaacggccggttcgccaaatataaatatttcacccacgttatgatcaataagacagacatgttgatgatcactaggagaggtgtgctgttcgtcactaaaggtacattcggtcagctgacttgcgaatggcagtacagttttgacgagttcacaaaggagccattcatcgtccacgggcgcaggctgcggattgaagctaaggagagagtgaagagtgtctttcatgccagagaatttggtaaaatcatcaatttcaagactcctgaagatgcgaggtggatcctgacaaaacttcaggaagctcgggagccaagcccaagtttatag

SEQ ID NO: 26883 - DNA, 9210 bp, Artificial Sequence
  Description of Artificial Sequence: Synthetic coding sequence
atggtgttcgagagcgtggtggtggacgtgctgaaccggttcctgggagactatgtcgtcgacctggacaccagccagttgtccctgggcatctggaagggggcagtagctctgaaaaacctgcaaatcaaggagaacgccctgagccaactggatgtccccttcaaggttaaggtcggccatatcgggaacctcaagctcatcattccatggaagaatttgtatacccagcccgtcgaagccgtgctcgaggagatctatcttctgattgtcccttcaagtaggatcaaatatgatccgcttaaagaggagaagcagctcatggaggcgaagcaacaggagttgaaacgcatcgaggaggctaagcagaaagtggtcgatcaagagcagcacctgcctgaaaaacaggacacttttgcagagaaattggtcacccagatcatcaagaatctccaggtgaagatctcttctatccacataagatacgaggatgacattacaaacagggacaaaccactgagctttggcatttctctccaaaatcttagtatgcagaccacggaccagtactgggtcccatgccttcatgacgagacagaaaagctggtacgcaaacttattcgacttgacaatctctttgcttactggaacgtcaaaagccagatgttctatctctctgattatgacaattcactagacgaccttaaaaacggaattgtgaacgagaacatcgtgcccgagggctacgacttcgttttcaggccaatctcagccaatgcaaagcttgtgatgaaccgacggtccgattttgatttctcagctccaaagataaatctagaaattgagcttcacaacatcgcaattgaatttaataagccccaatacttttccattatggaactactcgaaagcgttgacatgatggctcagaacctcccttatagaaagtttaagccagacgtgcctcttcaccaccatgctagagagtggtgggcgtatgccatccatggggttctggaggtgaacgtatgccccaggctgtggatgtggtcttggaaacacatcaggaagcatcgacagaaagtgaaacaatataaggagctgtacaagaaaaagctgacgtccaagaagcctcccggggagctgctcgtctcactggaagaactcgagaagactctggacgtatttaatatcactattgccaggcagaccgcagaggtcgaagtgaagaaagccgggtacaaaatatataaagagggtgtgaaagaccccgaagataacaagggctggttctcatggttgtggagctggagcgaacagaatactaatgaacagcaaccagacgtgcagcccgagaccttagaggagatgctgacccccgaagagaaggctctcctgtacgaggccatcggttatagtgagacagccgttgaccccacactattaaagacatttgaagccctgaaatttttcgtgcacctgaaatcgatgagtattgtcctccgggagaaccatcagaagcctgagctcgttgatatcgtgattgaggaattctccactcttatagtacagaggccaggagcccaggctattaagtttgagaccaaaattgattcattccatattacgggcctgccagacaatagtgaaaagccccgactcctgtcttcactggatgatgcaatgagcctttttcaaattactttcgaaatcaatcctctggacgagacagtgtctcagcggtgtattatagaggcagagcctctcgagattatctacgacgcccgcactgtcaacagcatcgtagaatttttccggccacctaaggaggttcacctggcacagctgactgcggccactcttaccaaactcgaagagttcaggtcaaaaacggccaccggcctgctgtatattatagagacccagaaagttcttgaccttaagataaacctcaaagcttcctatatcatagtgccgcaggacggcattttttcccccacatctaatctccttctgctggatctgggccatctaaaagtaacgagtaagtcccgttccgagctccctgatgtgaagcaaggagaagctaatcttaaagaaatcatggacagggcttacgactcatttgacattcaactgaccagtgttcagctcctgtacagccgcgtcggggataactggcgggaagcccgcaagctgtcggtaagcacacaacatatactggtgcccatgcacttcaatctggaactgagtaaggctatggttttcatggatgtgcgcatgcccaaattcaaaatatacggaaaacttccactgattagtctcagaatcagtgataaaaaacttcaagggattatggagctcatagagagtatccccaaacctgaacccgtgactgaggtgtccgcgcccgtcaagtctttccagatccaaacctcaacaagtctgggcacgtctcagatctcgcagaagatcatccctttgttggaactgccatctgtttctgaagacgacagcgaggaggaattcttcgacgcaccgtgttctccgctcgaagagcctctccagtttcctaccggtgttaaatcaataaggacacgaaaactccagaagcaggattgctcagttaatatgacgactttcaaaatccggtttgaagttccaaaagtgctcatcgaattctatcaccttgtgggagactgcgagcttagcgtcgttgagatactggtgcttggcctaggcgctgagattgagatacggacatatgaccttaaggcaaatgcattccttaaagagttttgcctgaaatgccccgagtacctagacgaaaataaaaagccggtgtatctggtcactacccttgacaacacaatggaagatctgctgactctggagtacgtgaaggccgagaaaaacgtgcccgatctcaaatccacctacaataatgtgctgcagctcatcaaggttaatttctcctctctcgacattcacctacacaccgaagcgctgctgaacaccataaactatcttcacaacattctccctcaaagcgaagagaaatctgctccagtatctacaacggagactgaggacaagggagacgtcatcaagaagctggctttaaagctgtctactaacgaggatattataacgctccagatcctggccgagctcagttgtctgcaaatcttcattcaggaccagaaatgcaacatctcagagatcaaaattgaggggcttgacagtgagatgattatgcgacccagcgaaacggagatcaatgcaaaattgaggaatattattgttctcgactctgatataactgctatctacaagaaagccgtctacatcaccgggaaggaagtgttctcattcaagatggtgtcatacatggatgccacagctggctccgcctacacggacatgaacgtagtggacattcaggtcaacctcattgtgggctgcattgaggtggtgttcgtgactaagtttctttacagcattttggcctttatcgacaatttccaggctgccaagcaggccctggctgaggcgaccgttcaggctgctggcatggcagctaccggagtcaaagaattagcccagaggtcttcaagaatggcccttgatattaatatcaaagctccagtggttgtgatccctcagtcgcccgtgtctgagaacgtttttgtcgcagacttcggcctcatcacgatgaccaatacctttcatatgattacagagtcccagtcatctccacctccggttatcgatctgattaccattaagttgagtgaaatgagactatatagatcaaggttcatcaacgacgcatatcaggaagtgttggacctccttctcccactgaatctggaagtagtcgtggagagaaacttgtgctgggaatggtaccaggaggttccctgctttaatgtcaacgcccagctgaaacctatggagtttatcctttcgcaagaggatatcactactatcttcaaaacgctgcatggcaacatttggtacgagaaggatgggtccgcctcaccagccgtgacgaaggatcagtactccgctacgtctggtgtcaccaccaacgcttcccatcactccgggggtgccacagtggttacggccgccgtggttgaggttcacagccgcgcactgctggtaaaaacaactctgaatatttcatttaagactgacgatcttacaatggtcctgtactcccccggacctaaacaggccagcttcaccgatgtgagggatccctcgctaaagctggcagagttcaagctggaaaatattattagtacactgaaaatgtacactgatggcagtactttttcttccttcagcctgaaaaactgcatcctggatgacaaaagaccccacgtcaaaaaggctaccccaaggatgatcggccttacggtaggtttcgacaagaaagacatgatggacattaaataccgcaaggttcgcgatggttgcgtcaccgatgccgtctttcaagagatgtacatctgtgcttctgttgaattcctccagactgtcgctaacgtcttcctcgaagcttacacaactggcactgctgtggagacaagcgtgcagacctggacagccaaagaagaagtccctactcaggaaagcgtcaagtgggaaatcaatgtcataattaagaatccagagattgttttcgtagcagacatgacgaaaaatgatgcccccgctctggtgatcaccacccaatgtgaaatttgttacaaagggaacctcgagaacagcacaatgactgccgctattaaggacctccaggttcgtgcctgtccattccttcccgttaagcggaagggtaagatcactacagttctgcagccttgtgacttattttatcagactacacagaaaggcacagacccccaagtaattgacatgagtgtcaagtcactcaccctgaaggtgtcacctgttattatcaacacaatgatcactattacgtcggcgctgtatactaccaaggaaactatccctgaggaaaccgcctcttctaccgcccacctgtgggaaaagaaagatactaagactctaaagatgtggtttctggaggagtccaacgagacggagaagatcgcgcccactaccgaattggtccctaagggagagatgattaaaatgaacattgacagtatcttcattgttttggaggcaggaattggtcaccgtactgtgcctatgttgcttgccaagagtaggtttagtggcgaaggcaaaaattggtcaagcctgataaacctgcattgtcagctggaacttgaagtccattactacaacgaaatgttcggggtttgggaacccctcctcgagccacttgaaatagaccaaaccgaagactttcgtccgtggaacttgggcatcaaaatgaagaagaaagcaaagatggctatcgttgaatccgatcctgaagaggaaaattataaggtccctgagtataagactgtgatctcttttcacagcaaggaccaacttaacatcaccctctccaaatgtgggttagtaatgctcaacaatctggtgaaagctttcacagaggcggcaactggctccagcgctgacttcgtgaaagatctggctcctttcatgatcctgaattcccttggacttactatttccgtttcaccttctgactccttctcggtgctgaacataccaatggcaaagagctatgtcttaaagaacggcgagtcactttccatggactacattcgcactaaggacaacgaccatttcaacgccatgacatcactgagcagcaaactgttcttcattctactgacacccgtgaaccacagtaccgccgacaagatacccttaaccaaggttggccgcagactgtatacagtgcggcatagggagtccggagtggagaggagtattgtctgtcagattgataccgtagagggaagtaaaaaagtcaccatccggagccctgtacagattaggaatcatttcagtgtgcccctcagcgtttacgaaggcgatacactgcttggcactgcatctcctgagaatgagttcaatatccctcttggatcctaccggtccttcatattcctcaagccggaggacgaaaactatcaaatgtgcgagggtatcgactttgaagaaattatcaaaaatgatggggcgctgctgaaaaaaaaatgccgaagcaagaatccatcaaaggagtcgtttttgatcaacattgtgcccgaaaaagacaatctgacatcgttaagtgtctacagcgaggacggatgggatctcccatacattatgcacctctggcccccgatcctactgagaaatcttctgccttacaagattgcctactacatcgagggtatagaaaactctgtctttactcttagtgagggtcacagcgctcaaatctgtacagcccagctcggcaaggcgcgactccatttaaagctcctcgactatcttaaccacgattggaaatccgaataccacatcaaaccaaatcaacaggacatttccttcgtatccttcacttgtgtcaccgagatggagaaaactgacttggatatcgcggttcacatgacctataacactggccagaccgtggttgcattccactccccgtattggatggtgaacaagacaggccgaatgctgcagtataaggctgatgggatccaccggaaacacccaccaaactataagaagccggttttgttttcattccaacctaatcatttcttcaacaataataaggtgcagttgatggttaccgattctgagctgagtaatcagtttagcatcgacactgtggggagtcacggcgctgtaaaatgcaaggggctcaagatggactaccaggtaggcgtcacgatagatttgagttcctttaatataaccaggattgtgacatttacgccattttacatgatcaaaaacaagagtaaataccacatctctgtggccgaagagggtaacgataagtggctcagtctggacttggagcagtgcattcccttttggcccgaatacgcttccagtaagctcctcatccaagtcgaaagatctgaggacccccccaagaggatttacttcaacaagcaggagaattgcatattgttacggctcgataatgagctcggaggaatcatagctgaggtgaacctggccgaacattccaccgtgataactttcctcgactaccatgacggcgccgccactttccttctgatcaatcacacaaaaaatgaactggttcaatacaaccagtcgagtctgtctgagatcgaggactcactacctcccggtaaggccgtattctacacttgggcggatccagtgggtagtcgcaggctgaaatggcgatgtaggaagagccacggcgaggttacacagaaggacgacatgatgatgcccattgatttgggtgagaaaaccatctatcttgtatcattctttgagggcttgcagcggattatactgttcacagaggatccacgtgtattcaaggttacatatgaaagtgaaaaggctgaactggcagagcaggagatcgctgtcgcccttcaagacgtcggcatctcccttgtgaacaactataccaaacaggaggtggcttacattggcatcacaagcagtgatgtagtttgggagaccaaacccaaaaagaaggcccgatggaaacccatgtcagtgaagcacaccgagaagctcgaacgggaatttaaggagtacactgagtccagcccttctgaagataaggtaatccagctggatactaatgtcccagtgcgcttgactccaaccggccacaatatgaagatcctacagcctcacgtgatcgcactgcgtaggaattaccttccagctctcaaagtggaatataacacatctgctcaccagtcttcattccggatacaaatctaccgcattcaaatacagaatcagattcatggtgctgtgtttccttttgttttttatccggtgaagcctcctaagtcggttacgatggattcagccccgaagccttttacagacgtgagtattgtgatgcggagcgcgggccacagccagatctctcgcattaagtacttcaaagtgcttatccaagagatggatctgagactcgatctggggtttatttacgctctgaccgatctcatgaccgaagcagaagttaccgagaacaccgaggtggagctgttccataaggacattgaagcatttaaagaagagtataagaccgcgtcactggtcgatcagtctcaggtctctctgtacgaatacttccatattagcccaattaagttgcatctcagcgttagcctctctagcggacgagaagaagctaaagattccaaacaaaatgggggcctcatccccgttcactctttaaacttgctgctcaagagcataggtgccactctcactgacgtgcaagacgtagtatttaagctcgctttcttcgaactgaactatcagttccatactacatccgaccttcagtcagaagtaatacgccactactccaagcaggccatcaagcaaatgtacgttttgattctgggcctggacgtgttagggaacccttttggcctcattcgcgagttttccgaaggagtagaggcatttttctacgagccataccagggcgcaatacaaggccccgaagagttcgtggaggggatggccttaggcctcaaagctttagtgggaggcgccgtgggcggcctcgccggggctgctagtaagattactggggccatggcaaaaggcgtggcagcaatgacaatggacgaggactaccaacagaaaagaagagaggctatgaataaacaaccggccggattccgagaggggattacacgtgggggaaagggacttgtctccggtttcgtcagcggaatcaccggcatcgtcaccaagccgatcaagggtgcccagaaggggggagccgcaggcttctttaagggggtcggaaagggcctggttggtgctgtcgcccggcctaccgggggcataattgacatggccagtagcacgtttcagggaattaagcgagcaacggagacatctgaagtcgagagccttcgtcctccacgattcttcaacgaagacggcgtgattcgtccttaccgacttagagacgggaccggtaaccagatgctgcaggcatctaaaagtctcatttag

SEQ ID NO: 26884 - DNA, 9408 bp, Artificial Sequence
  Description of Artificial Sequence: Synthetic coding sequence
atggtgttcgagagcgtggtggtggacgtgctgaaccggttcctgggagactatgtcgtggatttggatacctcccagctgtctctcgggatctggaagggtgctgttgccttaaaaaatctgcagataaaagaaaatgctctgtcacagctcgacgtgccattcaaggtaaaggtcggccacatcgggaatctgaaattaattatcccctggaaaaatttgtatacacaacctgttgaggccgtgctggaagagatatatcttcttatagtgcccagcagccgcatcaagtacgatccgctgaaagaggaaaagcaactcatggaagctaaacagcaggaactcaagaggatcgaggaagcaaaacaaaaggtcgtcgaccaagagcagcatctgccagaaaagcaggacacattcgctgagaaactagtgacccagattattaaaaatctgcaggtgaaaatctcttctatacatattaggtacgaggatgacattacaaaccgggacaagccactgtctttcggcatatcattgcaaaatctttccatgcagactacagatcaatactgggtgccttgcctgcatgatgagacggagaagttggtacgtaagttgatcagacttgacaacttgttcgcatactggaacgttaagtctcagatgttctatttgtctgattatgataacagcctggatgacctgaaaaacggaatcgtgaacgagaacatcgtgcctgagggatacgatttcgtgttcagaccgatcagtgctaacgccaagctcgtgatgaaccgacgatcagacttcgatttcagcgcaccaaaaattaaccttgagatagaattgcataacattgccatagagttcaacaaaccacaatatttttctatcatggaacttttggagtcagtggatatgatggcacagaatcttccttatcggaaattcaagccagacgttcccttgcaccatcatgcacgtgagtggtgggcatatgctatccatggcgtattggaggtaaatgtgtgcccaaggctctggatgtggtcttggaagcatattcgaaaacatcgtcagaaagtgaaacaatacaaggagctttataaaaagaaattgacgagtaaaaagccgccgggagagctgctggtctctctggaagaacttgagaaaactttggatgtgtttaatataacaattgcccgtcagaccgcagaagtggaggttaagaaggctgggtataagatctacaaagagggtgttaaagacccggaggacaataaagggtggttctcttggctgtggtcttggagtgagcagaatactaacgagcaacaaccagatgttcagcccgagactttggaagaaatgctgacccccgaagaaaaggcactcctctacgaggccatcgggtactcagaaaccgctgtagatccgaccctgctcaagacatttgaagctcttaaattttttgtgcacttaaagagcatgagtatagttttaagagagaatcatcagaagcccgaactggttgacatagtcattgaggaattctcgaccttaattgttcagcgtcccggcgcccaggcaatcaagtttgaaactaaaatcgacagctttcatattaccggattgcctgataactcggaaaagccgcgattgctaagttccctcgacgatgccatgtcactgttccagattacatttgagataaatcctctcgacgagacagtcagccagcggtgcattatcgaggcggaaccccttgagattatatatgatgcacggaccgtcaatagcatcgtggagtttttccggcctcctaaagaggtgcatttagcccagcttacagccgcaacactgaccaaacttgaggagttcaggagtaagacagctactggactgctgtacattatagaaactcagaaggtgctggacttgaagattaacctcaaagccagctacataatcgttcctcaggatggcatcttcagccctacaagcaatctccttctcctagatctgggacacctcaaagtaaccagcaagtcgaggtcagagctgccagatgtaaaacaaggggaggcgaatctgaaggaaatcatggatcgagcttacgattcgttcgatatccagttaacctccgtgcagctgttatactcccgcgtgggggacaactggagggaggcgcggaagttatccgtgtctacacagcacattttagtaccaatgcacttcaatctggaactgagcaaagccatggtgttcatggacgtgagaatgcccaaatttaagatctacgggaaactgcccctgataagcctgcggattagtgataaaaaactgcaaggcattatggagctgatcgaaagcatccccaagcctgaaccagtaaccgaagtatccgcaccagtgaaatcatttcagatccagacctcaacctccctgggcacgtctcagatctcacaaaaaatcatccctctgctggagctccccagcgtgtcagaggatgactcagaagaagagttctttgatgcgccctgctctcccctggaagagccactgcaattccccactggcgtcaaaagcattagaaccagaaaactacaaaagcaggactgttcggtcaacatgaccacgttcaagattagatttgaggtgccaaaagtactgatagagttctaccatctggttggcgattgcgagctctcggttgtcgagatcctggtcctcggactgggcgcagagattgagatccggacttatgacctgaaagcaaatgcttttctaaaagagttttgtcttaagtgtcctgaatacttggacgaaaacaagaaacccgtctatcttgtgacgaccctcgataacaccatggaagacctgctgactttagagtatgttaaggcggagaagaacgtgcccgatctcaaaagtacctacaacaacgttctgcaactcattaaggtcaactttagcagcctcgatatacacttgcacacagaagccttgcttaatactataaattatctgcacaatatccttccacagagcgaggagaagagtgcccccgtaagcacaacggaaactgaggacaagggtgacgttatcaaaaaactgggtctggactctgaaatgataatgcgcccttctgagactgagatcaatgccaaattgcgtaacattatagtgctggacagcgatatcactgcaatctacaaaaaagccgtttacataacaggaaaggaagtcttctctttcaaaatggtgtcgtacatggatgccacagcaggcagcgcctatacagatatgaacgtggtcgatatacaagtgaaccttattgtaggatgtatagaagtggtgtttgtaacgaagttcttgtactcaattttagcttttattgacaatttccaggcggccaagcaggctctcgcggaggccaccgtacaggctgccggaatggcagctacaggagttaaggagctagcccaacgcagttctaggatggccctggatattaacatcaaagcccccgtagtggtcattccacaatcacctgtctccgagaatgtattcgtggcagactttggactgatcacaatgaccaacactttccacatgattaccgaatcgcagtcaagtcctccacctgtcattgatttgatcaccattaagttgtctgaaatgcgcctgtacaggagtagattcattaatgacgcatatcaggaggtgctcgatctgctgctgccactaaatctcgaggttgtggttgagaggaatttatgttgggaatggtaccaggaagtcccctgcttcaacgtaaacgctcaattaaaaccaatggagtttatcctcagccaggaagatattactacgattttcaagactttgcacgggaatatatggtacgagaaagacgggagcgctagtcctgccgtcaccaaggaccagtactccgcgactagtggagtcactactaacgctagtcatcatagcgggggggctaccgtggttacggctgctgtcgttgaggtgcactccagggctctgctggtaaagaccacgctgaatatcagtttcaagaccgatgacctgaccatggttttgtatagtccgggccccaagcaggcgtcttttaccgatgtgcgagatccatcactgaagctcgccgaatttaagttggaaaatattatttcaacattaaagatgtataccgacggctccaccttctcttcattttccttaaagaattgcatcttggacgataagcgtccccacgtgaaaaaagctaccccgaggatgatcggcctgacagtgggctttgacaaaaaggacatgatggatattaagtacaggaaggtccgagacggttgcgtgacagatgcggtattccaggaaatgtacatctgtgccagtgtagagttcttgcagaccgtggccaacgtctttcttgaggcatacaccaccggcactgcagtagaaacctcggtacagacatggacagctaaagaggaggtcccaacccaagagtccgtgaaatgggaaattaatgtaattatcaagaacccggagatagtgttcgtcgccgacatgaccaaaaatgatgctcctgctctggttatcactacacaatgcgagatatgttacaagggaaatctggagaattctacgatgactgcagccataaaagatctgcaggtgcgcgcgtgccccttcctacctgtaaaacgaaagggtaagattacaaccgtgctgcagccctgtgacctgttctaccagactacacagaaggggacggacccccaagtgatcgatatgagcgtcaaatcccttactcttaaagtctcacctgtgatcatcaatacaatgattacaataacttcagctttgtataccactaaagagaccataccagaggagactgcttccagtacggcccacctgtgggaaaagaaagatactaagacgctcaagatgtggttcctcgaagagtctaatgagacagaaaaaatcgcacccaccactgagctggtgccaaagggcgaaatgattaagatgaatatcgactctattttcatcgtgttggaggccggtatcggacatcgcaccgtacctatgctgcttgccaagtcgagattttctggagaagggaagaactggtcttccctgataaacctgcactgtcagttggagctggaagtccattattacaatgagatgttcggagtttgggagccactcctggagcctctggagattgaccagacggaggacttcagaccctggaatctcggcatcaaaatgaagaagaaggccaagatggccattgtggagtcagatcctgaggaggagaactacaaggttcccgaatacaagaccgttatctctttccacagcaaggaccagcttaatattacgctcagcaagtgcggccttgtgatgctcaacaatctcgtgaaagctttcacagaagccgctaccggctcttctgctgactttgtgaaggacctcgcacccttcatgatcttaaacagccttggcctgacgatctctgtgagtccgtctgactctttctctgttttaaatataccaatggctaagtcctatgtgctgaaaaatggagagtcattgtccatggactatattcggacaaaagataacgatcatttcaacgccatgacatcgctcagctcgaaattgttttttatcctgcttacgcccgtcaaccattctacggctgacaagatcccgctgacgaaggtaggaagaagattatataccgttaggcacagagaatcaggagtagagcgatcaattgtgtgtcagatcgataccgttgagggttctaagaaagtgaccatccgcagcccagtgcaaatccgtaaccacttcagtgtgccccttagtgtgtacgagggcgataccttacttggcactgcatcacctgaaaacgaatttaatattccactgggaagctatcgcagcttcattttccttaagcctgaggatgaaaattaccagatgtgtgaaggaatcgatttcgaggaaataattaaaaacgacggcgccctgttaaagaagaagtgccgctccaaaaacccaagtaaagaatctttcctgatcaatatcgtgcctgagaaagataacctgacaagccttagtgtgtacagcgaggacggctgggacttgccttatattatgcacctgtggcctccaattcttctaagaaatctgctgccttataagatcgcctattacattgagggaatagagaactctgtgtttacactgtctgagggccattctgcccaaatctgcactgcacagctgggaaaagcccgcctgcacctcaagctgctggactatctgaatcatgactggaagagcgaataccacatcaaacccaaccagcaagacatcagtttcgtcagctttacttgtgtgactgagatggagaaaacagatcttgatatcgccgtccacatgacatacaatactggacagaccgtcgtggcctttcatagcccctactggatggtgaacaagaccggccggatgttgcagtataaagcagatggcatccacaggaagcaccctccaaactacaagaaaccggtactcttcagtttccaaccaaaccacttttttaacaataacaaagtacaactcatggtgacagattcggagcttagtaaccaattctctattgataccgttggatctcacggagcagtgaagtgcaaaggcttgaagatggattaccaggtgggagtaaccatcgacttaagttcttttaatattactaggattgtgacattcactcctttctacatgatcaaaaacaagtccaagtaccatatctctgtggccgaagaagggaacgataaatggctgtctttggatctagagcagtgtatccctttttggcctgaatatgcatcctccaaactgctcattcaggtcgagaggagcgaagaccctcccaaacgtatatatttcaataaacaggaaaattgtatcttgctcaggctcgacaacgaactcggtggtatcattgctgaggtgaacctggccgaacattctactgttattacgttcttggattatcatgatggcgcagcaaccttcctcctcatcaaccatactaagaatgagctggtacagtataaccaatcctccctgtcagaaattgaggactccctcccaccaggtaaggccgtgttctacacgtgggcagatccagtgggatctaggagactgaagtggagatgcagaaaatcccacggcgaggttacccaaaaggacgacatgatgatgcctattgacctgggcgagaagacaatctacctcgtgagctttttcgaaggactacagaggatcattctgttcaccgaggatcccagggtctttaaggtgacttatgaatccgaaaaagccgagttagcggagcaggagattgccgtcgcgctgcaggacgtggggatcagcttagtaaataactataccaagcaggaggtggcctatattgggatcacatctagtgacgtagtctgggaaactaagcctaagaaaaaagctcgctggaaaccgatgtcggtgaagcataccgagaaattagaaagggagtttaaggagtatacagaatctagcccatccgaagataaggtgatccagctggacacgaatgtgccagtccgattgacaccgaccgggcataacatgaagatccttcagccccatgtaatcgccctccgaagaaattacttacctgcccttaaagtagagtacaacacttccgctcaccaatcaagcttcaggatccagatttaccgaatccaaatacagaaccagatccatggtgcggtcttcccatttgtgttttaccccgtgaagcccccaaaaagcgtgactatggactccgcacctaagccctttacggatgtaagcatcgtgatgcggagcgctggccattcccagatttccagaataaaatatttcaaagtcctgatccaggagatggatctgcgcctcgacttgggcttcatttacgcactgacagaccttatgacggaagcagaggtgacagagaatactgaagtggagctatttcataaggacatcgaggcattcaaagaggaatataaaaccgctagcttggttgaccaatctcaggtcagcctatatgaatacttccatatatctccaattaagctgcatctgagtgtgagcctgagttcaggccgcgaggaggccaaggatagcaagcagaacggcgggctgatacccgtgcactctttgaatctactgctcaaatctataggagctaccctgaccgacgtgcaagacgtcgtctttaagctggctttttttgaactgaactatcagttccacaccacctctgacctgcagtcagaggtcatccgacactatagtaaacaagccattaagcagatgtatgtcctcattctaggtttggacgttctgggtaaccctttcggtcttattcgcgaattcagcgaaggagtggaggcattcttctacgagccttatcagggtgccatccagggacccgaggaattcgtcgaaggcatggccctgggcctgaaggccctggtggggggggcagttggtggattagcaggcgcagcctccaagatcacaggcgccatggcaaagggggtggccgcgatgaccatggacgaggactaccagcagaaaaggcgagaggctatgaataagcaacccgcaggttttagggagggcatcactcgtggagggaagggacttgtgagcggtttcgtgtctggaataaccggcattgtaacaaaaccaataaagggggcccaaaagggcggtgccgcaggcttctttaagggcgttgggaagggcttagtgggtgcagtcgcccgcccaactggaggcatcattgacatggcaagcagcacctttcagggaatcaagagagcaaccgaaacatcagaagtggagtcattaaggccccctaggttctttaatgaggacggtgtgattaggccataccggctacgggacggtaccggcaaccagatgctacaggtgatggaaaacggtcggttcgccaagtataagtacttcacacacgtgatgattaataagaccgatatgttgatgatcacgcggcggggcgtgctgtttgtcaccaaggggacctttggccagctgacatgtgaatggcagtacagcttcgatgaattcaccaaggaacctttcattgtgcatggccggcggctgcggatcgaagcgaaagagcgagttaaaagcgtgtttcatgcacgggaatttggcaagattatcaactttaagaccccagaggacgcaaggtggatcctaacgaagctccaagaagctagggagccctctcctagcttatag

SEQ ID NO: 26885 - DNA, 1317 bp, Artificial Sequence
  Description of Artificial Sequence: Synthetic coding sequence
atgaacgaggtgagcgtgatcaaggagggctggctgcacaagcggggtgaatacatcaaaacctggcgtccgcgctattttctgcttaagtctgatggatcgttcatcgggtacaaagagcgtcctgaagcgccagaccaaactctccctccacttaataacttctcagtggccgagtgtcagcttatgaagaccgagcggccccgccccaatacttttgtaataagatgcctgcagtggaccactgttatcgagcgtacctttcacgtggactctccagacgagagggaagagtggatgagggcaatacagatggtggctaattccctcaagcagagggcaccaggcgaagacccaatggattataagtgtggttcccccagtgactcctcaaccacggaggaaatggaggtagccgtgtcaaaggcccgggccaaagtgaccatgaacgattttgactacctgaaattactcggcaaagggactttcgggaaggtgattcttgtgcgggagaaggccactggccgatattacgccatgaaaatcctgagaaaggaagtcattatcgctaaggatgaagtggcccataccgtaacggagtctcgtgtgttgcaaaacacaagacaccccttcctgaccgcactgaagtatgcttttcagacccacgaccgtctgtgcttcgttatggaatatgccaatggaggggagctgttcttccatctcagccgtgagagagtttttaccgaagagcgggctagattttacggtgcagagatcgtgtccgccctggagtatctccactctcgggatgtcgtgtaccgagatattaaggtattagaggacaacgattacggcagggccgtggactggtggggcctcggtgtggtaatgtatgaaatgatgtgcggacgcctacccttctacaatcaggaccacgagcggctgttcgaactgatcctcatggaggagatacgattccctcggactctatcacccgaggctaagtccttgttggccggcttactgaagaaggatcctaaacaaagattgggcggtggccctagcgatgcaaaagaagtcatggagcatcgcttctttctgtccatcaattggcaagatgtggtgcaaaagaagctgctacccccatttaagccacaggtgacaagtgaggtggacactagatacttcgatgacgaatttaccgctcaaagcatcaccattacaccccccgataggtacgacagcctggggctgctggaacttgaccaaagaacccactttcctcagttttcctacagcgctagcatcagggaatag

SEQ ID NO: 26886 - DNA, 444 bp, Artificial Sequence
  Description of Artificial Sequence: Synthetic coding sequence
atgcggtgcctgagcagcaagaaggccggcagcaccagcgtggtgaagtacatcaagacctggcggcctaggtatttcctgttaaaaagcgacgggtcctttattgggtacaaggagagaccagaagcccctgaccagaccctgcctcctctaaacaacttttctgtggctgaatgtcagttgatgaagactgagcgccccaggccaaatacctttgttattcgctgtctgcagtggacaactgtaatcgaacgaacctttcatgtggactctcctgacgaaagggaggaatggatgcgcgccatccagatggtggcgaatagcttacagccgcacctgtgcgcccaaacccggatctggaagaccccccccccagcccaggcctgggccgtggggcgtcttgaaatccaggttctgatacatacctccccatccgagggctag

SEQ ID NO: 26887 - DNA, 1149 bp, Artificial Sequence
  Description of Artificial Sequence: Synthetic coding sequence
atgcgggccatccagatggtggccaacagcctgaagcagcgggcccctggcgaggatcccatggattacaaatgcggcagtccatctgatagttctaccaccgaagagatggaggtcgctgtcagcaaggcacgtgcaaaagttactatgaacgatttcgattatcttaagcttctcggcaagggcactttcggcaaggtgattttggtccgggagaaggctactggtcgatattacgccatgaagattctgaggaaagaagtgatcatcgctaaggacgaagtggcccacaccgtgaccgaatccagggtactgcagaacacccgccatccgtttttaaccgcacttaagtacgctttccagactcacgacaggctgtgttttgtgatggagtacgctaacggtggcgaactcttttttcatctgagccgcgagcgagtgtttacagaggagcgcgcaagattctacggcgctgaaatcgtttcagcactcgagtatctgcactcacgggacgttgtttaccgtgacattaagctagaaaacctcatgctggacaaggacgggcacatcaaaattaccgacttcggattgtgtaaggaaggcatcagtgacggagcaactatgaagactttctgcggaacccctgaatacctggctccagaagtgttagaggacaacgattacggaagggctgtggactggtggggcttgggtgtggtcatgtacgagatgatgtgcggacgactgcctttctacaatcaggaccacgagcgtctgttcgaactgattcttatggaagaaatcagattccccaggactctttctcctgaagccaagagcttactggccggtcttctcaaaaaggacccaaaacagaggctcggcggcggcccctctgatgcaaaagaagtcatggagcaccgcttctttttgtctattaactggcaggatgtagtccaaaagaagctactcccaccctttaagccccaggtcacatccgaggtggatactcgatactttgacgacgaattcacagcccaatctatcacaataacgcctccggatagatacgacagtctggggctactcgaacttgatcagaggacgcatttccctcaattcagttactccgctagtatccgcgaatag

SEQ ID NO: 26888 - DNA, 402 bp, Artificial Sequence
  Description of Artificial Sequence: Synthetic coding sequence
atgaacgaggtgagcgtgatcaaggagggctggctgcacaagcggggggagtacatcaagacgtggagacctcgttactttctgctaaagtcggacggatccttcatcggatacaaggagagaccagaggccccagatcagaccctccctcccttaaacaattttagcgtcgctgagtgccagttgatgaaaacagaaagaccaaggcccaatactttcgtgatcaggtgtctgcagtggaccactgtgatcgagcggactttccacgtggacagccctgacgagcgggaagagtggatgcgcgcgatccagatggtcgcaaatagtctcaaacaaagggctccaggagaagacccaatggactacaaatgcggaagtccttcagattcgtcaaccacgtag

SEQ ID NO: 26889 - DNA, 1446 bp, Artificial Sequence
  Description of Artificial Sequence: Synthetic coding sequence
atgaacgaggtgagcgtgatcaaggagggctggctgcacaagcggggggaatacataaagacctggaggccccgctacttcctgctcaagagcgacggatctttcatcgggtataaggagagaccggaggcccctgaccagactttaccgcccttgaataatttcagcgtggccgagtgtcagctgatgaaaaccgaaaggcctagacccaacacatttgtgatccgctgcttgcagtggacaaccgtgatcgaaagaacttttcacgttgattcccctgacgagagagaggaatggatgcgagcgatacagatggtagccaattctctaaaacagcgggcacctggtgaagaccctatggactacaagtgtggaagcccgagtgattcttctacgaccgaggaaatggaggtcgccgtgagcaaggcccgggcaaaagtcaccatgaatgattttgactacctcaaactgttgggcaagggaaccttcggcaaagttattctggtcagggaaaaggccactgggaggtactacgcgatgaaaattctgcgaaaagaagtcatcatagccaaggacgaggtcgcacatacggtgaccgaatctcgggtccttcagaatacaaggcatcctttcctcactgccctcaagtatgcttttcagactcacgacaggttatgttttgttatggaatacgcaaatggcggagagctcttctttcatttgtctcgcgaacgggttttcactgaagaacgagcacggttctatggcgccgaaattgtatctgcattggagtacctccactcccgggacgtggtctaccgggacattaagctggagaacctgatgctagacaaggacggccacatcaagataactgacttcggattatgtaaagaaggtatttctgatggtgcaacaatgaagaccttttgcggaacacctgagtacctggctcccgaggtgctggaagataacgactacggcagagccgtggattggtggggattgggagtggtaatgtatgagatgatgtgcggaagactccccttttataatcaggaccatgagcggctgtttgagctgatcctcatggaagagattcgcttccccagaacgttatctcctgaggccaagtcactgctggccggactcctaaaaaaagacccgaagcaaaggctgggaggcggtccctctgacgcgaaggaggtgatggagcaccgcttttttttaagcatcaactggcaggatgtggttcagaagaagctgctgcctccatttaaaccacaggtgacttcagaggttgataccagatattttgatgatgaattcactgctcagagtatcactatcaccccacccgatcgctatgattcactaggcctcctggagctggatcagaggacacatttcccacagttttcctacagcgctagtatcagagaatag

SEQ ID NO: 26890 - DNA, 402 bp, Artificial Sequence
  Description of Artificial Sequence: Synthetic coding sequence
atgaacgaggtgagcgtgatcaaggagggctggctgcacaagcggggagaatacattaagacttggcgtccgagatattttttgctcaagtcagatgggtctttcattggatacaaggaaaggcctgaagcacccgatcagaccttgccaccactcaataacttcagcgtagcggaatgccagctgatgaagacagagagacccagaccaaacacattcgtgatccgctgccttcagtggacaaccgttatcgagcggacttttcatgtggattctcctgatgaacgagaggaatggatgcgggctatccagatggtcgctaacagtctcaaacagagggctccaggagaggacccaatggactacaagtgcggtagtccaagcgactctagcaccacttag

SEQ ID NO: 26891 - DNA, 291 bp, Artificial Sequence
  Description of Artificial Sequence: Synthetic coding sequence
atgaacgaggtgagcgtgatcaaggagggctggctgcacaagcggggcgagtacataaaaacgtggagaccccggtattttctactgaagagcgacggtagctttattggatataaagaacgccccgaagcccccgaccagaccttaccaccactgaacaatttttccgtcgctgagtgccagctcatgaagactgagcgcccgaggcctaacacttttgtgatccgttgcctgcagtggaccactgtcatcgagcgcacattccatgtggattctcccgatgaacggtag

SEQ ID NO: 26892 - DNA, 360 bp, Artificial Sequence
  Description of Artificial Sequence: Synthetic coding sequence
atgaacgaggtgagcgtgatcaaggagggctggctgcacaagcggggggaatacattaagacctggagaccgcgctactttctgctgaagtctgacgggagctttatcggctacaaggagagaccggaggctccagaccagacactacctcccctgaacaatttctcagttgccgaatgccaattaatgaaaaccgagagaccccgccctaacacgttcgtcattcgctgtctgcagtggaccactgtgatcgagagaacatttcacgtggacagccctgacgagcgagaggagtggatgcgtgcgatccaaatggtcgctaacagtctgaagcagcgggcccctggcgaggacccctag

SEQ ID NO: 26893 - DNA, 1446 bp, Artificial Sequence
  Description of Artificial Sequence: Synthetic coding sequence
atgaacgaggtgagcgtgatcaaggagggctggctgcacaagcggggcgaatacatcaaaacttggcgcccacggtatttccttctcaagtctgatgggtcgtttatcggatataaagagcgcccggaagcccctgatcaaactctgccgcccttaaataacttttcagtggcagagtgccagttaatgaaaacagagcggcctagacccaacacattcgttatcagatgtctgcagtggaccacggttatcgaacgcacattccacgtagactcccctgatgagcgcgaggagtggatgcgtgctattcaaatggttgctaactctctgaaacaaagagcccccggagaggaccctatggactataaatgcggaagtcccagtgactcgagtaccactgaggaaatggaagtcgctgtttcaaaagcacgggcaaaggtgacgatgaacgattttgactacctgaaactcctaggtaagggcactttcggaaaggtgattctcgtgcgagagaaggccactgggcgttattatgccatgaagatcttgcggaaggaggtcatcattgccaaggatgaggtggcgcatactgtcacagaaagtcgcgtcctgcaaaacaccagacacccttttttgaccgccctgaagtacgcttttcaaacacacgatcgactatgttttgtcatggagtacgccaacggcggggagctcttcttccacctcagccgcgaacgtgtatttaccgaggaacgcgctagattttatggagcagagatcgtctctgccctggagtacctccattcccgcgacgtagtctacagggacatcaaactggagaatctcatgctagacaaggatggtcacatcaagataacggactttggcctgtgtaaggagggcataagcgatggagccaccatgaaaactttttgcgggacccccgagtatcttgcccctgaggtattggaagacaatgactatggaagggctgtggattggtggggcttgggtgtcgttatgtacgagatgatgtgcggcaggttacccttctacaatcaagaccacgaacgactttttgagcttatcttaatggaggagattcgatttccacgaacactgtcccctgaggcaaaatctctgctggcgggactgctaaagaaagaccccaagcagcgcctgggcggtggaccttccgacgcgaaagaagtcatggaacatcggttcttcttgtctatcaattggcaggatgtggtccagaaaaagttgctcccccctttcaagccccaggtgacctctgaagtagatacacgctatttcgacgacgagttcacagcccagtcaattaccatcacgcctcccgatcgctatgacagtctggggctgctcgaactggatcagagaacacacttcccccaattcagttatagtgcttcaatacgagaatag

SEQ ID NO: 26894 - DNA, 204 bp, Artificial Sequence
  Description of Artificial Sequence: Synthetic coding sequence
atgaacgaggtgagcgtgatcaaggagggctggctgcacaagcggggcgaatacattaagacctggagaccacgctatttcctcctgaaatctgatggctcctttatcggctataaagagagacctgaagcaccagaccagactctccccccactgaataactttagtgttgcggagtgtcagctaatgaagacagagaggtag

SEQ ID NO: 26895 - DNA, 144 bp, Artificial Sequence
  Description of Artificial Sequence: Synthetic coding sequence
atgaacgaggtgagcgtgatcaaggagggctggctgcacaagcggggggagtatattaagacgtggcggcctcggtacttcctgctgaaatcggatggctcgttcatcggctataaagagcgccctgaagctcctgaccagtag

SEQ ID NO: 26896 - DNA, 405 bp, Artificial Sequence
  Description of Artificial Sequence: Synthetic coding sequence
atgaacgaggtgagcgtgatcaaggagggctggctgcacaagcggggggaatacattaagacctggcggcctagatattttctcctgaaatccgatggctcattcatcggctacaaagaacggccagaggcacccgatcagacactgcctcctttaaataacttctctgtcgccgagtgtcagctgatgaaaacagagcgcccgaggccaaacacgttcgtgattcgctgcctgcaatggacgacagttatagaacgaactttccatgtggatagccccgacgaaagagaagaatggatgagggcaatccagatggtcgccaactccttaaagcaacgcgctccaggcgaggatccaatggattacaagtgcggctctccatccgacagcagcaccacagagtag

SEQ ID NO: 26897 - DNA, 324 bp, Artificial Sequence
  Description of Artificial Sequence: Synthetic coding sequence
atgaacgaggtgagcgtgatcaaggagggctggctgcacaagcggggagagtacatcaagacctggagaccccgctactttctcctgaagtcagacggctccttcataggctataaggagcgaccggaggcacctgaccagaccttgccccccttaaacaacttctccgtggctgagtgccagctaatgaagacagaacgccctcgccccaacactttcgtgattcggtgcctgcagtggaccactgtgatcgagaggacctttcatgtcgatagccctgatgagagagaagagtggatgcgcgcaatccagatggttgcctag

SEQ ID NO: 26898 - DNA, 867 bp, Artificial Sequence
  Description of Artificial Sequence: Synthetic coding sequence
atgaacgaggtgagcgtgatcaaggagggctggctgcacaagcggggagaatatattaaaacatggcggcccagatactttctcctgaaatctgatggaagcttcattgggtataaagagagaccagaggcccccgatcagacccttccaccactcaacaatttctccgttgcagagtgccagctcatgaagactgagcgacctcggcccaacacttttgtgattcggtgtcttcagtggaccactgtcatcgagcggacatttcatgtcgattcccccgatgagagggaagaatggatgagagcaatccaaatggttgcgaacagtctcaagcagagggctccaggcgaggaccctatggattacaaatgcggttcgccaagcgatagcagtaccaccgaagagatggaggtggccgtttccaaagccagagccaaggttaccatgaacgatttcgattacctgaaattactcggaaaggggacctttggaaaagtcattctagtacgcgagaaggccacagggcgatactacgccatgaagatcctccgaaaagaggtaatcatagcaaaggatgaggtggctcacactgtgactgagagccgcgtgctgcaaaacacccgccatcctttcctgacagtctcttgtcctccattgccccgacagtgtgaagcgagcctgtggacggaactgcgggagcgagccttaattttttggtataaggcccagtcatggggcaggcccggggggcaaggtaaggtgctgctgagacctgccaaatcttcagaacctaggcacgtcgttggcgtctctcggcttggagagtgggagggggatagttttttcatcgatggggggttcatgtag

SEQ ID NO: 26899 - DNA, 1440 bp, Artificial Sequence
  Description of Artificial Sequence: Synthetic coding sequence
atgagcgacgtgaccatcgtgaaggagggctgggtgcagaagcggggagaatatatcaagaactggaggccccggtattttctcttaaagacagacgggtcattcattggctataaggagaaacctcaggacgtggacctgccgtaccccttgaacaacttctctgtggccaagtgccaactcatgaagactgagaggcctaagcctaatacgttcattataaggtgccttcagtggaccaccgttattgaacggactttccacgtcgacacaccagaggaaagagaagaatggacagaggccatccaggctgtggcggaccggcttcaacgtcaagaggaagagaggatgaactgcagccctacttctcagatagataacattggggaggaagagatggacgcttcaactactcaccataagaggaaaaccatgaatgactttgattacctgaagcttctaggtaaaggaactttcggaaaggtgatcctggtgcgagagaaggcttccggtaagtactatgcgatgaagatactgaagaaggaggtcatcatcgccaaagacgaggtcgcccatactctcactgagtctagggtgttgaagaacacccggcacccgtttctgacaagcctcaagtactcctttcagactaaggaccgtctttgcttcgtcatggagtacgtcaatggaggcgagctgttttttcatctgtcccgggaacgcgtcttctcagaggatcggacccggttctacggtgcggaaatcgtgagcgctcttgactaccttcactccggtaagattgtgtaccgggacctcaagttagaaaacctgatgctcgacaaagacggtcacataaagataacagactttggattgtgcaaagagggaataactgacgcagccacgatgaagacattttgtgggactccagagtaccttgctcccgaggttcttgaagataatgactacggccgggccgtggattggtggggattaggggtagtaatgtacgaaatgatgtgcggcagactgcctttctataatcaggatcatgagaagctatttgagttaatcctaatggaggacataaaattcccgcggacgctttcaagcgacgctaagagtctcctgtctggccttctaatcaaggacccgaacaaaaggcttggcggcggacctgacgacgctaaagaaatcatgagacacagctttttttcgggcgttaattggcaggacgtgtacgacaaaaagcttgtgccccccttcaagccacaagtgaccagcgagactgacacaaggtacttcgacgaagagttcacagcacaaacaattaccattactccgcccgagaagtatgatgaggacggaatggactgcatggacaatgagcgaagacctcacttcccccagttttcttacagcgcaagcggccgtgaatag

SEQ ID NO: 26900 - DNA, 1398 bp, Artificial Sequence
  Description of Artificial Sequence: Synthetic coding sequence
atgagcgacgtgaccatcgtgaaggagggctgggtgcagaagcggggggagtacattaaaaactggcggccccgatacttcctactcaaaaccgacggatcttttatcggatataaggaaaaaccacaggatgttgacctgccttacccccttaataatttttcagtggccaaatgtcagttgatgaagaccgagcgaccaaaacctaatacattcataatccggtgcctacagtggacgaccgtgattgaaagaacttttcatgtcgatacacccgaggaacgtgaggagtggacagaggccatccaagctgtagcggatcggctgcagcggcaggaagaagagaggatgaactgttctcctactagtcagatagacaatatcggtgaggaggagatggacgccagtactactcaccacaagcggaagacaatgaatgatttcgattacctcaaacttctcggaaaaggcacgtttggcaaagttattcttgttagggagaaagcctcagggaagtactatgccatgaagattttgaagaaggaagtgatcatcgccaaggatgaagttgcccacactctcaccgagagtcgggtgctgaagaacacccggcacccgttcctgacttccctgaagtactccttccagacaaaagatcgactgtgctttgtcatggagtacgtcaacgggggcgaactatttttccatttgtccagagagagggtgttctctgaagacagaacaagattttacggtgctgagatcgtgtccgctctcgattaccttcatagcggcaaaattgtctaccgagatttgaaacttgagaaccttatgctggacaaagacgggcatatcaagatcaccgattttgggctgtgtaaggagggaattaccgacgccgctacaatgaaaaccttctgtgggacacctgagtatttagctcctgaagtgctcgaggataacgactatgggagggctgtggactggtggggcctcggggtagtgatgtacgagatgatgtgtggaagattacctttttacaatcaggatcatgagaaactgtttgaattgatccttatggaagatataaagtttccaaggaccctcagctccgacgcgaagagcctcctttcaggactcctgattaaggatccgaacaaaaggttaggaggcggcccagatgatgccaaagagatcatgagacacagttttttctctggtgtgaattggcaggacgtctatgataaaaagctagttcctccattcaaaccacaagtgacttccgagactgatactagatattttgatgaggaatttactgctcagacaataaccataactccaccagaaaaatgtcagcaaagtgactgtggaatgctcggcaattggaagaaatag

SEQ ID NO: 26901 - DNA, 1440 bp, Artificial Sequence
  Description of Artificial Sequence: Synthetic coding sequence
atgagcgacgtgaccatcgtgaaggagggctgggtgcagaagcggggagaatatatcaaaaattggaggcctaggtatttcctcctcaagactgatggctcgtttatcggatataaggagaagcctcaggatgtggatcttccttatccactgaacaactttagcgttgcaaagtgtcaactaatgaagacggagcgcccaaagcctaacacttttattataagatgtctacaatggaccacagtaattgagcgcacgttccatgtagacactccggaggagcgagaagagtggaccgaggcaatccaggcagtggcagataggctccaacggcaagaggaggagagaatgaactgttcccccacaagccagatcgacaatatcggggaggaagagatggacgctagtactacacatcataaacggaaaacgatgaatgacttcgactaccttaaactgctgggcaagggaactttcggcaaggtgatacttgttcgagaaaaggcttccgggaaatactatgccatgaaaatcttgaagaaggaggtgatcatcgcgaaggacgaagtcgcccacacattgactgagtccagagtccttaagaacacccggcacccatttctgacaagtctgaagtactcattccagacgaaagatcgcttatgtttcgtgatggaatacgttaatggcggcgagttgtttttccacctttcacgagagcgggtcttcagcgaggatcggacacgcttttacggcgcagaaatcgtgtcagcgctggattatttgcactcaggaaagattgtctaccgggacctcaagcttgagaacctgatgctggataaggatggccacattaaaattactgacttcgggctgtgcaaagaaggtattactgacgcggccaccatgaagaccttttgtggtacccccgagtatcttgctcccgaagtgctggaagataatgattacggtcgtgccgtcgactggtggggactgggggtggttatgtatgaaatgatgtgcggccgtctgccattctacaaccaggaccacgagaaactgtttgaacttattctgatggaggacatcaagttccccaggaccctcagtagcgacgccaaatcacttctttcaggtctcctcataaaagaccccaacaaaagattggggggcgggcccgatgatgccaaagagattatgcggcacagcttcttctccggtgtcaattggcaggacgtctatgataaaaagctggtgccaccctttaaacctcaggtgacgagcgagaccgacacccgctacttcgatgaggagtttacagcgcagacaataacgatcaccccgcctgagaagtatgacgaagacggaatggactgcatggataatgaaagacgcccccacttcccacagttctcttatagcgcaagcggcagggaatag

SEQ ID NO: 26902 - DNA, 1398 bp, Artificial Sequence
  Description of Artificial Sequence: Synthetic coding sequence
atgagcgacgtgaccatcgtgaaggagggctgggtgcagaagcggggcgaatatattaagaactggaggcctcgatattttctcctcaaaacagacggaagctttatagggtacaaggagaaacctcaggatgtggatctgccttacccattgaacaacttcagcgttgctaaatgccagctcatgaagactgaacgtccgaaacccaacactttcattattcgatgcctacagtggactacagtcattgaaaggaccttccatgtggacacaccagaagagagagaggaatggaccgaagccattcaggctgtagccgaccggctccaacggcaggaagaggaaaggatgaattgttctccaacctcccagatcgacaacatcggggaggaggaaatggacgcatctacaacccaccataagcgaaagacaatgaatgactttgactatttgaaactcttgggcaagggcactttcgggaaagtgatactggtgagagagaaggccagtggaaagtattacgccatgaaaattttgaagaaagaagttattatagccaaggacgaagtggcccacaccctgacagagtctcgcgtcttgaaaaacacacgtcacccatttctcacttccctaaaatattcctttcaaaccaaagaccggctgtgctttgttatggaatacgtcaatggtggggagctattctttcatctgtctagggaaagggtttttagcgaagataggacgaggttctatggcgctgaaatagtatctgcactggactatctgcattccggcaaaatcgtgtaccgagacctcaagcttgagaacttaatgctcgataaggacggacacataaaaattacagacttcggactatgcaaagaaggcataactgatgccgctacaatgaagacgttctgcggaaccccggagtaccttgcccctgaggtgttggaagacaatgactacggccgcgccgttgattggtgggggttgggggtagtgatgtacgagatgatgtgtgggcgcttgccattctataaccaggaccatgagaagcttttcgagctgattttaatggaggatatcaaatttcccagaaccttgagtagcgatgccaaatctttactgtccggcctgctgatcaaggaccctaacaagcgcctcgggggcggccccgacgacgctaaagagatcatgcgacactcattcttcagtggtgttaattggcaagacgtgtatgacaaaaagttggtgccaccttttaaacctcaagtcacaagcgagaccgacacccggtatttcgacgaggagtttacagctcagactatcactatcacgccgccagaaaagtgtcaacagagcgactgcgggatgcttggaaattggaaaaagtag

SEQ ID NO: 26903 - DNA, 420 bp, Artificial Sequence
  Description of Artificial Sequence: Synthetic coding sequence
atgagcgacgtgaccatcgtgaaggagggctgggtgcagaagcggggagaatatatcaagaactggcgacctagatatttcctgctgaagaccgacggttctttcatagggtacaaagagaagccccaggatgtggatctcccttaccctctgaacaacttttcagtagctaagtgccagctgatgaagactgaaaggcccaaacctaacacgtttattatacggtgccttcaatggacaactgtgattgagcggacttttcacgtggatactccagaggagcgggaagaatggaccgaggcgatccaggccgtcgccgacagattacagaggcaggaggaggaacggatgaactgcagtcctaccagccagattgataacatcggtgaggaagagatggacgcctcaaccacccactag

SEQ ID NO: 26904 - DNA, 624 bp, Artificial Sequence
  Description of Artificial Sequence: Synthetic coding sequence
atgagccccctgctgcggcggctgctgctggccgccctgctgcagctggcccccgctcaggcccccgtgtcccagcccgacgcccccggacaccaaaggaaagtggtctcctggattgacgtgtacaccagagctacttgccagcccagggaggtggtcgtgcccctgaccgttgagctcatgggaacagtggcaaaacagctcgtgcccagctgtgtaaccgtacaacgatgcgggggctgctgcccagatgatggcttggagtgcgtgccgactggacaacaccaagtgcggatgcagatcctgatgataagatacccctcctcacagctgggagagatgtctctggaagaacactcacaatgcgaatgtagaccaaagaagaaagattccgccgtgaagcctgatagagcagccactcctcaccaccggcctcaacctcggtctgtccccgggtgggacagcgcacctggagccccatcgcctgctgacattacacatcctactccagccccaggcccttcggcccatgccgccccctctaccactagcgctctgactcccggaccagccgctgcagctgccgacgctgcggcttctagcgttgctaaaggaggggcctag

SEQ ID NO: 26905 - DNA, 567 bp, Artificial Sequence
  Description of Artificial Sequence: Synthetic coding sequence
atgagccccctgctgcggcggctgctgctggccgccctgctgcagctggcgccagctcaggcccccgtgtcacaacccgatgctcctgggcatcagcgaaaagtcgtaagctggattgatgtctacacacgtgctacatgtcagcctcgcgaggtggtggtgcctcttacagtagagctgatgggtacagtcgcaaagcagctcgtaccctcctgtgtgacagtccagcgatgcgggggttgttgccctgacgacggtttggaatgcgtgcctacaggacagcatcaggtgcgaatgcaaatcctgatgatcagatacccctcctcacagcttggtgaaatgtctcttgaagaacatagccaatgtgagtgccggccaaagaaaaaagattccgcagtgaagccggatagcccaaggccactatgcccccgctgcacgcaacaccaccaaagacccgaccccagaacttgtaggtgtaggtgtcgcagacgcagtttcctccgatgccagggccgggggctggaactcaacccagatacttgccggtgtaggaagttaagacggtag

SEQ ID NO: 26906 - DNA, 1143 bp, Artificial Sequence
  Description of Artificial Sequence: Synthetic coding sequence
atgagcgagaccgtgatctgcagcagccgggccaccgtgatgctgtatgatgatggcaacaagcgctggctacccgccggtactggccctcaagccttcagccgtgttcagatttaccacaacccaacggccaactcctttcgggtcgtgggtagaaagatgcagcccgaccagcaggtggttatcaactgcgctattgtccgcggtgtcaagtacaaccaggctacacctaacttccatcagtggagggatgccaggcaggtgtgggggctgaatttcggatcgaaagaggacgcagctcagtttgctgcgggaatggccagcgctctcgaggccctggaaggtggaggcccgcccccaccccccgccctcccaacatggtctgtccccaacggaccatcacccgaggaagtggagcagcagaagcgtcagcaacccggcccaagtgaacacatcgagcgccgtgtgtccaatgccggcgggcctccagctcctcctgctggtggacctccccctcctccaggccctccgccaccacctgggcctccgccacccccagggcttcctccatcaggagtgcccgctgctgcccacggtgctggtgggggcccacctccggctcctcccctccctgctgcacagggaccgggaggaggcggggccggtgctccgggcctggccgcggctattgctggcgcaaagttacgaaaagtgtccaaacaggaagaggcatccggaggccccacagcccccaaagcggaaagtggccggagcgggggaggtggcttgatggaggagatgaacgccatgttggccagacgccgaaaggcaacccaggttggcgaaaagaccccaaaagacgagtcagccaatcaagaggagcccgaagctcgagtgccggcccaaagcgaaagtgtgcgccggccatgggaaaagaacagtactacactgccgcgtatgaaatccagttcgtcagtgaccaccagtgagacgcagccatgtactccatctagctctgattatagtgatctccagagagtgaagcaggagttgctagaagaggtcaagaaagagctgcaaaaggtcaaagaggagataatagaagccttcgtccaggagctgcggaagcgcggaagcccctag

SEQ ID NO: 26907 - DNA, 915 bp, Artificial Sequence
  Description of Artificial Sequence: Synthetic coding sequence
atggccggcaacttcgacagcgaggagcggagcagctggtactgggggaggctttccagacaggaagccgtggctctgttgcaaggacagaggcatggcgtgttcctggtccgagatagctccacctctcctggcgattatgttctcagcgtgagcgagaactcccgcgtatctcattatataatcaactcctccgggccccggcccccagtgcctccttctcctgcacagcccccacccggagtatccccgtcaagacttcgcataggtgaccaagagttcgactctctacctgctcttcttgagttctacaaaattcattatcttgatactactacactgatcgagccagttagccggagtcggcagggtagcggcgtgattctgcgacaggaagaggctgaatacgtcagagcgttgttcgacttcaatggaaatgatgaggaagacttaccatttaagaaaggtgatattctgcgcatcagggataagccagaggaacagtggtggaacgccgaggattctgagggcaagcgtggaatgattcctgtgccctatgtcgaaaaatatagaccggctagcgcttcagtgtctgcactaataggaggaaatcaagagggtagccatccgcagccactgggaggaccagaacccggaccctacgcccagccctctgtcaatactcccctacctaatctgcaaaatggccctatatatgcccgagtgattcagaagagggttcccaacgcctatgacaaaactgcgctggccttggaggtgggagaattggtgaaggtcacgaagatcaacgtgtctgggcagtgggaaggcgaatgtaatggcaaacggggtcactttccttttacacatgtgaggctcctagaccagcagaatcctgacgaagacttctcttag

SEQ ID NO: 26908 - DNA, 615 bp, Artificial Sequence
  Description of Artificial Sequence: Synthetic coding sequence
atggccggcaacttcgacagcgaggagcggagcagctggtactgggggagacttagccgtcaagaagccgtggcccttctgcaagggcagcgccacggtgtgtttcttgtccgcgatagttccacctcaccgggggattatgtgctgtcggtttctgagaattcccgagtgtcccactacataatcaacagttctggcccgcgccctcccgtccccccaagccccgcacagccaccacccggtgtttccccatcgcgtctccgcatcggggaccaggaatttgattctctccctgctctgctggagttctataagattcactacttagacaccaccacactcattgaaccagttagccgcagccgtcaggggtctggtgtgatcctgcgccaagaagaggctgagtacgtgagggctctctttgatttcaatggtaatgatgaggaagacctgccttttaagaagggtgatattctaagaattcgggataagcccgaggaacaatggtggaacgctgaggattccgaagggaagcgcggaatgattccagttccttatgtggagaagtaccgccccgcaagcgcctctgtttctgctctgatcggagggagatag

SEQ ID NO: 26909 - DNA, 2196 bp, Artificial Sequence
  Description of Artificial Sequence: Synthetic coding sequence
tgaaagcccgccaccggcctgtgggtgtgggtgagcctgctggtggccgcagggacggtccagccctctgacagccagtcagtgtgcgccggcacagagaataagctttcatccctgagcgatctggagcagcagtaccgggctctcagaaaatactacgaaaactgcgaggtagttatgggcaatcttgagatcactagtattgaacataaccgggacctgtcatttctgcgaagcgtacgggaggtcactggctatgtccttgtcgcgctaaaccagtttcgctaccttccactcgagaaccttaggatcattaggggaactaagctttacgaggatagatatgcgctggcgattttcttgaactataggaaggatggcaacttcgggctgcaggagctcggccttaaaaaccttaccgagattctgaatggcggcgtatatgtggaccaaaataaatttctgtgttatgccgatactatccactggcaagacatcgtcaggaacccatggccatctaacctgactctggtctctacgaacggatccagcggctgcggaaggtgccacaaatcctgcaccggtcgctgttggggtcccacagagaatcattgccaaaccttaacccggacagtttgcgcagaacagtgtgacggtcgatgttacggcccctacgtgtctgactgctgtcacagagagtgcgccggtggctgttctgggccaaaagatactgattgcttcgcttgtatgaacttcaatgacagtggcgcttgcgtcactcagtgcccgcaaacattcgtctataatcccacaaccttccagttagagcacaactttaacgctaaatatacctacggagccttttgtgtcaagaagtgccctcataacttcgtcgttgactcgtccagttgcgtgcgtgcttgcccaagcagcaagatggaggtggaggagaatggcattaaaatgtgcaagccatgtaccgatatttgccccaaggcttgcgatgggatcggcactggttcccttatgtctgctcaaacagtggactcatccaatatcgataaatttattaattgcaccaagattaacgggaacttgatttttttggtcaccggaattcatggcgatccctataatgcaattgaagccatcgaccctgaaaaattgaatgtttttcggacagtccgagaaattactggtttcctaaacatacagagctggccgcctaacatgaccgacttctctgtcttctctaatctggtcacaatcggtggcagggtgctctatagcgggcttagccttttgatcctgaaacagcagggaatcacctcgctgcaatttcaatctctcaaagagatctccgccgggaatatatatatcaccgataattcaaacctgtgctattatcatactataaactggaccaccctcttttccacaataaaccagcgaattgttatcagagataaccggaaagcagaaaactgtacagccgaaggcatggtgtgcaaccatctgtgcagttcagacgggtgctggggcccaggccctgaccaatgcttgtcctgtaggcgattcagccgcggcaggatttgtattgagtcatgcaatctttatgacggcgaattccgggagtttgagaatggatccatttgcgtggaatgcgatccacagtgcgagaaaatggaagacggccttctgacttgtcatggacctggacccgacaattgcaccaagtgctcccactttaaagatggccctaactgtgtggagaaatgtcccgacgggctgcagggcgcaaactctttcatttttaagtatgcagatccggatagagaatgccacccttgtcatccaaattgcactcagggctgcatcggctcaagcatcgaggattgcataggactgatggatcggactcccctgatagccgccggtgtaattggcggtctcttcatcctcgtaatcgtggggctgactttcgctgtctatgtcaggagaaagtccattaagaaaaaaagagccttgcggcggttcttggagactgagctggtggaacctctgacaccatcggggactgccccaaatcaggctcagctgcgcatattgaaagagactgagctgaagcgagtcaaggtgctggggtctggagctttcgggactgtctacaaagggatttgggtgccagaggggtag

SEQ ID NO: 26910 - DNA, 3927 bp, Artificial Sequence
  Description of Artificial Sequence: Synthetic coding sequence
atgaagcccgccaccggcctgtgggtgtgggtgagcctgctggtggccgcagggacagtgcagccgtctgactcccagtctgtgtgtgctgggacagaaaacaagctatcctcactgagtgacctggaacagcagtacagagctctgcgcaagtactacgaaaattgtgaggttgtcatgggtaacctcgagatcacaagcattgaacacaacagagatctaagcttcctcagatcagtacgggaggtcactgggtacgtgctggtcgccttgaaccaattcaggtatttgccactagagaacctgcggattattcgcggcaccaagttatatgaagaccgctatgccctggccatctttcttaactacaggaaggatggaaacttcggcctgcaggagctgggtttgaagaacctgacagagatccttaacggcggggtctacgtggatcagaataaatttctgtgttacgccgatactattcactggcaggacattgtgcggaatccgtggcctagtaacctcaccctcgtgtcaactaacgggtcttctggatgcggacgttgccataagtcctgtaccggaagatgctggggaccaactgagaaccattgtcaaacactgacccgtaccgtatgcgccgaacagtgcgacggtagatgctatggcccctacgtgagcgattgttgccaccgtgagtgcgctgggggctgcagcggcccgaaggacaccgactgcttcgcctgcatgaacttcaatgactctggagcctgtgtcacacagtgtccacagacattcgtatacaaccctaccacctttcagctcgaacataactttaacgccaaatacacctatggagcattttgcgtgaagaaatgcccacacaacttcgtcgtcgatagcagcagttgcgtccgagcatgccctagttcaaagatggaagtagaggaaaatggcatcaaaatgtgcaagccctgcactgacatctgccccaaggcttgcgatggcatcggtacagggtctctgatgtcagcccagacggtggacagtagcaacattgataaatttattaattgcaccaaaataaacggtaacctgatcttcttagttacagggattcacggagatccctataacgccattgaagccattgaccccgagaaactcaatgtatttcgcactgtgagagagatcacgggattcttgaacattcaatcttggcccccgaatatgactgacttcagtgtcttctctaatttagtgaccataggtggcagagtgctctatagtggactgtcactgctgatcctgaaacagcaaggcattactagtctccagttccagagcctcaaggagatttctgcaggcaacatctacatcacagataattccaacctgtgttactaccatacaatcaactggaccacactattctcaactattaatcagcggatcgtgatccgcgacaatcgcaaagccgaaaactgcaccgccgaaggaatggtgtgtaatcacttatgtagctccgatggttgttggggtccaggacccgaccagtgcctctcatgtaggcggttttcgaggggccgaatttgtatcgaatcttgtaacttatatgatggcgaatttcgagaattcgaaaacggctccatttgcgtggagtgcgatccccagtgtgagaagatggaggacgggctgcttacttgccacggacctggccccgataactgtaccaagtgcagccatttcaaggatggacctaattgtgtggaaaagtgtcccgatggtctacagggcgccaacagcttcattttcaagtacgctgaccccgatcgggagtgtcacccttgtcatcctaactgcacacaggggtgtaacggcccaacgtctcatgattgcatctactatccttggaccggtcactccaccctgcctcagcatgccaggacacctttgatcgccgccggggtgataggggggttgttcattctggtaatcgttggtctcaccttcgctgtgtatgtacgccggaagtcaatcaagaaaaagagggccttgaggagattcctggagactgagttagtggaaccccttactcccagtggtacagccccaaatcaagcccagctgcggatcctgaaggagaccgagctgaagcgcgtcaaggtattgggatcaggtgcctttgggactgtctacaaagggatctgggtgcccgaaggggaaactgtaaaaatacctgttgccatcaagattctgaacgagaccacaggccccaaagctaacgtggaattcatggacgaagcactgattatggcaagcatggatcacccccaccttgtgcggttgctgggcgtatgccttagccctacaattcagttggtgacgcagctcatgccacatggctgcctgctggagtatgttcatgaacacaaagacaatattggatctcaattgctgctgaattggtgcgtgcagatcgcaaagggcatgatgtacctggaggagcgaagactggtacatcgtgacctggcagccaggaatgtattggttaagtcccccaatcacgtcaaaattactgattttggcctcgcccgactactggaaggcgatgagaaggagtataatgctgatggagggaagatgcccataaagtggatggcgcttgagtgtattcactataggaaattcacgcatcagtctgacgtttggtcctacggcgtgactatttgggagctcatgacctttggagggaagccatatgatgggattccgactcgcgaaatcccagacttgctcgagaaaggggaacgattaccacagccgcccatctgcacaattgacgtatacatggtgatggtgaaatgttggatgatagacgcagattctcggcctaagtttaaggagctggcagcggagtttagcaggatggcccgggatcctcagaggtacctggtgatacagggtgatgataggatgaaactgccctcacccaacgattcaaagttcttccagaatcttctggacgaagaggacttggaggacatgatggacgccgaggagtacctcgttccccaggcattcaatatccctccgcccatttacactagtcgtgcccgaattgatagcaacagaagcgagatcggacattcaccacctcctgcttacactcctatgtccggcaatcagtttgtttacagagatggtggatttgctgccgagcagggcgtgtctgtgccatacagagctccaacctctacaatccctgaagcgcccgtggcccagggcgccactgcggaaatcttcgacgactcctgctgtaacggtactctccgcaagcccgtcgccccccacgtgcaggaggatagctctactcagagatattccgccgatcctaccgtctttgctcctgagcggagccctagaggcgagctggatgaagaaggttatatgactccaatgcgcgacaaacctaagcaggagtacctgaatcccgtggaggaaaatccttttgtctccagacggaaaaacggagaccttcaagcactggataatcccgagtaccataatgcgagcaatgggccacccaaggccgaagacgaatacgtcaatgagcccctatatctgaacaccttcgccaataccctggggaaggccgaataccttaaaaacaatatcctgtccatgcctgagaaagccaagaaagcatttgacaatcctgactattggaaccattcccttccgcctaggagcacacttcagcatcctgactacctccaggagtatagcacaaagtatttctacaagcaaaacgggagaatacgaccaatcgttgcagagaacccagagtacctgagtgaattcagtctgaagcccggaactgtattgcctccccccccatatcgccatcgcaatactgtggtgtag

SEQ ID NO: 26911 - DNA, 3897 bp, Artificial Sequence
  Description of Artificial Sequence: Synthetic coding sequence
atgaagcccgccaccggcctgtgggtgtgggtgagcctgctggtggctgcaggcaccgtacagcctagcgatagccagagtgtctgtgctgggacagagaacaagctgagtagtcttagcgatcttgaacagcagtaccgcgcgctgcgaaagtactacgagaattgcgaggtggtgatggggaacctcgaaataacgtctatcgagcataaccgtgacctgagcttccttagaagcgtccgggaagttacagggtatgtccttgttgccttaaatcagttccgctatctgccacttgaaaacctgaggatcattcggggcactaaattatatgaggaccggtatgctctagcaattttcctgaattacaggaaagacggcaatttcgggttgcaggaactgggtcttaaaaatctgacggagatcctgaacggaggtgtctacgtggaccagaacaagtttctctgttacgcagatacgattcattggcaggatatcgtgcggaacccctggccatccaacctgacactggtcagcactaatggctcttccggctgtggcaggtgtcataagtcctgcaccgggcggtgctggggacctaccgagaaccactgtcaaaccctgactcgcaccgtctgcgccgagcagtgtgatgggagatgctacggtccgtatgtctctgattgttgtcatagggagtgtgccggcggctgtagcgggccaaaggacacggactgcttcgcatgtatgaactttaatgattcaggtgcctgcgtgactcagtgcccacagacattcgtctacaacccaactacgtttcagttggaacacaattttaacgccaaatacacctatggcgcattttgtgtgaagaaatgcccccataatttcgtagtcgattctagcagctgcgtgcgtgcctgcccgagttcaaaaatggaagtggaggaaaacggtatcaagatgtgtaagccctgcacggatatatgccctaaggcctgcgacggtatcggcacgggcagtcttatgagcgcacagactgtcgacagctctaacattgataagtttataaattgtacaaagatcaatgggaacctgattttcctggtgaccggcatacatggcgatccctataatgccattgaggccatcgatcctgaaaagcttaacgtgttccgcacggttcgggaaattacaggtttcctgaatatccagtcatggccacccaacatgactgacttctctgtgttttctaacctggtgactattggggggcgggttttgtactctggcctgagcttactgatcttgaaacagcaaggtattacatctctgcagttccagtcactcaaagaaatctcggcagggaacatctacataactgataactccaacttgtgttattatcacaccatcaactggacaaccctcttttcgaccatcaaccaaagaatcgtgataagagacaacaggaaggccgagaactgtactgcagagggaatggtgtgcaaccatttgtgtagttctgatggttgctggggccctgggcctgaccagtgtctttcttgtagacgcttttcgcggggaaggatctgcattgagtcctgtaatctgtacgatggggagtttcgcgaattcgaaaacggcagcatctgtgtggagtgtgatccccagtgtgagaagatggaggacggtttgttgacatgccatgggcccggtccggataactgcacgaaatgctcccattttaaagatgggcctaactgcgttgaaaaatgccctgatgggttacaaggagctaattccttcatctttaaatacgccgaccccgacagagaatgccacccctgccaccccaactgcactcaaggctgtatcggatcctctattgaggactgcattgggctcatggataggacccccctgatcgctgctggcgtcatcgggggtctgttcatattagtcatagttggcctgacttttgccgtgtacgtgcggcgcaaaagtatcaaaaagaaacgggctctgagacggttcctcgagactgagcttgtggaacccctgacaccttccgggactgctcctaaccaggcccaacttcggatcttgaaagagacagaactaaagcgagtgaaggtgctggggtctggcgccttcgggacggtgtacaaaggcatatgggtgccagagggcgaaacagtaaaaattccagtggccattaaaatccttaacgaaaccacaggcccaaaggccaacgtcgaatttatggatgaggcactgattatggccagcatggaccacccgcatcttgttcgcctgctgggtgtgtgtctttctcccacgatacaactggtgactcagctgatgccacacggatgtctgctggagtacgtgcacgaacacaaggataacattggatcccagttgctcctgaactggtgtgttcaaatagccaaggggatgatgtacctagaagagaggcggctcgtccaccgcgaccttgcagcccggaacgtattggttaagtcccccaatcacgtaaaaattacggattttggcttggctcgacttttagaaggggatgaaaaagagtacaatgccgatggtggcaagatgcccattaaatggatggctctcgaatgcatccattacaggaaattcactcatcagtcggacgtgtggtcgtatggagttaccatctgggaattaatgacattcggggggaaaccttacgacggcatacctacaagagagattccagaccttctggagaaaggggagaggttgcctcagcctccaatttgcacaattgatgtctacatggtgatggtgaagtgttggatgatcgacgccgacagtcggccaaaatttaaagaattagcggccgagttttccaggatggcccgggatccccagcgctacctcgtcatccagggagacgatcggatgaagctgccctcgcctaatgatagcaaattcttccagaacttgttagacgaggaggacttagaagacatgatggacgccgaggaatatttggttccccaggcctttaacatcccgccccccatctacacttcccgcgcccgcatcgatagtaatcggagtgagatcgggcattccccaccccctgcgtacaccccaatgtccggcaatcagtttgtgtatcgcgacggtggcttcgcagccgagcagggcgtttccgtaccttaccgcgcccctacctcaaccattcccgaggcccccgttgcccaaggagctactgcagaaatctttgatgacagttgctgtaacggcactctcaggaaacccgtggctccacatgttcaggaagattcatctacccagcgatattcagccgatccgactgtctttgctccagagagatccccacgtggagagctcgacgaggaggggtatatgacgccaatgcgcgacaaacccaagcaagagtatctgaaccccgtcgaagagaaccctttcgtaagtcgccggaagaacggagatttgcaggcattggacaaccctgagtaccacaatgcgtccaacggcccacccaaggccgaggacgaatacgtgaacgaacctttatatctcaacacctttgcgaacaccctgggaaaggcagaatatctgaagaataatattctcagcatgcccgagaaggcaaaaaaggcttttgataatcccgactactggaaccacagccttccacccagaagcactcttcaacatcccgactaccttcaggagtactccacgaaatacttctataagcagaacggaaggataagacccatcgttgcagagaacccggaatatttgtccgagttcagcttgaaacctgggacagtcctgcccccgcctccatatcgacataggaatacagtagtgtag

SEQ ID NO: 26912 - DNA, 387 bp, Artificial Sequence
  Description of Artificial Sequence: Synthetic coding sequence
atgggcaacctggagatcaccagcatcgagcacaaccgggacctgtcattcctgcgaagcgtgcgcgaagtgacaggttatgttctggtcgctcttaatcaattccggtatttacctttggagaatttgagaatcattagaggcaccaaactgtatgaggatagatatgcccttgctatattcctaaactatagaaaggacggcaactttgggctccaggagctgggattgaagaacctgaccgagatcctcaacggcggagtgtatgtggatcagaacaagttcttgtgctatgccgacactattcattggcaggacatcgtgcgtaacccgtggccgtcgaacctgaccctcgtgagcacaaatggcagtagcgggtgtggctag

SEQ ID NO: 26913 - DNA, 3879 bp, Artificial Sequence
  Description of Artificial Sequence: Synthetic coding sequence
atgaagcccgccaccggcctgtgggtgtgggtgagcctgctggtggcagccggcaccgtccaaccctccgactcccagtccgtctgtgcaggaacagagaacaagctgagctccctatccgacctggagcagcagtatcgggcactgcggaaatactatgaaaattgcgaggtggtgatgggcaatctggaaatcacaagcatagaacataacagggacctctcctttctgagatcagtgcgggaggttacgggctatgtgttagtggcactcaaccagttccgatatctgcctttggaaaacctgaggatcattcgcggaacgaagctctacgaggacagatacgctcttgccatcttccttaactaccggaaagacgggaattttgggctacaggagctcggactgaagaacctcactgaaatattgaacgggggggtgtacgtggaccaaaataagttcttatgctacgccgacaccatccactggcaggacattgttcgtaatccctggccctccaacctcacactggtgtctaccaatggctcctccggctgcggtcgctgccataagtcttgtacaggtcgctgttggggccctaccgagaatcattgtcagactctgacccggaccgtgtgtgcagaacagtgtgatggtcgctgctacggaccctatgttagtgactgctgccacagggaatgcgctggagggtgtagcggcccgaaagacaccgactgcttcgcgtgtatgaacttcaacgactccggagcgtgtgtgacgcagtgtccgcagactttcgtgtataaccctacaacctttcaacttgagcacaactttaacgcaaaatatacctacggagccttctgcgtaaagaagtgtccacataactttgtcgtggactcgagctcatgtgtacgagcctgtccatccagcaagatggaggttgaagagaacggcatcaaaatgtgcaaaccatgtaccgatatttgtcctaaagcatgcgacggaatcggtaccggcagtctaatgtctgctcagactgtggattccagcaatatcgacaaatttataaattgtactaagattaacggcaatcttatcttcctagtcacggggattcacggcgatccctataatgcaatcgaggccattgaccctgaaaagctgaacgttttccgaacagtgcgggagattaccgggtttctgaatattcaatcatggcctcctaacatgaccgatttctccgtgttttccaacctcgtcacgatcggcggccgcgtcctgtattctgggcttagcctcctgattctcaaacagcagggaattacaagcctccagttccaatccctaaaagagatctctgctggcaatatatatatcacagataattcaaacctgtgctattaccacactattaattggactacactcttctcaacaatcaaccagagaattgtgatccgagataaccgcaaggccgaaaattgcaccgccgagggcatggtgtgtaaccatttatgctctagtgacggatgttggggcccagggcccgatcagtgtttatcctgtagacggtttagcagaggccggatttgtatagagtcatgtaacctttatgatggagagtttagggagttcgagaacggcagcatttgcgtggagtgcgatccacaatgcgagaagatggaggatggcctgctcacttgccatggtcccgggcccgataattgcaccaagtgctctcatttcaaggacggacccaattgcgttgagaagtgccctgacgggctgcaaggcgcaaactccttcatattcaaatacgcagacccggaccgggaatgccacccttgccatcccaactgtacacaggggtgcaacggcccaacatctcacgattgcatatattatccctggactggccacagtactttgcctcaacatgcacggactcctctgattgctgctggagttatcggcggactgttcatactggtgatcgtcgggctcactttcgctgtctacgtcagacggaagagtattaagaaaaagcgtgctcttcgccggtttttagagaccgagctagtggaacccctcacaccctcaggaactgcccccaaccaggctcaacttcgtatacttaaggagacagagctcaagcgagttaaggttctggggtcgggcgcatttggaacagtctataaaggcatttgggtacccgagggagagacggtcaaaatcccggtagccattaagattttgaacgaaacaacaggcccaaaagctaatgtggagtttatggatgaggccctgatcatggcgtcaatggaccatccacatctcgtgcggcttttgggtgtgtgcctgtcgccaactattcaacttgtaacccagctgatgcctcacggatgcttgctcgaatacgttcatgagcataaagataatattggtagccagcttctcctcaattggtgcgtgcagatcgcgaagggcatgatgtatctggaggaacgtcggttggtgcatcgggacctggctgcacggaacgtcctcgtcaagagccccaaccatgtgaagattacagatttcggactggcaagacttctcgagggagacgagaaagaatataatgccgatggcggaaagatgcccatcaaatggatggcccttgagtgcatccactacagaaagttcactcaccagtccgatgtgtggtcctatggggtaaccatctgggagctaatgacctttggagggaaaccttatgatggcattccaacccgtgagattcccgatctgctggaaaagggcgagcggcttccccagcctccaatctgcacaatcgacgtgtacatggtcatggtcaaatgctggatgatcgacgctgattcgagaccgaagttcaaggaattagcagccgaattcagccgtatggcgagagatccgcagcgctatctggtgatccagggcgacgaccggatgaaactgccatctcccaacgattcaaagtttttccagaatctgttggacgaagaagacttggaggacatgatggacgctgaggaatatctggtccctcaggcttttaacatcccgcccccaatctatacatctcgtgcacgtatcgactccaacagaaaccagtttgtctatcgcgatggcggcttcgccgcagaacagggggtcagcgtcccttacagggcaccaaccagtacaattccagaggcaccagtcgctcaaggagccaccgctgagatctttgacgacagctgttgcaacggtactctgcggaagccagtcgcaccccatgtgcaggaagattcatctacgcagcgctacagcgccgacccgactgtgttcgcccccgaaaggagcccacgcggtgagctcgatgaggaggggtatatgacacctatgagagacaagcctaaacaggaatatctcaacccagtcgaagagaatcccttcgtgtcgaggagaaaaaacggcgacctgcaggccctggataaccctgagtaccacaatgcgagtaacggacctccgaaggccgaggatgaatatgtaaatgagccactgtatttgaacacctttgccaacacactgggcaaggcagagtacctgaagaacaacattctgtctatgcccgagaaagctaaaaaggccttcgataatcctgactattggaatcattctctaccaccccgctccacgctgcagcaccccgattatcttcaggaatactccaccaaatacttttacaagcagaatggccgcattaggccaatcgtcgccgaaaacccggagtatcttagcgaattcagcctgaaacctgggaccgtgctgcctccccctccttataggcatcggaacactgttgtatag

SEQ ID NO: 26914 - DNA, 4029 bp, Artificial Sequence
  Description of Artificial Sequence: Synthetic coding sequence
atgcgggccaacgacgccctgcaggtgctgggcctgctgttcagcctggctcgcggttctgaggtcggaaacagccaggccgtgtgcccaggcactctcaacggcctctccgtgacaggcgatgcagagaaccagtatcagactttatacaaactgtacgaaagatgcgaggtcgtcatgggaaatctggagattgtgctgacagggcataatgctgatctttcctttctgcagtggatcagagaggttactggatacgtcctggttgcaatgaacgaattctccaccctgccgctgccgaatctcagggtggtgcgggggacccaggtgtacgacggaaagttcgccatcttcgtgatgctgaactataatacaaatagcagccacgcgttgcgtcagcttcgcttgacacaactgacggagatactgtcaggtggtgtgtacatcgaaaagaacgataagctctgccacatggacacaattgattggagagacatcgtgcgagaccgggacgcggagatcgttgtgaaggataacggaaggtcatgcccaccttgccatgaagtgtgtaaaggacgttgttggggaccgggtagcgaagattgtcagaccttaactaaaaccatttgtgcgccacaatgcaatggccactgcttcggcccaaatccaaatcagtgttgccacgatgagtgtgccggcggctgtagcgggccccaggataccgactgcttcgcctgtagacacttcaatgatagcggtgcgtgcgtcccccggtgcccccagccccttgtctacaataaactaaccttccagctggagccaaacccgcacactaaataccagtacgggggggtgtgtgtggctagctgtcctcataacttcgtcgtggatcaaacaagttgtgtccgggcctgtcctccggataaaatggaggtagacaaaaatggcctcaagatgtgtgagccatgtggaggcctgtgtcccaaggcatgcgagggcacgggatccggatctaggtttcaaactgtagatagctctaatattgatggatttgttaactgtactaagatcctcggcaatttggacttcctgatcaccggccttaatggcgacccctggcataaaatcccggccctagaccccgagaaacttaatgtgtttaggactgtgagggagataactgggtacctgaatatacaatcatggcccccgcacatgcacaatttctccgtgttcagcaatctcaccactattggtggtcgatcattgtataatcggggattctccctgctgattatgaaaaacctgaatgtcacttcactggggtttaggagcctcaaggaaattagcgccggccgcatctatatctccgcaaaccgccagttgtgttaccatcatagcctcaattggacaaaagttctgagagggcctacggaggagagacttgacattaaacataaccggcccaggagggattgcgtcgccgaaggcaaagtttgtgatcctttgtgctcgtcaggcggatgttggggaccaggtcccggacaatgtttgagttgccgtaactactcacgtggtggggtctgtgtcacccattgcaatttcctcaacggggagccccgagagttcgcccatgaggctgagtgtttttcttgtcacccagaatgtcagcccatggaaggaaccgccacatgtaacggcagcggatccgacacctgcgcacagtgcgcccacttcagagatggcccacattgtgtgagcagctgtccccacggggtgctgggcgctaagggtcctatttacaaataccccgacgtgcagaacgagtgtcgaccttgccatgaaaattgtacacagggttgcaaggggcccgaacttcaggactgtttaggccagacactcgtgctgatcggtaaaacccacctgaccatggcactgactgtgatcgccggcctggtggtcatttttatgatgttggggggaaccttcctctattggagagggagaaggatccagaacaagagggccatgaggaggtacctggaacggggagagtctattgagccccttgaccccagcgagaaggccaataaggtcctggcccggatctttaaggagactgagttgagaaagcttaaagtcctcgggagcggggtatttgggacagttcacaagggcgtgtggattccggagggtgagtcaattaaaattcctgtgtgcatcaaagttattgaagataagagtgggcggcagtcgttccaagctgtgacagaccacatgctcgccatcggaagtttggatcatgctcacattgtgcggctcttgggactttgccctggcagcagcttgcagctcgtcacccagtacctgcccctggggtcattgctcgatcatgtgagacagcataggggcgctcttggcccgcagctgttgctgaactggggggttcaaatcgcgaagggaatgtattatctagaggagcacggaatggtccaccgcaacttggccgcccgaaacgtgcttctgaagtcaccttctcaggtgcaagttgccgactttggcgttgccgatttgttgccgccagatgataagcagctgctgtactctgaagccaaaacacctattaagtggatggcgctggagtcaatccactttgggaagtatacccatcagtcagacgtgtggagttacggcgttactgtttgggaactgatgacatttggggctgagccctatgcaggattgagactggccgaggttcccgacctgctggagaagggcgagcggttagcacagccacagatctgtacaatcgacgtttatatggtgatggtgaaatgttggatgattgatgaaaacatcaggccgacatttaaggagttggcgaacgagtttacaagaatggcacgagaccctccaagatacttggtgattaagcgcgagtccggcccagggattgcacccggacccgaaccgcatggtctgacgaataagaagttggaagaagtggagctggagccagagttggatctggatctggatctggaagccgaggaggataatttagccacaaccaccttagggtccgccctgtcgctgccagtagggactctgaaccgccctagaggctcccaaagtttgctgtcaccatctagtggatacatgcctatgaatcaagggaatctgggcgagtcctgtcaagagagcgctgtctcagggagcagcgaaagatgcccgcggccagttagccttcacccaatgccccgagggtgtttggcctcagagtcctctgagggtcatgtcacgggctcagaagcggagctccaagagaaggtttccatgtgccgcagtcggtcccggagtcgctctccaaggccaagaggggactcggcttatcacagtcagcgtcatagtctcctgacccctgtgacaccactttcaccacccggactcgaagaagaagatgtaaacggctacgttatgccagacacacacctaaaaggcaccccttcaagccgggagggcacgcttagcagtgtcgggctatcctccgtgctaggcactgaagaggaagatgaggatgaagaatacgagtatatgaatagacggaggaggcattccccacctcacccaccgcgcccctctagcctggaggaattggggtatgagtacatggatgtgggctcagatctgtccgcctctttaggctcaacccagagttgtcccttgcaccctgtgcctattatgccaaccgccgggacgacccccgatgaggactacgagtatatgaatcggcagcgtgacggaggggggccaggcggggactacgccgctatgggagcttgcccggcctctgaacaggggtatgaggaaatgagggctttccagggcccaggccaccaagcccctcatgtacactatgcaagactcaagactctgcggagcttagaagctactgactctgctttcgacaaccccgactactggcactcccgcctcttcccgaaggctaatgcccagcgtacttag

SEQ ID NO: 26915 - DNA, 996 bp, Artificial Sequence
  Description of Artificial Sequence: Synthetic coding sequence
atgcgggccaacgacgccctgcaggtgctgggcctgctgttcagcctggctcgtggctccgaagttggcaattctcaagccgtctgccccggaacactcaatggactgagtgttacaggggatgcagagaaccagtaccagacactatacaaactgtacgagcgttgtgaggtcgttatggggaatctggagattgttctaaccgggcacaacgccgacctgtcattccttcagtggattcgcgaagtcacggggtatgttttggtggcaatgaacgagttcagtactctgcccttgccaaatctgagggttgtgcgtgggacgcaggtgtacgatggcaagtttgctatttttgtgatgctgaattacaacactaattcctcccatgcactgcgccagctgaggcttacacagttaaccgaaatcctgtcagggggcgtctatatcgagaagaacgataagttgtgtcacatggatacaatcgactggcgggatatagttcgcgatagagacgctgagatagtggttaaagacaacggccgatcatgccctccttgtcatgaagtgtgtaaaggtaggtgttggggaccaggatcggaggactgccagacactaaccaaaactatttgcgccccgcagtgcaacgggcactgtttcggccccaacccaaaccaatgttgccatgatgagtgtgccggcggctgtagcggccctcaagacactgactgcttcgcgtgtagacactttaatgactcgggagcctgcgtacctcgctgtcctcaaccactggtttataataaactcactttccagcttgagcccaatccacatactaagtaccaatatggtggagtctgtgtcgctagctgtcctcacaattttgtggttgaccaaacgtcttgtgtgcgtgcgtgccctcccgataagatggaagtagataagaacggactaaagatgtgcgagccttgcggcgggttgtgtcctaaggtcttttag

SEQ ID NO: 26916 - DNA, 552 bp, Artificial Sequence
  Description of Artificial Sequence: Synthetic coding sequence
atgcgggccaacgacgccctgcaggtgctgggcctgctgttcagcctggcccggggctccgaagtaggcaactcacaagctgtgtgccctggaacgctgaatggcctgtctgtaaccggcgacgcagaaaaccagtaccagactctatacaagctgtacgagagatgtgaggtggtgatgggcaatttggagatcgtccttacgggacacaatgccgacctatcctttctacagtggatcagagaggtgacaggttacgtcctagtcgctatgaacgaattttccactctcccactacccaaccttagagttgtccgaggaacccaggtatacgatggaaaattcgcaatcttcgtgatgttaaattacaacaccaattcttcacacgctctccggcagctccggctcacacaacttacaggtcagttcccaatggttccttccggcctgacgccccagccagcccaggattggtatctgctggacgatgatcctcggttactcaccctgagcgctagctccaaggtcccggtgacactggccgcagtgtag

SEQ ID NO: 26917 - DNA, 3852 bp, Artificial Sequence
  Description of Artificial Sequence: Synthetic coding sequence
atgggcaacctggagatcgtgctgaccggccacaacgccgacctgtcttttctgcagtggatccgtgaggttactggctacgtgctagttgcgatgaacgagttctcgacccttccacttcccaacctaagagtcgtgcgaggaacacaggtttacgatggcaaattcgcgatttttgtcatgctaaactacaacaccaattccagccatgcactacggcagttgcgccttacacagctcacggagatcctcagcggcggagtatatattgagaaaaacgataagctgtgccacatggacacaattgattggcgggatatcgttagagaccgcgatgccgagatcgtcgtgaaagacaatggcaggtcttgcccaccttgtcacgaagtgtgtaaaggccgttgctgggggcctggttctgaagactgtcaaaccttaaccaagactatttgcgctcctcagtgtaatggtcactgttttggtcccaatcccaaccaatgctgccacgatgaatgtgctggcggctgtagcggtccgcaggatactgactgcttcgcttgtagacattttaacgactcgggtgcttgtgttccaagatgtccacagcctttggtctataataaactcacgttccaactggagcccaacccacacactaaataccaatatggcggcgtctgcgtggcaagctgtccccacaactttgtcgtggatcagacttcctgcgttagggcctgccctcctgacaagatggaggtggacaagaacggcctgaaaatgtgcgagccatgcggcggactatgtccaaaggcctgcgagggcaccggaagtggctctcgcttccagacagtcgatagctccaatatcgacggttttgtgaactgcaccaagatattaggcaacctagattttctcataacaggcctgaacggcgacccctggcacaaaattccggctctggatcctgagaaactcaacgtgtttagaaccgtgcgagagatcacgggctatctgaacatccagtcgtggccaccgcacatgcataacttcagcgttttctccaatctcaccacgattgggggaaggtccctgtacaacagaggcttttccctgctgattatgaagaatctgaatgttaccagtctcggttttaggtccctgaaagaaatctctgccgggcggatctacattagcgccaatcggcagttatgctatcatcacagcttgaactggaccaaagtcttacgcggacccacagaggaaaggctggacatcaagcacaacagaccaaggagagactgtgtcgctgaagggaaggtgtgcgacccactatgtagcagcgggggctgctggggccctggtccagggcaatgcttaagctgcagaaactattcaaggggaggagtctgcgtgactcattgcaatttcctcaatggcgaacctcgcgagttcgcgcacgaagccgagtgcttcagctgccatccagaatgtcagcctatggagggcaccgcgacttgtaatggtagcgggagcgacacctgcgcccagtgtgcccactttcgagatggccctcactgcgttagctcttgtccacacggcgtcctcggagcaaagggccctatctataagtatccagacgtgcaaaatgagtgtcgtccttgccacgagaattgcactcagggctgtaaagggcctgagcttcaggattgtttggggcagaccctggtgctcatcggaaagacgcaccttaccatggcgctcacagtgattgctggcctggttgttatatttatgatgctggggggtactttcctgtactggcggggacggagaatccagaataagagggcaatgcgccgctacttggagagaggcgagtctattgaaccccttgacccatcagaaaaggctaacaaagtgctggctagaatattcaaggagacagagttgaggaaactcaaagtactggggtcaggcgtgtttggaacagtccacaaaggcgtctggatcccggaaggggagagcattaagatcccagtctgtatcaaagtgatcgaggacaagtccggcaggcagagttttcaggccgtgacagatcacatgctcgccatcggatcactggaccatgctcatatcgtgcgtttactgggcctttgcccaggatcctctctccagctagttacccagtatctgcctctgggaagcttgttggaccacgtcaggcaacatcgtggcgccctgggcccccagctcctactgaattggggagtgcaaattgccaaaggaatgtattacctggaggaacacggaatggtacacaggaatctggctgccaggaatgtgctcttgaaatctccctcacaagtgcaggtggcggatttcggcgtggccgatctcttgcctcctgacgacaaacagctgttgtactccgaagctaagacgccaataaaatggatggctctagagtccatccattttggaaaatacactcatcagagtgacgtttggtcatatggagtaacagtgtgggaattgatgacatttggagcggagccatatgccggattaaggttggcagaggtgccagacctgctagagaagggcgagaggctcgcccagccccagatctgcacaattgatgtgtacatggtgatggtgaagtgctggatgatcgacgagaatatcaggcccacttttaaggagctggcgaatgagttcacccggatggctcgagatcccccccgatatctggtgatcaaacgagagtccgggccagggatagctcctgggccagagccacacggcctgactaacaagaagctcgaggaggtggagctcgaaccagagctggacctggacttggatttagaagccgaggaggacaatctcgctactactaccttgggctccgccctgagcctcccggttggaacactaaacaggcctaggggttctcaatcgctgctctcacctagtagtggctatatgcctatgaatcagggcaacctgggagaaagttgccaagaaagcgctgtctctggcagcagcgagcggtgcccacggccagtttctctgcacccaatgccacgcggatgccttgcatctgaatctagcgagggccacgtgacaggttctgaagcggagctgcaggaaaaagtctctatgtgccggtctcggtcccgtagtcgatcacctcgcccccggggcgattctgcctatcactcccagcgacacagcctgctgaccccagtaaccccactcagcccccctggcttagaagaggaggatgtcaacggttacgtcatgcccgatactcatcttaagggtactccaagcagcagagaaggtaccttgagctccgttggactcagttcagtactaggtacagaggaagaggatgaggatgaagagtatgaatacatgaaccggcgtcgccgacattccccaccgcatcccccacggccctcatcgctcgaggagctgggctatgagtacatggacgtgggatctgacctcagcgcgagcctgggatcaacccagtcgtgtcctctgcaccctgtgcccatcatgcccactgccggaaccacccccgacgaggattatgaatatatgaatagacagcgggacgggggcgggcctggcggggattacgccgccatgggcgcttgtcccgcctccgaacagggctatgaggaaatgcgcgcctttcaaggtcccggccaccaagcacctcatgtccactacgcacggctcaaaaccctgaggtctctagaggccaccgatagcgcgtttgataacccagattattggcatagccgcctcttcccgaaggccaacgctcaacggacctag

SEQ ID NO: 26918 - DNA, 2100 bp, Artificial Sequence
  Description of Artificial Sequence: Synthetic coding sequence
atggccctgaccgtgatcgccggcctggtggtgatcttcatgatgctgggcggaacttttttgtactggcggggtcgacgcatccaaaataaacgggcgatgcgacggtacctggaaaggggggaatctatcgagcctcttgatccatctgagaaggccaataaagtcctcgcacggatctttaaagaaaccgaattgcgcaagctcaaagtgctcgggtctggggtgttcggaaccgtgcacaaaggcgtctggatccccgaaggagaatcgattaagatccctgtttgtattaaggtgatcgaagacaaaagtggtagacagtcgtttcaggccgtgaccgatcacatgctggctatcggatccctcgaccacgcacacattgttcgactcttaggactttgccccggtagctccctccagctggtcacacagtatcttccccttgggagcctattggaccatgtgcggcagcacaggggggccctggggccacaacttctgctgaactggggcgtccagattgcaaaaggtatgtattacctcgaagaacacggcatggtgcaccgtaatctggccgcgcgaaatgtcctcctgaagtcaccatcgcaggtccaggtggccgattttggggtggccgatttgttacccccagacgacaaacagctcctttactccgaagcaaaaacgcctattaaatggatggctctcgagagtatacactttgggaaatacacgcaccagagtgatgtctggagctatggagtaaccgtgtgggagttgatgacttttggggctgaaccttatgccggcctccgtctcgccgaggttcctgacttattagaaaaaggagagagactagcgcagccccagatttgcactatcgatgtttacatggttatggtgaaatgctggatgattgacgaaaatatccggccgactttcaaagaacttgctaatgagttcacacggatggcccgggatcctccacgatatttggtcatcaaaagggagtcagggcctggaattgcaccaggacctgaaccacatggcctgaccaataaaaaactggaagaggttgagctcgagccagaactggatctcgatctggatctggaggctgaggaggataatctagcgacaaccaccctgggctcagctctgagtctgcctgtcggcacactgaatcggcccaggggctcgcagagcttgctaagccctagctcagggtacatgcccatgaatcagggtaacctcggcgaaagctgccaggagtctgcagtgtcgggctcttccgagagatgccctagacccgtgagcctgcaccccatgccacggggctgcttggcaagtgaaagttccgaaggacacgttacagggtccgaagctgaactgcaggaaaaagtgtcaatgtgcaggtctaggtcccggagcaggtctcctcgcccacgcggggattctgcctatcacagtcagaggcattccttactgacccccgtgaccccactgtctccgcctgggctagaagaggaagatgtgaacggctacgtgatgcccgacacgcacctgaagggcacaccttccagtcgcgagggcaccctcagctcagtcggactgtctagtgttcttggcaccgaggaggaagatgaggacgaggaatacgaatatatgaaccgacgaagaagacactctcccccgcatcctccgcggcctagtagccttgaggaactggggtacgaatacatggatgtgggttcagacctgagtgcctctctgggatctacccaatcatgtccacttcacccagttcctataatgccaactgcgggcacgactccggatgaggattacgagtacatgaacaggcaacgggatggcgggggacccgggggggattatgccgcaatgggggcctgccccgcttctgaacaggggtacgaggaaatgcgcgccttccaaggcccagggcaccaggccccacatgtacactatgcccggctgaagacactccgttcccttgaggccactgactcagcgttcgataatccggattattggcactctcgactctttccaaaggccaacgcacagagaacatag

SEQ ID NO: 26919 - DNA, 381 bp, Artificial Sequence
  Description of Artificial Sequence: Synthetic coding sequence
atgcgggccaacgacgccctgcaggtgctgggcctgctgttcagcctcgcaagggggtccgaagttggcaattctcaggccgtatgccccgggacactgaatggcctgtccgtaaccggcgatgccgagaaccaatatcagacattgtataagctgtatgaaagatgcgaagtcgttatgggaaacctcgagatcgttctaacagggcataacgcggacctgtcgttcctgcagtggatcagagaagttactggctatgtcctggtggccatgaacgagttttcaacactccccttacccaacttgcgcgtcgttcggggtacacaggtttatgacggaaaatttgctattttcgtcatgttgaattacaataccaactag

SEQ ID NO: 26920 - DNA, 2766 bp, Artificial Sequence
  Description of Artificial Sequence: Synthetic coding sequence
atgcgggccaacgacgccctgcaggtgctgggcctgctgttcagcttagcgcgcggaagcgaggtgggcaattcccaagccgtgtgccccgggactctgaacggcttgtctgtgactggcgacgccgaaaaccagtaccaaacattatataagctttatgaacgatgcgaagtggtaatggggaatctcgagatcgttctcaccggtcacaatgcagatctgtcattcttgcagtggattagagaggtgactggctacgtgttagtagcaatgaatgaatttagtaccctgcccttgcccaatttgcgggtggtgcggggcacacaggtgtatgacggaaagtttgcgatctttgtgatgctcaactataacacaaattcatcgcatgctctgagacagctgaggcttactcagctgacggagatcctgtccggcggtgtgtacatagaaaagaacgacaagctgtgccacatggataccatcgactggagggatattgtgcgagatcgggatgccgaaattgtggttaaagacaacggacggtcctgcccaccatgtcacgaagtatgtaaagggcgctgctggggtcctggatctgaagattgtcaaaccctcacaaaaactatatgcgccccacaatgcaacggacattgcttcggtccaaatccaaaccaatgctgtcacgacgagtgtgccggcgggtgctctgggcctcaagacaccgactgttttgcttgcagacatttcaatgactctggtgcttgtgtccctcggtgtcctcagcccctggtttacaacaaactgacgttccagctggagccaaatcctcacactaaataccagtacgggggcgtctgcgtagcctcttgcccccacaacttcgtcgtggatcagacaagttgtgtccgggcttgtcccccagacaagatggaggtcgacaagaatggcctgaagatgtgtgaaccatgcggtgggctgtgcccgaaggcatgcgaggggacagggtcaggttcccggttccagacagtcgactcatcaaacatcgatggcttcgttaattgcaccaagatcttaggaaaccttgactttttaattactggcctcaacggagatccttggcacaaaatccccgcactggacccggagaaactgaacgtctttagaaccgttcgagagatcaccgggtacctcaacatccagtcatggccacctcacatgcacaatttctctgtattctccaatctgacaacaattggaggtcggtccttgtacaatcgtggattctctctgctgatcatgaagaatctcaacgtgacatctctaggatttagaagcctgaaggagatctctgccggccgcatctacatcagtgcaaacaggcaactttgttaccaccattcactaaattggacaaaggtcttaaggggaccaacggaagagcgtcttgatattaaacacaataggccacgccgtgattgtgtcgccgaaggcaaagtgtgcgacccgctgtgttcctcaggagggtgctggggtcccggccccggtcagtgcctttcctgtaggaattacagccgcggcggagtgtgtgtaactcattgcaactttctaaacggcgagcctcgggaatttgcgcatgaagctgagtgcttcagctgtcatccagaatgccaacccatggaggggactgcgacgtgtaacggttcgggttctgatacatgcgcacagtgcgcccatttccgtgatggccctcactgtgttagcagttgtcctcatggagtgctgggcgccaaggggcctatatataagtatcctgatgtccagaatgagtgtagaccttgccacgagaattgcacgcagggttgtaagggccccgagctgcaggactgcctggggcagactttggtgctgattgggaagacacatttgactatggcattaacggtgattgccggactggtggtcattttcatgatgctgggcggtacatttctttattggcggggtcgcaggatacagaataagagggctatgagaagatatctggagcgcggggagtcaatcgagcccctggatccatccgaaaaggcaaataaggtgctggcacgcatcttcaaagagaccgaattgcgcaagctcaaggttctgggatctggagtgtttgggactgttcataagggcgtgtggatccctgagggagagtccatcaagattccggtttgcattaaagtcatcgaagacaaatccggaagacagtcatttcaggccgtgaccgaccatatgttagccattgggagccttgaccacgcgcacatcgtacggctgttaggcctgtgtccagggagctcgctccaacttgtgacgcagtatctgcccttaggctcattacttgaccacgtcaggcaacacaggggagctctgggcccacagctcctgctgaattggggcgtgcagatcgctaaaggtatgtactacttggaagaacatgggatggtccatcgaaacctggcagcccgcaatgtcctgctgaagtccccgagccaggtgcaagtcgcggacttcggggtggccgacttgcttccaccggacgataaacagctgctctatagcgaggcaaaaactcctataaaatggatggcccttgaatcaatccacttcggcaagtatactcatcagagtgatgtttggtcctatggacaatgtatctggatgccctcactgccttcactggcaccggtgagtaacctaccttttgagaccccttcgtag

SEQ ID NO: 26921 - DNA, 10191 bp, Artificial Sequence
  Description of Artificial Sequence: Synthetic coding sequence
atgttcatcaacatcaagagcatcctgtggatgtgcagcaccctgatcgtaacccatgccctgcataaggtcaaggttggaaaaagccctcccgtccgaggttccctgagcggcaaggtgagtctgccctgtcatttttctacaatgccaaccctgccaccatcctataatacctctgaattcctcaggatcaagtggtccaaaattgaagtggataagaatggtaaggatctgaaagaaacaaccgtgctcgttgcacagaatggaaatatcaaaatcggtcaggactacaaaggaagggtaagtgttcccacacatccggaagccgtaggcgatgctagccttactgtggtcaagctgctggcctccgatgcaggtctgtatcggtgcgatgtaatgtacggcattgaggacactcaggataccgtttcccttactgtggatggcgtggtgttccattaccgggctgccacttcaagatatacactaaattttgaggccgctcagaaggcctgcttggatgtgggcgcagtcattgcaactcccgagcagttgttcgccgcctacgaggacggttttgagcagtgtgatgcaggctggcttgcggatcaaactgtgcgttatccaatccgagcccctcgggtgggatgttacggggataaaatgggcaaagccggcgtacggacatatggttttcggtcaccacaggaaacctatgatgtctattgttatgtcgatcatctcgacggagacgtctttcatctgacagtgcctagcaagttcacattcgaggaagctgctaaggagtgtgaaaatcaggacgcccgattagctacagtcggcgagctccaggcggcatggaggaacggctttgatcagtgcgattatgggtggctgtcggatgcctcagtgcgacatccggtgaccgtggcccgagcccaatgcggggggggtctgctgggagtgcggactttgtacagatttgagaatcagacaggcttccctccccctgacagccgctttgatgcctattgcttcaagccaaaagaggcaactaccatcgatttgtcaattctagctgagacagcatccccctcgttgagcaaagagccacagatggtttccgaccgtactaccccgattattcccttagtagatgagctgcctgttattccaacggaattcccgccagtcggcaacatagtgagtttcgaacagaaagcaaccgtgcagccacaggctatcacagactctctcgctacaaaactccctacgccaaccggatctaccaaaaagccttgggacatggatgactactctcctagcgcttccggtcctttaggtaaattggacattagcgaaattaaggaggaagtgcttcaatccaccactggcgtgtcacattacgcaacggactcttgggatggggtcgtggaagacaagcaaactcaggagtcggtcacccagattgaacagattgaggtaggccccctcgtcaccagcatggagattctgaagcacattccaagcaaggagttccccgttaccgagacccctctagtaacggcgcgtatgattcttgagtcaaagaccgagaagaaaatggtctctactgtgagtgaattagtgaccaccggccactacggatttacccttggagaagaggacgacgaagacagaaccttaaccgtggggagcgacgagtccaccctgatattcgatcaaatcccagaggtaattaccgttagtaagacttcagaggatacaattcacacgcatctggaagaccttgaatctgtgtccgcgagcactacggtgagccccctcattatgccggataacaatggctcctcaatggacgactgggaagagcgccaaactagtgggcgaatcaccgaagaattcctcgggaagtacctgtctacaacaccatttccctctcagcaccggaccgaaattgagctgtttccttacagcggagataagatcctcgtggaaggcatcagcacggtcatttatccaagcttgcaaaccgaaatgacccacagacgagagaggaccgaaactctgattcccgagatgcgaacggacacctatacggacgaaattcaggaagagatcaccaagagccccttcatgggaaaaactgaggaagaagtctttagcggaatgaaactgtcaacctccctgagtgagccgattcacgtgacggagtcctctgttgagatgactaaaagcttcgatttccctacactcattactaaactcagtgccgaacccaccgaagtgagggacatggaggaagacttcaccgcgacgcctggaaccacaaagtatgatgagaacatcaccaccgtgctcctagcccacggtactctgtctgtagaggcagccactgtgagtaaatggagctgggacgaggataacacgacaagcaagccgctggaatccactgaaccgagcgcgagttctaagctaccaccagccctcctcactaccgtggggatgaacggtaaggacaaggacatcccctcgttcaccgaggatggggctgacgagttcacccttattcccgactctacacaaaagcagctcgaagaggtgaccgatgaggacattgccgcacacggaaagtttactataagatttcagcctactaccagcacagggatcgcagagaagtcaacacttcgagactccactaccgaagaaaaggtgcccccgatcacaagcaccgagggtcaggtttacgcgaccatggaggggtcggccctgggggaagtggaggacgtggatttaagcaagcctgtgagcactgtcccacagtttgcacacacttccgaggtcgaaggactggcattcgtgagttacagttccacccaggaacctaccacgtatgttgactcttcccatacaatcccattgagcgtcataccaaagacggactggggtgttctggtgccctctgtcccatccgaggatgaggttttgggagaaccctcacaagacatcctggttattgaccagacccgattggaagcaacaatctctccagagacaatgcgcacaacgaagatcaccgagggtaccacccaggaggaattcccttggaaggaacagacagctgaaaaacccgtgccagctctcagcagcacagcttggacgccgaaagaagcggttactcccctcgacgaacaggagggcgatggcagcgcttacaccgtgtccgaagatgaactattgacggggtccgagagggtgcctgtgttggagactacaccagtggggaagattgatcatagcgttagctacccgcccggagctgtgacggaacacaaagttaaaactgatgaagtcgtgacactgacaccgcgtatcgggccaaaagtgagcttaagcccggggcctgaacagaagtacgagacagagggaagtagcaccacaggcttcacaagcagtctgtctcccttctctactcatattactcagctcatggaggaaacgacaaccgagaagacttctctggaggacattgatctggggagcggcctgttcgagaaaccaaaggccaccgaattgattgaattttccaccataaaggtcaccgtgcccagcgatataacaactgctttctccagcgttgacagactacataccacttctgcctttaagccaagttctgccataactaaaaagcctccactcattgatagggagccaggcgaagagaccacaagtgacatggtgatcattggggagagtaccagccatgtcccgcccactactctcgaggatattgtggctaaggagacagagacggacattgaccgggagtatttcactacctcctccccacccgcaacacaaccaactcgtccaccgacggtggaagacaaagaggctttcgggcctcaggccttatctacaccccagccacctgcatccactaagtttcaccctgatatcaacgtttatatcatagaggtgagagagaacaaaacgggtcggatgtctgacttgagtgtcatcggccaccctattgactctgaatcgaaggaagatgagccctgctccgaggagacagatcccgttcatgacctgatggcggaaatactgcctgagtttccagacataatcgaaatcgacctctaccactccgaggagaatgaggaagaggaggaggaatgcgccaacgctacagacgtgactacaactccttcagtgcagtacataaatggaaaacatctggtaactacagttcccaaagatcccgaggccgccgaggcgaggcggggccagtttgagagcgtggccccaagccagaacttctctgactcttccgaatccgacactcacccattcgttattgctaagacagagttatccacagccgtacagcctaacgagagtacagaaacaacagaaagtttagaggttacttggaaacccgagacctatccggaaacttctgagcatttttcaggtggtgagcctgatgttttccctacagttcccttccatgaagagtttgaaagtggcacagccaagaaaggagccgagtccgtgaccgagagggacactgaggtggggcatcaagcccacgaacataccgaacctgtgtcactgttccccgaggaaagctccggcgaaattgcaatcgaccaggagtcccagaaaatcgcatttgcccgagctaccgaagtgactttcggcgaggaggtagagaaaagtacatccgtaacatatacgcctacaattgtcccttcttctgcttcagcatatgtgagcgaggaggaggccgtgacactgatcgggaacccttggcctgacgatctcctctccacgaaggagagctgggtagaggccaccccaagacaggttgtggagctctccgggtccagctccatcccgattacagagggaagcggcgaggcagaggaagacgaagacacgatgttcactatggtgaccgacttgtcacagagaaacacaacagacaccctgattaccctggacacgtcccggataatcacggagagcttcttcgaggttcccgcgaccacaatttaccccgtgtctgaacagccttctgcgaaggtcgtccctacaaagttcgtctcagaaacggacacatccgagtggatctcgagcactactgtagaggaaaaaaagcgcaaagaagaagaaggcacgacagggactgcaagcacttttgaagtttacagctcgacacagcggagcgatcagctaatcctcccattcgagttggaatctccgaatgtcgccacaagctcagatagcggtacacgaaaaagcttcatgtccctgaccacccctacccaatctgagcgggaaatgaccgatagcactcctgtgttcacagagacgaatacactcgaaaacctgggggctcagacaacggagcacagttccatccaccagcccggagttcaggaaggtctgactacacttccacggtcccctgcatcagtgttcatggagcagggaagcggcgaggctgccgcagatcccgagacaactactgtgtcttctttcagcctgaacgttgaatatgctatacaagcagaaaaggaggtagcaggcaccctaagcccccacgttgaaactaccttctctacagagcccacagggttggtactgtctactgtgatggatcgcgtagttgcagagaatatcactcagacttccagagagattgttatatccgagcgtttgggcgagcctaattatggagcagagattcggggtttcagcacaggcttcccgctcgaagaggatttttcaggcgatttccgggagtatagcaccgtctctcacccaatcgccaaggaagagacagtcatgatggaaggtagtggagacgctgcttttagagacacacaaacctctccgtctacagtgcctacttcagtgcacatctcgcatatcagcgacagcgaaggaccttccagcaccatggtgagcactagcgcttttccttgggaggagttcacaagttctgccgaaggcagcggcgagcagctggtgaccgtgagttcctctgtggttcccgttctccccagtgccgtccagaaatttagtggaacagccagcagcattatcgatgaaggtctgggtgaggtgggaactgtcaacgagatcgatcgcaggtccaccatccttccaacagccgaggttgagggcaccaaagcaccggtagaaaaagaggaagttaaggtgtctggaactgtaagcactaatttcccacagactatcgagccagccaagctatggtctcggcaagaagtgaaccctgtgcgccaggagattgagagcgagactacctctgaggagcaaatccaagaagagaaatcctttgaatctccacaaaactccccagccaccgagcaaacgattttcgattcccagacttttacggagaccgaactcaagaccactgattactccgtcttgactactaagaagacatatagcgatgacaaggagatgaaagaagaggataccagtcttgtcaacatgtccactcctgatccagatgccaacggactggaatcttataccactctccccgaggccactgaaaagagtcattttttcctcgcaactgcgctggttacggaatctattcccgcagaacacgtggtgacagatagtcctatcaaaaaagaagagagcacaaagcattttcccaaagggatgcggcctacaatccaggagtccgatacggaactgcttttttcaggcctcggcagtggcgaagaagttctacctactctgcctaccgagtctgtcaatttcacagaggtcgagcagatcaataacactctttatccacatacttcacaggtggaaagtacctcctcagacaaaattgaagacttcaaccggatggagaatgtagctaaagaagtcggccctctggtttctcagactgatatcttcgaaggttcaggcagcgtgacttcaacaaccctgatagagatattatcagataccggcgctgaggggccgacggtagccccactgccttttagcaccgacattggacatccccagaatcagaccgtgaggtgggccgaagagatccagacatccaggcctcagaccattactgagcaggacagcaataagaacagttccaccgcggagattaatgagactactactagttctaccgattttctggcgagagcttacggattcgagatggccaaggagtttgtcacttcagcacccaaaccaagtgatctttactatgaaccttcaggagagggaagcggggaggtcgatattgtggacagcttccacacatcagccactacccaggctacaagacaggagtcgtccacaaccttcgtgtccgatggatccctagaaaagcaccctgaagtcccaagcgccaaggccgttactgccgatggatttcccacagttagtgtgatgttgcccttgcattcagagcagaataaaagctccccagatcccacatccacgcttagcaatacggtctcctacgagcggagcactgacggctcctttcaggatagattccgcgaatttgaagactccacactcaagccgaaccgcaagaagcccactgagaacatcattatcgacctggacaaggaggataaggacctcatcctgacaattacggaaagtaccattctggaaatactgcctgagctaacctcggataagaacaccatcattgacattgatcacactaagccagtgtatgaagatatcctaggcatgcaaaccgacatagacaccgaagtgccatctgagccccacgactcaaatgacgagagcaatgatgacagcacacaggttcaggagatctacgaagctgccgtcaacctgtcactgactgaggagaccttcgagggatccgctgatgtacttgcctcatatacacaggcaactcatgatgagtcaatgacctatgaagaccggtcacagctagaccatatgggattccattttacgactggcatccccgcccctagtacagagactgaattagacgtgttgcttcccactgccacctctttgcctatacctagaaagtccgctacagtcattccagagatcgagggcataaaggctgaggcgaaagccctggacgacatgttcgaaagtagcactctgtccgatggacaagcaatcgccgaccagagtgagatcatcccgacactgggtcaatttgaaagaacccaggaggaatacgaggataagaaacacgctgggcccagtttccaaccagaattctcaagcggagccgaggaggctttagttgaccacaccccctatctgagcattgcaactacccacctcatggatcagagcgtgaccgaggtgccagacgtgatggaggggagcaaccccccatactataccgacaccacacttgccgtgtcaacctttgccaaactttcctcccagacaccatcatcccctctaaccatctacagcgggtcggaggcaagcggtcacacagagattccacaaccatccgctctccccggaatcgatgtgggttcatctgttatgtccccacaggacagcttcaaggagattcacgttaatatcgaggctactttcaagccatcaagtgaagaatatttgcatattacagaacccccgagtttgagcccagacacaaagctcgagccttctgaagacgatggtaagcctgaacttttggaggagatggaggcttctcccactgagctaattgcagtcgagggtaccgagatcctccaggattttcaaaataagacggacgggcaagtgtccggagaggcaatcaagatgttcccgacaatcaaaacccctgaggctggcaccgtgattactacagccgacgaaatcgaactggaaggcgctacccagtggcctcacagcacatcagcaagcgctacctacggagtcgaagccggggtagtcccctggctatctccgcaaactagcgagcgtcctacattgagttcgtctcctgagataaaccccgaaactcaggcagctctcataagaggacaagactccaccatagccgcatcagagcagcaggtggctgctagaattttggatagcaatgatcaggccacggtcaatcccgtcgagttcaatacagaggtagccacacccccattcagtctgctggaaacgtccaacgaaacggacttcctgatcgggattaatgaggaaagtgtcgagggcaccgcgatttatcttcccgggcctgaccgatgcaagatgaacccctgtctgaacggtggtacctgttaccccacagaaacctcctacgtctgcacatgcgtcccgggctattcgggtgaccagtgtgagctggacttcgatgaatgtcatagcaatccttgccgtaacggagccacctgcgtggatggcttcaatacttttaggtgcctctgccttccttcttacgttggagctctctgtgagcaagacacagagacatgcgactacggttggcacaaattccagggtcaatgctacaagtacttcgcacataggaggacctgggacgcggcggagagagagtgtcgactccagggggcccacctgactagtatcctctctcacgaagagcaaatgttcgtcaatcgggtaggccatgattatcagtggattgggctgaacgataagatgttcgaacatgacttcaggtggaccgatggttccaccctccagtatgagaattggagacccaaccagcctgacagcttcttcagtgctggtgaagactgcgtggttatcatttggcacgagaacggacagtggaacgacgtcccctgtaactaccatcttacgtacacttgcaagaaagggaccgtggcttgtggccagccgccagtcgtcgaaaatgctaaaacattcgggaaaatgaagcctcgatacgaaattaatagcctgatccggtatcactgcaaggacggtttcatccaaagacatctcccaactatccggtgcctgggcaatggacggtgggccattccaaagataacctgcatgaacccgagcgcttaccagaggacttactctatgaaatatttcaagaacagctcctccgctaaggacaattcaatcaacacctcaaaacacgatcatcgctggagtagacgatggcaggagtcaaggcgctag

SEQ ID NO: 26922 - DNA, 4929 bp, Artificial Sequence
  Description of Artificial Sequence: Synthetic coding sequence
atgttcatcaacatcaagagcatcctgtggatgtgcagcaccctgattgtgacccatgcacttcataaggtgaaagtcgggaaaagccctccagtcagaggctccctcagtggaaaagtatctctcccatgtcacttcagcacgatgccaactttgccgccttcctataacacctctgagtttttgagaattaaatggtcgaagatagaagtggacaaaaatggcaaagacctgaaggagacaacagtcctggtcgcgcagaacggcaatattaaaatcggacaagactataagggtcgcgtttctgtgcccacgcaccccgaggccgttggggatgcgtcactgaccgtcgtgaagcttttagcaagcgatgccggcctgtaccgctgcgatgtcatgtatggtattgaagacacacaggatactgtatcattaactgtcgatggcgtggtcttccactatagagcggcaactagccgctatacgttgaatttcgaggccgcacagaaagcctgcctggacgtgggagcagttattgctacccccgagcagctgttcgcggcctatgaagacggcttcgagcagtgtgacgcggggtggcttgccgaccagacagtccgataccctattagagcccctcgcgtgggatgttatggtgacaaaatgggcaaagcaggagtgaggacatatggatttaggtcgcctcaggagacctatgacgtatactgctatgtggatcacctcgatggggatgtgtttcaccttactgttccttccaaattcacttttgaagaggcggctaaagaatgcgaaaaccaggatgctcgccttgccaccgtgggcgaactgcaggccgcatggagaaatggcttcgaccagtgtgactatgggtggctctccgacgcctcagtccgccatcctgtgacagtcgcccgagcacagtgtggtggtggcctcctcggagtgaggaccttatacaggttcgagaatcagaccgggttcccaccacccgatagtcgcttcgacgcttactgcttcaagcctaaagaggccaccactattgatctctcaatactcgccgaaactgcttcccccagtctgagcaaagaaccacaaatggtatcagatagaacaacgcccataatccctttggttgatgagctacccgtgattcctaccgagtttcctccggtgggaaatattgttagtttcgaacagaaggcaaccgtccagccgcaggccattaccgatagtctcgccaccaaactgccaacccctacgggaagtacgaaaaagccatgggatatggatgactacagcccatcggcttccgggccattgggcaagctggatattagtgaaattaaggaggaagtgttacagagtactactggcgtgagtcattatgccacggactcttgggacggagtggttgaggacaagcagacccaagaatctgtcacccaaatcgaacagattgaagtgggacccctggtgacttctatggagattttaaagcacatccccagcaaggagtttccagtgacagaaacccccttggtgaccgcaaggatgatccttgaaagtaaaacagaaaagaagatggtttccacagtgtccgagctggtcacgacaggccactacgggttcactctgggcgaggaggacgatgaagatcggaccctgacggtcgggagtgatgaatcaaccttgatcttcgaccagattcctgaagtgattaccgtttcgaaaacttccgaagatacaatccacacacatctggaagacttagaatcagtgtccgcaagtaccactgttagtcccctgatcatgcctgataacaacggaagttctatggatgactgggaagagcggcagaccagcgggagaatcacagaggagttcttgggcaaatacttaagcaccacaccattcccttctcagcatcgaaccgaaatcgaattgtttccctacagcggtgacaaaatactggtggagggaatctccacggtaatctacccatctcttcagacggaaatgacccatcggcgggagaggaccgagacactgatccccgaaatgcgaacggacacgtataccgacgaaatccaggaagaaataaccaaatcgccgttcatggggaaaaccgaagaggaggtgttttcagggatgaagctgagcacatctttgagcgaacccatacacgtgaccgaatcgagtgtggaaatgacaaaaagcttcgattttcctacattgataaccaagctttcagccgaacccactgaggtgcgtgacatggaggaagatttcaccgccacacctggaacaaccaagtacgatgagaacatcaccaccgttctactggcccacggcacgttatcagtagaagccgctaccgtgagcaaatggtcttgggacgaagacaatacaacaagcaagcctctcgagtccaccgagccttctgcatcttctaagctgcctcccgctctcctgacgacagtgggaatgaacgggaaagataaagacatccccagctttactgaggatggtgcagatgaatttacattgattcctgactctacccagaagcagctggaggaggtgaccgatgaggatatagccgcccacggtaaattcaccatcagatttcagcctaccacctcaacaggaatcgcggagaaatctacactgcgggattcaactactgaggagaaggtgccaccaatcacaagtaccgaaggccaagtgtatgcaacaatggagggaagcgcccttggagaggtggaagacgtcgacctgtcaaaacccgtgtctactgttccacagtttgcccatacgtctgaagttgagggtctagccttcgtatcttattccagtacacaggaaccaacaacttatgtggacagtagtcacacaatcccactgtctgtgattcctaagacggactggggcgtcctggtccctagtgttccgagcgaggacgaggttttgggcgagccctcacaggacattctggtcatcgatcagactcgtcttgaagcaaccattagccctgaaaccatgcggaccacaaagattaccgaggggacaactcaggaggaattcccttggaaagaacaaaccgccgaaaagcctgtgccagccctatcctccacagcttggactccgaaggaggccgtcacgccactggatgaacaggagggcgacggctccgcctataccgtgagtgaggacgaactgctgaccggcagtgaacgggttcctgtgctggaaaccactcctgttggaaagattgatcactccgtgtcctatccccctggcgctgtcacagagcataaggtgaaaactgatgaggtcgtcactctaacgccccgaatcgggcctaaggtgagtctcagtccaggtcccgagcaaaagtatgagacagaggggtcctcaactaccggcttcacatcttccctctcaccattctccactcacattacccagctaatggaggaaactacaactgagaagacaagcctggaggacatcgatctgggtagcggcctctttgagaaaccgaaagccacagagctgatcgaattttcaactataaaggtgaccgttccgagcgacataacaaccgcgttcagctctgtggaccgtcttcacaccacgtccgctttcaagcccagctccgcaattaccaagaaacctcccctgatagatcgcgaacctggcgaagaaactacatctgacatggttattattggcgagtccaccagccacgtaccaccaactactctggaagacatcgtggctaaagagaccgagaccgatatcgaccgggaatatttcactacctcctcaccacccgcgactcaaccaacacggccccccactgtggaggacaaggaagccttcggtcctcaggccttatctactccccaacccccagcttccacaaaattccatccagacatcaacgtctatataattgaagtccgggagaacaagactggtcccgaccggtgtaagatgaatccatgcttgaatgggggaacttgttaccctaccgaaaccagctatgtatgtacttgcgtgcctgggtattctggcgatcagtgcgaactagacttcgatgagtgtcatagtaacccgtgccgcaacggagcaacatgcgtagatggatttaacacgtttagatgcctgtgcttgcctagttatgtcggggccctgtgtgagcaagatacagagacctgtgattacggctggcataaattccagggccagtgttacaagtactttgcccacagacgtacgtgggatgcggctgagcgggaatgccggttgcagggagcacatttgacgtccatcctgagccacgaggaacagatgtttgttaaccgcgttggacacgactatcagtggattggcttgaacgacaagatgtttgaacatgattttaggtggactgacgggagtactcttcagtatgaaaattggcgccctaatcagcctgactcttttttttcagccggggaagattgtgttgtcatcatctggcatgagaacggccagtggaacgacgttccctgcaattatcaccttacatacacctgtaaaaaaggaactgtggcttgcggacagcctccggtggtcgagaacgccaaaactttcggcaagatgaaaccaaggtacgaaatcaactcactcataaggtaccactgcaaggatgggttcatacagcgacatctgcctacaatacgatgcctgggcaatggcaggtgggctatccccaaaatcacttgtatgaatcccagtgcatatcagcggacttacagcatgaagtactttaagaatagcagcagtgccaaagataattcgatcaatacctctaaacatgaccaccgctggtctcggagatggcaggagtcaagaagatag

SEQ ID NO: 26923 - DNA, 7230 bp, Artificial Sequence
  Description of Artificial Sequence: Synthetic coding sequence
atgttcatcaacatcaagagcatcctgtggatgtgcagcaccctgatcgtgacccacgcactacataaggttaaggtgggaaagtcacccccggtgaggggttctctgagcggcaaggtaagcctgccctgtcacttcagcacgatgccaactctgccgcctagctataatacctctgaattcctgagaatcaagtggtccaaaatcgaggttgacaagaacggaaaagatttgaaggaaacaaccgtgctcgtggctcagaacggcaacattaaaatcgggcaggattacaagggacgggtgagcgtgccaacgcacccagaggccgtcggggatgcgtccctgactgttgtgaagctgctggcctcagacgctgggctgtatcgatgcgacgtgatgtacgggattgaagacacccaggacactgtctctctgactgtagacggagttgtgtttcactatcgggctgcaacttccaggtacacgctcaacttcgaggctgcccaaaaagcttgtctggatgtaggggcagtgatcgcaaccccggagcagctgtttgccgcctatgaggacggcttcgagcagtgcgatgccggctggctggccgatcaaaccgttcgatatcccatccgtgcccctcgcgtggggtgctacggcgataaaatggggaaggctggagtgcgtacttacgggtttaggtcacctcaggagacgtacgacgtttattgttacgtagaccacctggatggtgacgtgtttcaccttaccgtgccatccaaattcaccttcgaggaggccgcaaaagaatgtgagaaccaggatgcacgcttggctactgtcggcgaactgcaagccgcctggcgcaatggctttgaccagtgcgactatggttggctgtccgacgcttccgtcaggcaccctgtcactgtagcccgcgcacagtgcggcggcggtctgctcggggtgcgaacactttaccggtttgagaatcaaacaggttttccacctcccgactctcggtttgacgcctattgtttcaagcgtagaatgagcgatctgtccgtgatcggccacccaatcgattctgaatctaaagaggacgaaccgtgttcagaggaaactgaccctgtccatgatctcatggctgagatcctgccggaatttcctgacattattgagatcgatctgtatcacagtgaagagaacgaggaagaggaagaggaatgcgccaacgccacagacgtgaccacaaccccctccgtccagtatatcaacggcaaacacctggtgactaccgtgcctaaagacccggaagctgctgaggctcgcagaggtcagtttgaatccgtggctccctctcagaatttcagcgacagcagcgagagcgacacgcatcccttcgtgattgcgaagacagagctgtctactgcagtgcagcctaatgaatcaaccgaaacaaccgaaagcctcgaggtgacttggaagcccgaaacttatcctgaaacaagcgagcattttagcggcggtgaaccagacgtttttcccaccgtcccctttcatgaggaatttgagtcagggactgcaaagaaaggcgccgagagcgtgaccgagcgcgacactgaggtgggccaccaggctcatgagcacacagaaccggtgagcttgttcccggaggaaagctcaggggaaattgcaatcgaccaagagtcccaaaagattgcgtttgctcgcgctaccgaagttacctttggcgaggaggtggagaagagcacatccgtgacatacacgcccacgatcgtcccttcttcggcctcggcttacgtgagtgaggaggaagctgtgactctgatcgggaatccctggcctgacgatttgctgagtaccaaggagtcttgggttgaagctactcctcgacaggtagtggagctaagcggctcatctagtataccaattactgaaggatccggcgaggctgaggaggatgaagacactatgttcacaatggtgaccgatctgtctcagaggaacactacagatacattgattacactggacacatctaggattatcaccgaatcatttttcgaagtgcccgctaccaccatttacccagtcagtgagcagccctccgctaaggttgtcccaacaaaatttgtgagcgagaccgatacaagcgaatggattagtagcaccacggtggaagaaaagaaaaggaaggaagaagagggcactactggtacagccagtaccttcgaggtctattcgagcacccagaggagtgatcaattaatcctacccttcgagcttgaatccccgaatgtggctacttcaagcgacagcggcacccggaagagctttatgtcacttaccacccccactcagagtgaacgggaaatgaccgattctactcctgtcttcactgagacaaacacactggagaaccttggcgcccagaccacagagcattcctctatccatcagcctggcgtgcaagagggccttacaacgctgcccaggagtccggcgtcagtctttatggagcagggttcaggagaggccgccgcggaccccgaaaccacgacagtttcatcctttagtctcaatgtagagtatgccattcaggcagaaaaggaggtggctggaactctatccccacacgtcgagacaacattctcaacagagcccacagggctggttttatctaccgtgatggatagggtggtcgccgagaacattacccagacatcaagagaaatcgtgattagcgaaaggctaggcgaacccaattacggcgctgagatccgcggattctcaactgggttccccttggaggaagacttcagcggcgattttcgcgagtattcaactgtgtctcaccccattgccaaggaggaaactgttatgatggaggggtcgggcgacgccgcttttcgagacacacagaccagtccctccacagtgcctacaagcgtccacataagccacataagtgattcagaggggccaagctccaccatggtctccacgtccgcttttccctgggaggaatttactagttccgcagaaggaagcggggaacagttggtgaccgtgtctagctccgtggtaccggtgttaccatctgccgtccagaaattcagcggaacagcttcgagcataatagacgaaggcctcggtgaggtcgggactgtgaacgaaatagatcgaagatctacgattctcccaaccgcggaggtggaaggaaccaaggctcctgtcgagaaggaggaggtgaaggtttccggaactgtttctacaaactttcctcagactatcgagcctgcaaagctatggagccggcaggaagtaaacccagtgcgccaggagatcgaaagcgaaacaactagtgaagaacaaattcaggaggaaaagtctttcgaatcccctcagaatagccccgccacagaacagacaattttcgattctcagacattcactgaaaccgaactcaagaccacggattattccgtcttgactaccaaaaagacctatagtgacgacaaggagatgaaggaagaggatacatcactggtaaacatgagcacgcccgacccggatgccaacggcctcgagagctataccactctcccagaagcgactgagaagtctcactttttcttggccacggccctggttacagagtcaattcccgcggagcatgtcgtaacagattccccaattaaaaaggaagagtccacaaagcacttccccaagggtatgagaccaactatccaggagtctgacactgagctattgtttagcggactcgggtcaggcgaggaggttctgcccacactgcctaccgaatctgtaaactttacggaggtcgaacagattaacaacacactgtatccgcacaccagccaagtagaatctacttcgtcagacaaaattgaggactttaacaggatggaaaatgtggcaaaggaggtcggcccccttgttagccagaccgatatcttcgagggctccggaagcgtgactagtacaactctgattgaaatactgtcggatacaggcgccgaaggccctacagtcgctcctcttcctttctcaacagacataggacaccctcaaaatcaaaccgtgcgctgggccgaggagattcaaacatcccggcctcagactatcaccgagcaggattccaacaaaaatagctcaacggctgagatcaatgagaccaccacctcctccaccgattttctggcccgggcttatggcttcgagatggccaaggagtttgtaaccagcgccccaaaaccaagtgatttatactacgagccaagtggtgagggatctggagaggtggacatcgtagactcttttcatacctccgccacaacccaggctacaaggcaggaaagttctaccacattcgtaagcgatgggtccctggaaaagcatccggaagtgcccagcgcaaaagcagtcacagcagacggcttccctacagtgtccgtgatgcttccactgcacagcgaacagaacaagagcagcccagatcccacctccacactgtccaatacagtgagttatgaacgatccacggatgggtcattccaggatcgctttagggagtttgaggactccaccttaaaaccaaacaggaagaagcccactgagaacataattattgacttggataaggaagacaaagatttaatcctaactatcaccgaatctactatcctggagattctccctgagctgacatccgataaaaacactatcatcgatattgaccacacaaagcctgtctacgaagatattcttggcatgcagactgacattgacaccgaggtgccctccgaaccgcacgactccaatgacgagtcaaacgacgattctacgcaggttcaggaaatttatgaggctgcagtgaacctatctctgaccgaggagacttttgagggatcggccgatgtgcttgccagttatacccaagccactcacgatgagagcatgacctatgaagatcgttcccagctggatcacatgggattccatttcaccactgggatcccagctccgtctacggagactgagctagatgttctcctgcccactgctacatctctgcccattcccagaaaatctgctacggtgatcccagaaatcgaagggataaaagccgaagccaaggccctggatgatatgtttgaatcgtcaacattgtctgacggacaggcgatagcggatcagtcagaaatcatccccaccctgggccaattcgagcgcacccaggaagagtacgaagacaagaagcacgcggggccttcatttcagccagagttcagtagcggagcggaagaggcactagtcgaccacacgccttatctaagtattgcaaccacacatctgatggatcaaagcgtcaccgaggtccctgacgtcatggagggttctaaccccccgtattacacagacactactctggcagtgtccaccttcgccaaacttagtagtcagacaccaagtagtcctttgacaatctattcagggtcagaagctagtggtcatacagagatcccccaaccatcagctctgcctgggatcgacgtcgggagcagtgtaatgtccccccaagacagtttcaaagagattcacgtcaacattgaggccacctttaaaccatcttccgaggagtacctccatatcacagagcctccctcactctcacctgacaccaagttggaaccaagtgaagacgacggaaaaccagagctgctggaggagatggaagcctcgcccaccgagcttatcgcggtggagggcaccgagattctacaggatttccaaaacaagacggatgggcaagtgtcaggggaggcgatcaagatgttcccaactataaagacaccagaagctgggacggtcatcacgaccgcggatgaaatcgagctggagggggccacacagtggccccacagcacctccgccagtgctacttacggggtggaagccggcgtggttccctggcttagcccccaaacttccgagaggcccaccctgagctccagccctgagattaacccagagacccaagcagcactgatacggggacaggactcgaccatagctgcttccgagcagcaggtcgccgctaggatactcgatagcaatgatcaggcaactgtgaaccccgtggagtttaacaccgaagttgctactcctccattcagtttgttggagacatccaacgagactgatttccttattggaatcaatgaggaaagcgtggagggcactgccatttacctgccaggccccgacagatgtaaaatgaatccttgcctgaatggaggaacctgctatcctactgaaacatcctacgtgtgcacttgtgtccccggctacagtggtgaccagtgcgaactcgactttgacgagtgccacagtaacccctgtaggaatggagcaacatgcgtcgacggctttaacaccttcagatgtttatgtctgcccagttacgtgggtgcactgtgtgaacaagacacggagacttgtgattacggatggcataaattccagggtcagtgctataagtactttgcccaccggcggacctgggatgccgccgagcgcgaatgccgcctccagggagctcatttgacaagtatcctgagccacgaagaacagatgttcgtgaacagggtaggccacgactaccagtggatcgggctcaacgacaagatgtttgaacatgatttcaggtggactgatggctctacattgcagtatgaaaattggcgccccaaccagccggatagttttttctctgcaggtgaggactgtgtggtcatcatctggcacgagaatggtcagtggaatgacgtgccttgcaactaccatttgacctacacctgcaaaaaagggacagtcgcctgcggtcaacccccagtggtcgagaatgcaaaaacatttggaaagatgaagcctcgatacgaaatcaactccctgattcgttaccactgcaaagacggctttatccagcgtcaccttccgacaattcgttgcctgggcaacgggaggtgggctatcccaaagatcacttgtatgaacccatctgcgtaccaacgaacatactctatgaaatactttaaaaattccagcagcgctaaggataatagcatcaacacgagcaagcacgaccaccgctggtcgcgaagatggcaagagagcaggcgttag

SEQ ID NO: 26924 - DNA, 4785 bp, Artificial Sequence
  Description of Artificial Sequence: Synthetic coding sequence
atgcccaccctgccccccagctacaacaccagcgagttcctgcggattaagtggtctaaaatcgaggtagataagaatggaaaagatctcaaggagaccaccgtcctggttgcccagaacgggaacataaagatcggacaagattataagggcagggtatctgtacccacgcatcccgaagcagtaggtgatgcctctctgaccgtagtcaaactgctggcatccgatgcaggcctgtatcgctgcgatgtgatgtatggcatagaagatacacaagataccgttagcctgacagttgatggcgtcgtcttccattatagagcggccacatcacggtatactttgaactttgaggctgcacagaaagcctgtctggacgtgggggccgtgattgccactcccgaacagctgtttgccgcgtacgaagatggctttgagcagtgtgatgcgggttggctagcagatcaaaccgtgagatacccaatacgtgccccaagagtgggatgctacggagataaaatgggtaaagccggtgtgcggacatacggatttcgatccccacaggagacctacgacgtgtactgctatgtggaccatctggacggagacgtcttccacttaactgtcccctcaaaatttacctttgaggaagctgcaaaagagtgtgaaaatcaggatgcccggcttgccacagttggagaattacaggctgcctggcgaaatggatttgaccagtgcgactacggttggctgagcgacgcatctgtgcgtcaccctgtcacagtggcccgggcccagtgtgggggtggccttctcggcgtgcgcacactgtatagattcgagaaccagaccggtttccctcctcccgacagccggtttgacgcttattgttttaagcctaaggaggcaaccaccatagacttgtccattctagcagaaactgccagtcccagcctctccaaggagccacaaatggtgtctgatcgcaccactcctatcattccactcgtggatgaattaccagtgatcccaaccgagttccctccggtgggcaacattgtgagctttgagcagaaagctaccgtccaaccgcaggcgattaccgactcgttggcaacaaagctccctaccccaactggcagcactaaaaagccttgggacatggatgactacagcccctccgcatcgggccccttggggaagttggatatctctgaaattaaggaggaggtcctccagagtacaacaggcgtgtctcactatgctactgactcatgggatggagtggtcgaagataagcagacgcaagagagcgtcactcagattgaacaaatcgaggtcgggccgctggttacctcaatggaaattctgaagcacattccgtcaaaagaattccccgtcacggaaacccccctcgtaaccgcacgaatgatcttggaatctaaaaccgagaaaaagatggtgtctactgtgagcgagctggtcaccactggccattacggctttactctcggggaagaggatgatgaagaccgaacgctgactgttggttccgatgaatccaccctcatcttcgaccagatccccgaagtcattactgtgtcgaaaacctccgaggacaccattcatactcacctggaggacctggaatccgtgtctgcaagcaccacagttagccctctcattatgcctgacaacaacgggtcttccatggacgattgggaggagcgacagacatctggacgcatcaccgaggagtttctgggaaagtacttatcgacgacaccgtttccctcccagcaccgaacagagatcgagttgttcccctacagcggggacaagatattggttgagggaatttcaaccgtgatatatccttcactgcagacagaaatgacacatagacgggagcggactgagacattgataccagaaatgcgaacagatacttacaccgacgaaattcaggaggaaattaccaaatcaccttttatggggaagactgaagaggaagttttttcaggcatgaaactctcgaccagcttgtcagaacctattcacgtaaccgagagttccgttgagatgacaaaatccttcgattttccaaccctgattactaagctgtcagcagaacccaccgaggtgagagatatggaggaagacttcactgctactccagggaccaccaagtatgacgagaacatcaccacagtgctgctggctcacgggaccctatctgttgaagccgcaacagtgagtaagtggtcgtgggatgaagacaacacaacaagtaaacccctggaatcaactgagccctcagcgagtagtaaactgccccccgccctcctgaccactgtgggtatgaacggcaaagataaagatatcccatccttcaccgaagatggtgctgatgagttcactctcattcccgattctacacaaaaacaacttgaagaggtaactgacgaagacattgccgcacatggaaagttcacgatcaggtttcagccgacgacatccacgggcatcgcagagaaatccactctgcgggatagtactaccgaagaaaaagttccgcctataacatccacagagggccaggtatacgcgactatggagggcagcgctcttggagaggttgaagacgttgacctttctaagcctgtctccacagttccccagttcgcccacacctctgaagtcgagggcttggcatttgtctcctattcaagcactcaggaaccaaccacatatgtcgactctagtcataccatcccactttccgtcattcctaaaacagattggggagtgctggtgccctctgtgccatctgaggatgaagtcttgggtgagcccagccaggatatcctggtgattgaccagacccgcttggaggccactatcagccccgagacaatgcgcactaccaaaatcaccgagggtaccacacaggaggaattcccttggaaggaacaaacggccgagaagccagttcccgctctatcatctacagcctggaccccgaaggaagcagtgactccactggacgagcaagagggagacggctccgcctacactgtgagcgaagacgagcttctgactgggagcgaaagggtccccgtcctagagaccacccccgttggtaagatcgaccatagcgtcagttacccaccaggggcagtgactgagcacaaagttaaaaccgatgaggtcgtcaccctcacgcccagaatcggaccaaaagtaagtctgagtccggggcccgaacagaaatatgaaacagagggcagcagcacaactgggtttaccagctcgctgtctccattttctacgcacattactcagctgatggaagaaaccaccacagaaaagacaagcttagaggacatcgatcttggttctggcttgtttgagaagccgaaggccaccgagctcatagaattttccacaatcaaggtaaccgtgccttccgacataactaccgccttttcctcggttgatagactccacacaacaagtgcgttcaaacctagctccgccattaccaagaaacccccactgattgaccgcgagccaggtgaggagactactagtgacatggtcattatcggcgaaagcacaagccatgtgccgccgacaacactcgaagatatagttgccaaagagaccgagacagacattgaccgggagtatttcaccacctccagtccccccgccacccagcccactaggccacctacagtggaggacaaagaggcatttgggccccaggccctctcaaccccacagccccccgcgtctacaaagttccatccggacattaacgtctatatcattgaggtaagggagaataagaccggcccagaccggtgcaaaatgaatccctgcctaaacggagggacttgttatccaaccgaaacttcatacgtgtgtacctgtgtgcctggctactcaggtgaccagtgcgagttagacttcgatgagtgtcatagtaacccatgtcgaaacggcgcaacatgtgtcgatggcttcaacacgtttcggtgtctatgcctgccaagttacgtgggagccctttgtgaacaagacacagaaacctgcgactacgggtggcataagtttcaggggcagtgttataagtactttgctcatagacgcacttgggatgcagccgagcgagagtgccgattacagggcgcacacctgacctccatcctgtcacatgaagagcagatgttcgtaaaccgggtcggacacgactaccagtggataggactgaatgataagatgtttgagcacgacttccgttggaccgatgggagcaccctgcagtacgaaaactggcggccaaaccagcctgactctttttttagcgccggtgaggactgtgtggttataatttggcacgaaaatgggcagtggaatgatgtgccatgtaactaccacctgacctatacttgtaaaaaggggaccgtggcatgtggccagcctccagtcgtcgaaaacgccaagacattcggtaaaatgaaaccccggtacgaaattaacagcctgatcaggtaccattgtaaagacggcttcatacaacgtcacctgcccaccatcagatgcctgggcaacggccgctgggctatccctaaaattacctgcatgaatccaagtgcatatcagaggacttattccatgaaatattttaaaaacagtagttctgcaaaagacaatagtattaatacaagcaaacatgatcaccgctggagccggcggtggcaagaaagtcgaagatag

SEQ ID NO: 26925 - DNA, 1968 bp, Artificial Sequence
  Description of Artificial Sequence: Synthetic coding sequence
atgttcatcaacatcaagagcatcctgtggatgtgcagcaccctgatcgtcacccatgcactgcacaaagttaaagtggggaagtctccgcctgtgcgggggtcgttaagcggcaaggtcagcctgccgtgtcatttctccacgatgcctactctccctccttcttataatacatcggaattcttgcggattaagtggtcgaagatcgaggtagacaagaacggaaaggatctgaaggagaccaccgtgttggtagcgcagaatgggaacattaagatcgggcaggattataaggggagagtctccgtcccgacgcatcctgaagctgttggcgatgcgtctttaaccgtggtgaagctcctcgctagtgatgctggtttgtaccggtgcgacgtcatgtacggcatcgaggacacccaggataccgtgagtctgacggtcgacggcgtggtcttccattatcgagcagctactagtcgttataccctcaatttcgaggcggcacagaaagcctgtctcgacgttggagcagttattgcaacgccagagcaattgttcgccgcctacgaagatggtttcgaacaatgtgatgcggggtggctagctgatcaaactgtacgttatcctatcagggcgccccgcgtcggatgctatggggataaaatgggaaaggccggagtgaggacatatgggttcagatcccctcaggagacctacgacgtgtattgttacgtcgatcacctagatggggacgtgttccatttgaccgttccatctaaatttacctttgaagaagctgccaaggaatgcgaaaatcaagacgccagacttgccacagtgggagagctccaggcagcttggcggaatggctttgatcaatgcgattacggctggcttagcgacgcctcagtacgccatcctgtcaccgtagcacgagcacaatgtggcgggggattgttgggcgtgagaactctctatcggttcgagaaccaaaccggattccccccccctgacagccggtttgatgcttattgcttcaaacggcctgataggtgtaaaatgaatccttgtttgaatggaggaacttgctaccccacagagaccagctacgtgtgtacgtgcgtcccaggttactctggcgaccaatgtgaactggacttcgacgagtgccactcgaacccatgccggaacggcgccacttgtgtagacggcttcaacacgtttaggtgtttatgcctaccctcctacgtcggagcactttgcgagcaagacaccgagacctgcgactatggatggcacaagtttcaaggccagtgctacaaatattttgctcatcgcaggacgtgggatgcggctgagcgggagtgccgtctacagggagcacatctgactagcatcctgagtcacgaagagcagatgtttgtgaatcgagtgggccatgattatcagtggattggtctaaacgataaaatgtttgaacacgattttaggtggacagatgggagcaccctccagtatgagaactggcgtccaaaccagcctgactcctttttttcagcaggcgaggactgtgtcgttatcatttggcacgagaacgggcaatggaacgatgttccctgcaactatcacctgacatacacctgcaagaaggggactgtcgcttgcggtcagcctcctgtcgtagagaacgccaagacttttggaaagatgaagccacgatacgaaatcaactcgctgataagataccactgcaaagacgggttcattcaacggcatttgccaaccattaggtgtctcggcaatggacgctgggccattcctaagatcacttgtatgaacccatcagcctaccagagaacttatagtatgaaatattttaagaattcctcatcagccaaagataatagcatcaacacctcgaagcatgaccatcggtggtcccggcggtggcaagagagccgaaggtag

SEQ ID NO: 26926 - DNA, 1440 bp, Artificial Sequence
  Description of Artificial Sequence: Synthetic coding sequence
atggccagcaccatcaaggaggccctgagcgtggtgagcgaggaccagtccctgtttgagtgtgcatatggaaccccacacctcgccaaaaccgagatgacagctagttcaagcagcgactatggacagacaagcaaaatgtccccacgtgtgccacagcaagactggctgagccaacctccggcaagagtgactatcaagatggagtgcaaccctagccaagtaaacggcagcagaaatagccctgatgagtgctctgtggcgaaaggcggcaaaatggtcgggagcccggacacagtggggatgaattacggcagctacatggaagagaaacacatgcctcctcccaatatgacaacgaatgagaggcgtgtcattgtacctgctgacccaacactgtggagcacagaccatgtcaggcagtggctcgagtgggcagtaaaagagtatggactgcctgatgtgaatattcttctctttcagaacatcgatgggaaggaactttgtaagatgacgaaggacgatttccagcggctcaccccatcttacaatgccgatatcttgttatcccatctgcattatcttcgtgagacacccctgccccacctcacctccgatgatgtggataaagcgttgcagaattcgccacgcctgatgcacgcccggaatactggaggtgcagcctttatcttcccgaacacatccgtgtatccggaagcaacgcagcggataaccacaaggcccgacctaccatatgagccaccacgaagaagcgcctggaccgggcatgggcatccaacccctcagagcaaagccgcgcaaccgagtccctccacggtaccaaagaccgaggaccaaaggccccagttggatccctatcagattctgggtccaacatcttctagactggccaatccggggagcgggcagatccagctttggcagtttctgttggaattattgagtgattcatcaaatagtagttgcattacttgggaaggcacgaacggagagtttaaaatgacagacccggacgaagtggctcgtcgctggggtgagagaaagtctaagcccaatatgaattacgataagcttagtcgggccctgagatactactacgacaagaatatcatgaccaaggtgcacggaaaaaggtacgcctacaagtttgactttcacgggatcgcccaggccctgcagcctcatcccccggaaagctccctatacaaataccctagcgacctcccctacatgggcagctaccacgctcatccccaaaaaatgaactttgtggcaccccatccaccagccctgcccgttacatcttcatcctttttcgcagcgcctaacccgtactggaacagcccaactggcgggatctatccaaatacccgcctgccaactagccacatgccatcccacctcggcacctattattag

SEQ ID NO: 26927 - DNA, 1092 bp, Artificial Sequence
  Description of Artificial Sequence: Synthetic coding sequence
atggtgggcagccccgacaccgtgggcatgaactacggcagctacatggaagagaaacacatgccgccaccaaacatgactacaaatgagcggcgcgtcatcgtacctgccgatcccacgctctggagtaccgatcacgtgcgacaatggctggagtgggctgtgaaagagtatggattacccgacgtaaatattctgctgtttcagaacatcgatggtaaggagctgtgcaaaatgactaaggacgacttccagaggctgacgccaagttacaacgcggacattctcctttcacacctccactacctgcgggaaacacccttgccccacctcacttccgacgacgtggataaagcgctacagaatagtccaaggctgatgcacgctagaaatacggacttgccatacgaaccgccaaggcgttcggcatggacaggtcacgggcatcccactccacaatctaaagctgcccagccatccccatctaccgttcccaaaacggaggaccagcgaccccagcttgatccataccagatcctcgggccaactagttctcgtctcgccaatcccggttccgggcagatccagctctggcagttcctgctcgagctgctatcggattcttccaacagctcttgcattacctgggagggaacaaatggcgaattcaagatgactgatcccgacgaggttgcacgcagatggggcgagagaaaatccaagccaaacatgaattatgacaaattgagcagggccctaagatactactacgacaagaatataatgactaaggtgcatggaaagcggtacgcttacaagtttgatttccatggcatcgctcaagcccttcaaccccatcctcccgagtcctccctctacaagtatccaagcgatctgccgtacatggggtcttaccacgcccatcctcagaaaatgaattttgtggccccacatcctccagccctcccggtgacgtcctcgagtttctttgccgcaccgaatccatactggaacagtcctacaggagggatctatccgaatacaagactgcctacgagccatatgccctctcatctgggcacatactactag

SEQ ID NO: 26928 - DNA, 1389 bp, Artificial Sequence
  Description of Artificial Sequence: Synthetic coding sequence
atgatccagaccgtgcccgaccccgccgcccacatcaaggaggccctcagtgtagtgtccgaggatcagagcttgttcgagtgcgcatacggtacgcctcacctggctaaaaccgagatgacagcgtccagcagcagcgactatggccaaacatctaagatgtccccgcgcgtcccccagcaggattggttatcacagccacccgctcgagtgacaatcaaaatggagtgtaatccgagccaggtgaatggctccagaaactcccccgacgagtgttccgtggccaagggcgggaagatggttggttctccagataccgtgggtatgaattacggctcctacatggaagagaagcatatgccaccccccaacatgactaccaacgagaggcgggtcatcgtacccgcagacccaacactttggtcaacggaccacgtacggcagtggctggaatgggcagtaaaagagtatgggttgcccgatgtcaatatcttgcttttccaaaatattgatggtaaagagctgtgtaagatgaccaaagacgactttcagaggttaaccccttcttataacgctgacatcctgttatcacacctgcactatctccgggagacgccccttccacacctgacatcagacgatgtggacaaagcacttcagaactcgccacgactcatgcacgcccgaaacactgatctcccgtacgaacctccacgtaggagcgcctggaccggacatggccacccaactccgcagtcgaaagcagctcagccctctccaagtactgtacccaagactgaggatcaacggccgcagcttgacccatatcaaatccttggacccacaagctcacggctggcaaaccctgggagcggtcaaatacagctgtggcaattcttgctagagttgttaagcgatagctctaactcgtcctgtatcacatgggaaggaaccaatggtgagttcaagatgacagacccggacgaagtcgctcgccgctggggcgaaaggaagtctaaaccaaacatgaactacgacaagttaagtcgcgctctgcggtattattacgataagaacatcatgactaaagtgcacggaaagcggtatgcctacaaatttgatttccacggcattgcccaggccttgcagccgcatcctccagaatcctcactttacaaatatccatccgacctcccctatatggggagctatcacgctcacccccagaagatgaatttcgtagccccacacccacctgcactgcctgtcacttccagttctttctttgccgctcccaatccttattggaacagcccaaccggcgggatctaccccaacaccaggttgccaacatcccatatgccctcccatcttggcacttattactag

SEQ ID NO: 26929 - DNA, 1461 bp, Artificial Sequence
  Description of Artificial Sequence: Synthetic coding sequence
atgatccagaccgtgcccgaccccgccgcccacatcaaggaggccctgtctgtggtatccgaggatcagagtctctttgagtgcgcctatggaacaccgcacctcgctaaaacagaaatgacggcttcctccagttcagattatggccagaccagcaagatgagccccagggtgccgcagcaggactggctttcccaaccaccagcaagggtcactattaaaatggaatgcaacccatcacaggtgaatggcagtcgtaatagcccagacgagtgtagtgtggcgaaaggagggaagatggtgggctcccctgatacagtggggatgaattatggatcatacatggaagaaaagcatatgcctcccccgaatatgacaacaaatgaacgccgggttatcgtgcccgctgacccgactttgtggtccaccgatcacgtacggcagtggctggaatgggcagtcaaggagtacggactgcccgacgtcaacatcttgctgtttcagaacattgacgggaaagagctgtgtaagatgactaaggatgacttccagcgcttgacccctagctacaatgctgacatcctgttatcacacctgcactacctgcgggaaaccccactgccacatctcacaagtgacgatgtggataaagcgctacagaactcgccgcggctcatgcacgcccgcaatacagggggggccgctttcatctttcctaatacatccgtttatccggaagcgactcagcgcattactactaggcccgaccttccttatgagcctccccggcgcagcgcatggacagggcacggacatccaacgccccagtccaaggccgcccaaccatctcccagcaccgtgcccaagactgaagaccaaagacctcaactggatccgtatcagattttgggcccaacgtcaagccgccttgcaaaccctgggtctgggcaaatccagttatggcaattccttctggaactcttaagtgacagcagtaatagctcctgtattacttgggaagggaccaacggagagttcaagatgactgacccagacgaggttgctagaagatggggcgagagaaagtccaaacccaatatgaattatgacaagctctcccgcgctctgcggtattattatgacaagaatatcatgaccaaagtacatggcaagcgatatgcttataagttcgatttccacggcatcgctcaggcactacagccacatccgcccgagagtagcctgtacaaataccccagtgacttaccgtacatggggagctatcatgctcatccccagaaaatgaatttcgtggctccgcatcccccggccctccctgtcacatcatcatccttctttgctgcccccaatccatattggaattccccaaccggaggaatctaccctaacaccagactccccactagtcatatgcccagccatctgggcacttactattag

SEQ ID NO: 26930 - DNA, 1461 bp, Artificial Sequence
  Description of Artificial Sequence: Synthetic coding sequence
atgatccagaccgtgcccgaccccgccgcccacatcaaggaggccctgagcgtggtgagcgaagaccagagtctattcgaatgcgcctacgggacaccacaccttgctaaaactgagatgaccgcttcatctagttccgattacggccagacctctaagatgagtccccgcgtccctcagcaggactggctgtcccaaccccctgctagggttaccatcaagatggaatgcaacccatcccaagtgaacgggagcaggaattcccccgacgaatgtagcgttgccaaaggggggaagatggtaggatccccggatacagtgggaatgaattacggaagctatatggaggagaagcacatgcctcctccaaacatgacgacaaatgaacggcgcgtcatcgtacctgcagaccctacgctgtggtcaacagatcatgtgcgacagtggctggaatgggctgttaaggagtatggcctgcccgacgtcaatattctgctcttccagaacatagatggtaaagagctgtgcaagatgaccaaggatgattttcaacgactcactccatcttataacgcggatatcctgttgtctcatctacactacttgagagaaacgcctcttcctcatctaactagcgacgacgttgacaaagcactgcagaattccccccggctgatgcacgcccgaaatactggcggggccgccttcattttccccaataccagtgtttacccagaggcaacgcagcggatcaccacaagacccgatttaccctatgagcctccaaggaggtccgcctggactggtcacgggcacccaaccccacagtcaaaggctgcccaaccaagtccctccaccgtaccaaagaccgaagaccaaagaccacaactcgatccatatcagatactcggtccaacctcatcccgccttgccaatccaggctccggacagatacagctctggcaatttctcctggaactcttatcagactcttccaactcaagctgtattacttgggagggaaccaacggagagtttaaaatgacagatccagacgaagtggccaggcgatggggcgagagaaagtcgaagccgaacatgaattatgacaagttgagcagggctttgcgatactactacgataagaacatcatgaccaaagtccacggcaaaagatatgcttacaagttcgactttcacggtatcgctcaggccctgcagccccaccctcctgagtccagtctatataaatatccatctgatctgccgtacatgggcagttatcatgctcacccacaaaagatgaacttcgttgctccccatccaccggccctacccgtcacatcatcaagcttttttgctgctcctaatccctactggaattcccccaccgggggcatatacccgaacacccgtctgcctaccagccacatgccaagccacctaggcacatattattag

SEQ ID NO: 26931 - DNA, 516 bp, Artificial Sequence
  Description of Artificial Sequence: Synthetic coding sequence
atggccagcaccatcaaggaggccctgagcgtggtgagcgaggaccaatctctgttcgaatgcgcctacggaacccctcatctggctaaaacggagatgactgcgtcttcatcctcggactacggacaaacatcaaaaatgagccctcgagtccctcagcaggactggctttcccagccaccagccagagttacaatcaagatggagtgcaacccctcccaagtaaacggctcccgcaactcaccagatgaatgtagcgtagccaagggcggtaagatggtgggctccccagacaccgtgggcatgaactatggttcctatatggaagaaaagcatatgcctcctcccaatatgactactaatgagcggcgagtcatcgtgcccgccgatctcccatatgaacctccccgtaggtccgcatggactggtcacggccaccccaccccccaatctaagggcactgtgctggcaccgatgaccctctcttttatgtcccaagctgtagacgactgctag

SEQ ID NO: 26932 - DNA, 1389 bp, Artificial Sequence
  Description of Artificial Sequence: Synthetic coding sequence
atgatccagaccgtgcccgaccccgccgcccacatcaaggaggccttgagtgtggtgtcggaagatcagtccctgtttgagtgcgcctacggcaccccacacctggctaagacggaaatgaccgcctctagttcgagcgactatgggcagactagtaagatgtcaccaagagtgccacaacaggattggctgtctcagccgcccgctcgcgtcacaatcaagatggagtgtaacccctctcaagtcaatggctctcggaactcaccagacgagtgcagcgttgctaagggagggaagatggtggggtcccccgacactgtgggtatgaattacgggtcctatatggaagaaaaacacatgcccccaccaaacatgacgacgaatgaaaggagagtcatcgtccctgccgaccccaccctttggtccaccgatcacgtccgacaatggctcgaatgggcagtcaaagagtatgggttacccgatgtcaacattctgttgtttcagaacatcgacggcaaggagctgtgtaaaatgaccaaagatgattttcaaaggctgaccccctcctataatgctgatatcttactgagtcacctccactatcttagggagacacctctccctcatttgacatcagatgatgtagacaaggcactgcagaacagccctaggctgatgcacgccagaaacactgacttgccatacgaacccccccgccggtctgcctggaccggacatggccacccaacaccccagtccaaagcagcacagccatcacccagtacagtgcctaagactgaggaccagcggccccaattagatccgtaccagattctcggacccacttcgtctaggctggcgaatccaggttctggacaaatccagctctggcagtttctcctcgaactgctgagtgacagcagcaacagctcttgcattacctgggaggggacaaacggagaatttaaaatgactgaccctgatgaggtcgccagaaggtggggcgaaaggaagtctaagcccaatatgaattacgataagctatcccgggcactgaggtattactatgacaagaacattatgaccaaggtgcacgggaaacgatatgcctacaagttcgactttcacggtatcgctcaagccctgcaaccacaccctcctgagtcttcattgtacaaataccccagcgatctcccatatatgggcagctaccacgctcacccacaaaagatgaactttgtggcgcctcaccctccagctctccctgttactagttcaagcttctttgcagcccccaatccatactggaattcacctactggtggcatttaccccaatacccggctgccgacatcccatatgcccagtcacctcggcacctactactag

SEQ ID NO: 26933 - DNA, 1164 bp, Artificial Sequence
  Description of Artificial Sequence: Synthetic coding sequence
atggtgggcagccccgacaccgtgggcatgaactacggcagctacatggaggaaaagcatatgccccctccaaatatgacaactaacgaaaggcgtgtgattgtaccagctgatccaaccctgtggtctaccgatcatgtccgccagtggttggagtgggcggtgaaggagtacggcttgccagatgttaacatcctgttgttccagaatatcgatggaaaagagttgtgcaaaatgactaaggatgatttccagcgactcacaccttcgtataacgcagatattctgcttagccatcttcactatctccgcgagactccgctgccacatctgacttcggacgatgtggacaaagcactgcaaaactcacctaggttgatgcacgcacgtaacaccggtggcgccgcctttatctttccaaacacaagcgtgtatcccgaagccacacagcgcatcacaacgcgacccgacctcccgtatgagccacctcgcagaagcgcctggacaggccatgggcaccccactcctcagtccaaagccgcacagccgagcccttctaccgtacccaaaactgaagatcagaggccccagctggatccctaccagattctgggcccaacaagctcccgattggctaacccaggaagcggacagatccaactgtggcagtttctcctcgaactgctatccgacagttctaatagctcttgtatcacttgggagggcacaaatggcgagtttaaaatgactgatcctgacgaggtggcccgtaggtggggggaaaggaaatccaagcctaatatgaactatgacaaactctcccgggcccttaggtactattacgacaagaacattatgaccaaagttcatggtaaacgatatgcatataagttcgattttcatggcatcgcgcaggcccttcagccccatcccccagaatccagtctttataagtatccttcggacctgccttacatgggaagctaccatgcacatcctcaaaaaatgaattttgtggcccctcacccacccgcccttcccgtgacttcttcctcattttttgcagctccaaatccatactggaactctccaacaggcgggatttatcctaacacgaggcttccaacaagccatatgccgtcgcatttaggtacgtactattag

SEQ ID NO: 26934 - DNA, 1410 bp, Artificial Sequence
  Description of Artificial Sequence: Synthetic coding sequence
atgaacgacttcggcatcaagaacatggaccaggtggcccccgtggcaaactcatacagggggaccctcaaaagacagccggccttcgatacattcgatggtagtttatttgcagtgttcccttccctgaacgaggagcagacgttgcaggaggtgccaaccggactcgatagcatttcccatgattcagccaactgtgagctccctctattgactccctgctcaaaggccgtcatgtcccaggcgctcaaggctaccttcagtggattcaaaaaagagcagcgaagactcggaattcctaaaaacccttggctttggtcagagcaacaagtgtgccagtggttgctgtgggctacaaatgaatttagtctggtcaacgtgaacttacaaaggtttggcatgaacggtcaaatgctgtgtaatctgggcaaagagcgattcttagagctggctcccgattttgtcggagacatcctgtgggaacacctcgagcagatgatcaaggaaaaccaagagaaaaccgaagaccagtacgaagagaactcccacctaaccagcgttcctcattggatcaattctaacaccctcggctttgggactgagcaggctccctatggcatgcagacccaaaattaccccaaaggcgggttgctggattctatgtgtcccgctagcaccccttccgtacttagctccgaacaggagttccaaatgttccccaagagccgattatcctcagtgagcgtgacttactgtagtgtctcgcaggacttccccggatcaaatcttaacttgctgacaaacaattctgggacgcctaaagatcatgattctcctgaaaatggtgcggatagcttcgaatcctctgactctctcctacagagctggaactcccagtcatccttgctggatgtacaacgcgttcctagcttcgagtcgttcgaggacgattgtagccagagtctatgtttgaacaaaccaactatgtcatttaaagactatatacaagaaaggtccgaccccgtagaacagggcaaacctgtgatcccggccgctgtcttagcaggattcactggtagtgggcctatccagctgtggcagttccttctggagttactgagcgataagagctgccagagctttatatcctggacaggagacggctgggagtttaagctcgctgatcctgatgaagttgcacgaagatggggaaagcgtaaaaacaagccaaaaatgaattacgaaaagctgagcaggggcttgcgctactattacgataagaacatcatccacaagacctcgggcaagaggtacgtgtatcgttttgtgtgtgaccttcagaaccttctgggattcactcctgaggaactacacgctatactgggggtccagcctgataccgaggattag

SEQ ID NO: 26935 - DNA, 1410 bp, Artificial Sequence
  Description of Artificial Sequence: Synthetic coding sequence
atgaacgacttcggcatcaagaacatggaccaggtggcccccgtggcaaatagctaccgaggtacgctgaagcggcagcccgcctttgacacttttgacgggtctctgttcgctgttttcccatcgctgaatgaggagcagacactgcaggaggtgcccacgggtctcgattctatttcccacgatagtgccaactgcgagttgcccttgctgaccccatgcagcaaggctgtcatgtcccaagccttgaaagccaccttttccggctttaagaaggagcagaggagactaggcattcctaaaaacccatggctctggagcgaacagcaggtgtgtcagtggctgctctgggctacgaatgagtttagtctagtgaatgtaaatctccagaggttcggcatgaacggacagatgttatgtaacctcgggaaggagagatttctcgaactcgcacctgacttcgttggagacatactgtgggagcaccttgaacagatgatcaaggaaaaccaagagaaaacggaggatcagtacgaagaaaattcccacctgaccagcgtgccacattggatcaatagtaacactctgggcttcgggacagagcaggccccttacgggatgcaaacccagaattatcccaaaggcggcctgttggatagcatgtgtcctgcatccacaccgagtgtcctgagttctgaacaggaattccagatgttccctaaatctagactgagctcagtttccgtcacatactgttcagtcagccaggacttccccggatccaatctcaatctgctgaccaataatagcggaactcctaaggaccatgactctcccgagaacggagcggactcttttgaatcctcggactcattgctgcagagctggaactcacaatcctctctcctggatgtgcagcgcgttccgagctttgagtccttcgaagatgactgttctcagtccctctgtctgaataagccgactatgagcttcaaagattatattcaggagcgttcagaccctgtagagcagggtaagcctgttattcctgccgctgtgcttgctgggttcaccggaagcggacctatccaactctggcagttcctgcttgagttgctgtcagataagtcctgccagtcctttatttcctggacgggcgacggatgggagtttaagctggcagatcctgatgaagtagccaggagatgggggaaacggaagaataagccgaagatgaactatgagaaactgagcagaggtctccggtactattacgacaagaatataatccacaaaacaagtggcaaacgatacgtttaccggtttgtgtgtgacctccagaacttactgggctttacacccgaggaattgcacgccattctgggagtgcagccagatactgaagactag

SEQ ID NO: 26936 - DNA, 507 bp, Artificial Sequence
  Description of Artificial Sequence: Synthetic coding sequence
atgaacgacttcggcatcaagaacatggaccaggtggcccccgtggccaatagctatagaggcactctgaaaagacaacctgcgtttgatacttttgatggatcactgttcgccgtatttccatctttaaacgaagaacagacacttcaggaagtgcctaccggacttgactccatcagccatgactcagcaaattgcgagctgcctctgttgacaccttgcagtaaggctgtcatgtcccaagcactgaaagccacatttagtggctttaagaaagaacaacgccgcctgggcatacctaagaatccgtggctgtggagtgaacagcaagtgtgtcagtggttactgtgggcgaccaacgaattctccctcgtaaacgtgaacctgcagaggttcggtatgaacggacagatgctatgcaacctggggaaagagcggtttctggagctggcccccgactttgttggagacattctttgggagcacctggaacagatgatcaagtag

SEQ ID NO: 26937 - DNA, 813 bp, Artificial Sequence
  Description of Artificial Sequence: Synthetic coding sequence
atgaacgacttcggcatcaagaacatggaccaggtggcccccgtggccaactcttacagaggaacgctgaagaggcagcccgcctttgataccttcgatgggtctttattcgccgtgtttcccagcttgaatgaagaacagactctgcaagaggtgcccaccggattggatagcatttcccacgattctgctaactgtgaactgcctctgctgactccctgctccaaggctgtgatgagtcaggcactgaaggctactttcagcggcttcaaaaaagagcagcggagactgggcatacccaagaatccctggctgtggtcagagcagcaagtgtgccagtggctcttgtgggccactaacgagtttagcctggtaaacgtcaacctgcagcggtttggaatgaatgggcaaatgttgtgtaatctcggcaaggagaggtttctggagctggcaccggacttcgttggtgacatattatgggagcatctcgaacagatgatcaaggagaaccaggaaaaaactgaggatcagtatgaagagaactcccaccttaccagcgtgccacattggattaattcaaacaccctgggctttggcacggaacaagcaccctatggaatgcagacgcagaactatcccaaaggcggattgctggattcaatgtgcccagcttcaacgcctagcgttctctcaagcgagcaggaattccaaatgttccccaagtcaagactgtcctctgtcagtgtgacttactgtagcgtctctcaggacttccctgggtcaaacctcaatttgcttaccaataattcatag

SEQ ID NO: 26938 - DNA, 570 bp, Artificial Sequence
  Description of Artificial Sequence: Synthetic coding sequence
atgaccgagtacaagctggtggtggtgggcgccggcggcgtgggcaagagtgccctgacaattcagctgattcagaaccacttcgtagatgagtatgatccgactatcgaagactcctatcgcaaacaagtggtgatcgacggagagacatgtttgttggacatacttgacacagcaggccaggaggaatacagcgccatgcgcgatcagtacatgagaacaggcgaggggttcctgtgtgtattcgcaatcaataatacaaagagcttcgaagacatccaccagtatcgagaacagataaaacgcgtgaaagacagtgatgacgtaccaatggtgctggtggggaataagtgcgacctggcagcacggactgtggaatcgcggcaggctcaggacttggcccgatcgtatggaatcccctacatcgagacatctgccaagactagacagggtgtcgaagacgcattctacacactcgtaagggagattcgccagcacaagttacgaaagttgaacccgcctgacgagtcaggccctggctgtatgagctgcaaatgtgtgctgagctag

SEQ ID NO: 26939 - DNA, 513 bp, Artificial Sequence
  Description of Artificial Sequence: Synthetic coding sequence
atgaccgagtacaagctggtggtggtgggcgccggcggcgtgggcaagtctgccctgaccattcagctcatacagaatcacttcgtggacgaatacgaccccacaattgaagattcttaccgcaagcaggttgtaatcgacggagaaacctgtctgctagatatactcgacaccgccgggcaagaggaatactctgccatgcgagatcagtacatgagaaccggtgagggttttctgtgcgtctttgctatcaataacactaaaagctttgaagatatacaccaatatagggagcagattaagcgtgttaaggacagtgacgatgtgccaatggtgctggttggcaacaaatgcgacctggctgccaggaccgttgagtcaaggcaggcccaggaccttgcccgtagctacggcattccatacatcgagacttccgccaaaacaaggcaggggtcacgctccggctctagcagctcatcggggacgctctgggatcctcccggccccatgtag

SEQ ID NO: 26940 - DNA, 570 bp, Artificial Sequence
  Description of Artificial Sequence: Synthetic coding sequence
atgaccgagtacaagctggtggtggtgggcgccggcggcgtgggcaagtctgcactaacgatccagctgattcagaatcactttgttgatgagtacgaccccactatcgaggatagctacagaaaacaggtggtgattgatggcgaaacctgcctgttagatatcttagacaccgccgggcaagaggagtattccgctatgagggaccagtacatgcgaacgggagaggggttcctttgcgtatttgccattaataataccaagtcatttgaagatatacaccagtaccgggagcagattaagagagtaaaggacagcgatgacgtgcccatggtcctcgtggggaacaagtgcgatctggctgcccgtacggtggagtcgagacaggcgcaagatctggccagaagttacggaatcccttatatagaaacaagtgctaagacccgacaaggggtcgaggacgctttttatacccttgtgcgggagatccgccaacacaagttaagaaagctcaaccctcctgacgagagtggaccaggctgtatgtcatgcaagtgcgtgttgagctag

SEQ ID NO: 26941 - DNA, 513 bp, Artificial Sequence
  Description of Artificial Sequence: Synthetic coding sequence
atgaccgagtacaagctggtggtggtgggcgccggcggcgtgggcaaatctgccctaaccattcagctaatccagaatcattttgtggacgaatacgatcctaccattgaggactcatacaggaaacaggtcgttattgacggggagacttgtttgctggatatcttagacactgccggtcaagaagagtacagtgctatgcgcgatcaatatatgcggactggagaaggctttctgtgcgtgtttgcaattaacaataccaaaagctttgaagatattcaccaataccgggagcagattaagcgcgtaaaagatagcgacgacgtcccgatggtcttagtggggaataaatgtgatctggccgcccgaacggtcgagagccgacaggcacaggacctcgctcggtcatatggcatcccttacatcgagacatcagccaaaacacgtcaggggtccaggagtgggtcctcttcatcctcggggactctgtgggatcctcccgggcctatgtag

SEQ ID NO: 26942 - DNA, 570 bp, Artificial Sequence
  Description of Artificial Sequence: Synthetic coding sequence
atgaccgagtacaagctggtggtggtgggcgccggcggcgtgggcaaatcagcactaacaatccaattaatacagaatcacttcgtcgatgagtatgaccctaccattgaggacagctacaggaagcaggtcgtgattgacggggagacctgtctgttggatattttagacactgccgggcaggaggagtacagcgcgatgagggatcagtacatgcgcactggcgagggtttcctttgcgtgtttgccatcaacaacactaagtcctttgaggatatccatcagtacagggagcaaataaagagagttaaggactctgatgatgtgcccatggtccttgtcggcaacaaatgcgacttagcagctagaaccgtcgaaagccggcaggcacaggatctggcccgcagctacggaataccttatattgagacatctgccaagactcgacagggggtggaagatgctttctatactctggtgcgggagatccgacaacacaagcttagaaaactgaacccacctgatgagagcggaccaggatgcatgtcatgtaaatgcgttctgagttag

SEQ ID NO: 26943 - DNA, 513 bp, Artificial Sequence
  Description of Artificial Sequence: Synthetic coding sequence
atgaccgagtacaagctggtggtggtgggcgccggcggcgtgggcaaatctgctctcaccattcagctgatccaaaaccattttgtcgacgagtatgatcctaccatcgaagactcttaccgaaaacaggtggtgatcgatggcgaaacatgtctgttggacatcctggacaccgccggccaggaagagtatagtgccatgagagaccagtatatgaggactggcgaaggcttcctgtgtgtgtttgccattaataacacaaaatcgtttgaagatattcatcagtatagagagcagattaaacgcgtgaaggatagtgatgatgtgccaatggtgctggtcggcaacaagtgtgacctggccgccagaacagtggagtctcggcaggcccaagatttggctcgatcttatggtatcccctatatagagacaagcgctaaaaccagacagggtagtagatccggatcatcctctagttccgggacactttgggacccgcccggccctatgtag

SEQ ID NO: 26944 - DNA, 609 bp, Artificial Sequence
  Description of Artificial Sequence: Synthetic coding sequence
atgctgccccccggcaccgccaccctgctgaccctgctgctggccgccgggtctctgggtcagaagcctcaaaggccccgacgccctgcctccccaatcagcaccatacagcctaaagcgaacttcgacgcacagcaatttgccggcacctggcttctagtggctgtgggctcagcatgccggttcctgcaagaacaaggtcatagggcggaagccacaactttgcatgtggccccccagggcaccgcgatggccgtgagcaccttccggaaacttgatggcatctgttggcaagttcgtcagctgtatggcgataccggcgttttgggacgctttttactgcaggccagggacgcaagaggcgcggtccacgtcgtggtggctgagacagattatcagtctttcgctgtcctttacctcgaaagagcggggcagctgagcgtgaagctgtatgccagaagtctccccgtcagcgactcagtgttaagtggctttgaacaaagagtgcaagaagcacacctaaccgaggaccaaatcttctactttccgaagtacggattctgtgaggcagccgaccagttccatgtattggacgaggtgaggagatag

SEQ ID NO: 26945 - DNA, 522 bp, Artificial Sequence
  Description of Artificial Sequence: Synthetic coding sequence
ggcttcctggtgcccctgtggctgatgcggaactgcttccggctgcaagaggagatgcttcagagggaggaggctgagaacacactccagtcttttcgccaggacgtggacaacgctagtttagcgagactcgatctcgaacggaaggtggagtccctccaagaagagattgcattcctgaagaagcttcacgaggaggagatccaagaactgcaagcacagatccaggagcagcacgtccagattgacgttgatgtctcaaagcccgacctgacagctgcactccgggatgtcaggcagcagtacgaaagtgtcgcagcgaagaatctgcaggaagcagaagaatggtataaaagcaagttcgcggatctctccgaagccgctaaccggaacaatgatgcattgagacaggcaaaacaggagtctactgagtaccgcaggcaggtgcagtccctcacatgtgaggtcgatgccctgaagggcactgtcagtaccaatccggctgttaaagagggcaagtag

SEQ ID NO: 26946 - DNA, 687 bp, Artificial Sequence
  Description of Artificial Sequence: Synthetic coding sequence
atgcggaactgcttccggctgcaggaggagatgctgcagcgggaggaagctgaaaataccctccaatcgtttagacaggacgttgataatgctagtttggcgagattggacctagagagaaaagtcgagtcactgcaggaggagatcgcttttctgaagaaacttcacgaggaggagattcaggagctgcaggcgcaaatccaggagcaacatgtgcagatcgatgtggacgtttcaaagccagacctcactgccgcactgagagatgtccggcagcaatacgagtcagttgcagccaagaatctgcaggaggccgaggaatggtataaaagtaaatttgccgacctgagcgaagccgcaaaccggaataacgatgcgctgaggcaggctaaacaggagtccaccgaatacagacggcaggtgcaatctcttacgtgtgaggtggatgctctgaaagggacaaacgagtcgttggaacgccagatgagagagatggaggaaaatttcgccgtggaagctgcgaactatcaagacactatcggacggctccaggatgagatccaaaacatgaaggaggaaatggcacgccatctgcgagagtaccaggacctcttaaatgtcaaaatggccctggatattgagattgccacctaccggaaactgctcgagggggaggaatcacgatag

SEQ ID NO: 26947 - DNA, 1296 bp, Artificial Sequence
  Description of Artificial Sequence: Synthetic coding sequence
atgagcacccggagcgtgagcagcagcagctaccggcggatgttcggtggccctggaaccgccagccgcccttcctcaagccgaagctacgtcactacatccactcgtacttactcactcggctcagctctgcggcctagcacgtcacgtagtctgtatgcctcatcccctggaggcgtctatgctacaaggagcagcgctgttcggctgagatcatctgtgcccggagtgcggcttttgcaggactccgttgactttagcttggcagacgctatcaacaccgagtttaagaacacccggacaaacgagaaagtggaactacaggagctgaacgatcggttcgccaattatattgataaagtccggttcctcgaacaacagaacaagattcttctggcagaactcgagcagctgaaaggccagggcaaaagtaggctgggagatctgtatgaagaagaaatgcgggaacttcgtaggcaagttgaccagctcaccaatgataaggctcgagtcgaagtcgaacgggacaatctcgccgaggacattatgagactccgtgagaaactccaagaagaaatgctccagagagaggaggctgagaacaccctgcaatcatttcggcaggatgttgataatgcttccctcgcccggctagatttagaaaggaaagtggagtcactgcaggaggaaatagccttcctgaagaagttgcacgaagaagaaattcaggaactccaggcccagatccaggaacagcacgtgcaaattgatgtggacgtctcaaagcctgatttaaccgctgctctacgcgatgtaagacaacaatacgaatccgtagcagcaaagaatctccaggaagcagaagagtggtacaaaagtaaatttgccgacctctcggaggccgctaacagaaataacgacgcactccggcaggcaaagcaggaatcaactgagtaccggaggcaggttcagagtctgacctgtgaggtagacgccctcaagggcactaacgaatctctggaaaggcagatgcgagaaatggaggagaatttcgcggtggaggccgctaattatcaggataccattgggcgcctgcaggacgagatccagaatatgaaagaggagatggcacggcaccttcgagaatatcaggatttgcttaacgtaaaaatggctctcgacatcgaaattgccacatacagaaagctgctcgaaggtgaagagtcccgaatttctctgcccctgccgaattttagctctctcaaccttcgagggaaacactttatcagcctttag

SEQ ID NO: 26948 - DNA, 1401 bp, Artificial Sequence
  Description of Artificial Sequence: Synthetic coding sequence
atgagcacccggagcgtgagcagcagcagctaccggcggatgttcggcggtcccggcactgcaagcaggccaagcagtagcaggagttatgttaccacgtctacacggacatatagtctgggctctgctctgcggccctcaacttcccggtcactgtatgcgtctagccccgggggggtttatgcaacccgttcatccgccgtgaggctccgaagtagcgtaccaggcgttcggctgttacaggactcagttgatttctctctcgccgacgcgataaacactgagtttaaaaacacaaggactaatgaaaaggtagaactgcaagagctaaacgataggttcgccaactatatcgacaaagtgcgcttcctagagcagcagaacaagattcttctggcggaacttgagcaactaaaaggtcagggaaaatccagactgggagacttgtacgaagaggagatgagagagctgcgtcggcaggtggatcaactcactaatgataaggcaagagtcgaggtggaaagggataaccttgcagaggatataatgagactgcgcgagaagctacaagaagagatgctgcagcgcgaggaagctgaaaacacactccagtctttccgacaagacgtcgacaacgctagcctggcccgtctggacctagagcggaaggtcgagtcactgcaggaggaaattgctttcctgaaaaaactgcatgaagaggagatccaggaactgcaagctcagatccaggagcagcatgtgcaaatcgacgtggacgtttcaaagccagacttaacagccgccctccgcgatgtacggcagcagtacgagtctgtcgccgccaagaatcttcaggaagccgaagagtggtataaatcaaagtttgcagacctgagtgaggcagccaaccgcaataatgacgctctccgacaggctaagcaggaaagcaccgagtatcgcaggcaggttcagtccttgacctgtgaagtcgacgcgctcaaaggcacgaacgagagcctcgagaggcaaatgcgggagatggaagaaaactttgctgtcgaagcagccaactaccaggacaccatcggaaggctgcaagacgagatccagaatatgaaagaagagatggcgagacatttacgagaataccaggatttgctgaatgtcaagatggccttggacatcgagatcgcgacctaccgtaaactgttggagggcgaggagtcacggatttctctgcctctgcctaacttcagctccctgaacctaagagagactaatctggactccctccccctggtggacacccactccaagcggacactattgatcaagactgtagagaccagggacggacaggtaattaatgagacgtcacagcaccacgacgatctagaatag

SEQ ID NO: 26949 - DNA, 1224 bp, Artificial Sequence
  Description of Artificial Sequence: Synthetic coding sequence
atgttcggcggccccggcaccgccagccggcccagcagcagccggtcctatgtgacaacctccacacgtacctacagccttgggtccgccctacgcccgtcaacctctcgaagtctgtatgccagcagccccggcggcgtgtacgccacacgatcatccgccgtaagacttcgctcgagcgtgccaggagttcgcctgctgcaggattccgtcgacttttcattggccgatgctatcaatacggaattcaagaatactcgcacaaacgagaaagttgaactgcaagaactcaacgatcgtttcgctaactacatcgataaagttcgattcctcgagcagcagaataagattctgctggctgaattagaacaattgaagggacagggcaagtcccgactgggagacctctacgaagaggagatgcgggagctgaggaggcaggttgaccagctcacaaacgacaaggcacgcgtcgaggtggagcgcgataatctggccgaagacattatgcgtctgcgggagaagctccaagaagagatgttgcagagagaggaggccgaaaacacactccaaagtttccgacaggacgtcgataacgcatccctagcccgtcttgatctggagcgcaaggtggagagcctgcaggaggagatagccttcttgaagaagctgcatgaggaggaaatacaggaactgcaggcgcagattcaggagcagcacgtgcagatcgatgttgatgtgtcgaagccagatttgacagccgccctgcgggacgttagacaacagtacgaatccgtcgccgctaagaatcttcaggaagccgaagagtggtataaatccaaatttgctgacttgagcgaagccgctaacagaaataacgacgccctgcgacaggcaaagcaggagagcaccgagtacaggcgacaggttcagtccctgacttgtgaagtagatgccttgaaaggaacgaatgaatccctagagcggcagatgagggaaatggaggaaaatttcgcagtggaagcagccaactaccaggatactattggtcgactgcaagatgagatccagaatatgaaagaggagatggctaggcacctaagggagtaccaggatctattaaacgtgaagatggcgctggatatcgaaatcgcaacatatcgcaaactgctggaaggagaggaatctcgaatcttgtgcctctttcagactttccccccctag

SEQ ID NO: 26950 - DNA, 2256 bp, Artificial Sequence
  Description of Artificial Sequence: Synthetic coding sequence
atggaggacctgagcagccccgacagcaccctgctgcagggcggccacaacctgttgtcctctgcaagctttcaagaggctgtgacttttaaggatgtgatcgtcgattttacacaagaagagtggaaacagctagaccctgggcaacgagacctgttccgggacgtcactcttgaaaattatacccacctcgtgagcattgggctccaggtcagcaaacctgatgtcatttctcaactcgagcagggaactgagccctggattatggaaccatccattcctgtcggaacatgtgcagactgggaaacacgcctcgaaaacagcgtgtctgcacccgaacctgatatcagcgaagaagagctctctccggaagtgatcgtggagaagcacaaaagagatgattcatggtcctctaacttgctggagtcatgggagtacgaggggtctttggagcggcagcaggcaaaccagcagactctgcccaaagaaattaaagttacagagaagacaatccccagctgggagaaggggcccgtaaacaacgagttcggcaagtccgtgaatgtctcctcgaacttagtcactcaggagccgagcccagaggagacatcaaccaagcgtagtatcaaacagaattccaacccagtgaaaaaggaaaaaagctgcaaatgcaacgaatgcggtaaggcattcagctactgtagcgccctgattagacatcagaggactcatacaggagaaaagccttataaatgtaatgagtgtgagaaggctttttcgcgctccgaaaatctgatcaaccaccaacggattcacactggtgacaaaccttataagtgcgaccagtgtggcaaaggctttatcgaaggtccctccctgacccagcatcagcgcatacatacgggagagaagccctataagtgcgatgagtgcgggaaagctttctcgcagcggacgcacctggtacagcaccagagaatccacacgggcgagaagccatacacttgcaatgaatgtggaaaggcattctcccagcggggacacttcatggagcatcaaaaaatccacacaggtgaaaagccattcaagtgtgacgaatgcgacaaaacttttacccgaagcactcacctgacacagcaccagaaaatccatacgggcgagaaaacatataagtgtaacgaatgcggaaaggctttcaacggcccctccaccttcattagacaccatatgattcatactggagaaaagccctacgagtgcaacgagtgcggcaaagctttcagtcaacatagcaatctcacacaacatcagaagacccacaccggggagaagccttacgattgcgcagagtgtggcaagagcttctcctactggtcgtccctagcccaacacctcaagattcacacgggtgagaagccatataaatgcaacgagtgcggcaaagcatttagttactgcagctccttgacgcagcaccggagaattcatactagagaaaaacctttcgagtgttccgaatgcggaaaggcgtttagttatctgtctaatctcaaccagcatcaaaagacccatacccaggaaaaggcttacgagtgcaaggagtgtggcaaggcctttatcaggtcaagctccttggccaagcacgaacggattcacacaggcgaaaagccctatcagtgccacgaatgtggcaagaccttttcttatggctctagcctgatccagcatcggaaaattcatacaggcgaaaggccgtataaatgcaacgagtgtggaagggcattcaaccagaacatccatctcacccagcataaacggatccatactggcgctaagccgtacgagtgtgccgagtgcgggaaggctttccgccactgcagctccctagcgcagcatcaaaagactcacacagaggaaaaaccttaccaatgcaataagtgtgagaagaccttctcccagtcctctcacctgacccagcaccagcgtattcatacgggggagaaaccgtacaagtgtaatgagtgcgacaaggcattttcaaggtccactcacttgacagagcaccagaacactcataccggcgaaaaaccctataactgcaacgagtgcagaaagactttttctcagtccacttacctgatacagcaccagaggattcatagcggggagaagcctttcggatgtaacgactgcgggaaaagctttaggtaccgctccgccctgaacaagcaccagcggctgcaccctgggatttag

SEQ ID NO: 26951 - DNA, 3201 bp, Artificial Sequence
  Description of Artificial Sequence: Synthetic coding sequence
atgcccgtgttccacacccggaccatcgagagcatcctggagcccgtcgcacaacagatctcgcatttggttattatgcatgaggagggtgaggttgatgggaaggcaatacccgatcttactgccccagttgctgcagtgcaggctgctgtatccaatctggtaagagttggaaaggaaaccgtccagactacagaggaccaaatcctgaagagggacatgccccctgcattcattaaggtggagaatgcttgtacaaagctagtacaggcagcccagatgcttcagtctgatccgtattctgtaccagcaagggactacctgatagatggcagtaggggtatcctgtcaggcacttctgacttgctgctgaccttcgacgaggctgaagtgcggaaaatcatcagagtgtgtaagggtatcctcgagtaccttaccgtcgctgaggtcgtcgagacaatggaggatcttgtcacgtacactaagaacttgggtccgggcatgacaaaaatggccaaaatgatcgacgagcgacagcaggaattaactcaccaggagcacagggtgatgctggttaacagtatgaataccgttaaagagctcctgcctgtactgataagtgccatgaagattttcgtaactaccaagaacagcaagaaccagggaatcgaggaggcgttaaaaaatcgaaacttcacagtggaaaagatgtctgccgaaatcaatgagattatccgggtgctgcaactgacttcttgggatgaggacgcatgggcctctaaagatactgaagccatgaagagggcgctggctagcattgattcaaagctgaatcaagccaaggggtggctccgagatccttccgcctcacccggggatgccggagagcaggcaatccgacaaatcctagacgaagccggcaaggtgggcgagctgtgcgctggaaaggagaggcgggagatactggggacttgtaagatgctgggtcagatgactgatcaggttgcagatttacgcgcacgaggtcagggcagcagcccagttgcaatgcagaaggctcagcaggtctctcagggcctggatgtgctgaccgccaaagtcgaaaacgctgcacggaaactcgaagccatgactaatagtaagcagagcattgcaaaaaagatagacgctgctcagaactggcttgcagaccccaacgggggtcctgaaggagaggagcaaatacggggtgcgctggcagaggcccgtaaaatcgcagagctctgcgatgaccccaaagagcgtgatgacatcctgcgttccttaggagaaatcagcgctcttaccagcaagctagccgatctgcggagacaggggaagggggatagccctgaggccagggcattagccaagcaagtagcaacagctctgcagaatttgcagaccaaaactaatagggctgtggccaacagcaggcctgctaaggccgctgtccatctagaaggaaagattgaacaggcccaacggtggattgataatcctactgtggacgacagaggtgttgggcaggccgcaattcggggcctggtggccgagggccaccgcctggcgaacgtgatgatgggcccataccgtcaggatcttctggccaagtgtgatcgggtggatcagctcactgcacaactcgctgatttggcagctcggggcgagggagaaagcccccaggctcgcgctttggcctcacagctgcaggactctctcaaggatttgaaggcacgcatgcaggaggctatgacacaagaagtgtctgatgtgttctcagatacaacaacacctatcaagctcctggcagtggctgcgactgcccccccagacgctcccaaccgcgaagaggtgttcgacgagcgcgccgccaattttgagaaccactctgggaagctcggggctactgctgaaaaagcagcagccgtaggcacagcaaacaaaagcacggttgaaggaattcaggcttctgtgaagaccgccagggagctgacaccacaagtggtttcagcagcacggattctgctccgaaatcctggtaaccaggccgcgtacgagcattttgaaacaatgaaaaatcaatggattgacaacgtagaaaagatgactggtctggtggacgaggccattgacacaaaatcccttctagacgcgagcgaggaggctataaagaaagacctcgacaaatgtaaggtggctatggctaatattcagcctcagatgctggtcgctggggctacctctatcgcccggagggccaataggattctcttggtcgctaagagagaggtggaaaacagcgaagacccaaaatttagggaagccgtaaaagccgccagtgacgaattaagcaaaacaatttccccaatggttatggatgccaaggcagttgccggcaacatttctgatcctggattgcaaaaatccttccttgacagcggctaccgcattttaggagctgtggccaaggtgcgagaagcatttcagcctcaagaaccagactttccacccccaccaccagatctcgaacagctgaggctgacagatgagctggctccgcccaagcctcccctgcctgaaggagaggtccctccaccacgacctcctccacctgaagaaaaggatgaggaattccccgaacagaaggccggggaggtaattaaccagcccatgatgatggcagccaggcaactgcatgacgaggctcgcaaatggagctcaaaaggaaacgacatcatcgctgcggctaagcggatggccctgcttatggcggaaatgagtcgcctcgtcagaggtggtagcggcactaaaagagccctgattcagtgcgcgaaggacatcgcaaaagccagtgacgaggtcacaagattggccaaagaggtggcaaagcaatgtaccgacaagcgcattcgcaccaatttgttacaggtctgcgaacgcatcccgaccatttccactcagctcaaaattctctctacggttaaggccacaatgttgggtaggacgaacatatcagacgaggagtccgagcaagccacggagatgctggtccacaatgcgcagaacctgatgcagtccgtgaaagaaactgtgagagaagcagaggctgcgagcataaagatacggaccgacgcaggctttacactccggtgggtccgcaagacaccttggtatcagtag

SEQ ID NO: 26952 - DNA, 2784 bp, Artificial Sequence
  Description of Artificial Sequence: Synthetic coding sequence
atgctgcagagcgacccctacagcgtgcccgcccgggactacctgattgacggtagcagaggcattctgtccggtacctcggatctgcttctaacttttgacgaagccgaagttcgcaaaataattagagtatgcaagggtatcttagaatacctgacagtggcggaagtggtcgagacaatggaggaccttgtcacttataccaagaatttgggaccgggaatgacaaagatggcaaagatgatagacgaacgacagcaggaactgacccaccaagagcacagagtcatgctcgtgaactccatgaataccgtgaaggagctgttgccagtactgattagcgctatgaaaatcttcgtaaccactaagaattctaagaatcaaggcatcgaagaagccctgaagaatcgaaacttcacggtggaaaagatgtcagccgagatcaatgagatcatccgcgtgctgcagttgacatcatgggacgaggatgcgtgggcatccaaagatacagaagcaatgaaacgggcccttgcctctatagactccaagctaaaccaggctaaaggctggttgcgcgatccatcagccagccctggggacgccggggagcaggccatcagacagatactcgatgaagccggtaaagtgggggaactatgcgccggaaaggaacgcagagagattttagggacctgcaaaatgctggggcagatgacagatcaggtcgcggacctgcgcgcgcgcggccagggatcgagtccagtcgcaatgcaaaaggcgcagcaagtgtctcagggcttagatgttctaaccgccaaagtggagaacgcggccagaaaactggaagctatgaccaacagtaaacagtcaatagctaaaaagattgacgccgcccagaactggctagcagatcccaatggaggacctgaaggcgaggaacaaatcagaggggcattggccgaggcacgaaagatagcggaactgtgtgacgaccccaaagagcgcgatgatattctgagatcactgggcgaaatttctgcccttacaagcaagctcgctgatctccggcgccagggtaaaggagactcgcccgaggccagggctctcgcaaagcaggtggccacagctttgcaaaatctccagaccaaaacaaaccgggccgttgctaattctcggcccgcaaaggccgctgtacacttagaaggaaaaattgagcaggcccagcggtggatcgataacccgacagtggacgacagaggtgtgggtcaagccgccattcggggattggtagctgaaggccatcggctggccaatgttatgatgggcccctataggcaggacctgctagcaaaatgtgatagagtggaccagcttaccgcccagttagcagacctcgccgctagaggcgagggtgaaagccctcaggcccgtgctttggcaagccagctgcaggactccttaaaggatctgaaggcaagaatgcaggaggccatgacccaggaggtttccgatgttttttctgatacgacaacccctattaaactcctcgcggtagctgcaactgccccaccggacgcacctaatcgtgaagaggtgtttgacgaaagagctgcaaatttcgaaaaccattccggcaagctgggtgccaccgcggagaaggctgccgccgtgggtacggccaacaagtcaactgtcgaaggcattcaggcctccgtgaaaactgccagggaactgacaccacaggttgtgagcgcagctcggatcctgctgcggaaccccggaaatcaggccgcatatgagcacttcgagacaatgaagaaccaatggatcgacaatgtggagaaaatgaccggattggtagacgaggctattgatacaaagtcattattagacgcttcagaggaagcaatcaaaaaagacctggataaatgtaaagtggccatggccaacattcaaccacagatgctggtggccggcgcgaccagcatcgctcggagagctaacagaatccttcttgtggccaagagagaagtcgagaattccgaagaccctaaattccgcgaggctgtaaaggcagcaagcgatgagctgtcgaagaccatctccccaatggtgatggatgccaaggctgtcgccggaaacatcagcgaccccgggctgcagaagtcatttctcgatagtggatacagaattctcggagccgtggcaaaggttcgagaggccttccagccccaggaacccgactttccgccgcccccccctgatctcgaacagctgcgtctcaccgatgagttagccccccctaaaccccccctgccagaaggggaagtgccaccgccacgtccccccccacccgaagagaaggatgaagagttcccagaacaaaaggccggcgaagtgataaatcaacccatgatgatggcagcaagacagctccacgacgaggccagaaaatggtctagtaagcctggcattcctgcagctgaagtgggcataggagtagtagccgaagcggatgcagcagacgccgctggatttccagtgccgcccgatatggaagacgactatgagccggagcttctgctgatgccttcaaatcagcctgtcaaccagccaattctggcagctgcgcagagcttgcacagagaggcaactaaatggagcagtaagggaaacgacattatcgccgcagctaagcgcatggcactgctgatggcggaaatgtcaaggctggtgaggggcggaagcgtgccaagaacatcacctagaccccagatgagatag

SEQ ID NO: 26953 - DNA, 984 bp, Artificial Sequence
  Description of Artificial Sequence: Synthetic coding sequence
atgcccgtgttccacacccggaccatcgagagcatcctggagcccgtggcccagcagattagccacctagtgatcatgcatgaagaaggcgaagtcgacggcaaggccatacctgatttgacagctccagttgcggccgtgcaggctgccgtatcaaatctcgttcgggttgggaaggaaacggtccagacgacggaggatcagatcttgaagcgggatatgccccctgcctttatcaaagtcgaaaatgcttgcacaaagttggtacaagctgctcaaatgcttcaatctgatccctatagtgtgcctgcccgcgactacttaatcgatgggagcaggggaattctctctggaacctccgatctcctgctgacttttgatgaagccgaagtgccacccccccgccccccgcctcctgaagaaaaagatgaggaattccctgaacagaaggcaggagaagttatcaaccagcccatgatgatggccgcccgacagttgcatgatgaagccaggaagtggagttctaaaggcaatgacatcatcgccgccgccaagaggatggctttgcttatggctgagatgagtcggctggtcagaggcgggagcgggaccaaacgggccctgatccagtgcgcaaaggacattgccaaggcttcagacgaagtcacccgcttggccaaagaggtggcaaagcagtgtactgacaaaaggataaggaccaacctgcttcaggtttgtgagcgtataccaactatctcgacacaacttaaaattctctctaccgtcaaagcgaccatgctgggaagaacaaatatctccgatgaggagtccgaacaggccacggagatgctggtgcataatgctcagaatctcatgcaatcagtgaaagagacagtgagagaggcagaggccgccagcatcaaaatcaggactgacgcaggcttcaccttgcgctgggtgagaaaaactccctggtatcagtag

SEQ ID NO: 26954 - DNA, 2421 bp, Artificial Sequence
  Description of Artificial Sequence: Synthetic coding sequence
ggccagatgaccgaccaggtggccgacctgcgggcccggggccaggggtcttcccctgtcgcgatgcagaaggcacagcaggtgagtcagggccttgatgttttgacggccaaggttgaaaacgccgctcgcaaattagaagcaatgaccaatagtaagcagtcgatcgccaagaaaattgatgctgcccaaaattggctggctgaccccaacggtggaccggagggcgaggagcagatcaggggagccctggccgaagcacgcaaaatcgcagagctttgcgacgaccctaaggagcgcgacgatatacttcgatctcttggcgaaatttcagcccttacatctaagctggccgaccttcgcagacagggtaagggggactcacccgaggctcgcgcattggctaaacaagtcgctaccgctctccagaacctgcagacaaaaactaatagagctgtcgcgaacagcagaccggctaaagcagccgttcacctcgaggggaagattgagcaggcccagcggtggattgataaccctacagtggatgacaggggtgttgggcaggcagctattcgcggattggtagccgaggggcaccgcctcgcgaatgtgatgatgggaccctatagacaggatctgctggccaaatgcgaccgtgtggatcagctgaccgcacagctcgccgatctggcagccagaggtgagggtgagtcaccccaagccagagcactggctagccagttgcaggattccctgaaagacttgaaagcccggatgcaggaggccatgacccaggaggtgtcggacgtgttttccgacactacaacacccatcaagttactggcggtggctgctactgcacctccagatgcaccaaatcgggaggaagtgtttgatgaacgagccgcgaactttgaaaatcatagcggcaagctcggagctacagctgaaaaagcagcagccgtggggaccgctaacaagtccacagtcgagggcatacaggcatctgttaagacagctcgcgagctcaccccccaggtagtctccgcagccagaatcctgttaagaaatccgggtaatcaggctgcatacgagcattttgaaactatgaagaaccaatggattgataacgtcgagaagatgaccggtctggtcgatgaagctatcgacactaagtccctcttagacgcctccgaggaggcgattaaaaaggacctagataagtgcaaggttgctatggctaacatccaaccgcagatgctggtggctggggcgacctctatcgctagaagagcaaataggatcctgttagtggccaaaagagaggttgaaaattcagaggatcccaagttccgtgaagcagttaaggccgcgtctgacgagctatccaaaacgatttcccccatggtgatggacgcaaaagccgtagcaggcaatatctcagatcccggcttacagaagtcattcctcgacagcggttatcggattttaggcgccgtcgccaaagtaagggaggcattccagccccaagaacccgatttcccaccgccccccccagaccttgaacagctccgccttaccgacgaattggcccccccaaagccccccctgccagaaggcgaagtgcccccgccacgtccgcctcctcccgaagagaaagacgaggagtttcccgaacagaaggccggggaagttatcaatcaacctatgatgatggctgcccgacagctgcacgatgaagcccggaagtggtcctctaagcctggaataccagccgccgaggtgggaatcggagtggtggccgaggcggacgcggcagatgccgccgggtttcccgttcctcctgatatggaagacgactatgagcctgagctcctcctcatgcctagtaaccagcccgtcaaccaacctattctcgcggcagcacagagtctgcatcgcgaagccaccaagtggtcttcaaaaggcaatgatatcatcgccgcggccaaacgcatggcgcttctcatggcagagatgtcccgactagtcagaggcggatctggcacaaaacgggcgttaattcagtgcgcaaaggacatagccaaggcctcggatgaggtgacgaggcttgctaaagaagtagccaagcagtgcaccgacaagcggattaggacaaatttgctgcaggtgtgcgaaagaattcctaccattagcacccaactgaagatcctatcaacagtcaaagctaccatgctcgggcgcacgaatatctccgacgaggagagcgaacaggctactgagatgttggtgcataacgcccagaacctaatgcagagtgttaaagagaccgtcagggaagcagaagcagcgtctatcaaaattcggaccgatgcagggttcactcttcgctgggtccggaagacaccctggtatcagtag

SEQ ID NO: 26955 - DNA, 3021 bp, Artificial Sequence
  Description of Artificial Sequence: Synthetic coding sequence
atgccccccgccttcatcaaggtggagaacgcctgcaccaagctggttcaggccgcccagatgttgcagagcgatccatattctgtacccgcaagagattatctcattgacggctcaaggggtatcctcagcgggacatctgatttattgcttaccttcgacgaggccgaggtgcgaaagattattagagtctgtaagggcatcctggagtacctgaccgtggcggaagtagttgaaaccatggaagacttggtgacctataccaaaaatttgggacccggtatgacaaagatggctaaaatgattgatgaacggcagcaagaacttacacaccaggaacaccgggttatgctggttaattctatgaacaccgtgaaagagctgttgcctgtccttatatctgctatgaagatattcgtgacaaccaaaaactccaaaaaccagggtatagaggaagccctgaagaacaggaactttaccgttgagaagatgagcgctgaaattaacgagattattcgagtgctccagcttacaagttgggatgaggatgcatgggcgagcaaggacacggaagctatgaagagagccctggccagcatagactccaagctgaaccaggccaaaggctggcttcgcgacccaagtgcatcacccggcgacgctggcgaacaggcaatcagacagatccttgatgaagcaggaaaggtgggtgaactgtgtgccgggaaagaaaggcgcgaaatactgggcacctgcaaaatgcttgggcagatgactgatcaggtagccgatcttcgtgctagaggacagggctcgtcaccggtcgcaatgcagaaagctcagcaagtttcacagggcctagatgtcttaaccgcaaaggtggaaaacgccgctcgaaagcttgaagccatgacaaattcaaaacaaagtattgctaagaaaattgatgcagcgcagaactggctggccgatccaaacgggggaccggaaggtgaagaacagatcaggggtgctctggctgaagctcgtaagattgcggaactctgcgacgaccccaaagaacgtgatgatatattacgctcactgggcgagatctcagccctgacctctaagctagccgatctgcggcgccagggcaaaggggattcacccgaggcaagggcgcttgccaaacaagtggccaccgctctacaaaatctccaaaccaaaacgaacagggcagtagctaacagtcgtccagccaaagctgcagtccatctcgaaggcaagatcgaacaggcccagagatggattgacaaccccaccgtcgacgacaggggggtaggacaggccgccatcagaggccttgtcgctgagggccatcgactggccaacgtgatgatgggcccgtaccgacaggatctgctcgccaaatgtgacagggtggatcagctgactgcacaactggccgacctggcggcgaggggtgagggagagagcccccaggcccgcgccctggcctctcagctgcaggacagtctgaaagacttaaaagcgagaatgcaggaggccatgacccaggaggtaagcgacgtgttttctgacactacaaccccaattaaactgctcgcagtggccgcgactgcccctcctgacgcccccaaccgggaggaagtgtttgatgaacgagctgcaaactttgaaaaccattccgggaagctgggcgcgacggccgaaaaggccgccgccgtcggaaccgccaacaaaagtaccgtagaaggaatccaggcttccgtaaaaacggccagagagcttactcctcaagttgtttctgcggcccgcattctcctcaggaaccccggaaatcaggccgcctatgagcatttcgaaaccatgaagaaccagtggatagataacgtggaaaagatgactggcctagtggacgaagctatcgataccaaaagcctgctggacgcttctgaggaggcaataaagaaagatctcgacaagtgtaaagttgccatggcgaatatccagccacaaatgctagttgcaggcgccactagtatcgctagacgggccaaccgtattctgctcgtagctaagcgagaggtcgagaactccgaagatcccaagttccgcgaggcggtaaaagcggcttccgatgagctgagcaaaactatctcccccatggtcatggatgctaaagccgtggctgggaatatctcagatccaggtttgcaaaaatcttttctggactctggatacagaattctcggggcagtggctaaggttcgcgaagccttccagccgcaagaacccgatttcccacctccgccgccagacctggaacagctgcgtctcactgacgagctggcacccccaaaaccacccctgccagagggggaggtgcctcccccccgcccgccaccaccggaggaaaaggatgaggagttcccggagcaaaaggcaggggaagttatcaaccaacccatgatgatggctgcaaggcagctgcatgacgaggctaggaagtggtcgagcaaaggaaatgatattatagcggctgctaaaagaatggctctcctgatggcggagatgtccaggttggtgcgtggcggctcaggtaccaagagggcactgatccagtgcgccaaagatattgcaaaagcaagcgacgaggtcactcgattagcaaaggaagtggccaagcagtgtacagacaagaggatccgcaccaatctgctgcaggtctgtgaaagaatccccacaatctcaacccagttgaagatcttaagtaccgttaaagctacgatgctgggccgtacgaatatctctgacgaggagagtgagcaagcgaccgaaatgctcgtccacaacgcccagaacctcatgcagtccgtgaaggagaccgtgcgggaattgaaactgctccaaagcaagtttgaacagatgctggatcttcattgtgctggtctagagcggctcccaggaacaagccgacacctggcagaaccaggatggcacaggaacctatattag

SEQ ID NO: 26956 - DNA, 570 bp, Artificial Sequence
  Description of Artificial Sequence: Synthetic coding sequence
atgaccgagtacaagctggtggtggtgggcgccggcggcgtgggcaagtctgccctgactattcagcttatccagaatcactttgtagacgagtacgaccccactatcgaagatagctacagaaagcaggtcgtaatcgacggagaaacctgcctcctggacatacttgatacggcgggacaagaggaatattccgcgatgcgggaccagtatatgcgcactggcgaaggtttcctatgtgtgtttgccattaacaacacgaaatcatttgaggacattcatcattaccgggagcagataaagcgagtaaaagattccgaggacgtgcccatggtactggtgggcaataagtgtgatctgcccagccgcaccgttgacaccaagcaggcccaggacttggctagatcctatggaatccccttcatagagacatctgccaaaacaagacagagagtggaggacgcgttttataccttggtccgagaaatcaggcagtatcggctgaagaagatttccaaagaagagaaaacaccaggatgcgtcaagataaaaaagtgcattataatgtag

SEQ ID NO: 26957 - DNA, 567 bp, Artificial Sequence
  Description of Artificial Sequence: Synthetic coding sequence
atgaccgagtacaagctggtggtggtgggcgccggcggcgtgggcaagagcgcactgacgatccagctgatccagaatcactttgtggacgaatatgatcccacgatcgaagatagctaccggaaacaggtcgtcatagatggcgaaacgtgcctgctggacatcttggacacagccggccaggaggaatactctgctatgcgcgatcagtacatgagaactggagaggggtttctgtgtgtatttgcgattaacaatacgaaaagcttcgaggatatccaccactacagggaacaaattaaacgtgtcaaagatagcgaagatgtaccaatggtccttgtggggaacaaatgtgacctgccgtcacgcactgtggacactaaacaggctcaggatctggctcggtcctatgggattccttttatcgaaacctcggccaagactagacagggcgtcgatgatgcgttctacaccctggttcgcgaaattaggaagcataaagaaaagatgtcaaaggacggcaaaaagaaaaagaaaaagtctaagaccaagtgtgtgataatgtag

SEQ ID NO: 26958 - DNA, 228 bp, Artificial Sequence
  Description of Artificial Sequence: Synthetic coding sequence
atgaccgagtacaagctggtggtggtgggcgccggcggcgtgggcaagtctgccctgactattcagctcatccagaaccacttcgtcgatgaatacgatccaacaatcgaaggcgtggacgatgcattttacacactcgtgcgcgaaattcggaagcataaagagaagatgtccaaggacggaaaaaaaaagaaaaagaaaagcaaaaccaagtgcgtcatcatgtag

SEQ ID NO: 26959 - DNA, 2931 bp, Artificial Sequence
  Description of Artificial Sequence: Synthetic coding sequence
atgcggggcgcccggggcgcctgggacttcctgtgcgtgctgctgctgcttctgagggtgcaaactggatcatctcagccaagcgtgagtccaggcgagccctcgccacccagcatccatcccggtaagtccgatctcattgtaagggtgggggacgagatcaggctattatgcaccgacccaggctttgtgaagtggacgttcgaaatcctggatgagactaacgaaaataaacaaaatgagtggatcaccgagaaggccgaggccaccaatactggaaaatacacttgtaccaataaacacggactgtccaattccatctacgtattcgttcgggaccctgcaaagctgtttctggtcgaccgaagcctgtacggtaaggaggacaatgacaccctggtgcgctgtccactcaccgacccagaagttacgaactacagcctcaaggggtgtcagggcaagcccctcccaaaagacctgcgatttatcccagatccgaaggccggcattatgataaaaagtgtaaaacgggcctatcatcgcttatgcctgcactgctccgtcgatcaagaaggtaaaagtgttctgtccgaaaagttcattctgaaagtgcgacccgcgtttaaggccgtccccgtcgtgtctgttagtaaagcaagctacttactccgagagggcgaagagttcacggttacctgcacaatcaaggacgtcagctcttcggtatatagcacctggaagcgcgagaactctcaaaccaagctgcaggaaaagtacaattcctggcaccacggcgattttaactacgaaagacaagccaccctcaccatctcttctgcaagagtgaacgattcgggagtgtttatgtgctatgctaataatacgttcgggagcgcgaacgtaaccacgacgttggaggtagtcgataagggattcattaatatatttccgatgattaataccacagtgtttgtgaatgacggtgagaacgtggatctgattgtggaatatgaggcctttcccaagccggagcaccagcagtggatatatatgaatagaacctttactgacaaatgggaagattatcctaaatcggagaatgagagtaacatcaggtatgtatccgagttgcatctcacgaggctcaagggcaccgagggcggtacttacacgtttcttgtctccaactctgatgtgaatgccgccattgcattcaatgtgtatgtcaacaccaagcccgagattctgacgtacgaccggctggtcaatggtatgctgcagtgtgtcgctgccgggttcccggagccaaccatagattggtatttctgtccaggcacagaacagagatgctctgcatctgttttgcctgtggatgtccagacactgaattcatccggacctccctttggtaagttggtcgtacagtcaagtatcgattctagcgcctttaagcacaatggcactgttgagtgcaaagcttataatgatgtcggaaaaaccagcgcctacttcaatttcgcgttcaaggggaacaataaggagcagatccacccacacacacttttcacgccattactgatcggattcgtgatagtggccggaatgatgtgcatcatcgttatgattctcacatataaatacttgcaaaagcctatgtacgaggtgcaatggaaggtggtcgaggagataaatgggaataattatgtgtatattgatccaacacagcttccttacgatcataaatgggaattcccgcggaaccgtctttctttcggaaaaacccttggcgccggagcatttggaaaagtggtcgaagccaccgcatacggccttataaaaagcgatgccgccatgaccgtagccgtcaaaatgttaaagccctctgcacatctaaccgaacgagaggccctcatgtcggagctcaaagtgttgtcctacctgggcaatcatatgaatattgtaaatcttttgggggcctgtacgattggcggcccgactctagtgattactgagtactgttgctatggggatttgctaaatttcttgcggaggaaaagggacagctttatttgcagcaaacaagaagatcatgctgaagcggccctatacaagaatttgctgcactctaaggagtccagttgctcggactctaccaacgaatatatggacatgaagccgggcgtctcttacgtggtgccaactaaagccgacaaacgtagatcagtccgtattggaagttatattgaacgtgacgtgacacccgcaatcatggaggatgatgaactggcactggatttggaagacctgctctcttttagctaccaggtcgccaaaggaatggcattcctggccagcaagaactgcatccaccgcgatctggcggctcgtaacatcctgcttacccacggacgtattaccaagatttgcgatttcgggctggccagagatatcaaaaacgatagcaattacgtggtgaagggcaacgctaggctgcccgtgaagtggatggctcctgagtcgatattcaactgcgtgtatacttttgaaagcgatgtgtggagttatggcatttttctgtgggaattgttctctctcggaagtagcccgtatcctgggatgcctgtggacagtaaattctataagatgataaaggagggcttcaggatgctctcacctgagcatgctccagctgagatgtatgacattatgaaaacgtgctgggacgctgacccactgaaacgtccaacatttaagcagattgtgcaattaattgagaagcagatatcagagtctactaatcacatttatagtaacctggctaattgctccccgaatcgacagaagcccgtggtggatcattccgtccgcatcaatagtgtaggcagtacagcaagctctagccagcccctgctcgtccacgacgatgtttag

SEQ ID NO: 26960 - DNA, 2919 bp, Artificial Sequence
  Description of Artificial Sequence: Synthetic coding sequence
atgcggggcgcccggggcgcctgggacttcctgtgcgtgctgctgctgttgctacgagtccagacaggttcttctcagccatcagtaagtccgggagaaccaagtcctccctctatccaccctggcaagtcagacttaatcgtgcgagttggtgatgaaatcaggttactgtgtaccgatccaggatttgtcaaatggaccttcgagattctggatgagacgaatgagaacaaacagaacgaatggatcacggagaaggcggaggccacgaataccggaaagtacacatgtacgaataagcacggtctaagcaactctatctacgtgttcgtgcgcgatcccgccaagctgttcctcgtcgatcgttccctgtacggaaaggaggataacgacaccctggtaaggtgccctctcacggatcccgaggtgacgaactatagtctgaagggatgtcagggtaaaccattacccaaggacctgcgcttcattcctgatccaaaggccggaatcatgatcaagtctgtgaagagggcctaccataggctctgcctgcactgtagcgttgatcaggagggtaagagcgtactcagcgagaaatttatcctgaaggtgcgccctgccttcaaagccgtccctgttgtctccgtgtcaaaagcctcgtatttactgcgggagggagaggaatttaccgtgacgtgtacgataaaggacgtgtctagtagtgtctacagtacgtggaaacgggagaacagccagactaagttgcaggaaaaatataattcctggcatcatggagattttaactatgagcggcaagccaccctcacaatctcatctgcccgagtgaacgacagtggcgtgttcatgtgctatgcaaataatacatttggttccgcgaacgttactacaaccttggaggttgtggacaaagggtttattaacatttttcctatgattaatactactgtattcgtcaatgacggcgaaaacgtcgatttgatcgtggagtatgaggcatttcccaaaccggagcaccagcagtggatatatatgaatcgcactttcacagacaaatgggaggattacccaaagtctgagaatgaaagtaatatacgttatgtgtctgagctgcatctcacaagactcaaaggcaccgaaggaggtacttacacctttctcgtgagcaactccgatgtcaatgccgctatcgctttcaatgtgtacgtcaacaccaagccagagattctcacctatgatcgcctggtgaatgggatgcttcaatgcgtggctgcaggcttccctgaacccactattgactggtatttttgcccaggcactgagcaacgctgctccgcctctgttctgcctgttgatgttcaaacgcttaacagtagcggtcctcccttcggtaagctggttgttcagagctccatagatagtagcgcatttaaacacaacggcaccgttgagtgcaaagcctacaacgatgtgggcaaaaccagcgcttattttaatttcgcctttaaagagcagattcacccccacacactatttacgccacttctcattggctttgttattgtagccggtatgatgtgcataatagtgatgatcctcacttataaatacctacagaaacctatgtacgaggtacaatggaaggtggtagaggaaattaatgggaataattacgtgtacatcgatcctacacaattaccctatgaccacaaatgggagtttccccggaataggctctcatttggaaaaacgctcggtgccggagctttcgggaaagtcgtagaggctaccgcttacggcctcatcaagagtgatgctgccatgacagtggcagtgaaaatgttaaaaccctcggctcacctaaccgaacgtgaggctctcatgagcgagttaaaagtcctgagttacctgggaaatcatatgaacattgtcaatctcttaggggcttgcacaatcggtggacctacccttgtgatcaccgagtattgttgttacggcgatctcttgaactttctccgtaggaaacgggacagctttatttgctctaagcaggaggaccacgctgaagccgcattatacaagaacctgcttcatagtaaggagtcaagttgctcggactctaccaatgagtacatggacatgaagcccggcgtaagctacgtggtgcccaccaaggctgataagaggaggtctgtgaggatcggctcgtatatcgagcgtgacgtgacgcctgccatcatggaagacgatgaattagcgttggacctggaggaccttcttagctttagctaccaggtggccaaaggaatggctttcctggcaagcaaaaactgcatccacagggatttggctgccagaaatatccttctgacccatgggcgtatcacaaagatctgcgacttcggcctcgctagggacatcaagaacgatagtaactatgtcgtgaaaggcaatgcccgcctcccagtgaagtggatggcgcccgagagcatcttcaattgcgtatacacctttgaatccgatgtgtggagttatggcatttttctctgggaacttttctcactgggctctagcccgtaccccggcatgccagtcgatagcaagttctacaagatgatcaaggaaggcttcaggatgctgagcccagaacatgcgcctgccgaaatgtatgacattatgaagacatgttgggacgcagaccccttgaagagacccactttcaagcagatcgtgcaactcattgagaaacagatcagtgagagcacaaaccacatctactcgaacctggccaactgtagcccgaacaggcaaaagccagttgtggatcattctgtccggatcaactcggtgggtagcacagcttctagtagccagccactgttggtgcacgatgacgtgtag

SEQ ID NO: 26961 - DNA, 1242 bp, Artificial Sequence
  Description of Artificial Sequence: Synthetic coding sequence
atgcggggcgcccggggcgcctgggacttcctgtgcgtgctgctgctgttactccgagtccagaccggttcaagccaaccttctgtgagcccaggggagccgagtcctccaagcatccatcctggcaagtccgacctaatagtacgggtcggcgatgaaattcgattgctatgcactgacccaggattcgtaaagtggacttttgagatcttggatgagacgaatgagaacaagcagaatgaatggatcacggaaaaagcagaggcgaccaataccgggaagtatacgtgtactaacaaacatgggctgtcaaatagcatctatgtgttcgtccgggaccctgctaaactcttcctggtcgaccgttccctttatggcaaagaggacaacgatacactggtgcgttgcccgctgacagatccggaagtaactaattatagtctaaagggctgtcaaggaaagccattacccaaagatttacggttcatcccagaccccaaagctggtattatgatcaaaagcgtgaagcgggcgtatcatcggttgtgccttcactgctcggtggatcaagaaggcaagagcgtgctctcagagaagtttatcctcaaagttaggcctgctttcaaggctgttccagtagtgtcagtgtctaaggcctcttatctgttgagggaaggtgaggagttcactgtcacttgcaccatcaaggacgtgtccagctctgtgtatagcacctggaaacgcgagaattcccagacgaaactgcaagagaagtacaactcctggcaccacggggattttaactatgagcggcaagccaccctgacaatctcatctgctcgcgtgaatgattctggagttttcatgtgttatgctaacaacacgttcggcagtgctaatgtgactactaccctggaagtggtggataagggattcatcaatatattcccgatgattaacaccaccgtgttcgttaacgacggtgaaaatgtcgacctcatcgtcgagtatgaggcctttcctaagccggagcaccagcagtggatctatatgaatagaacatttactgacaaatgggaagattatcccaagagtgaaaacgaatctaatattcggtacgtctctgaattacacctgacacgcctgaaaggtacagaggggggcacctatacttttctagtgtccaacagcgacgtcaacgccgcaatcgcgtttaacgtgtacgttaatagtaaattatag

SEQ ID NO: 26962 - DNA, 1212 bp, Artificial Sequence
  Description of Artificial Sequence: Synthetic coding sequence
atggccagcgagctggccatgagcaacagcgacctgcccaccagccctctggccatggaatacgtgaacgatttcgacctcatgaagtttgaagtgaagaaggaacctgtcgagaccgataggataatttcccagtgtggcagactcattgccggaggatcactgagcagcaccccaatgtcgactccgtgttcgagcgtccctccaagccctagcttctccgcccccagtccagggagtggttcggagcaaaaagcgcatctggaggattattactggatgaccggatacccccaacaactcaatccagaggcattaggattttctccagaagatgcagtggaagcgttaattagcaattcacaccagctgcaaggcggctttgacggctacgctagaggcgcccagcaactggccgcagctgctggtgccggcgccggtgctagtctgggcggctcaggggaggagatgggcccggctgctgccgttgtaagtgcggtaatcgccgcggccgcggctcagtctggtgccggaccacattaccaccaccatcaccaccatgctgcgggacaccatcatcacccaaccgcaggcgcccccggagctgccggatcagcggccgcctccgcagggggtgcaggtggagccggtggcggaggaccagcgagtgcaggcggcggcggcggcgggggcggaggaggaggtgggggcggagccgcaggggcaggaggagctctacatccgcaccacgccgcaggagggctgcactttgatgatcgtttctcggatgaacaattggttaccatgtcagtccgagaactaaatagacaactgagaggtgttagtaaggaggaagtcatccgattgaaacagaaacggcggacgctaaaaaaccgaggctatgcccagagctgtcgatttaagcgagttcaacagcgtcacgttttggagtcggagaagaaccagcttctccagcaggtagaccacctaaaacaagagatctccaggctagtgcgcgagcgggatgcctataaagagaagtatgaaaagttggtcagctccggatttcgtgagaacggcagcagttctgataatcccagctctccagagtttttcatcacagagccaacaagaaaactcgaaccttcggtggggtatgccaccttttggaaaccgcagcacagagttcttacttcagtctttacgaaatag

SEQ ID NO: 26963 - DNA, 1122 bp, Artificial Sequence
  Description of Artificial Sequence: Synthetic coding sequence
atggccagcgagctggccatgagcaacagcgacctgcccaccagcccgctcgccatggagtatgtaaacgacttcgatctgatgaagttcgaagtgaagaaggagcctgtggagacagaccgcatcatcagccagtgcggtcgtctgatcgccggcgggagcttaagttcaacccccatgagcacaccttgtagttcagtgccccctagtccatccttctctgctccatctccagggtccgggagcgagcaaaaagctcatctggaggattattactggatgacgggttatccacagcagctcaacccagaagctctaggattttcacccgaagatgcagtggaggccttgattagcaactctcatcagttgcaagggggctttgacgggtacgcaaggggggcacaacagttggctgccgccgccggcgctggggccggagcatccctgggaggcagcggtgaagagatgggtccagctgccgcagtggtttctgcggtgattgctgcagccgcggcccagagcggcgccgggccacattaccatcaccatcatcaccacgccgccgggcaccaccatcatccgaccgcgggggcacccggtgccgcagggtcagctgctgcaagcgctggaggagccggcggcgccggaggagggggccccgctagcgccgggggaggagggggcggcgggggcgggggcggtggcgggggcgcagctggggccggaggcgcactgcatccacatcatgctgccggcggactgcactttgatgaccgattctcggatgaacagcttgttactatgagcgtgcgggaactcaatagacagctgaggggggtatctaaagaggaggttatcaggctgaagcaaaaacgcagaacactgaaaaacagaggatatgcccaatcctgccggttcaaacgggtccagcagcgtcatgtgttggagtcagagaagaatcagctgctccaacaggtagatcacttaaaacaggaaatcagcagactggtgcgggaaagggacgcttacaaggaaaagtacgaaaaactagtgagtagtgggtttcgcgaaaacgggtctagcagcgacaacccttctagtccagagtttttcatgtag

SEQ ID NO: 26964 - DNA, 1062 bp, Artificial Sequence
  Description of Artificial Sequence: Synthetic coding sequence
atggccgccgagctggccatgggcgccgagctgcccagcagccccctggccatagaatacgtgaacgattttgacttaatgaagttcgaagtgaaaaaggagcccccagaggctgaaaggttttgccatcggttacccccaggtagtttgtccagtactcctctgtcaactccatgttccagtgtcccctctagtcctagtttctgcgctccctcccctggtaccggaggcggcggcggggctggtgggggcgggggcagctcacaggctgggggggcccccggccccccttcgggcggcccaggcgcagtcggaggaactagtggtaaacctgctctcgaggatctgtattggatgtccgggtaccagcaccaccttaatccagaagccctgaacctcacaccagaagacgccgtcgaagccttaatcggtagtggccatcacggagcacaccacggagcccatcatcctgccgcagcagccgcttatgaagcgttccgcggccctggctttgctggaggcgggggagctgacgatatgggcgctggccatcaccacggcgcccatcatgcagcgcatcaccaccacgctgcccatcaccaccatcatcatcaccatcaccacgggggagccgggcatggcgggggagccggacaccacgtccgtttagaggagagattctccgacgatcagttggtttcaatgtctgtgcgggagctgaatcggcaactgcgcgggttcagcaaggaggaggttatccggctaaaacaaaaaaggcgcaccctgaagaaccgcggctacgcccaatcctgcagattcaaacgtgtccagcagcggcatatcctagagtccgaaaagtgtcagctccaatctcaagtggagcagctgaagcttgaggtcgggaggctggccaaggagcgtgatctgtataaggaaaaatacgagaaacttgcaggccgaggggggcccggaagcgctggaggagcggggtttccaagagaaccaagcccaccccaggctggtccaggcggggccaaggggactgccgattttttcctttag

SEQ ID NO: 26965 - DNA, 972 bp, Artificial Sequence
  Description of Artificial Sequence: Synthetic coding sequence
atggccgccgagctgagcatgggccccgagctgcccaccagcccccttgccatggagtatgtgaatgattttgatctgttgaagttcgatgtgaaaaaagagcccctaggaagggcagaaaggcccggacgcccctgtacccgtctgcagcccgccggctccgtttcctccactcccctctccactccgtgcagttccgtgcctagttcaccttcattctcaccgacagagcaaaaaacccatctcgaagacttatactggatggccagtaactatcaacaaatgaaccccgaagcccttaacttaacgccggaagatgctgttgaggctttaatcggtagtcatcctgtgccccaacccttacagtcattcgactccttcagaggcgctcaccaccatcaccatcatcaccacccccatccccaccacgcttatcccggtgccggcgttgcccacgacgaactgggccctcacgcccacccacatcatcatcatcaccatcaggcctcccccccaccctccagcgcagcatcacccgcccaacagctgccaacttcacatcctgggccaggccctcacgcaacagcttcagccactgctgccggaggtaacggttccgtagaagaccgcttttctgacgatcagctagtcagcatgtccgtccgggagttaaatcggcacttgaggggctttactaaggatgaggtgattcgcctaaagcagaagcgaagaacactgaaaaaccgtggctacgcccagtcttgtagatataaaagagtccaacagaagcatcacttggagaatgagaagacccagctgatccaacaggtcgaacagctcaaacaggaggtctcccgcctagccagagaaagggatgcatataaagtcaaatgcgaaaagctggccaattctggatttcgcgaggccggcagtacttctgactcaccttcctcccccgagtttttcctatag

SEQ ID NO: 26966 - DNA, 972 bp, Artificial Sequence
  Description of Artificial Sequence: Synthetic coding sequence
atggccgccgagctgagcatgggccccgagctgcccaccagccccctggctatggagtatgtcaacgatttcgatctccttaagtttgacgtgaagaaggagcccctgggccgcgccgagagacctggccggccatgtactagactgcagccagccggaagcgtgtcaagtacccctctctcaactccctgctccagtgtcccgagtagcccctctttcagccccacagagcagaaaacccatctggaggacctgtattggatggctagtaactatcagcaaatgaaccctgaagccctcaatctgacgccggaggacgcggtggaagcgttaattggttctcaccctgtgcctcaacctttgcagagtttcgattcttttaggggggctcaccatcatcaccaccaccatcatccacacccccatcatgcctacccgggagcaggtgttgcccacgacgaactcggaccgcacgcacatccccaccatcaccaccaccaccaggccagcccacccccatcttccgctgcctccccagctcaacagcttcccacatctcaccctgggccagggcctcacgccacagcgtctgcaactgcagcgggtggaaatgggtctgtggaggatagattttcagatgatcagctggtcagcatgagtgtgcgcgagcttaatagacacctgcggggattcacaaaggatgaggtcattcgcctgaagcaaaagagaaggacactcaaaaatcggggatatgcacagagctgtcgctacaagcgggtgcaacagaagcaccacctggaaaacgagaaaactcaactcatccagcaggtggaacaactcaaacaggaggttagcagattagctagagagcgggacgcatacaaggttaagtgcgaaaagctcgccaattcaggcttccgggaagcagggtcaacatccgacagtccatcgagtcctgaattcttcctatag

SEQ ID NO: 26967 - DNA, 1233 bp, Artificial Sequence
  Description of Artificial Sequence: Synthetic coding sequence
atggccaagcggagccggagcgaggacgaggacgacgacctgcagtacgccgatcacgactacgaagttccacagcaaaagggcctgaaaaaattgtggaatcgggtgaagtggacacgggatgaggatgataagctcaagaaactggttgagcagcacggaacagacgactggaccctcatcgcctcccatctacagaatcgtagtgattttcagtgccaacatcgctggcaaaaggtgctaaatcctgaactgatcaagggtccttggactaaagaagaagaccagcgagtcatcgagcttgtccagaagtatggcaagaagagaaagatgcgcgtgggtcacagtccagggagcgaattaagggacgggagcctaaatgacggtggcaacatggctctcaaacatacacctctcaaaacactgcccttttcacctagccaattttttaacacatgtccgggaaacgagcagctgaacatagagaatccatctttcacttctactcctatctgtggacagaaggcactgataactactcctctccataaagagaccactcccaaggaccagaaggagaatgtcgggttcaggacacccacaattagacggtctatactgggcacgacaccccgcacccccactccattcaaaaacgcactggccgctcaggaaaaaaagtatggccccttaaagatcgtcagccagccacttgcattcctggaggaggatattcgggaggtgctgaaggaagaaacaggcaccgacctgttcttgaaagaggaggacgagcccgcctacaagtcttgtaaacaagagaatacggctagtggcaaaaaggttaggaagtctttggtgctcgataactgggagaaagaagagtctggcactcagctgcttaccgaagatatttcagatatgcagtctgaaaatcgttttactacgagccttctgatgatccctttgcttgagatccatgacaataggtgcaatttgattcctgagaaacaggatataaatagcacgaacaagacctatacgctcaccaagaagaagccgaaccccaatacgtctaaggtggtaaaactggagaagaatttacagtcaaactgcgaatgggagacagtcgtgtacggcaaaaccgaggaccagctgatcatgactgagcaggccagaaggtatctctccacatacactgctacaagtagcaccagtcgggcacttatactgtag

SEQ ID NO: 26968 - DNA, 2259 bp, Artificial Sequence
  Description of Artificial Sequence: Synthetic coding sequence
atggccaagcggagccggagcgaggacgaggacgacgacctgcagtacgctgatcacgattatgaagttccccagcagaagggtctaaaaaagttatggaacagagtgaaatggaccagagacgaagacgataaactcaaaaaattggtcgagcagcatggaactgatgattggactctaattgcatctcacctacagaatcggtctgattttcagtgtcagcatagatggcagaaggtcctgaaccccgagctgatcaaaggtccttggacaaaggaggaagatcagagagtgatcgaactggtgcagaagtacgggccaaagcggtggtctttaatcgctaagcacttaaagggtaggattggcaagcagtgtagggaacggtggcacaatcatctcaatcccgaagtcaaaaagagctcgtggactgaggaggaggatcgcattatctatgaagcccacaaaagactggggaataggtgggctgagatcgctaagctactgcccggaaggactgataactctattaagaaccattggaacagtacaatgcgccggaaagtggagcaagaagggtacttgcaggacggtataaagtcagaacgatcaagttccaagcttcagcataagccctgcgctgcaatggatcatatgcagactcaaaaccaattttatatccccgttcagatcccaggctatcagtatgtatcaccagagggcaattgcatagaacacgtccagcccacaagtgcgttcatccagcagcccttcatagatgaggatcccgataaggaaaaaaagatcaaggagctggagatgctgctaatgtcagccgaaaatgaggtgcgcagaaagcgcattccctctcagcccggatcatttagcagctggtccgggtcatttctcatggatgataatatgagcaatacacttaacagtctcgatgagcatacatccgagttctatagcatggacgagaaccagcccgttagtgcacagcagaatagtccgaccaagttcctggccgtcgaggcgaatgccgtgctgagctcactgcagacaattccggagttcgcagagaccctggagctgatcgaatccgacccggtcgcgtggtccgatgtcacatcattcgacataagcgatgcggctgcttctcccattaagtctacccccgtaaaattgatgcggatacagcacaatgaaggggccatggaatgccaatttaacgtctctttggtgcttgagggcaagaagaacacctgcaacggtggaaacagtgaagcagtaccactgaccagtcccaacatagccaagttctctacccctcccgctattctgcggaagaaaaggaaaatgagggttggacattccccgggatctgagctgagagacggctccttaaatgacggcggcaacatggctcttaaacatactcccctcaaaactttacccttctcccctagccagttctttaacacttgccctggcaacgaacagctgaatatcgaaaatccgtcctttactagcactccaatatgtggtcagaaagcgctaattacaacccccctacacaaggaaacgacgccgaaagaccagaaggagaatgtggggttccggactcctacaatcaggagatctatcttaggcacaacacctcgcacaccaacccctttcaagaatgcattggccgcgcaggagaaaaaatatggcccactaaagattgtgtctcaaccgctcgcgtttctggaagaagacatcagggaggtgctcaaagaggagacgggaacagatctctttttgaaggaggaagacgagcccgcctacaagagctgtaaacaggaaaataccgccagtgggaaaaaagtccggaaatccttggtgcttgataactgggagaaggaggaaagtgggacgcagctcctaaccgaggatattagtgatatgcaatccgaaaataggtttactacgtcactactgatgatccctctgctggaaattcatgacaatcggtgcaatttgataccggagaagcaagacatcaactccactaacaagacctatacactaaccaaaaaaaagcctaaccccaatacttcgaaagtggtgaagctcgagaaaaacctgcaaagtaattgtgaatgggaaactgtggtgtacgggaagactgaggatcagttgattatgacagagcaggcacgcaggtacctcagcacttacacagccacgtctagcacctcacgcgcactgatcctgtag

SEQ ID NO: 26969 - DNA, 2079 bp, Artificial Sequence
  Description of Artificial Sequence: Synthetic coding sequence
atggccaagcggagccggagcgaggacgaggacgacgacctgcagtacgcggaccacgattacgaggtcccccagcaaaagggtctgaagaaactctggaaccgtgtgaagtggactcgggatgaggacgacaagctaaagaagctggtagagcagcacggcactgacgactggacgctgattgcctcacatcttcagaacagaagcgatttccagtgtcagcaccggtggcagaaggtgttgaacccagagcttattaaaggcccatggactaaggaggaggaccagcgtgttattgaactcgttcagaaatacggccccaaaaggtggtcccttatcgccaaacatcttaaaggtcgaattggcaaacaatgccgggagcgctggcacaaccatctgaaccccgaggtcaaaaaaagttcctggacagaagaagaagataggataatctatgaggctcataaaaggctcggcaaccgttgggcggaaatagccaagttacttcccgggagaaccgacaacagtattaagaatcactggaattcaactatgaggcggaaggttgaacaggagggctacctgcaggatgggatcaagagcgaacggtctagttccaagttgcagcacaagccctgtgctgccatggaccacatgcaaactcaaaaccaattttatatccccgttcagataccagggtatcagtacgtgtcaccggaggggaactgcatcgaacacgtgcagccaacaagcgctttcatccagcaaccattcatcgatgaagatcctgacaaagaaaaaaaaattaaggaactggagatgctgctcatgtcggcagagaacgaagtccgcaggaaacggattccttctcagccaggcagtttcagctcatggagtggttcctttttaatggatgacaacatgtcaaatactctgaacagcctggatgaacatactagcgagttctacagcatggacgagaaccagcccgtttccgcacagcagaacagtcctactaaattcctggccgttgaggccaatgccgtgctaagctctctgcagaccataccagagtttgccgagaccctggagttgatagagagcgacccagtggcctggtcagacgtcacatccttcgacatcagcgacgccgcagctagtcccattaagtctacacccgtgaagcttatgcgaatccagcataacgaaggagccatggaatgccagttcaacgtgtcattagtgctggaagggaagaaaaatacatgtaacgggggaaacagcgaggctgtgccactcaccagcccgaacatcgctaagttctcgacccctcccgctatactccgaaaaaagagaaaaatgagagtgggtcactctcctggctccgagcttcgcgacggatcactgaacgacggtggtaacatggccctgaaacacacccctcttaagacattacccttttcaccatctcagtttttcaacacatgcccgggcaatgagcagcttaatatcgagaatccctcatttacgagcacacctatttgcggccaaaaagcactcattacaacacctctgcacaaggagacgacaccgaaagatcagaaggagaatgtgggcttcagaaccccaacgatacgccgcagcatcctgggaacaacccctcgcacacctacaccctttaagaatgctcttgccgcacaggaaaaaaagtacggaccgttgaaaatcgtgtcccaaccacttgctttcctggaggaggacatacgggaggtgctgaaagaggagactggcacagacctgtttctgaaggaagaagacgagcccgcatacaagagctgcaagcaggagaatacagccagcggcaagaaagtgcgaaaaagtttagtactggataactgggaaaaagaggagtccggtacgcagctgctaacagaagatatatccgatatgcagtcgaattgcgaatgggaaaccgttgtatatgggaaaactgaggatcagctcatcatgacggaacaggccaggagatatctgtcaacctacaccgcaacttctagtacaagccgggccctgatactctag

SEQ ID NO: 26970 - DNA, 711 bp, Artificial Sequence
  Description of Artificial Sequence: Synthetic coding sequence
atgtgcgtgtgcgccggctgccgggccgcccccagccggcggggcgcaggaccacttcaagtcgctggtggctggtccgaaggcgctgacatggattatgattcttaccagcactatttttacgactatgactgtggcgaggatttttacagaagcacggcacccagcgaagacatttggaagaagttcgaactagtcccctccccccctacaagcccaccctgggggctgggccccggagctggggatcctgcgcctggtatcggccccccagagccttggccaggtggctgtacaggcgatgaggcagagagccgcggccactccaaaggatggggcagaaactacgcttcaattataagacgggattgcatgtggagtgggttctctgctagagagcgcctggaacgagcggtgagtgaccgtctggcgccaggcgcgccccgcgggaaccctcccaaggctagtgctgctcctgactgcacgccgtccctggaagccggaaatcctgcacccgcggcaccatgtcccctgggagagccaaaaacacaggcatgctccggctccgagtctcccagcgatagcggcaaggatttgcctgagccctcaaagcggggacctcctcacggttggcctaagctgtgcccttgccttcgctccggaattggttccagccaggccctcggtccttccccccccctatttgggtag

SEQ ID NO: 26971 - DNA, 1095 bp, Artificial Sequence
  Description of Artificial Sequence: Synthetic coding sequence
atggactacgacagctaccagcactacttctacgactacgactgcggtgaggacttctacagatctacggctccttctgaggacatatggaagaagttcgaactagtgccgtcccctcccacgagtcctccatggggattagggccgggcgctggcgatcccgcgcccggcatcgggcctccagagccttggccagggggctgtaccggggatgaggcagagagcagaggacactcaaaaggctggggaagaaactatgcttcaattattcggcgcgactgcatgtggtccggcttcagcgcgcgtgagcgactcgagcgggcagtgtccgatcgtctggcacccggcgcccctcgcggaaatccacccaaggcgagcgccgcacctgactgcacgccctccctcgaggcaggcaaccccgctcccgctgccccttgtccgctgggtgaaccaaaaacccaggcctgtagcgggagtgagtctcctagcgatagtgagaatgaagaaatagatgtggtcaccgttgaaaagcgacaatcactaggaatcaggaagccagtgaccataacagtcagagccgatcctctggacccttgtatgaagcattttcatatctcaattcaccagcagcagcacaattacgcagcgaggttccccccggagtcttgctctcaggaggaggcctccgaacggggcccccaggaggaggtgctcgagagagacgcggctggcgagaaagaggatgaggaggacgaagaaattgtgtctcccccgcccgtagaatctgaggctgcacagtcttgccatcccaaacccgtttcctccgacaccgaggacgtgaccaaaagaaagaatcacaatttcctggagcgcaagcggagaaacgacctgcggtcaagatttcttgccctccgagatcaggtccccactctggcgtcttgttcaaaagccccaaaagttgtaatcctttccaaggcccttgagtacttacaggccctggtcggagctgaaaagaggatggcaacagaaaagcgccaattgagatgtagacagcagcagctgcaaaagagaattgcctatctgacaggctactag

SEQ ID NO: 26972 - DNA, 1185 bp, Artificial Sequence
  Description of Artificial Sequence: Synthetic coding sequence
atgtgcgtgtgcgccggctgccgggccgcccccagccggcggggcgctggccctctccaggtagcaggggggtggagcgagggggcggacatggattacgatagttaccagcattatttctatgattacgattgtggggaggatttttaccggtcgactgcaccatcagaggacatctggaaaaaatttgagctggtgccttcacctcctaccagtcctccatgggggctggggcccggcgcgggcgatcctgcccctgggataggcccgcctgagccgtggcctggtggctgcacaggagatgaggctgagtccaggggtcatagcaaaggttggggccgcaactacgcttccatcatccgcagagattgtatgtggtctggattctctgcccgggaaaggctcgaacgcgccgtgagtgatcgtctagcccctggggcgccgcgtggcaatcccccaaaagcctccgccgccccagactgcaccccaagcctggaagccggcaatcccgcgcctgcggccccctgtccccttggcgaacccaaaacccaagcatgttctggatccgagtctccctctgacagcgagaacgaggagattgatgtcgtcaccgtcgaaaagcggcagtcccttggcatcagaaagcctgtgaccattacagtgagagccgaccctctcgacccctgtatgaagcattttcatattagcattcatcaacagcagcacaattatgccgcccgcttccctccggagtcctgctcgcaagaagaggcgagcgagaggggccctcaggaggaggttcttgaaagagacgccgcaggagaaaaagaagacgaggaagacgaagagatcgtcagtccacctccggtggagagcgaggcggctcaatcatgtcatcccaagcccgtctcttcagacactgaggatgtcactaagagaaagaatcacaacttcctagagcgcaaaagacgcaatgaccttcgatcgcgattcctggctctgcgggatcaagtgccaaccctggcttcctgctccaaggctcctaaggtggtgatcctaagtaaagccctggaatacctccaggcgctcgtaggagccgaaaagcgaatggccacagaaaagcgtcagctgcggtgcagacaacagcaattacaaaagcgcatcgcctatttaacgggctactag

SEQ ID NO: 26973 - DNA, 621 bp, Artificial Sequence
  Description of Artificial Sequence: Synthetic coding sequence
atggactacgacagctaccagcactacttctacgactacgactgcggcgaagacttctatcgaagtacagctccctcagaggacatctggaaaaagttcgaactggtaccttctccgcctacatctccaccctggggtctgggaccaggagccggagacccagctccagggatcggcccacccgagccctggcccgggggctgtacaggcgatgaagctgagagccgcggacactctaagggctgggggagaaattacgcttccattatccgcagagactgcatgtggagtgggttttccgctcgggagagactggagcgggcggtgagcgatcgcctggcccctggggccccgcgggggaatcctcctaaagccagcgcagcccccgattgcacaccatccctcgaggctggtaatcctgccccagctgcaccgtgccccctgggcgaaccaaagacgcaggcttgttctggctctgagagccctagcgattcaggcaaagatctcccagaacccagcaagagaggacctccccacggctggccaaagctgtgtccctgtttacggagcggaattgggagttcacaggccctaggaccttctccaccactcttcggctag

SEQ ID NO: 26974 - DNA, 303 bp, Artificial Sequence
  Description of Artificial Sequence: Synthetic coding sequence
atggactacgacagctaccagcactacttctacgactacgactgcggggaagacttttataggtctaccgcccctagcgaagatatttggaaaaagtttgagctggttccttctccccccacaagtcccccctggggattaggccctggagctggagatcctgcgcccggcatcggacccccagagccctggccgggaggctgcacgggcgatgaagcagaaagcagaggccacagcaagggctgggggcggaattacgcctccattattaggcgtgattgtatgtggtccgggttcagttag

SEQ ID NO: 26975 - DNA, 642 bp, Artificial Sequence
  Description of Artificial Sequence: Synthetic coding sequence
atgccccggcgggccgagaactgggacgaggccgaggtgggcgccgaagaggcaggggtcgaagagtatggacctgaagaagacgggggtgaggagtccggcgctgaagaatccggtcccgaggagagtggccccgaggaactgggagctgaagaggagatggaagctggacggccccgccccgtactgcggagcgttaactctagggaaccttcacaggtgatcttttgcaaccggagccctcgcgtagtgctaccagtatggctcaacttcgatggtgagccacagccatacccaactctaccgccaggcacaggtcggaggatccacagctaccggggccacctctggctctttagagatgcgggcacacacgacgggctactggtgaaccagaccgaattattcgtgccctccctaaatgttgatggacaacctatctttgctaacatcaccctgcccgtgtacactttgaaggagcgctgcttgcaggtcgtacgctccttagtcaaacctgagaattaccgacgactcgacatcgtgcggtccctgtacgaagaccttgaagatcatccaaatgttcaaaaggatctcgagagattgactcaggaacggattgctcatcagcggatgggcgactag

SEQ ID NO: 26976 - DNA, 519 bp, Artificial Sequence
  Description of Artificial Sequence: Synthetic coding sequence
atgccccggcgggccgagaactgggacgaggccgaggtgggcgccgaagaggctggagtggaggagtacggccctgaagaggacggcggagaagagagtggtgccgaggagtctggacccgaggaatcaggccccgaggagctgggcgcagaagaagagatggaagccggccggccccggcccgtactgagatctgtgaactctcgagaaccctcgcaggtcatattttgtaacaggtcaccccgggtcgttttgcccgtatggttgaactttgatggcgaaccacagccttatccaacgctcccccctggaacagggagacggatccactcctaccgcgtctatactctcaaggaaaggtgtctgcaggttgttaggagtctggtgaaaccggagaattaccgtcgcctggacatagttaggtcactgtacgaggatctcgaagaccaccccaacgtccaaaaggacttggagcgtctcactcaggaacggatagctcaccagcggatgggtgactag

SEQ ID NO: 26977 - DNA, 396 bp, Artificial Sequence
  Description of Artificial Sequence: Synthetic coding sequence
atgccccggcgggccgagaactgggacgaggccgaggtgggcgccgaggaggcaggcgttgaagaatatggcccagaggaagactcgtaccgagggcatttgtggctttttagggacgccggtactcatgacggcctcttagttaatcagacagaactctttgtgccaagccttaacgttgatggccagcctatctttgccaatattactctacctgtatacactctgaaggaacggtgtctccaggtggtgagatctctggtgaagcccgagaactatagacgactggatatcgtccggagtctctatgaggacctcgaggaccatcctaacgtccagaaggacctggagcgactaacacaggagcgcatcgcacaccagcgcatgggagattag

SEQ ID NO: 26978 - DNA, 1281 bp, Artificial Sequence
  Description of Artificial Sequence: Synthetic coding sequence
atggtgcacttctgcggcctgctgaccctgcaccgggagcccgtgcctctaaaatcaattagtgtatccgtcaatatttacgagtttgtggctggcgtgtccgctactttgaattacgaaaatgaagaaaaagtgccactggaggcttttttcgtgtttcctatggacgaagactcggctgtgtacagctttgaagccctcgtggatggtaagaaaattgtggcagagctgcaagataagatgaaagcacgcactaattacgagaaggcaattagtcagggccatcaagcattcctgctcgaaggcgacagttcctcgcgagacgtatttagctgcaatgttggcaaccttcagccaggatcgaaggctgctgtgaccctgaaatatgtgcaagaacttccacttgaggccgatggggccctccggttcgttttgcccgcggtactcaacccccggtaccaattttccggttcttccaaagatagctgcctgaatgtgaagacccccatcgtccctgtggaagatctgccttacacactgtctatggtagcaacaatcgattcccaacacggaatcgagaaggtgcaatctaactgccccctgagccctacagagtacctgggcgaggacaagacttcagcccaggtctctctggcagcagggcataaatttgatcgagatgtcgagctgttaatctactataacgaggtgcacacaccttcagtcgtgctagaaatgggaatgccaaacatgaagcccgggcatcttatgggggatccttctgctatggtgtccttttatcccaacatccccgaagaccaacccagtaatacgtgtggtgaattcatcttccttatggacaggagcgggagtatgcagagcccaatgagcagccaggatacaagccaactccgtatccaagctgccaaggaaacattgatacttttgttaaagtcccttcctattgggtgctatttcaacatttatggcttcggatcatcttacgaggcctgcttccctgagtctgtgaagtatacccagcagaccatggaggaggccttgggccgcgttaagctgatgcaggctgacctaggcgggacagagatcctggcaccactgcagaacatttatcggggcccgtcaattccagggcacccactgcaggtattcgagaggccatatacactgaccgttctgctgctgcacctctccccggaaggcaacctttgtgtgatcagacctagacattcgcgatggactattacggttagcgtggggtag

SEQ ID NO: 26979 - DNA, 2361 bp, Artificial Sequence
  Description of Artificial Sequence: Synthetic coding sequence
atggtgcacttctgcggcctgctgaccctgcaccgggagcccgtgcccctaaaaagtatctctgtgagcgtgaacatttacgaattcgtcgctggagtgagcgcaacactaaattatgagaacgaggaaaaggtacccttggaggctttttttgtattccctatggacgaagatagtgcagtctattcattcgaggccttggtcgatggcaaaaagatagtcgctgagctgcaggataaaatgaaagcacggaccaattatgaaaaagccatcagccaagggcaccaagcatttttattggaaggcgacagttctagtcgcgatgttttttcctgtaacgtcggtaacctccaacccggatcaaaggctgccgtcacactgaagtatgtgcaggagctgcctttggaggcagatggggctctgcgattcgtcctccccgccgttcttaaccccaggtaccagttctccggctcaagtaaggactcctgcctcaacgtcaagacacccatcgttcctgtggaggaccttccatacacactctcaatggtcgccaccatcgatagtcagcatggcatcgagaaagtgcagagcaactgtcccctgagtccgaccgagtatctgggggaggacaagacctctgcgcaggtgtcactggcagccggccacaagttcgatagggacgtggagttacttatttactacaacgaggtacatactccctccgtagtgctggaaatgggaatgcctaacatgaaacctgggcaccttatgggagatccttctgcaatggtgtctttttaccccaatatccctgaagatcagcccagtaacacttgcggggaatttatctttctgatggatcgttccgggagcatgcagagtcccatgagctcccaggatacttcccagcttagaattcaggcagccaaggaaacgctaatcttactgctaaagtctttgccaatcggctgttacttcaatatatatggattcggcagcagctatgaggcctgctttccggagtccgtgaagtacacccaacagactatggaggaggccctcggccgcgttaaactcatgcaagctgacttgggcggcactgagatcttggcaccactgcagaacatttataggggcccgagcattcctgggcacccattgcagctcttcgtttttacagacggcgaggttaccgacacctttagtgtgatcaaggaggtgcgaattaaccggcagaagcaccgctgttttagttttggaattggcgaaggaacatccacatctctgatcaagggaatcgcccgcgccagcggcggcacatcagaatttattactggcaaggaccggatgcagagtaaggctctgcgtacactgaagagatctctacaacctgtagtggaggacgtcagcctgtcctggcacttgccccccggcttatccgctaaaatgctttcaccagaacagactgtgatttttcgggggcagcggctgatatcctatgcacagctaacggggagaatgcccgcagctgagactacaggtgaggtgtgtcttaagtacacactccaagggaaaacctttgaagataaagtgaccttccccctccagccgaaacccgatgtgaatctgactatccatcgcttagccgctaaatctctgctgcagacaaaagacatgggcctacgtgagacccccgcatccgataaaaaggatgcactcaatctatcgctggagtcaggggtaatctccagctttacagcattcattgccatcaacaaggagctgaataaacccgtccaggggccgttggcccatagagacgttcctcggccgatacttctgggcgcatcagcccccttaaagatcaagtgtcagtcaggtttccggaaggctctccatagtgaccgacccccatccgcctcccagcctagaggggaactgatgtgttataaagcaaaaaccttccaaatggatgactacagcttgtgcggattaatcagtcacaaagaccagcactcgccaggctttggggaaaaccacctggttcagttaatttatcatcagaatgcaaacggcagctgggacctcaatgaagacctggccaagatcctgggtatgtctctggaagagatcatggcggcccagcctgccgagctcgtggattcatcaggctgggccacaattttagcagtgatatggctgcacagcaacggcaaggacttaaagtgtgaatgggaacttctcgaacgtaaagccgtggcttggatgcgcgctcatgccggctccaccatgcccagcgtggtgaaggcagccattacattcttgaaaagttctgtggaccctgcgatattcgccttctag

SEQ ID NO: 26980 - DNA, 1248 bp, Artificial Sequence
  Description of Artificial Sequence: Synthetic coding sequence
atggtgcacttctgcggcctgctgaccctgcaccgggagcccgtgcccctcaagtcaatttcagtgtctgtgaacatttacgagttcgtagcaggagtgagcgccacattaaactatgagaacgaagaaaaggtgccactagaagcattctttgtctttccaatggacgaagacagtgccgtgtatagttttgaggccctcgtagacggcaagaagatcgtggctgaacttcaggataaaatgaaggcccgtaccaactatgaaaaggccatctctcagggacatcaagcattccttcttgaaggagatagttccagcagagacgtcttttcctgtaatgtggggaacctgcagcccgggagtaaggcagccgtgacactgaagtacgtgcaggaactgccactggaggccgacggagctcttagattcgttctgcccgcagtgctgaacccacgttatcagttttctggatcttccaaggattcctgcctcaatgtcaagacccccatcgtgcctgtggaggacttaccctatacactgtcaatggtcgccacaatcgattcgcaacatgggattgaaaaggtgcagtcaaattgcccgctttcacctaccgagtatttgggggaagataagacctctgcccaggtctctctggcagccgggcacaagtttgatagggatgtggagttgctgatttattataatgaagtccacacaccgtccgtggtgctggagatggggatgccaaatatgaagcccgggcacctgatgggagatcccagtgccatggtttctttttacccgaacattcccgaggatcagccatctaatacctgcggcgaattcattttcctgatggatcgaagtggcagcatgcaatcccctatgtctagtcaggatacttctcagctaaggattcaggccgctaaggagacactgattctgctgctgaaaagcctccctatcggctgttacttcaacatttacgggttcggatcgagctacgaggcctgcttccctgaatctgtaaagtatacgcagcaaaccatggaagaagccctcggccgagtcaagcttatgcaagctgatctcggcggaactgaaatcctggcccctcttcaaaacatctatcggggtccctccatccccggacacccgctgcaactgttcgtatttaccgacggtgaggtgaccgatacctttagcgtgattaaagaggtaagaatcaatagacagaaacataggtag

SEQ ID NO: 26981 - DNA, 2361 bp, Artificial Sequence
  Description of Artificial Sequence: Synthetic coding sequence
atggtgcacttctgcggcctgctgaccctgcaccgggagcccgtgccactcaaatccattagtgtgtccgtcaacatctatgagtttgttgccggggtcagcgccaccctgaattacgagaacgaagagaaagtaccccttgaggcattcttcgtgttcccaatggatgaagacagcgctgtgtattcctttgaggccctggtcgacggaaagaagattgtcgctgaactccaggacaagatgaaagctagaaccaactatgaaaaggcgatcagccaaggccatcaggcctttttactcgagggggatagttcatccagggacgtgttctcgtgcaacgttggcaatcttcagcctggctccaaggctgcagtgaccctaaagtatgtacaagagctgcctctcgaggccgacggagcgctgcgcttcgtgctgccagccgtcctcaaccctcggtatcagtttagcggcagttccaaagatagttgtctgaatgtgaaaactcctatagttcccgtggaggacctgccctatactctttcaatggtagcgacgattgatagtcagcacggcatagagaaggtgcagtctaactgcccactaagtcctacagagtacctgggagaagacaagactagcgcccaggtgagcttggccgcagggcacaaatttgatagagacgtagagctcctgatatactacaacgaagtacatacaccctctgttgtgctagagatggggatgcccaatatgaaacccggccacttgatgggcgacccaagtgccatggtgagcttctatccgaatatccccgaggatcaaccgtccaacacatgtggtgaatttatcttccttatggatcgaagcggatctatgcagtcccccatgtccagccaggacaccagtcagctgaggatccaggccgctaaggagaccctgatcctcctcttaaagtcccttccgatcggctgttattttaacatttatgggtttgggtcaagttatgaggcttgcttccccgagagcgtgaagtatacgcagcaaacaatggaagaagcgttgggccgtgtaaagctgatgcaggccgaccttggcggcacggagatcctcgcacccttgcagaacatatacagaggaccatcaattccaggccacccccttcagctgtttgtgttcacagatggcgaggtgacagacaccttctccgtgattaaagaagtaagaattaatcgtcagaagcaccggtgcttcagctttggcattggagagggtacctctacctccctgattaagggcatcgcgagagccagcggcggcacgtccgagttcattactggaaaggataggatgcagtccaaagccctgagaacattgaaacgttcacttcagcctgtggtcgaggatgtctccttatcctggcacctgccaccgggcctgtcagcgaaaatgctgagcccagagcagacggtgatctttcgcggccagcggctcatctcatatgcccagctgaccggaagaatgcctgccgccgaaacgacaggcgaagtgtgcctaaaatatacactccaggggaagacatttgaagataaggtcacctttcctctccagccaaaacctgacgtgaacctgacaatccatcgactcgcagctaaatctcttttacaaactaaagatatgggtttgagagaaacacctgcttcggacaagaaggacgctttgaatctgagcctcgagtcaggcgtcatctcttctttcactgccttcattgcgatcaataaggagctgaataagcccgtgcagggacctctagcacatcgagacgtaccaagacccattctcctgggtgcctccgcgccgctcaaaatcaagtgccagagtggattcagaaaggctctacattccgacaggccgcccagcgcgtcacagcccagaggcgagctgatgtgttacaaggctaaaacctttcagatggacgattattctctctgtggcctgattagtcataaggatcagcacagccccggattcggcgaaaatcacctggttcagcttatttatcatcagaacgcaaatggatcatgggatctgaacgaggatctggcaaaaattctgggcatgtctctagaagaaatcatggccgcccaacccgcagaattggttgactcgtctggctgggccacaattctggccgtgatttggctccactcgaatggaaaagatctgaagtgtgaatgggagctgctcgaaaggaaggccgttgcatggatgagggcacatgcgggaagcaccatgcctagcgtcgtgaaagctgctatcacctttctaaaaagcagcgtcgaccccgccattttcgcgttctag

SEQ ID NO: 26982 - DNA, 1248 bp, Artificial Sequence
  Description of Artificial Sequence: Synthetic coding sequence
atggtgcacttctgcggcctgctgaccctgcaccgggagcccgtgcctctgaaatccattagtgtttcagtaaatatctacgaattcgttgccggcgtgtcggctacactgaactatgagaacgaggagaaagtccctctcgaggctttcttcgtatttcctatggacgaagatagcgcggtgtattcatttgaggctctggtagacggtaagaaaatcgttgccgagcttcaggacaaaatgaaggcccgaaccaattacgagaaggcaatctcccagggccaccaggctttccttctggagggggacagcagtagccgcgatgtgttcagctgtaacgtggggaatctgcagcccgggtctaaagcagccgttacgcttaagtatgtgcaggagctccccctggaagcagacggtgcactgcgtttcgtccttcctgcggtgctgaatccaagatatcagttcagcggcagttctaaagacagctgcttaaacgtgaaaactcctattgtccccgtggaagacttgccatacacgctctccatggtcgcgaccatcgacagtcagcatgggatcgaaaaggtacagagcaattgtccactgtcaccaactgagtatctcggggaggataagacctcagcccaggttagcctcgcggccggacacaagttcgacagggatgtggaattattaatttactataacgaagtacatactcccagtgtggtgctggagatgggaatgcccaatatgaagcctgggcacctgatgggcgatcccagcgcaatggtttctttctatccgaatataccggaggatcagccctcaaacacatgtggcgagtttatttttctaatggacaggtcaggaagcatgcagtccccaatgagctcccaggacacatcccagctgagaattcaagcggctaaggagactctaattctgctgctaaagtccctgccaattggctgttactttaatatatacgggttcggatcatcctacgaggcttgctttccagagtctgttaaatatacgcagcaaaccatggaggaggcgttagggcgggtcaagttaatgcaggctgacctgggaggaactgagattctggcaccattgcagaatatctatcggggacctagcatccctggtcaccccctgcaactgtttgtgttcacagacggcgaggtcacagacaccttcagtgtgatcaaggaggtgcgaataaatcgacagaagcatcggtag

SEQ ID NO: 26983 - DNA, 2301 bp, Artificial Sequence
  Description of Artificial Sequence: Synthetic coding sequence
atggccgccctgagcggcggcggcggcggcggcgccgagcccggccaagccttgttcaacggagatatggagccggaggctggtgctggcgcaggcgccgccgcgtccagcgccgcggaccccgcaataccagaggaagtctggaatattaaacagatgatcaagctgacacaagagcacatcgaagcgctactcgacaaattcgggggcgaacacaatcctccgagtatctacctggaagcctatgaagagtataccagcaaactcgatgccttgcagcaaagggagcagcagctgctagagagtctgggcaatggcactgacttctccgttagtagtagcgcatcgatggatactgtgacgtcatcctcctcctcaagcctgagcgtgttacctagttcgctgagcgtgttccagaaccctactgatgtcgcacgttccaaccccaaaagcccccaaaagcctatcgtccgggtgttcctgcctaataaacaaagaacagtggttcctgctcgctgcggagtcaccgttcgggactcccttaaaaaggccctgatgatgcgtggtctgattccagaatgctgcgctgtgtatcgcatccaggatggtgagaagaaacccatcggatgggacacagatatatcatggttgactggagaggagctacatgtggaggtgctggagaacgtgcccctgaccacgcacaattttgttcggaaaacattttttacgctagctttttgcgatttctgtagaaagctccttttccaggggttccgctgtcagacctgcggatacaaattccatcagcggtgctccaccgaggttcctctgatgtgcgttaattatgaccagctggatctcctctttgtgtcaaaattcttcgaacaccatccgattccccaagaggaagcctcgctggctgaaaccgcgctaacgagcggatctagccccagcgctcccgcgagcgattccatcggtccacagattcttacgtctccatcaccgagtaaaagtatcccgattccacagccattcagaccagccgatgaagatcacaggaaccagtttggtcaacgcgatagatcctccagcgctcccaacgtacacatcaatacaatcgagccggtaaacatagacgacctgataagggaccagggtttccgtggtgatgggggcagtaccaccggactaagtgcaacccctccagccagtctgcctgggtccctcacaaatgtcaaagcgctccaaaaatcccccggaccgcaacgggaacgcaagagcagttcttcctctgaggaccgcaacaggatgaagacccttgggcgtcgcgatagctctgatgattgggaaataccagacggccagattactgtaggtcaaaggataggatctgggtcctttgggaccgtatataagggaaaatggcatggtgacgttgcggtaaagatgcttaatgtgaccgcaccaaccccacagcagcttcaggcatttaaaaatgaggtaggcgttcttagaaagacaaggcatgtgaatatcctgctgttcatggggtatagtacgaaaccccagctggcaatcgttactcagtggtgcgagggttcgagcctgtaccatcacctgcacataatagaaactaaattcgaaatgattaaactgattgacatagcccggcagacagctcaggggatggattatctccacgctaagagcattatccacagagatctcaaatctaataatatctttctgcatgaggatctgacagttaaaattggagattttgggctagcaacagtgaagagccgatggtcagggagccatcagttcgagcagctgtctgggtctatactgtggatggccccagaggttattcgaatgcaggataagaacccatacagctttcaaagcgacgtttatgccttcggtatcgtcctgtacgaactcatgaccggacagctgccctattctaatattaataatcgggaccagattatcttcatggtgggcagaggatacctcagcccggatctgagcaaagttagatcgaattgccccaaggccatgaaaaggctaatggctgagtgcctgaagaaaaagcgggacgagcgtcccctgtttccccagattcttgcatcgatcgaactcctagcgagaagcctgcctaagatccatcgctctgcatctgagccaagtcttaatcgcgccggcttccagactgaagacttttcgctgtacgcctgtgcctccccaaaaactcctatacaggcgggaggttatggcgcgtttccggtccactag

SEQ ID NO: 26984 - DNA, 1947 bp, Artificial Sequence
  Description of Artificial Sequence: Synthetic coding sequence
atggagcacatccagggcgcctggaagaccatcagcaacggcttcggcttcaaagatgcagttttcgatggaagtagctgcataagccctactatcgtgcagcagtttgggtaccagcggagggcctctgacgacggtaagctgacagacccctctaagacttccaacaccattagagtgtttctgccaaataagcagaggactgtcgttaatgtcaggaatgggatgtcactccatgattgccttatgaaggctctcaaagtcaggggactccagcctgagtgttgtgcggtattcagacttctccatgaacacaaagggaaaaaagccagacttgattggaatactgacgccgctagcttgatcggtgaggagcttcaggtggatttcctggatcatgtgccactcaccacgcacaactttgcccgaaagacattcctcaaactggcgttttgcgacatttgtcaaaaattcttgcttaatggattcaggtgccagacttgtgggtacaagtttcatgaacactgctccaccaaagttcccactatgtgtgttgactggtccaatatacgtcagctgctgctcttccccaactctaccataggggactctggggttccagctctcccctctttgacgatgaggcgaatgagggagtcagtttcaaggatgccggtgtcatcccaacacaggtatagcacgccccatgccttcaccttcaacacgagctccccatcctctgaaggatctctctctcaacgacagaggtccaccagtacacctaacgtgcacatggtgagcaccactctgcccgtggacagccgcatgatagaggacgccatcaggagtcattctgagagtgctagtccctccgccctcagttcaagccctaataatttgtcccctactggctggtctcagccaaaaacccccgttccagcccagagggagagggcccccgtgtccgggacccaggaaaagaacaagatccgccctcgcgggcaaagagattcctcttattactgggaaatcgaagcatctgaggtgatgttaagcacacggattgggagcggcagcttcggaaccgtttacaaagggaaatggcacggagacgtggctgttaagatccttaaagtggtggacccaaccccagaacaatttcaggctttcaggaatgaggtggctgttctcaggaaaactcgccacgtcaacatccttctctttatgggctatatgaccaaagacaacctggcaatcgtgacacagtggtgtgaaggtagttctctgtataagcacctgcatgtccaggaaactaaattccagatgttccaactcattgatatcgcaagacagactgcccaggggatggactatttgcatgcaaaaaatatcatccaccgagacatgaagtccaacaatatcttcctgcacgagggcctaaccgtgaagatcggtgatttcggcctggctaccgtgaagtcccgctggtctgggtctcaacaggtggagcaaccgacaggatcagtgctgtggatggctcccgaagtaatcaggatgcaagacaataatcctttctcgttccaatcagacgtgtacagttacgggatcgtgctgtatgaactcatgactggcgaactgccctattctcacatcaacaaccgcgatcaaatcatcttcatggtgggccgggggtatgcttcgcccgacctgtcaaagctgtacaagaactgtcctaaagcgatgaagagactggtcgctgactgcgtgaaaaaggtgaaggaagaacgcccactgtttcctcagattctgtcttcaatcgagcttttacagcactcccttcccaaaatcaacaggtctgcgagtgaaccaagtctgcatagagccgcccataccgaagatattaacgcctgtacactcaccaccagcccaaggctgcctgtgttctag

SEQ ID NO: 26985 - DNA, 2007 bp, Artificial Sequence
  Description of Artificial Sequence: Synthetic coding sequence
atggagcacatccagggcgcctggaagaccatcagcaacggcttcgggttcaaggatgctgtctttgacggttcttcctgtatctcgccaacaatcgtgcagcaatttggctaccaaagacgggcctccgatgatgggaaattaaccgatccctcaaaaacatccaataccattcgggtgttcctgcctaacaagcagaggacagtcgtaaacgtacgcaacgggatgagcttgcacgactgcttaatgaaggcgcttaaggtccgcggactgcagcctgaatgttgcgctgtgttcaggctgttacatgagcataagggaaaaaaggcgcgcctggactggaacactgacgccgcttctctgatcggagaggaactgcaggttgattttctggatcacgtcccactcactacacacaattttgccaggaagacctttttgaagctggcgttttgtgatatctgccagaagtttctgttgaatggattcaggtgccagacttgtggctataagtttcatgagcactgctccaccaaggttccaaccatgtgcgtggactggtctaatattaggcagctcttactgtttcccaatagcaccataggcgactctggtgtgccagccttgccgagtctcactatgaggaggatgcgtgaatctgtttcccgaatgccagtatccagtcaacaccgatactccacaccccatgcttttacctttaatacctcatccccctcttcggaagggtctctttctcagaggcaacggtctacttccacacctaacgttcacatggtctcaactaccctgccagtggattcccggatgattgaaaacaataacctgagtgcttcacccagggcttggtctcgacgattttgcctgcgaggcagagatgcaataaggagccacagtgagagcgcatcacccagcgcactatcatcatcacccaacaatctctcgcccacaggctggtctcaaccgaaaacgcccgtgcctgcccagcgtgagagagctccagtaagcggcacacaggagaagaataaaattagaccacgcggccagcgcgatagttcatattattgggagatagaagcttctgaggtgatgcttagcacccgtattggcagtggctcgtttggtaccgtatataagggcaaatggcacggtgatgttgcggtgaagatcctcaaggtggtcgaccctacgcccgaacagtttcaggccttcagaaatgaggttgcagtgctcaggaaaacacgtcacgtaaatattttgctcttcatggggtacatgactaaagataatctcgccatcgtgacccagtggtgtgaagggagctcactctacaagcacttgcacgttcaagaaaccaagttccaaatgttccagctaatcgacattgcacgacagactgcgcaggggatggattatctccacgccaagaatattattcaccgtgatatgaagagcaacaacatttttctccacgaaggcctcacggtgaaaataggcgactttgggcttgcgacggtgaagagccggtggagcggtagccaacaggttgagcagccgactgggagcgtcctgtggatggccccagaagtcatccggatgcaggacaataaccctttctcatttcagtccgacgtttactcatacggcattgtgctgtatgaacttatgactggcgagttgccttatagccacattaataatcgggatcagatcatatttatggttggccgaggctacgcgtcacccgacttgtcaaagttgtataagaactgccctaaagcaatgaaacggttggtcgccgactgcgtcaagaaagttaaggaggagaggccactcttccctcaaatcctctcaagtattgagctgctgcagcactcactgcccaaaattaaccgcagcgctagcgagccgtccctgcatagagccgcgcatacagaggatattaatgcctgcactctgactacctcgccgagactgccggtcttctag

SEQ ID NO: 26986 - DNA, 1302 bp, Artificial Sequence
  Description of Artificial Sequence: Synthetic coding sequence
atgtgcgtggactggagcaacatccggcagctgttcagccagcaccgttactctacgccccacgcatttacctttaacacatcaagccctagcagtgaagggagtctgtcccagcggcagcggtccactagtacgccgaacgtgcacatggtgtccacaaccctgcctgtggattccagaatgatagaggacgctattagaagccactccgaaagtgcttcaccttctgcccttagcagcagcccgaacaatctgagccccacgggttggagccagccgaagacaccggttcctgcccaacgcgaacgcgctcccgtttctgggactcaggagaagaacaagattcgcccacgtgggcagcgggacagctcttactattgggagatagaagctagcgaggtgatgctgtcaacccgcattggctccggctcattcgggacagtctacaagggaaaatggcatggagatgtggctgtaaaaattctgaaagtagtggacccaaccccagaacaattccaggcctttaggaacgaggtggctgtcctgaggaagactagacacgttaatatcctgctgtttatgggctatatgaccaaagacaacctcgccatcgtaacacagtggtgtgagggctcttcgctgtacaagcacctccatgtgcaggagacaaagttccagatgtttcaactcatcgacattgcccgacagaccgctcagggtatggattatttgcatgccaaaaatattatccaccgcgacatgaagagcaataatatctttctccacgaaggactgacagtgaaaattggcgacttcggccttgcaactgtcaagtctagatggagtggtagccagcaggttgagcagccaacgggcagtgtactgtggatggcgccagaagtgataagaatgcaagacaacaatcccttcagctttcagtcagatgtctactcttatgggattgtgttgtatgaactgatgacgggagagctgccctactctcacatcaacaaccgcgaccagatcattttcatggtgggccgtggttatgcatccccggatttatccaagctttataaaaattgcccaaaagctatgaagaggctcgtcgccgattgcgttaaaaaagtgaaagaagagcgtccactgtttccccagattctgtctagcattgagcttctccagcattcactgccgaaaataaatcgcagtgcttctgaacccagcctgcacagagccgcccatacagaggatatcaatgcatgtacgctcaccacctccccacggttgcccgtcttctag

SEQ ID NO: 26987 - DNA, 1704 bp, Artificial Sequence
  Description of Artificial Sequence: Synthetic coding sequence
atgatggccaacagccagatcctgctgcggcaggccaccctgagcgtcttcagctgtcggacctccaaagaacagtgtaaaaaggctcggctggactggaacaccgacgctgcttctctgattggggaggagctgcaggtcgacttccttgaccacgtaccgttgaccactcataatttcgcgcgcaagactttccttaaacttgcattttgtgacatttgccaaaagttcctcctcaacggctttcgctgtcagacctgtgggtacaaattccacgaacactgctccacaaaggtccctaccatgtgtgtggattggagcaacattcgccagctgctactgttcccgaatagtacaattggagattctggagtgcccgccttgccctcgctgactatgcgccgcatgagggagtcagtaagtcgtatgcccgtttcatcgcagcacagatattcaacaccgcatgcttttactttcaacacctcctctccttcttctgaaggctcccttagccaacggcagcgcagcacatctacacctaatgtgcacatggtgagtaccacacttcctgtggatagtcgtatgatcgaggacgctattcgcagccacagcgagtcggcttcgccaagcgcactgtcctccagtcccaacaacttatccccgactggatggtcccaacctaaaactccagtgcctgcccaacgagagcgagcacccgtctcaggaacacaggagaagaataagatacgcccacgcggacaacgagattcctcatattactgggagatcgaggcaagcgaagttatgctgtcgacaagaattggatcaggaagttttggtaccgtgtataaaggaaaatggcatggagacgtggccgtgaagatcctgaaggtcgttgatcccaccccagagcaattccaggcctttaggaacgaggttgccgttctgaggaaaacaaggcatgtgaatattctcttgtttatgggctatatgaccaaagacaatctcgcaatcgttacccagtggtgcgaaggaagcagtttgtacaagcacttgcatgtgcaggagacaaagtttcagatgttccagctgatcgatattgcaaggcagacagcgcagggtatggattatttacatgcaaagaacataatccaccgggacatgaagagcaataatatttttctgcatgagggtttgaccgttaagattggagatttcgggttggccacggtaaaaagcaggtggagtggcagccaacaggtagaacagccaaccgggagcgttctgtggatggcccccgaagtcatcagaatgcaagacaataacccgttcagcttccaaagtgatgtgtactcttatggaattgtgttgtacgagctgatgactggcgagctcccctatagccacataaataatcgggaccaaataatcttcatggtggggaggggctatgcctccccagatctttctaaattgtacaaaaattgtccaaaagccatgaagcggctggtggcagactgcgttaagaaagtaaaagaggagcgcccccttttcccacagatcctctccagtatcgagctcctgcagcacagcctgcctaaaataaaccgcagcgctagcgaacctagcctgcatcgagccgctcacaccgaggacatcaacgcctgtaccttgaccacctctcccagactgcccgtcttctag

SEQ ID NO: 26988 - DNA, 1611 bp, Artificial Sequence
  Description of Artificial Sequence: Synthetic coding sequence
atgggcagcaacaagagcaagcccaaggacgccagccagcggcggcgctctctcgagcccgccgaaaacgtgcacggcgctggtgggggtgcttttccggcctcacaaacccccagcaagccagcttccgcggacggacacagaggaccatcggctgccttcgctccggccgctgctgagcctaaactttttggcggcttcaactccagcgataccgtaacctcccctcagcgcgccgggccccttgcaggtggagttacaacctttgtggccttgtacgattatgagtcccgcaccgagacggacttatccttcaaaaaaggcgagcgcctgcagatagtgaacaatacagagggggactggtggcttgcccattcattgtctacaggccagacagggtacattccaagtaactacgtcgcaccctccgattctatacaggcagaagaatggtattttggaaagattacccggcgggagtcagagcgtctgctgctgaacgctgaaaaccctaggggcacattcttggtgcgggagtcagaaaccactaagggagcttattgcctgtccgttagcgactttgataatgcaaagggcctgaatgtcaaacattataagattagaaaactcgactccggggggttttacatcaccagtcgaacccagttcaattcgctccagcagctggtggcatactactctaaacatgctgatggcctgtgccacaggctgacgaccgtgtgccctacgagcaagccccagacacaggggctggcaaaggacgcttgggagataccccgcgagagcctgcggctggaggtgaaactgggccaaggctgcttcggagaggtgtggatgggaacatggaatggaacaacccgagttgcaatcaagaccctgaaaccgggaaccatgtcaccagaagcctttctgcaggaggcgcaagtgatgaaaaaactgaggcacgagaagctggtacagctgtacgctgtagtgtctgaagaacccatctacatagtcaccgaatacatgtccaaaggatcgctcctggatttcttgaagggcgaaaccggcaaatacctgcgcctgccgcagctggtcgacatggctgctcagatcgcttctggcatggcatacgtggaaagaatgaattatgtgcatcgagaccttcgggctgccaacatcttggtcggcgaaaatctggtgtgtaaagtggccgactttggtctggctcgcctgatcgaagacaatgagtataccgcccgccagggagccaagttccctatcaaatggacagctcccgaagcagcgctgtacggcaggtttactattaagagcgatgtgtggtcctttggaatacttctgacggaattgacaaccaaaggccgtgtcccatacccaggcatggtcaaccgcgaagtgcttgatcaggtcgagcggggttatcggatgccatgcccaccagagtgccccgagtctttgcacgacctgatgtgccaatgttggcgtaaggaaccagaagaaaggccgacattcgagtacctgcaggctttcctcgaagactactttacctcaaccgagcctcaatatcaaccaggcgagaacctttag

SEQ ID NO: 26989 - DNA, 1629 bp, Artificial Sequence
  Description of Artificial Sequence: Synthetic coding sequence
atgggcagcaacaagagcaagcccaaggacgccagccagcggcggaggagtctggagcccgcagagaacgtccacggagccggagggggcgcattcccggcctcacaaactccatccaagcccgctagcgccgacggccaccgaggtccatcagccgcctttgcacccgctgctgcagaacccaaactgtttgggggatttaacagcagcgatacagttacatctcctcaacgggccgggccacttgccggcggagttactacgttcgtggctttgtacgattacgagtcacggacagaaaccgacctctcgttcaagaagggggagagactgcagatcgtgaataatacccggaaggtcgatgtgagagagggggattggtggttagcccattcactgtcgactggacaaaccggctatattcccagtaattatgtggcgccgagtgactctattcaggccgaggaatggtatttcggaaaaatcaccagaagagagtctgagagattattgttgaatgcggagaacccgagaggcacctttcttgtaagggagtccgagactacgaaaggtgcctactgccttagcgtgagtgacttcgataacgcaaaaggcctgaatgtcaagcactataaaattcgcaagcttgactcgggcggtttctatattacatccagaacgcaattcaattcgctccaacaactggtggcttattactctaagcacgctgacgggctctgccatagactcactactgtgtgccctacatccaagccacaaacccagggcctggccaaagacgcctgggaaataccaagggagagcctgcggctcgaggtgaaactagggcaggggtgtttcggcgaggtatggatgggcacatggaatggcaccacgcgcgtggccattaaaacgctcaagcctggtactatgtcgcctgaggcatttttgcaggaggcgcaggtcatgaagaaactacggcacgaaaagctggtgcagctgtatgccgtcgtctccgaggaacccatttatatcgtaactgagtacatgtccaagggttcactgctcgacttcctaaagggcgaaacgggcaagtacctgagactcccacaacttgtcgatatggccgcccagattgcttctggtatggcatatgtggagcgcatgaactatgttcatcgagatctgcgcgcagctaatatattagttggcgagaaccttgtgtgcaaagttgctgacttcggactcgcccggctaatagaagacaatgaatatactgctaggcaaggggctaaattccccattaaatggactgctccggaggccgccctctatgggagatttactattaagagcgacgtctggagctttggcatactcctgactgagctcacaacaaaggggcgagtcccatatcctggaatggtcaatcgtgaggttctggaccaagtggaacgcgggtaccgcatgccctgcccaccagaatgcccggaaagtcttcatgatttgatgtgtcagtgctggcgtaaagagcccgaagagcggcctacctttgaatacttacaggcttttctggaggattatttcacttccacagagccccagtaccaacctggtgagaatctttag

SEQ ID NO: 26990 - DNA, 1611 bp, Artificial Sequence
  Description of Artificial Sequence: Synthetic coding sequence
atgggcagcaacaagagcaagcccaaggacgccagccagcggcggcggtcgctagaaccagcggagaacgtgcacggtgcaggaggaggcgccttccccgcctctcagactccctccaagccagcatctgctgacgggcatcggggaccgagtgctgctttcgccccggcggccgccgagccaaaactgttcggcggcttcaattcatcagacacggtgaccagcccacagcgggccggcccactggccggaggcgtgaccaccttcgttgcgctgtatgactacgaatctagaacagagaccgacctgagcttcaagaagggcgagagactacagatcgtaaataacaccgagggggactggtggcttgcccactccttgtccaccggccaaaccggatacataccctcaaactacgtggctccatctgactccattcaggcagaagagtggtatttcggaaaaatcactaggcgcgaatccgaacggttgctcctcaatgcagaaaacccccgcggcactttcctcgtgcgggaaagtgagacaacgaaaggcgcctattgcctcagtgtctcggactttgataatgctaagggtctaaacgtgaaacattataaaatccgcaaactcgactctggcggattctacatcacctcacgtacccaatttaattctcttcagcagctggttgcatactactccaagcatgccgatggtctgtgccaccgtctgactaccgtgtgtccaacgagcaaacctcagacacaagggctagccaaggatgcttgggagattccacgcgagtcccttagacttgaggttaagctgggacaagggtgcttcggcgaagtatggatggggacctggaacgggaccacacgagttgccatcaagacactaaagcctggaaccatgagtcctgaagcattcctgcaggaggctcaggtgatgaaaaaactgaggcatgaaaagctggtacagctgtacgcagtcgtaagcgaggagcctatctacatagtcactgaatatatgtcaaaggggagtttactggacttcctgaagggcgagaccgggaaatacctgagactaccgcagctcgtggatatggcggcccagatcgcttcagggatggcctacgtggagcggatgaactatgtgcatcgcgacctgcgggcggcaaatattttggtaggcgaaaatttggtgtgtaaggtggccgacttcggcctggctagactgattgaggacaatgaatacaccgcccgccagggcgctaagtttccaattaagtggactgctcccgaagccgctctctatggcagattcacaattaagagtgacgtgtggtcatttggtattctactgacagagctgacaaccaaaggccgcgtcccatacccaggcatggtcaacagggaggtactcgaccaggtggaaagaggatatcgcatgccatgtcctcctgagtgtcccgaaagtctccatgacctgatgtgtcaatgttggcggaaggagccagaggagaggcccacttttgagtacctgcaggcctttttggaggactactttacaagcactgagccgcaataccagcctggggagaacttgtag

SEQ ID NO: 26991 - DNA, 1611 bp, Artificial Sequence
  Description of Artificial Sequence: Synthetic coding sequence
atgggcagcaacaagagcaagcccaaggacgccagccagcggcggcgctctcttgaacctgccgaaaacgtgcatggggccggaggcggggccttcccggcaagccagacaccctctaaaccagcatcagcggacgggcacagggggccatccgctgctttcgctcccgctgcagcagaacccaaactatttggcggctttaactcatccgacacagtgaccagtccgcagagagccggcccactcgccggaggcgtaactacattcgttgctctctatgactacgagtcaagaaccgaaacggacctgagtttcaaaaagggggagcgcttgcagatcgtgaacaacaccgagggcgattggtggctggcccacagcctgtcaacaggccaaacagggtacatccccagcaattatgtggccccttctgatagcattcaggccgaagagtggtatttcggcaaaatcactcgcagggagtcagaacgtctgctgcttaacgccgaaaatcctaggggaacatttctcgtaagggagtctgagaccactaaaggagcctattgtttgtccgtgtctgatttcgacaacgccaagggcctgaatgtgaaacactacaagatacgaaaactggactccggcgggttttacataacatccagaacccagttcaatagccttcagcagctcgttgcgtattactcgaaacatgctgatggcctgtgccaccgcttgacaaccgtctgtccaacctccaaaccccagacccaaggtctggcaaaagatgcttgggagattcctagggagtctctccggctggaggtgaagctcggccagggctgcttcggcgaagtgtggatgggcacctggaatggtaccacccgcgtagctatcaaaacattgaaacctggaacaatgtctcctgaggcttttctgcaggaagctcaggttatgaaaaaactgcgtcacgaaaaattggttcaattgtacgcagtcgtgtccgaagaacctatatatattgtgacagaatacatgagcaagggctcgctgctggattttctgaaaggggaaacagggaagtacctcagattaccccagcttgtcgacatggctgcccagatcgcctcaggaatggcttatgtggaaagaatgaactacgtgcacagggatctgcgggccgctaacatcctcgttggtgaaaacttggtctgtaaagttgctgactttggccttgctcgattgatagaagacaatgaatacactgcccggcaaggagctaaatttccaatcaaatggactgcacccgaggctgccttatacgggcgatttactattaagtcagacgtgtggagttttggaattttgctgacagaactgaccacaaaggggagggtaccataccccgggatggtgaatagggaagtcctggatcaggtagaacgaggatataggatgccttgccccccagagtgtccagagagtctgcatgacctaatgtgtcagtgctggaggaaagagcctgaggagcgcccaacttttgaatatctgcaagccttcctggaggactatttcacatctaccgaacctcagtatcaacccggggaaaatttgtag

SEQ ID NO: 26992 - DNA, 1611 bp, Artificial Sequence
  Description of Artificial Sequence: Synthetic coding sequence
atgggcagcaacaagagcaagcccaaggacgccagccagcggcggaggagcctcgaacccgcagagaacgtgcacggcgctggaggcggtgcctttccagctagtcagacgccatccaagccagccagtgcggacgggcaccgggggccatctgctgcgtttgcacccgcagctgcggagcctaaactcttcggaggattcaactcctcagatactgtgaccagtccgcaaagagccgggcctcttgcaggtggcgtgaccacctttgtggcgctgtacgattacgagtcacggaccgagactgacttgtcttttaaaaagggcgaacgtctgcagatcgtgaataatacggaaggcgattggtggctagcacacagcctttctaccggacaaactggatacattccctccaactacgtggccccctctgatagcatacaggcggaggaatggtattttggcaagatcacacgcagggagtctgagcgccttctgctaaatgcggagaaccctcggggaacttttttagtgagggaatccgagactaccaaaggtgcctactgtctgagcgtgagtgactttgacaacgcaaagggactcaacgtcaagcactacaaaatccgaaagctagactctgggggcttctacataacaagccgcactcagtttaattcactgcaacagctcgtggcctattactccaagcacgcagacggtctttgccacagactgacaaccgtctgccccacttcaaagccacagacacaaggattggcaaaagatgcttgggaaattcccagagagagtcttcgactcgaggttaaactgggacaaggatgtttcggcgaggtttggatgggcacttggaatggcacaactcgggttgccatcaagaccttaaaacccggaaccatgtccccagaggccttcctccaggaggcccaggtgatgaagaagttaagacatgaaaagctcgtgcagttgtacgccgttgtcagcgaggagcccatttatatcgtaacggagtatatgtctaaggggtcacttttggattttcttaaaggagaaacaggcaaatacctaagattgccccaactggttgacatggccgcccagattgccagcggcatggcttacgtagaaagaatgaactacgtccatcgggatcttagggcggctaatatcttggttggcgaaaatttggtgtgtaaggtggctgatttcggtcttgctaggttgattgaggataacgaatacaccgccaggcagggcgctaagttccccatcaagtggaccgcacctgaagcagcattgtacggacggtttactataaagagcgatgtttggagcttcgggatcttactgacggagctgactacaaagggccgagtgccgtaccccggtatggtcaaccgcgaggtgctggatcaggtcgaacggggctaccgaatgccatgccctcctgaatgccctgagagtctgcatgatctgatgtgccaatgctggagaaaggaaccagaagagagaccaactttcgaatacttgcaggccttccttgaggattatttcactagtacagaaccgcagtaccaacccggggagaatctttag

SEQ ID NO: 26993 - DNA, 423 bp, Artificial Sequence
  Description of Artificial Sequence: Synthetic coding sequence
atgcccctggtgaagcggaacatcgacccccggcacctgtgccacactgcactgccaagagggataaagaatgagctagaatgcgtgaccaacattagtcttgccaacatcattcgacagctgagttctctgagcaagtatgcagaggatattttcggagaactgtttaatgaggcccatagtttttcattccgagtgaattcccttcaggagagggtggatagattgtcagtgtccgttactcagcttgatcccaaggaggaggaactgagtcttcaggacatcacaatgcgcaaggcctttagaagcagtaccatccaggaccagcagctgttcgatcggaagacacttcccatcccccttcaagaaacctacgacgtctgcgagcagccgcccccattgaacatcctgaccccgtactag

SEQ ID NO: 26994 - DNA, 1680 bp, Artificial Sequence
  Description of Artificial Sequence: Synthetic coding sequence
atgcccctggtgaagcggaacatcgacccccggcacctgtgccacaccgctttgccacgaggcattaagaacgaactggagtgcgtcacaaacattagtctggcaaacatcattaggcagctgagcagtctgtcaaaatacgccgaggatatattcggcgagctcttcaacgaggctcattctttttcatttagggtgaactcccttcaggagagagtggaccgcttaagcgtcagtgtcacgcaactggacccgaaggaagaggagctcagcctccaagatatcacaatgagaaaagcattcagatcgtccaccattcaagaccaacagctgtttgaccgcaaaactttacccataccactgcaagagacatacgatgtttgcgagcagcctccccctcttaatattctcactccgtaccgcgatgacggcaaggagggcttgaaattctacaccaacccctcatatttcttcgacctgtggaaggagaagatgttgcaggacacagaagataaaaggaaagaaaagcgcaagcaaaaacagaaaaacctggataggccacacgagcctgagaaagtgccccgcgctccgcacgacagacgaagagagtggcagaaacttgcccagggcccagagttggcggaggatgacgccaacttgctgcataagcacattgaggtggccaatggtcctgcctcacacttcgaaactagaccccagacttatgtggatcatatggacggctcctacagtcttagcgcattgccgttctctcagatgtctgagttgctgacaagggcggaggaaagggtgctggtgcgtcctcatgaacccccaccgccgccacccatgcacggtgccggagatgctaaacctatccctacttgtatcagctcagccactggattaatagagaatcgaccccaaagtcctgctaccgggagaacccctgtcttcgtgtctcctacccccccccccccccccccaccccttccttcagctttaagtaccagcagtctccgcgcctccatgacatccacaccccctccgcctgtacctcctcctccacccccccccgctaccgccctgcaggctcctgccgtcccccccccacccgctcctcttcaaattgccccgggcgtactacatccagctccacccccaatcgccccaccattggtgcagccaagccccccagtggctcgagctgccccagtgtgtgaaacagtcccagtgcatcccctgccccagggcgaggtgcaagggctgccaccccctccaccacctccacccttaccgccacctgggatccgtcctagcagcccagttacagtgaccgccctggctcacccgccatctggtctgcatcccacaccgagcaccgcccccgggccccatgttcccctgatgccacctagcccgccttctcaggtgatcccagccagtgagccaaagaggcacccttccactcttcccgtaatctcagacgcccgaagtgtgctgctggaggctataagaaagggtatccagttaagaaaagtggaagaacagagggagcaggaggcgaaacacgaacgcattgagaatgacgtagctaccatcttgtcgcgcaggatcgccgtcgagtatagtgacagcgaagatgatagtgagttcgacgaggtcgattggctggaatag

SEQ ID NO: 26995 - DNA, 423 bp, Artificial Sequence
  Description of Artificial Sequence: Synthetic coding sequence
atgcccctggtgaagcggaacatcgacccccggcacctgtgccacactgcacttcctaggggaattaagaacgagctcgagtgcgttacaaacatctccctggctaatatcattaggcagttatctagcttgtcgaaatacgcagaggacatctttggcgagctgttcaacgaagcccatagcttcagctttcgtgtaaacagcctccaggagcgcgtcgacaggctgtctgtctctgtcactcagctagaccccaaagaagaggagctgagtctgcaggacattacaatgaggaaagcatttagatcttcaacaatacaagatcaacagctcttcgatcggaaaacactgccaattccactgcaggaaacatacgatgtttgtgagcagcccccaccgctcaacatactgacaccctattag

SEQ ID NO: 26996 - DNA, 1680 bp, Artificial Sequence
  Description of Artificial Sequence: Synthetic coding sequence
atgcccctggtgaagcggaacatcgacccccggcacctgtgccacacagcactccctcgcggcatcaaaaacgaattagaatgcgtcaccaacatctccttagccaacatcattcgacagctgtcgtccctctctaagtatgcagaagacattttcggcgaactgtttaacgaggcgcattctttttccttcagggttaacagcctgcaggaacgcgttgaccgcctgtcggtctcagtcacccagttggatcccaaagaagaagagctgtctctacaggatataactatgcggaaggcatttcggtcgtcaaccatacaggaccaacagctgtttgatcggaaaacgctgccaattcccctgcaggagacctatgacgtttgtgaacagcccccaccactgaatatattaacaccttatcgtgatgatggtaaggagggcctgaaattttacaccaacccctcctacttcttcgatttgtggaaagagaagatgcttcaagacacagaggataagaggaaagagaaaaggaagcagaagcagaaaaacctggacagaccgcatgaacccgagaaggttcccagggccccacacgatcgccgcagggaatggcagaaactggcacagggcccagagttagccgaggatgatgcaaacttattgcataaacacatcgaagtggctaatggcccggcttcccacttcgaaacacgcccacagacatacgtggatcatatggatggttcctattctctcagcgccctgccgttctcccagatgtccgagctgctaactcgagctgaggaacgggttttagtgaggcctcatgagcctcctcctccaccgccaatgcatggcgccggagacgccaagccgatacccacatgcatttcttctgcaacaggcctcatagagaatcggccacaatctcccgccactggccggactccagtgttcgtatcacccacgcctccaccaccaccaccacccctgccttctgccttgtcaaccagtagcctgagggctagcatgacatctacgcctccgccgcccgtgcctcccccacccccccccccggctaccgccctgcaggccccggctgtgcctcccccccctgcacccttacagattgcaccaggcgtcctccacccagcacccccacccatagcaccccctctggttcagcctagcccacctgtggccagggccgctcctgtgtgtgagacagtcccagtccatcccttgccacagggagaggtgcagggactgccaccgcccccccccccccctcctttgccccctccagggatacggccaagcagccccgtcactgtgaccgcactggcccacccaccaagcgggttgcatcccactccatccactgccccgggccctcatgtaccactcatgccacctagcccaccaagccaggtgattcccgcttcggaacccaaacggcacccaagtaccctgccggtgatatcagatgctagaagtgtgctgctcgaggccatacgtaaggggatacagctgcgcaaggtcgaggaacaacgcgagcaagaggccaaacacgaaaggatcgagaatgacgtggcgaccatcttatcaaggaggattgctgtggaatattccgatagtgaggatgattctgagtttgacgaggtggattggctcgagtag

SEQ ID NO: 26997 - DNA, 1680 bp, Artificial Sequence
  Description of Artificial Sequence: Synthetic coding sequence
atgcccctggtgaagcggaacatcgacccccggcacctgtgccacacggccctcccacggggcatcaagaacgaactagaatgtgtgacaaacataagtcttgccaatattattaggcagctcagctctcttagcaagtacgccgaggacatcttcggggaactctttaacgaggctcattccttcagcttccgggtgaacagtctgcaggagagagttgatcgactatccgtgagtgttacccagctcgaccctaaggaggaagagctatcactgcaggacataactatgcgcaaagcttttcggagtagtaccatccaggaccaacagctctttgatcgaaagactctcccaatcccacttcaggaaacgtacgacgtgtgcgaacagcctccgccattaaatatcctcacaccttatcgggacgacggtaaagagggtctgaagttctatactaatccctcctatttcttcgatctttggaaggaaaaaatgctgcaggacaccgaagataagcggaaggaaaaacgaaagcagaagcagaaaaacttggatcgcccccatgagcctgaaaaggtgcctagggccccccatgataggcgtcgggagtggcagaaactggcgcagggacccgaactggcggaagatgatgcgaatctgcttcataagcacatcgaagttgccaacggccctgccagtcactttgagaccaggccacagacttacgtcgatcacatggatggctcctatagcctctcggccctccctttctcccaaatgtctgagctcctgaccagggcagaagagcgggttctggttaggccccacgagcctccgccccccccgccgatgcacggcgccggagacgctaaaccgataccgacttgcatcagctctgctacagggctgattgaaaatagaccgcagtctccggcgactgggcgcacaccagtgttcgtgtcccctaccccacctccacctcctcctcccctaccttcagccctctctacctctagcctgcgcgctagcatgacaagcacccccccaccacccgtccctccgccgccccctcctccagctacggccctccaggcccccgccgtgcctcccccgccagcaccactccagatcgccccaggggttttacaccccgccccccctccaattgcaccacccctggttcagccaagcccacctgtggctcgagctgcccccgtttgcgagactgtcccagtgcatccccttccacagggagaggtgcaggggttgccgccacccccaccaccaccaccccttccgccaccagggattagaccctctagccctgtcacggtgacagccctggcacatccgccttccggccttcaccccacccccagtaccgcacccggaccacacgtgcccctcatgcctccgtctcctccatctcaagtcattcccgccagtgagcccaaacgacatcccagcactctgccagttatttcggacgcgaggtccgtcctgttagaggccatcagaaaaggcattcagctcaggaaggtggaagaacaaagggaacaagaagcaaaacacgagagaatcgaaaatgacgtcgccacaatcctctccagaagaatcgctgtggaatactccgattctgaagatgattcagaatttgacgaagttgattggctggagtag

SEQ ID NO: 26998 - DNA, 1680 bp, Artificial Sequence
  Description of Artificial Sequence: Synthetic coding sequence
atgcccctggtgaagcggaacatcgacccccggcacctgtgccacaccgctcttcccagagggatcaagaatgaactggagtgtgtcacaaatatatctctcgccaacatcattcgccaactatccagcctgagtaagtatgccgaggacattttcggggagctatttaacgaagcacacagcttcagcttcagggtgaattccctgcaggagcgggttgaccgtttgtccgtcagcgtgactcaacttgatcctaaggaggaagagctgagcctgcaggatatcaccatgagaaaggcattccgctcctctacaattcaggaccagcaactattcgacaggaaaaccctccctatccctctccaggagacttacgacgtttgcgagcagccaccgccactgaacatccttaccccataccgcgacgacgggaaggaagggttaaagttctatactaatcctagctacttctttgacctatggaaagagaagatgttacaagatacagaagacaagcgcaaggaaaagcgcaagcaaaagcaaaagaacctggataggccgcacgaaccagaaaaggtgcctagggcccctcacgacaggagacgggagtggcagaaactggcccagggacccgaactggctgaggacgatgcgaatctgctgcacaagcatattgaggtggctaatgggcctgcttctcatttcgaaactcgaccccagacgtacgtggatcatatggacggcagctatagcctctcagcgttgcctttttcccagatgtccgagttgctgacccgcgcggaggaacgcgtgttggtgcgaccccatgagcccccccctccgcctccgatgcacggcgctggggacgcaaagcccatccctacttgtatcagcagcgctaccgggcttatcgagaaccggcctcagtccccagcaacggggaggactccagtcttcgttagtcccaccccccctccaccacctcctccactgccgagcgcactgagcacgtcatctctgcgggcctccatgacctctaccccacctcccccggtcccgccccctccacccccccctgcaactgcgcttcaggcacctgcagtgcctccacccccggccccacttcaaatagcgcccggtgtgcttcatcctgcaccacctcccatcgccccaccccttgtacaaccaagtcctcctgtggctagggcagcgcctgtatgcgaaaccgtgcctgtccacccactcccccagggagaggtacagggcctgccaccaccccctccgccaccccccctgcccccaccaggaattcgcccttccagtcctgtcaccgttacagcactcgcccatcctccgagcggactgcatccaaccccctcaacagcccctgggccacacgttcccttgatgcctccgtctcccccctctcaggtcatcccggcttctgagccgaagcgacaccctagcacattgcctgtaatctcggacgctcgcagtgtgttgctagaggccatcaggaagggaattcagcttcgcaaagtggaggagcaaagggagcaggaagctaaacacgagaggatcgagaatgatgtggctacaattctttccagacgcatcgcggtagaatacagcgactctgaggacgacagtgagtttgacgaggtggactggctggaatag

SEQ ID NO: 26999 - DNA, 1680 bp, Artificial Sequence
  Description of Artificial Sequence: Synthetic coding sequence
atgcccctggtgaagcggaacatcgacccccggcacctgtgccacaccgccctgccgcgaggaattaaaaacgagctcgaatgcgtgacaaatatttctttggccaacataattagacagttgtccagtctgtctaagtacgcagaggatatcttcggagaactgttcaacgaggcgcactcttttagtttcagagttaatagcctccaagaacgcgtggatcgactctcagtgtctgtaactcagcttgaccccaaggaagaggaactatctctgcaggacatcacgatgcgcaaggccttcaggtctagtactatccaggatcagcagttattcgatcggaaaaccttacccattcctctgcaggaaacatatgacgtttgcgagcagcctccgccacttaacatcctcaccccttatagagacgacggaaaggaagggttaaagttttacactaacccatcctacttctttgacctatggaaggaaaagatgttacaagacaccgaggacaagcggaaggaaaaacggaaacagaaacaaaaaaatttagacagaccacatgaacccgaaaaagtgccgcgcgccccccacgatcgcaggcgcgagtggcagaagttagcccagggacctgaactcgccgaggacgacgctaacttattacacaaacatattgaggtcgccaacgggcctgctagccacttcgaaaccagaccacagacatacgtagatcacatggatggctcatatagcttatccgcattgcctttctcccagatgagcgagctgttaacaagagccgaagagcgggttctggtgcgcccacacgaacccccccctcctcctcctatgcatggagctggagacgccaagccaatcccaacttgtatcagctctgctactggcctcattgagaacaggccacagtcaccagctactgggcgcacccctgtattcgtctccccgacacctcccccgcccccgcctcctctcccgtctgccctctcaacatccagtctgagagccagcatgacatctacaccccctccgcccgtcccgcccccaccacctccccccgcgactgccttgcaggccccagctgtgccgcctccaccagctcctctgcagatcgccccaggcgtgctccatccagccccccctcctattgcaccaccgctcgttcagccgtcccctcccgtggctagggcagccccagtctgtgagacggtacctgtgcacccactccctcagggcgaagtccaaggcctgccgccgcctccaccaccgccccccctaccacctcctggcattagaccctcctccccagtaactgtcactgccctcgcgcacccacccagtggcctccaccccactccctccactgccccaggcccacatgtgccgttaatgcctccctcacctccttcccaggtgattcctgcctcagaaccaaagcggcacccatctacactccccgtcatctcagatgcccgatctgttctgctggaggcaatcaggaagggaatccaactacgtaaggtagaagagcagcgggaacaggaggccaaacacgagcgcattgagaatgacgtggcaactattctgtcccgcaggattgcggtggaatatagcgactcagaggatgactccgagtttgatgaggtcgactggctggaatag

SEQ ID NO: 27000 - DNA, 270 bp, Artificial Sequence
  Description of Artificial Sequence: Synthetic coding sequence
atgcccctggtgaagcggaacatcgacccccggcacctgtgccacacggccctgccacgagggatcaaaaacgagctggagtgcgtgacaaacatatcactcgcgaacatcatccggcagctgagtagcctgtccaaatacgctgaggacatcttcggcgaattgttcaatgaagcccactcattttctttcagggtgaactccctccaggagcgcgtggacaggctgtccgtgtctgttacacaacttgatcctaaagaagaagaatag

SEQ ID NO: 27001 - DNA, 543 bp, Artificial Sequence
  Description of Artificial Sequence: Synthetic coding sequence
atgcccctggtgaagcggaacatcgacccccggcacctgtgccacacggccctgccccgcggtatcaagaatgaactggagtgtgtgaccaacatctccctggctaacatcattagacagctctcctccctctccaaatatgcggaggacatttttggggagctgttcaatgaagcacactctttctcctttcgcgtaaattctttgcaggagagagtcgaccggctttccgtgtcagtaacacagcttgatccaaaggaggaagagctgagcctgcaggacatcacgatgagaaaagcttttcgtagctctactatacaagaccaacaactattcgatcggaagacactacccattcccctacaggagacatacgacgtgtgtgagcagccgcctcccctgaacattcttaccccatacagagacgacgggaaagagggactgaagttttacactaacccatcctatttctttgacctgtggaaggagaaaatgttacaagacacagaggataagagaaaagagaaacggaaacaaaagtag

SEQ ID NO: 27002 - DNA, 270 bp, Artificial Sequence
  Description of Artificial Sequence: Synthetic coding sequence
atgcccctggtgaagcggaacatcgacccccggcacctgtgccacacagctctaccccgagggattaaaaatgaattagagtgcgtgaccaacatctccctcgccaatattataaggcagttgtctagtctcagtaaatacgctgaagacatcttcggggagctgtttaatgaggcccatagctttagctttcgcgttaacagcctccaggagagagtagatcgactgagtgtgtctgttacgcagttggaccccaaggaggaggaatag

SEQ ID NO: 27003 - DNA, 1497 bp, Artificial Sequence
  Description of Artificial Sequence: Synthetic coding sequence
atgcccctggtgacccggaacatcgagccccggcacctgtgccggcagaccctcccaagtgtaaggtctgagctggagtgtgtgactaacatcacgctagcaaatgttatcaggcaactgggcagcttatcgaagtacgctgaggatattttcggcgaacttttcacccaggccaataccttcgcctcacgggtgtcaagcctcgccgaacgggttgatcgccttcaggtcaaagtgacccaactggatcccaaagaggaagaggtaagccttcaggggatcaacacccgcaaagcctttcgcagctctactattcaggatcagaagttattcgatcgaaactcactgcctgtcccggtgcttgaaacatataatacctgtgacacccctccgccccttaataatttaaccccataccgggacgacgggaaagaagctctaaagttttataccgatccttcctatttctttgacctttggaaagagaaaatgcttcaggatacaaaagacattatgaaggaaaagaggaaacaccggaaagagaaaaaagataatcccaaccggggcaatgtaaatcctcgcaaaatcaagacgaggaaggaggaatgggagaagatgaaaatgggacaggaattcgtagagtccaaggagaagttagggacctctggataccctcccacgcttgtgtatcagaacggctctatcggctgcgtggagaacgtggacgcttcttcatatccaccacccccacagtccgacagtgcatctagcccctccccatcctttagcgaggacaacctgccccccccccctgccgagttctcatatcctgtggataatcaacgcggcagcggcttggccgggcccaaaagatcttccgtcgtgtctcccagccacccaccaccggcaccgcctctgggatctccacctggacccaaaccgggtttcgcccccccacccgcacctccaccccctcccccgcctatgataggcatacccccccccccacctcccgttggttttgggtcacccggaacccctcccccgccttcccctccgtccttccccccccaccccgatttcgccgctcctccaccgcccccaccacctccagcagctgactaccctacactgccccctccaccgctcagccagcccactggtggggcaccacccccaccaccccctccgccccctccaggtccgcctcctcctccgttcacaggcgcagacgggcagccagccatccccccgcccctgtccgacacaaccaagcctaaatcgtccttgcccgctgttagcgacgccaggtctgatctgctgagcgccatacgtcaggggtttcagttgcgccgggtggaagagcagcgcgaacaggagaagagggacgtggtcggaaatgacgtggctaccatcctgagcaggcgcatcgctgtggagtattctgattctgaagatgacagttccgagtttgacgaggatgattggtcggattag

SEQ ID NO: 27004 - DNA, 846 bp, Artificial Sequence
  Description of Artificial Sequence: Synthetic coding sequence
atgcccctggtgacccggaacatcgagccccggcacctgtgccggcagacacttccttcagtgcggagcgaattggagtgcgtaaccaatattactctcgccaatgttatcagacagcttgggagcctgtctaagtacgctgaggacatcttcggtgagcttttcacacaggctaacacattcgctagtagagtgtcctccctcgccgagagggtagatcggctccaggtcaaggttacccagttggatcccaaagaagaggaagtgtcccttcagggtatcaacacccgaaaggcgttccgcagctccacaatacaagaccagaaactgttcgaccggaattccctgcccgtgcccgtgcttgaaacctataatacttgcgatacaccaccgccactaaacaatctcactccatacagagatgacggcaaggaagccctgaaattttacaccgatccttcatatttcttcgatctttggaaggagaaaatgctgcaggatacaaaggatattatgaaggaaaaaagaaagcacagaaaagagaagaaggacaatccaaatcgtgggaatgtcaatccaagaaagattaaaacccgcaaggaagaatgggaaaagatgaaaatgggccaggaattcgtagaaagcaaagaaaaactgggcacctccggctaccctcctaccctcgtgtatcagaatgggagtatagggtgcgttgagaacgtagatgcctcttcctacccaccacctccacagtccgattctgccagctcaccgtctccaagtttcagtgaggacaacctacccccaccgcccgcggagtttagattcagtgcagcgcagggctag

SEQ ID NO: 27005 - DNA, 1533 bp, Artificial Sequence
  Description of Artificial Sequence: Synthetic coding sequence
atgcccgtgccccccccccccgcccccccccccccccccaccttcgccttggcgaacacagagaagcctacactgaacaagaccgagcaagcaggccggaatgccttactgtctgatatatccaagggcaagaagcttaagaagacagtgactaatgaccgtagcgcacctattttggataaacccaaaggggccggtgcagggggaggcggcgggggcttcgggggcggaggtggtttcggcgggggcggtgggggtggcggaggtgggagtttcggcggcggcggccccccaggcctgggggggctttttcaggcaggcatgcctaaacttcgctcaactgcaaatcgggacaacgattcagggggctcgcggcccccgcttctcccccccggtgggcgcagcacctccgctaagccctttagtcctccatcgggcccgggccgcttccccgtgccctcacctggtcataggtctgggccaccagagccccagaggaataggatgcctcctccccgaccagacgtgggcagcaagccagattctattccgcctcctgttccgagcacacccagaccaattcagtcctcccctcacaacagaggttcacctccggtgcctggcggaccacgacagccctctccaggcccgactccccctcccttcccagggaatagagggactgccttaggggggggttctataagacagtctccccttagctcctcaagccctttcagcaaccgacctcccctgccccctacacctagtagggccctggacgacaagccacctcctcctcccccacccgtgggaaatcggccttccattcatagggaggcggtaccaccccctcctcctcaaaacaacaagccacctgtaccaagtacaccaagaccttcagccagctctcaggccccaccaccgcctcccccaccttcacgccccgggccccctccgctgcccccttcctctagtggaaacgatgagaccccaagattaccacagaggaatcttagtcttagctcatcaacccctcccctcccctcccctggcagatctgggccactgccaccccctccatctgagagacctcctccccccgtcagagaccctcccggccgctccggcccgctgccccctccacctcctgtgtctagaaacggaagcaccagccgcgcactacccgctaccccgcagctgcccagtcggtccggggttgattcccccagaagcggcccccgtcccccactaccgcccgaccggcctagcgctggcgcaccccccccaccaccaccgtcaaccagcatcagaaacggatttcaggattctccatgcgaggatgaatgggaaagtaggttttattttcaccccatatctgaccttcctccccccgaaccctatgtacagactactaagagttacccaagtaaattagcccggaacgagagcagaagtggtagcaaccgaagagagcgcggagcaccgccactcccccccataccacgacccccaaagcaggcagctgagtag

SEQ ID NO: 27006 - DNA, 1512 bp, Artificial Sequence
  Description of Artificial Sequence: Synthetic coding sequence
atgcccgtgccccccccccccgcccccccccccccccccaccttcgcactagccaatactgagaagccgactctcaacaaaacagagcaggccggacggaatgctctcctgagcgacatttccaaagggaagaagctgaaaaagactgtaactaacgaccgctcagcccccattcttgataagccaaaaggcgccggcgcaggaggaggggggggaggattcggcgggggaggcggcttcggagggggcggcggggggggcggcggcggatcgttcggcggtggggggccgcccggtcttggggggctgttccaggccggcatgcctaagctgcgaagcactgccaatagagataatgactcaggcggaagtcgacccccattgctaccacctggcggaagatcgacaagtgcaaagcccttctccccaccctctggcccaggaaggttccctgtgccctcacccgggcatcggtcaggtcctcctgagccgcagcgtaaccggatgcccccaccacgtccagacgtcggatcaaagcccgacagtatccccccgcccgtgcccagtaccccgagacccatacagtccagtccgcacaatcggggctcacctcccgtgcccggtggtccacgccagccgagccctggcccgacccccccgccatttccaggcaatcgcggaacagcactcgggggaggaagcattcggcaaagcccactgagtagctctagcccattttccaatcgccctccgctgccccctaccccatctcgcgctctggacgataaacctccaccccctccacccccggtcggaaaccgaccctctatccatcgggaagcggtacctcccccacctccacagaataacaagccccccgtgccttccacaccaaggccaagtgcatcaagccaagcaccacctccacctccacctccttcccgacctggtccacccccgctaccaccatccagtagcgggaacgatgagaccccacggctgcctcaacggaatctgtctctgagcagctcaacacccccacttcctagtccaggtaggagtggacccctaccccctcctcctagcgagagacctcccccaccagtgcgggatccacctggcaggagtgggcctctgccacccccccccccagtgagccgaaacggctctacttcacgcgcattgccggctacaccccaactcccctctcggagcggggtggatagcccgagaagtggtccacggcccccactccctcctgacagaccatctgccggagccccacccccgcccccccccagcacaagcattagaaatgggttccaggattccccttgcgaggatgagtgggagtcacgtttttacttccaccctatttccgacctgcctccacctgagccctatgtccagaccacaaagagctaccctagtaagcttgccaggaatgagagtaggtccggctctaatcgcagagaacgcggggctccccccctcccaccgatccctaggtag

SEQ ID NO: 27007 - DNA, 1512 bp, Artificial Sequence
  Description of Artificial Sequence: Synthetic coding sequence
atgcccgtgccccccccccccgcccccccccccccccccaccttcgctttggcaaacaccgaaaaaccaaccttaaataagactgaacaagctggtcgaaatgcactgttaagcgatatttctaaaggaaagaagctgaagaagactgtgactaatgaccgctccgccccaatacttgataaacctaagggtgcaggcgcaggcggaggcggtgggggatttggcggcgggggcggattcggcggaggcggtgggggcggaggcgggggctccttcggcggagggggcccgcctggcttgggaggactattccaagcgggcatgcccaagctaaggtcaacagcaaaccgtgataacgatagtggcggtagcagaccaccactgctccctcctggtggacggtcaacctccgccaagccattcagtcccccctccggccccggccgatttcccgtccccagccctggccatcgatcaggacctccggaacctcagaggaaccgaatgccacctcctcggcctgatgttgggagcaaacctgactccattcccccccctgtgccatccactccacgcccaatccagtccagcccgcacaatcggggatcacctcccgtgccgggcgggccccgccagcctagccctgggccaaccccccccccctttcctggcaatagaggcacagctttaggaggtggaagtattaggcagtcgcccctgagtagctccagtccatttagtaaccgcccacctctgccccccaccccgtcccgggccttagatgacaaaccccctcctccacctcccccagtagggaaccggccgtctatacatagggaggcggtccctccgcctccacctcagaataacaaacctccggtgcccagtacccctaggccttctgcctccagtcaggctcctccacccccaccaccacctagccgaccagggccacctccactaccaccatctagttcaggaaatgacgagacaccccgacttcctcagcggaacctttcactgtcctcctctaccccccccctgcccagccccgggcgtagtggccctctgcctccacctccctccgagcgacctcctccacccgtgagggatcctcctggtcgcagtggacccctacctccccctcccccggtttctcgcaatggttccaccagtcgcgcgctgccagccaccccccagctgcccagccgaagcggcgtggattctccaaggagcggacctcgaccacccctgcccccggaccgtccaagcgccggagccccgcctccaccaccaccttccacttccatccgaaatggattccaggactcaccctgcgaagacgagtgggaatcccgcttctatttccaccccatatcagatctgccgccccctgagccctacgtccagacaacaaagagctacccctctaagttagcacgcaatgaatctagaagcggctccaatcggagggaacgcggggcccctccattgccaccaatcccacgttag

SEQ ID NO: 27008 - DNA, 1512 bp, Artificial Sequence
  Description of Artificial Sequence: Synthetic coding sequence
atgcccgtgccccccccccccgcccccccccccccccccaccttcgcacttgctaatactgagaaaccaacactgaacaaaacagaacaggcaggaagaaacgcgctcctatccgatatatccaaagggaaaaagctaaagaagacggttaccaatgatcgctccgcgcccatactcgacaagcctaaaggagctggagcgggcggaggaggaggtgggtttggggggggaggggggtttgggggcggtggcggcggcggtgggggtggcagttttggtggggggggcccacctggactgggcggactgtttcaggcgggcatgccgaaattacgctctaccgctaaccgagacaatgacagcggaggctctagaccgcctctgctccctcccgggggcaggtccacatcagccaagccattttctccgccaagtggacccggacgatttcccgtaccgtctccaggccaccgctcaggaccccccgaaccccagcgtaacaggatgccccctccccgccccgacgttggctctaaacctgacagtataccacctcctgtaccatccacccccagacctatccaatcgtctcctcataataggggcagtcctcctgtccctggcggtccacgacaaccttcacccggtcctacaccccccccgtttccagggaaccggggaaccgcactgggtggtgggtctattagacagtccccactgtcatccagctctccctttagcaataggccccctctgccccccactccaagccgcgcccttgacgataagccacctcctccaccgccgccagtggggaaccgacccagtattcaccgcgaggcagtaccaccccctcccccccagaataataagccccccgtgccgagcacaccacgtccaagcgcaagctctcaggccccccctcctcccccgccaccttccaggcccggaccacctcccctgcctcctagctcgagcgggaatgatgaaaccccgcgactcccccaaaggaacctgtccttatccagcagcacccctccactccccagtccaggccgctccggcccattaccacctcctccaagcgagcgaccccctccaccagtccgtgacccccccggcagaagcggccctcttccccctcctccacccgtgagccgtaatggttccacgagccgagcccttccagcaacaccacagctcccaagccggtcaggcgttgactcacctagatcaggaccgcgcccccctctgcctccagaccggccctcagcaggcgcaccccctcccccacccccctccacaagcatcaggaatggattccaggattctccctgcgaggatgaatgggagtctcgcttctacttccatcctatcagcgatttgccacctccagagccctacgttcaaacaactaagtcttaccccagtaagctggcgaggaacgaaagccgctccggctccaaccggagagagcgcggagcccctccactcccccccattcccaggtag

SEQ ID NO: 27009 - DNA, 1080 bp, Artificial Sequence
  Description of Artificial Sequence: Synthetic coding sequence
atgcccgtgccccccccccccgcccccccccccccccccaccttcgccctggcgaataccgagaagcctacactgaacaaaacagagcaggccggacgcaatgcattactctcggatatatcaaagggtaagaagttgaagaaaaccgttacaaacgaccgcagcgcgcctattctggacaaaccaaaaggggctggcgctggtggtggcggcgggggcttcgggggtggtggcggatttggtggcggcgggggcggtggaggcgggggcagtttcgggggggggggccctcctgggttgggtggactgttccaggctggaatgccgaagctgcgcagcactgcaaaccgcgataacgacagtgggggttcacgacctccgctgctgcctcccggaggccgctcaacaagtgcaaagccattcagccctcccagcggacctggaaggttccccgtgcctagtcctggacatcggtccgggccacccgagccacagaggaaccgaatgccacccccacgtcccgacgtggggagtaagcctgattccattcctccacccgtcccaagcactccaagacccatccagtcttccccacataatagaggctcccctcccgtccctggcggcccacgccagccaagcccaggcccaactccgccacctcctcccccagtacgcgatcccccagggcgtagcggccccctgccaccaccacctcccgtgagccggaatggcagcacctcaagggcccttcccgctacccctcaactgccctcaaggagcggagtcgattcccctcgttctggcccaagaccacccttgcctcccgaccggccatctgccggagctcctcctccacctcccccaagtacgtccatcagaaacggattccaggattccccatgcgaggacgagtgggaatcacgtttttactttcatcctatctccgaccttccacctcccgagccatatgtccaaaccaccaaaagttatccaagcaaacttgctcgaaacgagagtcggagcggatcaaatagacgggagagaggagctcctccattgccccctatcccccgctag

SEQ ID NO: 27010 - DNA, 1482 bp, Artificial Sequence
  Description of Artificial Sequence: Synthetic coding sequence
atgcccgtgccccccccccccgcccccccccccccccccaccttcgctctggccaatacagaaaaaccaaccctaaataaaaccgagcaagccggccgcaacgccctccttagtgacatttccaagggcaagaaactgaagaaaacagtgaccaatgaccgcagtgccccaattctggacaagccgaagggagcgggcgccggagggggaggagggggcttcggtggagggggagggttcggcggcggaggagggggggggggcggaggaagcttcggcggtggcgggccccccgggcttggtggactctttcaggccggcatgccaaaactccggtcgaccgcgaacagggacaacgattctggaggatccaggccaccgctattgcccccgggcggacgttcaacttcggctaagccgtttagtccaccttccggccctggacgattccccgttccgtcgccgggccataggagtggacctccagagccacagaggaataggatgcctcctcctaggcctgacgtgggctcgaagcctgacagcataccccccccagtgcccagtaccccccgccccattcagagttctccccacaaccgggggagcccaccagttccgggaggacccagacagccatcgcccgggccaacaccgccgccttttcctgggaaccgcggcaccgccctgggaggtggctccattaggcagtcccccctgagctcttcctcccctttcagcaaccgcccgccgctgcctccgaccccttctcgagcattagatgacaagcccccacccccgcctcctccggtgggaaaccggccttccatccaccgggaagccgttcccccccctcctcctcagaacaataaaccacccgtgccaagtacccctaggccgtcagcatcgtcacaggccccacctccacctccgcctccgtcccggcctgggcctccccccctgcctcccagcagttcaggaaatgacgaaaccccccgtttaccacagcgcaacctcagcctcagctcatcaaccccccccctgcccagccctggaagatcggggccacttccacctcctccatctgagaggcctccaccacctgtgcgcgatccccccggcagatcagggcctctgccccccccaccacctgttagtagaaacgggtccacctcacgcgccctcccagctacaccccagctgccgagccgatcaggcgttgattctccacgtagcggtcctagacctccattgccgcccgataggcccagcgccggcgctccgccccctcctcctccttcgacatcgatccgaaacggctttcaggatagcccatgcgaggatgagtgggaaagtagattctactttcacccaatatcagacctgccccctccagagccctacgttcaaactaccaagtcgtatccaagcaagctggccaggaacgagtctaggagcgaatacttctgccaaggcttttag

SEQ ID NO: 27011 - DNA, 303 bp, Artificial Sequence
  Description of Artificial Sequence: Synthetic coding sequence
atgcccgtgccccccccccccgcccccccccccccccccaccttcgctctggcaaatactgagaagccaactctgaacaagactgagcaagctggccggaatgcactcctgtctgacatcagcaaaggaaaaaaactcaagaagaccgtaacaaacgaccgtagcgcccctatcctcgacaagccgaaaggtgctggggccgggggcggcggcggcggatttggggggggtggcggctttggcgggggcgggggcggcggcggcggtggatcctttggggggggggggccaccaggcctgtag

SEQ ID NO: 27012 - DNA, 1647 bp, Artificial Sequence
  Description of Artificial Sequence: Synthetic coding sequence
atgaagaccctggagacccagcccctggcccccgactgctgcccctccgaccaggacccggctccggcccatcctagcccccatgcgagccccatgaacaagaatgccgacagtgaactgatgccgccaccccccgagcggggtgaccctccacggctgtcccctgatcccgtggctgggtccgccgtctcccaggaactgcgtgagggcgatcctgtttctctgtcgacacctctggagaccgaatttggctcaccgagcgagttatcgcccagaatcgaagaacaagaactctccgaaaatacgagtctacccgccgaagaggccaacggttccctttctgaggaggaggctaatgggccagagctgggtagtggaaaggctatggaggatacttctggcgaaccggctgcagaagatgagggcgacaccgcctggaattacagtttcagtcagctcccgcgatttctgtccggctcttggagtgagttctcaacacagcctgagaactttctgaaaggctgtaaatgggcaccagacggctcctgtatcctgaccaattctgccgataacatcctgaggatctacaatcttccacccgagctttatcatgagggggaacaggtggaatacgccgaaatggtaccagtgttacggatggttgagggggatacgatatacgattattgttggtactccctgatgtcatctgcccaaccagacacctcttacgtggcctcaagctcaagggagaaccctatccacatctgggacgcctttaccggcgagttacgggcgtcattcagggcctacaaccatctcgacgagttaacagccgcccactctctgtgtttttctccagatggttcacagttgttttgtggcttcaataggaccgtcagagtgttctctaccgcacggccagggagagactgtgaagtgcgcgccacctttgcaaagaagcagggccagtctggcatcatcagctgcatcgctttcagcccggcccagccactttatgcatgtggttcatacggccgcagcctaggattgtacgcctgggacgatggttcccctcttgcacttctggggggacatcaaggggggataacccacctctgttttcatcctgatggcaatcgctttttttccggagccagaaaggatgctgagctgctttgctgggacttacgacagtccggataccccctctggagcctgggtcgggaggttacaactaaccagcgaatttactttgacctggaccccactggtcagttcctggtgtctggtagtacgtcaggagccgtgagcgtgtgggataccgacgggcctggaaatgatggcaaaccagagcccgtgctgagcttcttgcctcagaaagactgcacgaatggggtgtctttgcacccgtcgcttccgctgttagccactgcctccgggcagcgggtcttcccagaacccaccgagtccggcgacgagggagaggaactggggctcccgcttctcagcaccagacacgtgcacctcgaatgtcgcctccagctgtggtggtgcgggggagctcccgactcgtcaatccccgacgatcaccagggggagaagggccagggtggaactgagggtggtgtgggggagctgatatag

SEQ ID NO: 27013 - DNA, 1647 bp, Artificial Sequence
  Description of Artificial Sequence: Synthetic coding sequence
atgaagaccctggagacccagcccctggcccccgactgctgcccctccgatcaggatcctgcacccgcccacccctcacctcacgcctcaccaatgaataaaaacgctgactctgagctcatgccacctccccctgagagaggcgacccacctagattgagtccagatccagtggccggatctgcagtttcgcaggaactgcgtgagggggaccctgtgagtctctccacgcctttggaaaccgaattcggatccccatcagaattaagcccaagaattgaggaacaggagctgagcgagaatacatccctgccagcagaggaggcgaacggttccctgagtgaagaagaagcgaacggaccagagcttggctccggcaaggcgatggaggacacctcaggggagccggccgcagaagacgaaggcgataccgcttggaattactcattctcacagctgcctaggttcctgtccgggtcttggagcgaattcagcactcagcccgaaaattttctgaaaggttgtaagtgggcgcctgacggctcctgtattctgaccaactctgcagataacatactgcgaatttacaacctgcctcccgaactttaccacgagggcgaacaggtcgagtatgcagaaatggtcccagtgcttcgaatggtggagggagacaccatctacgattattgctggtactccctcatgtccagcgctcaacccgatacaagctacgtggctagtagcagtagggagaaccccatccatatatgggacgcattcacaggcgagctgcgagcttctttccgtgcttacaaccacctagatgagttaacagccgcacactccttgtgcttttctccagatggctcacagctcttttgcggctttaatcggacagtccgggtttttagcaccgcccgcccggggcgggattgcgaggtgcgagcaacctttgccaagaaacagggccagtctgggattatttcgtgtatagccttcagtcctgcccagcctctctatgcttgtggaagttatggacgttctctgggtctttacgcatgggacgatggcagtccacttgctctcctgggaggccaccagggaggaattacgcatctgtgctttcaccccgacggcaaccgtttcttcagtggagccagaaaggatgccgagctactgtgctgggatctgagacagtccggctacccactgtggtctttggggagggaagtcaccacaaaccagcgaatctatttcgatctggatcccacaggacagttcttagtgtctggcagcacatctggggctgtgtcagtgtgggataccgacgggcccgggaatgatggcaaacccgagcccgtcctgtcatttttgccccagaaagactgcaccaacggggtatcgttgcacccctctttgcctttgctggctactgcaagcgggcagagagtcttcccagaaccaactgaatcaggcgacgagggcgaagaattgggattgccactgctgagcactagacacgtgcatctggagtgcagacttcagctgtggtggtgtggaggggcacctgattcatccatcccagatgaccaccagggagagaaaggtcagggcggcactgaaggcggcgtgggcgagcttatttag

SEQ ID NO: 27014 - DNA, 1647 bp, Artificial Sequence
  Description of Artificial Sequence: Synthetic coding sequence
atgaagaccctggagacccagcccctggcccccgactgctgcccctctgaccaagacccggcacccgcccatcctagcccgcatgcttctccaatgaacaaaaatgctgacagcgagctaatgcctcccccaccggagcgaggcgatccgcccagactaagtcccgacccagtggccggcagcgccgtgagtcaagaattacgcgagggtgaccctgtgagtctgtctacaccactggaaaccgagtttggaagcccctctgaactgtcccctaggatagaggagcaggaactctcggagaacaccagtctgcccgctgaggaagcaaacggctctctctcagaggaagaagctaatggaccggagttgggttcgggcaaagccatggaggatacctccggtgaacccgccgccgaggatgagggagatacagcctggaattattcattttcccaactgcctaggttcctgtctgggagttggtccgaattctctacacagccagagaactttcttaagggctgcaagtgggcgcctgatggtagctgcatccttaccaacagcgccgataacatactgcgcatctataacctgccaccagagctgtaccatgagggtgagcaagtcgagtatgcggagatggtaccagttctgagaatggtggaaggcgataccatttatgattattgttggtactccttgatgtcttctgcccaaccagatacgtcgtacgtagctagttcgagcagggaaaaccctatccatatttgggacgcattcactggcgaattaagagccagctttagagcgtataatcacctcgatgaactgacagcagctcatagtctctgtttttcaccggacggatctcagctgttctgcgggttcaatagaaccgtgcgagtttttagcactgctcgaccagggcgggactgcgaggtgcgcgccacctttgctaagaagcaagggcagtcaggcattatctcttgcatcgcattttcgcctgcccagcctctttacgcatgtggtagctacggacgcagtctgggcctgtatgcctgggatgacggctcgcctctggctttgcttggcggccatcagggaggcatcacccatctgtgcttccatccggacggcaaccggtttttcagcggcgctagaaaggatgcagaactgctgtgttgggacctgcgacagtctgggtaccctctgtggtctttaggtagggaggttacaacaaaccagcgcatatattttgacctggatcccactggacagttcttagtgtctggaagcactagcggcgcagtgagtgtgtgggacactgatggacctggcaacgatggaaaacccgagccagtgctgtcgtttttgcctcagaaagattgtaccaacggagtgtcattgcaccctagtctgcctctccttgccacagccagtggtcagcgagtgttccccgagcccacggaatccggagacgaaggagaagaactcgggttgcctctcttatccactagacatgtccatcttgagtgtcgcctacagctgtggtggtgtggcggcgcaccagacagctccattcccgatgaccaccagggagaaaaaggccagggcggcactgaagggggggtcggagagttaatttag

SEQ ID NO: 27015 - DNA, 567 bp, Artificial Sequence
  Description of Artificial Sequence: Synthetic coding sequence
atgaagaccctggagacccagcccctggcccccgactgctgcccctcggaccaggacccagctcctgctcagcccgatacatcctatgtcgcctcaagctcgcgagagaaccctattcatatctgggatgcctttactggcgagctccgtgcgagctttagggcctataatcacctcgatgagctcactgcggcacatagcttatgcttcagtccagacggctcccaactcttctgcggcttcaatcggaccgtgcgcgtgttttccacggctagacctgggcgcgactgtgaggtccgggctacttttgggaagcatctttgtctgcaggggagaaggcgggggaagggcaccgccacatgtaccggggccttctgcgagcccggcgctacctgcggtggctcccgcagaccactctacggtccgggaagcagatgttctcccgtgggccgcggcgcaaatcgtctgagggccggacgcaagccctcacaggggcagcccgcgggccaacggaccgcgagcttcttgaactcataccccgttagttgcggtgcttttggactgtag

SEQ ID NO: 27016 - DNA, 1647 bp, Artificial Sequence
  Description of Artificial Sequence: Synthetic coding sequence
atgaagaccctggagacccagcccctggcccccgactgctgcccctccgaccaggatccagcccccgcccacccctctccccatgcatctccaatgaacaaaaacgcagatagtgagttgatgccccctcctccggagaggggcgacccaccccgcctatctcctgaccctgtcgcaggttcagccgtttcgcaagaactccgagagggtgatcccgtcagtctctcaacgccgctggagactgagtttggaagcccttcagaactgtcaccaaggatcgaggagcaggagctttccgaaaatacgagcctacctgccgaggaagcaaacggatcacttagcgaggaggaggccaatggacctgagctgggttctggcaaagcaatggaagacactagcggggagcccgccgccgaggacgagggggacacggcttggaactactcattttcacagctgcctcgtttcttgtcggggtcctggtccgagttcagtacgcagcctgagaattttctgaaggggtgcaaatgggctcccgacggctcatgcatcctgacaaattctgccgacaatattctgaggatctacaacttgcctccagaattataccacgagggcgaacaggtggagtacgccgaaatggtccccgtgctccgaatggtggagggagatacaatctacgattattgttggtactctctgatgtctagcgcccagcccgacacttcctatgtggccagctcctcgcgggaaaacccaattcacatatgggacgctttcaccggggaacttagggcctccttcagagcctataatcacttagatgagctcactgccgcacactccctctgcttcagtcctgacgggagtcagctcttctgcggcttcaaccgaaccgttagggtgttcagtaccgcacggccaggaagagactgtgaagtgagagcaacattcgcaaagaaacaagggcagagtggtatcatcagctgtattgcctttagtcccgcacagcctctgtacgcctgcgggagctacgggaggagtttaggtctgtacgcctgggatgacggcagtccacttgctctgctggggggacatcaggggggaatcacccacttgtgcttccaccctgacggaaacagatttttttcgggggcacgtaaggatgccgagttgttatgttgggacttacggcaaagcgggtatcctctgtggtctctcggaagagaggtgaccactaatcaaaggatttatttcgatctggacccaacagggcaattcctggtcagcgggagtacttccggtgcggtgtccgtctgggacaccgatggccctggaaatgatggaaaaccagagcctgtcctgtccttcctgccacaaaaagactgcacaaacggggtctccctccatccaagcctgcctttgttggctacagcatctggacagcgcgtctttccagagccaaccgagtccggcgatgaaggagaggaactcgggttacctctgctgtccactcgccacgtccatctagagtgccggctgcagctgtggtggtgtgggggagcacccgatagttccatcccggacgaccatcagggggaaaagggacaaggcggtaccgaaggtggcgtcggtgagctaatctag

SEQ ID NO: 27017 - DNA, 1299 bp, Artificial Sequence
  Description of Artificial Sequence: Synthetic coding sequence
atggacaccgagaagagcggcaagcgggagttcgacgtgcggcagactccccaggtgaacattaatccttttacgccagatagcttgttgttgcacagctctggccagtgtcggcggagaaagcgaacctattggaatgacagctgtggagaagatatggaggccagcgactacgaactggaagacgaaacccggccagctaaacgcattacaattaccgaatctaatatgaaatctaggtatactactgaattccacgagctcgagaagatagggagcggcgagtttggctctgtgttcaagtgcgtgaagcgcctggacggatgtatatatgccatcaagagatcaaagaaacctctggcgggatctgtcgacgaacagaatgctctgagagaagtttacgcccatgccgtcctcggccagcattcccatgtagtaaggtatttctccgcctgggccgaggatgatcacatgctcattcaaaacgaatattgtaatggcggctcgctggctgacgcgatttccgagaattatcggattatgtcctacttcaaggaagccgagctgaaggacctgctgctgcaagtcggccgcggcctgcgttatatccactccatgagcctggttcacatggatattaagcctagtaatatcttcatcagcaggaccagtatcccaaacgcagcctccgaggagggtgatgaagacgattgggcctccaataaagttatgttcaagattggagatttgggacatgtcaccagaatctcctcaccccaggttgaagagggggatagcagattccttgcaaatgaggtgctgcaggaaaattacactcacctccctaaggccgacattttcgcactggctctgactgtagtttgcgccgccggggccgaacccctgcccaggaacggggatcagtggcacgagattcgccagggaaggctgcccagaattccgcaagttctctctcaagaattcactgagctcctcaaggtcatgatacatcccgatccagagcgtaggccgtcagctatggcactggtgaaacacagtgtactcctgtctgctagcagaaagagtgcagagcagctccgaatcgaactgaacgccgaaaaattcaagaactctctcttgcaaaaagagctaaagaaagcccagatggcaaaagccgccgccgaggagcgtgctctattcacagacagaatggctacacggtcaaccacacagtctaacagaacgagcaggctgatcggcaagaaaatgaatagatcagtatcactcactatctactag

SEQ ID NO: 27018 - DNA, 1941 bp, Artificial Sequence
  Description of Artificial Sequence: Synthetic coding sequence
atgagcttcctgagccggcagcagcccccccccccccggcgggccggggctgcttgtaccctgcgccagaagctgattttttcaccatgttcagactgtgaggaagaggaggaggaggaggaagaggagggttcgggacacagcacgggcgaagatagcgccttccaggaacccgactccccgcttccgcccgctagatcacctaccgaacccgggcctgagcggaggaggtctcctggtccagcacccggaagcccgggagagttagaggaggatttgctcctgcctggagcatgtcccggagcagacgaggctggaggtggcgccgagggagacagttgggaggaggagggatttggatcctcgtccccagtcaaaagcccagccgctccttacttcctgggctcctcttttagtcctgttcgctgtggaggccctggggatgcaagcccgagaggttgtggcgctagacgagcaggtgaaggcaggaggtcacctaggcccgatcatcccggaacacctccgcataaaacgttccgcaagctacgtctttttgacacaccacacacccccaaaagtttgctgtcaaaagcaaggggaattgacagctcaagcgtaaagttgcggggatcgtcactgttcatggataccgaaaagtccggtaaacgggaatttgacgtcagacaaacgcctcaggtaaatattaatcctttcacccctgattctctgctgctgcatagctctggccaatgccggaggcgcaaacggacttactggaacgattcgtgtggcgaggacatggaagcatccgactacgagctagaggacgaaactcgcccagccaaacgcattaccatcacagagagcaatatgaagtccaggtatacgaccgagtttcacgagctcgaaaagatcggttccggagagttcggcagcgtgtttaagtgcgtgaaaaggttggacggctgtatctatgccatcaaaaggagcaagaaaccccttgccgggtccgttgacgaacagaatgcactgcgcgaagtctatgctcacgcagttctggggcaacatagccatgtggttagatatttctccgcatgggcagaggatgatcatatgcttatccagaacgaatattgtaatggaggtagcttggcagacgcaatcagcgagaactacaggatcatgtcctacttcaaggaagccgagctgaaagaccttctcctgcaggttggacggggcctgaggtatatccatagcatgtcacttgtacatatggacataaagcccagtaatatatttatcagccggacatccatccctaacgcagcatccgaggaaggagacgaagacgattgggccagcaacaaggtgatgtttaagattggcgacctgggtcatgtcacaaggatttcttcaccacaggtcgaggaaggggacagtcggttcctcgcaaacgaggtgctgcaggagaattatacacacctgcctaaggctgatattttcgcactcgctttgaccgtggtttgtgcagctggcgcagagcctctcccgagaaacggggatcagtggcacgagatccggcagggaagactcccccgcatacctcaagtgctcagtcaggagtttactgagcttttgaaagtgatgatccacccggatcccgagcggcgccctagtgccatggccctcgtgaaacattccgtcctgctgtcagcttcgagaaagtccgctgagcagctaagaattgaactcaacgctgaaaagttcaagaattccctgctacagaaggagctgaagaaggcacagatggctaaggccgccgcagaagaaagggcactattcactgatcgcatggccactcgttccacgacccagagcaacagaaccagccgcttaatcggtaagaagatgaatcgatctgtgagcttgactatttactag

SEQ ID NO: 27019 - DNA, 1554 bp, Artificial Sequence
  Description of Artificial Sequence: Synthetic coding sequence
ctgcaggaccccgccagcacctgcgtgcccgagcccgccagccagcacaccttacgcagcggccccggctgcctccaacagccagaacagcagggcgtacgcgacccggggggtatatgggcaaagctgggtgctgcagaggcgtccgcagagcgcctgcagggtcggagaagccgaggcgcctccgggtctgaaccccagcagatgggttcagacgtgcgagatctgaacgctctactgcctgccgtccccagtttgggtgggggcggggggtgcgcattacctgttagcggcgcggcacagtgggcacctgtgctggactttgccccccccggcgcctccgcatacggctccctaggcggcccagccccacccccagcccctcctccccccccacctcccccgccccacagtttcataaagcaggagcccagttgggggggtgcagaaccacatgaagagcagtgcctctcagcgttcactgttcacttctcaggtcagttcacaggtacagcgggcgcctgccggtacggcccattcggcccccccccgccatcccaggcctcatcagggcaggctcggatgttcccgaatgctccatatctgccttcctgtctggaatcccagcccgcaattagaaatcagggatattccacagtgacgtttgacggtactccatcttatgggcatactccttcacaccatgcggcccagttccctaaccacagtttcaaacacgaggacccaatgggccagcagggaagcctcggggagcagcagtacagcgtccctcccccagtctacggctgccatactcccaccgacagttgtacaggatcacaggccttgctgctcagaacaccatatagctcagataatctttatcagatgacatcccagctggagtgcatgacttggaatcagatgaacctgggagcgactcttaagggagtcgctgccggcagcagtagctctgtgaaatggacagaaggccagagcaaccacagtaccggttacgaaagcgataaccacacaacacccatcctgtgtggggctcagtaccggattcacacgcacggagtgtttcgaggtatacaggacgtacggcgcgtgccgggtgtggctccgaccctggttaggagcgcatctgaaacttcagaaaagagaccgtttatgtgcgcctatcctggatgcaataagcggtattttaagttgtcgcacctgcaaatgcactctcgtaagcacaccggcgaaaagccttatcagtgcgattttaaggactgcgagcgtcgcttctcacgaagcgaccagctgaagagacatcagagaagacacacgggtgtgaagcctttccagtgcaaaacatgtcaacgcaaattttctcgtagtgaccatctcaagacccatacccgcacacacacaggaaaaacctctgagaagccgttttcctgtagatggccttcgtgtcaaaagaagtttgcgcggagcgatgaactggtgaggcaccacaacatgcaccagcggaatatgacaaagctccagctggccctctag

SEQ ID NO: 27020 - DNA, 954 bp, Artificial Sequence
  Description of Artificial Sequence: Synthetic coding sequence
ctgcaggaccccgccagcacctgcgtgcccgagcccgccagccagcacacattaaggtcaggtcccggttgcctgcaacagcccgagcagcaaggcgtgagggaccccggcggcatctgggccaaactgggagcagccgaggccagtgcagagagattacagggccgaagatctcgcggagcttctggatccgagccacagcagatggggagtgacgtgcgggatttgaatgcactcctccccgccgtgccctcattgggggggggaggaggctgcgcactgcctgtcagcggagccgcccagtgggccccagtgttagatttcgccccgccaggagcgtcggcatacggttccttgggtggtccagcccctcccccagccccgcccccacccccacctccacctccacactctttcataaagcaagagccctcgtggggtggcgcagaaccccacgaagaacaatgtcttagtgcatttactgtccactttagcgggcagtttaccggtactgctggagcctgtcggtatggaccatttgggccacctccaccaagccaggcatcctccggacaggcccgtatgtttcctaatgcaccttatttgcccagctgcctggagagccagcctgccatcagaaatcaggggtatagcaccgtgacctttgacggcactccaagttatggccatacgccctcccaccatgccgctcagttccccaaccattccttcaagcacgaggacccaatgggccagcagggttctctgggggagcagcagtactccgttcctccacctgtctacgggtgccatacgccgacggactcatgtaccgggtctcaggcattgctgctccggactccttatagctccgacaatctgtaccagatgacaagccagttggaatgcatgacgtggaaccagatgaatcttggggccaccctgaagggctag

SEQ ID NO: 27021 - DNA, 909 bp, Artificial Sequence
  Description of Artificial Sequence: Synthetic coding sequence
atggagaagggctacagcaccgtgaccttcgacggcacccccagctacgggcacacaccctcacatcatgctgctcaattccccaatcactcattcaaacacgaagatcccatgggtcagcaggggtcattaggagaacagcagtatagtgttcccccgcccgtttacgggtgtcacaccccaaccgattcatgtacgggctctcaggccttgttacttcggaccccttattctagtgataacttgtaccaaatgacctcccagcttgagtgtatgacgtggaatcagatgaacttgggcgccaccctgaagggggtggcggcaggttcttctagctctgtgaagtggaccgaggggcagtctaaccattctacgggctatgaatccgataaccacactacacccatcctgtgcggagctcagtatcggatacacacacatggggtttttcggggaatccaagatgtgcgacgcgtgccgggggtggcccctaccctggtgcggtcagcttccgaaacttccgagaagcgccctttcatgtgcgcctaccccggttgcaacaaacggtacttcaagctgtctcatttgcagatgcatagtcgcaaacataccggagaaaaaccatatcagtgcgacttcaaagactgcgaacgcagattcagccgctctgatcagctgaagcgacatcagaggagacataccggcgtcaaaccctttcagtgcaaaacatgccaaaggaaattcagtcgctcagatcaccttaagactcacacccggacacacaccggagaaaaaccattctcatgcagatggccaagctgccagaagaagtttgctcggagcgacgaacttgttaggcaccacaacatgcaccagcgtaacatgactaagcttcagctagccctctag

SEQ ID NO: 27022 - DNA, 1545 bp, Artificial Sequence
  Description of Artificial Sequence: Synthetic coding sequence
ctgcaggaccccgccagcacctgcgtgcccgagcccgccagccagcatacacttcgtagcggaccgggatgtttacagcagcctgagcagcagggcgtaagagacccaggcggaatatgggctaagttaggcgctgcggaagcctcagcagagagactccagggccggaggagtcggggtgccagtgggtccgagccccagcaaatgggctccgatgtgcgggatctgaacgccttactcccagccgtgccttccctcggcgggggcggcggttgcgcattaccagtgtccggggcagcccaatgggcgcccgttttggacttcgcgcctccgggagccagcgcttatgggtccctaggcggcccagcccccccccccgccccaccaccacctcccccccctccaccccactctttcataaagcaagagcccagctggggtggcgccgagccccacgaggaacagtgtttaagcgccttcaccgtacattttagcggccagttcacaggtacggcaggagcctgtcgctacggaccctttggtccccctcctcctagtcaggcctcctcagggcaagctcggatgtttcccaatgctccatacctgccctcttgtctagaatcccagccggccattagaaaccagggctattctactgttacctttgacggcactccatcatatggccacaccccctcacaccatgccgcccagttcccaaatcacagttttaaacatgaagatcctatggggcaacaggggtcgttgggagaacagcagtactcagttccaccccccgtgtatgggtgtcacacccccacagacagttgcactggatcccaggccctgctcctcaggaccccatacagctccgacaatctttaccagatgacctcccagctcgagtgcatgacttggaatcagatgaacctcggagccacgttgaagggtgtggctgctggctcctcttcctcagtcaagtggacagaagggcagtccaaccactcaaccgggtatgaaagcgataatcatacaaccccgatcctatgcggcgcacagtaccgcatccacacccatggcgtattccgaggtattcaagatgtccgacgcgtccctggtgtagcaccaactctggtgcggagcgctagcgagacttctgaaaaaagaccattcatgtgtgcctatcctgggtgcaacaagaggtactttaaattatctcatctgcagatgcacagtcggaagcacacaggcgaaaagccctatcaatgtgacttcaaggactgtgaaagaaggtttagcagaagcgatcagctcaagagacatcagcgccggcataccggagtaaagccttttcagtgtaaaacctgtcagaggaagtttagtcgcagtgaccatttaaagacacacacaaggacacacacaggtgaaaaacctttctcttgccggtggccaagttgccagaagaagtttgcccgcagtgacgagctagtccgccaccataatatgcatcaacgcaacatgaccaaactgcagctggctttgtag

SEQ ID NO: 27023 - DNA, 1494 bp, Artificial Sequence
  Description of Artificial Sequence: Synthetic coding sequence
ctgcaggaccccgccagcacctgcgtgcccgagcccgccagccagcatacgctccggagcgggccaggctgtcttcagcaaccggaacagcagggggtgcgcgatccggggggtatctgggctaagctcggggctgctgaggcctccgcagagaggttacagggcaggcgatcccgtggggcgtctggctctgaaccccagcagatggggagcgacgtgcgcgacctgaatgcactcttacccgctgtgccttcccttggaggcggcggtggttgcgcgttacccgtttcgggcgccgctcagtgggcgccagtattagactttgcccctcccggagcctcggcgtatggctccttaggagggcctgccccccctccagccccccccccgccacctccacctcccccacactcctttatcaagcaggaaccctcctggggtggtgcagagccacatgaagagcagtgtctctctgcctttacagtgcatttcagcggccagttcacaggaacagcaggggcttgccgctacgggccctttggaccaccacccccatcccaagcaagttcaggtcaggcccgcatgtttccaaacgccccctacctgccaagttgtctggaatcccagcccgcgatcagaaaccaaggatattctactgtgactttcgatggcaccccatcctacggtcatactccgagccaccacgccgcccagtttcctaaccactcctttaaacacgaagacccaatgggtcagcagggctcgctaggcgagcagcagtactcagttcctcccccggtttacggctgtcatacgccaactgattcctgtaccggttcccaggctctcctgttgcgcaccccttactctagcgataatttgtatcaaatgacatcgcaactcgagtgcatgacctggaaccagatgaacctgggcgctacactgaaaggacattctactggttacgagtcagataaccataccacgccaatcctgtgtggcgcgcagtatagaattcatacccatggcgtgttcagagggatccaagacgtacgccgcgttcctggtgtggccccaactttagtcagatcagctagtgagactagcgagaaacggccctttatgtgcgcctaccctgggtgtaataagcgctacttcaagttgagccacctgcagatgcattcaagaaaacacacaggcgagaagccttaccagtgtgattttaaagattgtgaacgccgctttagcaggagcgatcagctgaaacgccatcagcggagacatacaggggtcaagccatttcagtgtaagacatgccagcggaaattctcacgaagtgatcacctgaagacacacacgaggacccacacaggcgagaagcctttttcgtgtaggtggccgtcctgtcagaaaaagtttgctagatcagacgagcttgtgcgtcaccacaatatgcaccagcggaacatgaccaaattgcagctggccctgtag

SEQ ID NO: 27024 - DNA, 396 bp, Artificial Sequence
  Description of Artificial Sequence: Synthetic coding sequence
atgggccagcagggcagcctgggcgagcagcagtacagcgtgcccccgcctgtctacgggtgccacacacccaccgatagctgcaccggaagccaggccctcctcttgaggacaccttatagtagcgataacctctaccagatgacaagtcaactggaatgcatgacctggaatcagatgaacctgggggccacattgaaaggcgttgccgctggttcctccagctcagtcaaatggacagaagggcagagcaaccatagcacaggttatgagtcagacaaccatacaacgcctattctttgtggggcccaatacaggattcatacacacggggtgttcaggggaattcaggacgtccggagggtgcctggcgtggcccccacactggtaagatag

SEQ ID NO: 27025 - DNA, 537 bp, Artificial Sequence
  Description of Artificial Sequence: Synthetic coding sequence
tgactgggcgccaccctgaagggcgtggccgccggcagcagcagctctgtcaagtggactgaagggcagagcaatcactcaaccggctatgaaagcgataatcatacaacaccgatcctttgcggggcccagtaccgtatacacacacatggcgtctttcgcggaatccaagatgtgaggagagtgccgggggttgccccaactctagtgcgtagcgcttctgaaaccagcgagaaacggccattcatgtgcgcatatcccggatgtaataagagatactttaaactcagccatctgcaaatgcattcccgtaaacataccggcgttaaacctttccaatgtaagacttgccagcggaagtttagtcggtcagaccacctgaagacccatactaggacacatacaggaaaaaccagtgaaaaacctttctcctgtcggtggcccagctgccagaaaaaattcgctcggtcagacgaactagtacgacaccataacatgcaccaaagaaatatgactaaactgcaattagctctgtag

SEQ ID NO: 27026 - DNA, 867 bp, Artificial Sequence
  Description of Artificial Sequence: Synthetic coding sequence
atggagaagggctacagcaccgtgaccttcgacggcacccccagctacgggcatacaccctcacaccacgccgcgcagtttcctaatcattcttttaagcatgaagatccaatgggacagcagggaagcctgggggaacagcaatactcagtccctcctcctgtgtatggctgccacactcccactgatagttgcacagggtctcaggctctgctcctgagaacgccatattcctcggacaacctatatcagatgaccagccagctcgagtgcatgacttggaaccagatgaacctgggtgccaccctcaagggacactccaccgggtacgagagcgataaccatacgacgccaattctgtgtggagcgcagtacaggattcacacacatggggttttccgcgggattcaggatgtcagacgagtgcctggtgtggctcctacactggtgcggtctgcttcagagacaagtgaaaagcgccccttcatgtgtgcttatccaggctgtaataagagatacttcaaacttagccatctgcagatgcactctcgaaagcacaccggggaaaagccctaccagtgtgatttcaaggactgcgagcgccgcttctctcgatccgaccagctgaaaagacaccagagacgccacactggtgtcaagccttttcagtgcaagacatgccaacgcaagttcagccggtcagatcacctgaaaacacatacaagaacgcatactggtaaaaccagtgaaaaaccgtttagctgtaggtggccttcctgccaaaaaaagtttgccagatcagatgagctggtaagacatcacaatatgcatcagcgcaacatgaccaaactccagctggccctttag

SEQ ID NO: 27027 - DNA, 1065 bp, Artificial Sequence
  Description of Artificial Sequence: Synthetic coding sequence
atgcgggcccggccccaggtgtgcgaggccctgctgttcgccctggcactccagacaggtgtgtgctacgggatcaagtggctggcactgtctaaaaccccatctgcactcgcactgaatcagacccagcattgcaaacaactggaggggctggtgtcggcacaggtccagctgtgtaggtctaatctcgagctgatgcataccgtggtgcacgccgctagggaggtcatgaaggcctgccgacgggcgttcgcagacatgcgctggaattgttcctcaatcgagcttgccccgaattacttactagatttggagcggggcacccgggagagcgcttttgtatatgccctgtccgccgcagctattagccacgctatcgccagggcttgtaccagcggggacctgccggggtgttcttgcggccctgttcctggagagccccctggcccgggtaataggtggggagggtgcgctgataacttgtcttatggtctgctgatgggggctaaattctctgatgctccaatgaaggtcaagaagactggctcacaagctaacaaactgatgagactccacaatagcgaggtgggaaggcaggcactacgggcgagcctggagatgaaatgtaaatgtcatggcgttagcggatcatgctctatccgaacgtgctggaaaggactccaagaactccaagacgtcgctgccgatctaaaaacacggtatctgtcagccactaaggtggtgcacaggcccatgggaacccgcaagcacctggttcctaaggatctcgatatccggccagtgaaagactcggagcttgtttaccttcagtcatctcccgatttctgtatgaaaaacgaaaaggtcggaagccacgggacccaggacaggcagtgcaacaaaactagtaatggcagcgactcctgtgacctgatgtgttgtgggagaggctataatccctatactgatcgggttgttgaacggtgccactgtaagtaccactggtgttgctacgtgacctgccggcgttgtgaaaggacagtggagagatacgtgtgcaaatag

SEQ ID NO: 27028 - DNA, 762 bp, Artificial Sequence
  Description of Artificial Sequence: Synthetic coding sequence
atgcgggcccggccccaggtgtgcgaggccctgctgttcgccctggctctgcagaccggggtttgctacggaatcaagtggctggctctttctaagaccccatccgccctggcgctcaatcagacacagcactgtaagcagctcgagggtctggtgtccgctcaggtccagttgtgtagatctaatctcgaattgatgcacactgtcgtccatgccgctcgcgaggtgatgaaagcctgtcgtcgagcattcgccgatatgcgctggaactgtagttccatcgagctcgcccctaactatctcttggatttggagcggggcactagggaaagtgctttcgtatacgctctgtctgcagccgctatcagccatgcaatagcacgggcctgtacctccggagacctccctggctgttcctgtgggccagttcccggggagcctcccgggcccggcaatcgttggggaggctgcgctgacaacctgtcttatgggcttctcatgggcgcgaagtttagtgatgctccaatgaaggttaagaaaactgggtctcaggctaacaagctaatgagactccacaactcagaggttgggagacaggctttgagagcctctctgctggtgaattcccggtgccaggcctgggaggcagcttgtgcgctgccttcattaggcagtcaccaggagcagaaggtgtggcctccctggaaagagggcaggaccagcaaagagacagacaaaatcaaaaacaacctggctgcatag

SEQ ID NO: 27029 - DNA, 18 bp, Artificial Sequence
  Description of Artificial Sequence: Synthetic coding sequence
atgcgggcccggccctag

SEQ ID NO: 27030 - DNA, 1143 bp, Artificial Sequence
  Description of Artificial Sequence: Synthetic coding sequence
atgaagaagagcatcggcatcctgagccccggcgtggccctgggcatggcagggtcagccatgagcagtaaattctttctcgtggccctcgccattttcttttctttcgcccaagtggtcattgaagcgaactcatggtggtcgctcggcatgaataacccggtgcagatgagcgaggtctatattattggtgcacagccgctgtgctctcagctagccgggttatcgcaaggccagaaaaaactgtgccacctttaccaagaccacatgcagtacattggagaaggtgcaaaaacaggcattaaggagtgtcagtatcagtttcggcatcggcgttggaattgctcaaccgtggacaacaccagtgtgtttggtcgggttatgcagataggctccagagagaccgcttttacctacgccgtgagcgcagcaggcgtcgtgaacgcaatgagtcgcgcctgccgggaaggcgagctgagcacatgtgggtgctctcgcgcagcaagacctaaggatttaccgcgggactggctgtggggtggctgtggagataacatcgattatggatatcgcttcgcaaaagaatttgtagatgcacgggagcgcgaacgcattcatgccaagggctcgtatgagtccgctaggattcttatgaacctgcataataatgaggccggcaggcgcacagtttataatctggcggatgttgcctgtaaatgccacggcgtgtccggaagctgcagcctgaagacgtgttggctgcaactggcagatttccggaaggtgggagacgccctcaaggagaaatacgattcggccgctgcaatgcgcctgaacagtagaggaaaacttgtccaggtcaatagtcggttcaactctccgactacacaggacttagtttatatagacccttcccctgattactgtgtcagaaacgagagcaccggcagcctgggcacgcaagggcgcctctgtaacaagaccagcgaggggatggacggatgtgagctgatgtgctgcgggcggggttacgatcagtttaaaaccgtgcagacagaacgatgccactgtaagtttcattggtgttgctatgttaaatgcaaaaagtgcaccgagatcgtggatcagtttgtatgcaagtag

SEQ ID NO: 27031 - DNA, 390 bp, Artificial Sequence
  Description of Artificial Sequence: Synthetic coding sequence
atgaagaagagcatcggcatcctgagccccggcgtggccctgggcatggcaggctccgccatgtcttccaagttcttcctggttgccctcgccatctttttctcattcgcccaagttgtaattgaggcaaactcctggtggagcttagggatgaacaatcctgttcagatgtcacaggatgtgggaggtcatggatggttgcgggcccatgtacttagaccctggctgcggccggtacaggaccgtgcagacggggccctaccactgcaggtgcctctcgtgctactgcggcaggtgcaggaggtacacggagaccgcggacccgtgtgtgtgcaggtagttggggctacccaacatagcgcccccctgcccggccccgcgtacctgtag

SEQ ID NO: 27032 - DNA, 1143 bp, Artificial Sequence
  Description of Artificial Sequence: Synthetic coding sequence
atgaagaagagcatcggcatcctgagccccggcgtggccctgggcatggccggtagcgccatgtcatcgaagttctttctggtggctttggcgatctttttctcttttgctcaggtggtgatcgaagctaattcttggtggtcactgggcatgaataaccccgtccaaatgagtgaagtgtacatcataggcgcccagcctctatgctcccagctggccgggctcagccagggccagaagaaactgtgtcacctgtatcaggaccacatgcagtacattggcgaaggagccaaaactggtataaaggaatgtcagtaccagttcaggcatcgccggtggaactgtagcaccgtggacaataccagtgtgttcggacgcgttatgcagattgggagtcgggaaacggcgttcacttatgccgtcagtgccgctggtgtcgttaatgcgatgtctcgagcctgtcgggagggggagctaagcacatgcggctgcagtagagcagcaagacccaaagatttgccccgagattggctctggggcggatgtggcgacaacatagactatggctacagattcgccaaagaattcgtcgacgcaagagagcgtgaacgcatccatgcaaagggctcttacgagtccgcccgcatactcatgaatcttcacaacaacgaggcgggacgtcgcacagtgtataacctggctgacgtggcctgtaagtgtcatggcgtctctggtagttgcagcttaaaaacatgctggctgcaactcgccgatttccgcaaggtgggtgatgccttaaaggagaaatacgactccgccgcggctatgcggctgaattcacgcggcaagctggtccaggtgaatagtagattcaacagcccaactacacaggacctcgtgtatattgacccaagtccagactactgcgtgcggaatgagagcaccgggagcctcggcactcaagggcggctctgcaataaaacgtccgagggtatggatggatgtgaactaatgtgttgcgggcgagggtatgatcagttcaagacagtgcagaccgagcgctgtcactgcaagttccattggtgttgctatgttaagtgcaagaagtgtacagagattgtcgatcagttcgtctgcaagtag

SEQ ID NO: 27033 - DNA, 645 bp, Artificial Sequence
  Description of Artificial Sequence: Synthetic coding sequence
atggccggcagcgccatgagcagcaagttcttcctggtggccctggccatcttttttagcttcgcccaagtggttatcgaagccaatagctggtggagcctgggaatgaacaaccccgtgcagatgagcgaggtgtacattatcggagcccagcctctgtgctcccagctcgctggactgtcacagggccagaaaaagttatgtcacctatatcaggatcacatgcagtacattggtgaaggggcgaagacaggcatcaaagaatgccagtaccagttccggcacaggagatggaattgctccacagtcgataacactagtgtttttggtcgcgtgatgcagatcgggtcacgtgagactgcgttcacctatgctgtcagtgccgctggcgtggtgaatgctatgagcagagcgtgcagagagggcgagctgagtacatgcggctgctctcgagcggcccgccccaaagatttgcctcgtgattggctatggggcggctgtggggataacattgactatggctaccggtttgccaaggagtttgtggatgcacgggagagggagcggatacacgccaaaggttcctacgagtctgcccggatcctgatgaacttacataataacgaggctggtcgcagagtttag

SEQ ID NO: 27034 - DNA, 1098 bp, Artificial Sequence
  Description of Artificial Sequence: Synthetic coding sequence
atggccggcagcgccatgagcagcaagttcttcctggtggccctggccatcttcttctcctttgcccaggttgtgatcgaggccaactcctggtggagtctcggcatgaacaatcccgtgcaaatgtccgaagtgtatataatcggggcccaacctctgtgttcccagctagctggactctcacaagggcagaaaaaactctgccacctctatcaggaccatatgcagtatatcggcgagggcgccaagaccggtatcaaggaatgccagtatcaattcagacataggcgctggaattgcagtactgtcgacaacaccagcgtgttcggcagagtaatgcagattggctccagggagacagccttcacctatgctgtgtccgccgctggggttgtgaacgccatgagccgagcatgtagggagggcgagcttagtacgtgtgggtgttccagggcagccagaccaaaagacctgccacgtgactggctgtggggcggctgcggggacaatatcgattacggctaccggtttgctaaggaatttgtagacgctcgtgaacgcgagcggatccacgcgaagggcagctatgagagtgcgcggatacttatgaatttacataacaacgaggccggcagaagaactgtttacaatttggcagacgtcgcttgcaagtgccatggcgtcagcggatcttgtagccttaagacttgttggctgcagttggcggactttcgtaaggtaggagatgctctcaaggagaaatacgattccgccgccgccatgcgcctcaattccagggggaaactggttcaagtaaattctaggttcaattctcctacgacccaggacctggtatacatagacccatcccccgactactgcgtccgtaacgagtccacagggtcactggggacacagggccggctctgtaataagacttccgagggaatggacggctgcgagctcatgtgttgcggaaggggttacgaccagttcaagaccgtccagactgaacgctgccattgtaagttccattggtgctgttatgtgaagtgtaaaaagtgcactgaaattgtggatcaattcgtctgtaaatag

SEQ ID NO: 27035 - DNA, 876 bp, Artificial Sequence
  Description of Artificial Sequence: Synthetic coding sequence
atgcagtacatcggcgagggcgccaagaccggcatcaaggagtgccagtatcagttcagacaccgccgctggaactgtagcaccgtggacaatactagcgtgttcgggagagtgatgcagatcgggagccgcgagaccgcctttacctacgctgtgtcagccgctggggtggttaacgcaatgtcccgggcttgccgtgaaggtgagctgtctacctgcggatgtagcagggcggcccggcctaaggacctccctagagattggctgtggggtggttgtggggacaatatcgactatggctataggttcgctaaagagtttgtggatgccagggaaagagagagaattcatgccaaaggcagctacgaatctgcccgcattctgatgaatctgcataacaatgaggcaggaaggcgcactgtgtacaacctggcggatgtagcatgcaaatgccacggggtttcaggaagctgcagcttgaagacttgctggctccagcttgccgatttcagaaaggtgggtgacgcccttaaggagaagtacgactccgctgcggccatgcgtctcaatagccggggcaaactggtccaagtgaatagtagatttaattcacccaccacgcaggatctggtgtatatcgacccatcccccgattattgcgttaggaacgagagtactgggtccctcggaacccagggtcggctgtgcaacaagacatcagagggaatggatgggtgcgagctcatgtgctgcggcaggggctatgatcaattcaaaacagtgcagactgagagatgccactgtaaattccattggtgttgctacgtgaagtgtaaaaaatgcacagaaattgtggaccaattcgtgtgtaagtag

SEQ ID NO: 27036 - DNA, 1080 bp, Artificial Sequence
  Description of Artificial Sequence: Synthetic coding sequence
atgcccagcctgctgctgctgttcaccgccgccctgctgagcagctgggcccaactcctgaccgatgcaaactcatggtggtcactggctctgaatcccgtccagcgtcccgagatgttcatcatcggcgcccaacctgtgtgcagccagctgccaggcctcagtcccgggcaacgcaaactgtgccagttatatcaggaacatatggcttacatcggtgagggcgccaagacgggtattaaagagtgccaacatcaatttaggcaaagaaggtggaactgtagcacagctgacaacgctagcgtgtttggtagagtaatgcagattggatcacgtgagacagccttcacgcatgccgtctccgcagctggagtggtgaacgcaatttcccgagcatgccgcgaaggggaactgtcaacttgcggatgtagcaggacggcccggcctaaggacctccctcgggactggctgtggggcgggtgtggtgacaatgtagagtacggataccgtttcgctaaagagttcgtggacgccagggaacgtgagaaaaactttgcaaagggctccgaggagcaggggagagtactgatgaatctgcagaacaatgaagccggtaggcgcgcagtctataaaatggctgacgtagcatgcaaatgtcacggcgtgagcggcagctgctctctcaagacatgctggctgcagttggccgagtttcggaaagtgggagacaggctaaaggaaaaatacgattccgctgctgctatgagggtaactaggaaaggacggcttgagctggtcaattcaagatttacccagcccactcctgaggacttagtatatgttgatccctctcctgattactgccttcggaatgagagcactggctcgcttggtacccaaggccgattatgcaataagacgtctgaagggatggacggatgtgaacttatgtgctgcggaagggggtacaatcaattcaagtctgtgcaagtggagcggtgtcattgtaagttccattggtgttgctttgtgcgttgcaaaaagtgcacggagatcgtcgatcaatacatctgcaaatag

SEQ ID NO: 27037 - DNA, 1080 bp, Artificial Sequence
  Description of Artificial Sequence: Synthetic coding sequence
atgcccagcctgctgctgctgttcaccgccgccctgctgagcagctgggcccaactgctgaccgacgcaaactcatggtggtctctggctcttaatcctgtgcagcggcccgaaatgttcatcatcggggcccagcccgtatgctcgcagctcccaggcttgtcccccggacaaaggaaactgtgccaactgtaccaagaacacatggcatacattggcgaaggtgccaaaacaggaatcaaagaatgccaacaccagtttcgccagcgtcgttggaactgttcaactgctgacaatgcgtctgttttcggacgcgtgatgcaaatagggtctcgtgagacagccttcacccacgcagttagcgccgctggcgtagtgaatgcaatttctcgggcctgtcgcgaaggagagctctcaacctgcggttgtagccggaccgccagacccaaagacctgccaagagattggttatgggggggctgtggggacaacgtggagtacgggtatcgttttgcgaaggaattcgtggacgctcgcgagcgcgaaaaaaattttgccaaaggctccgaggagcaggggcgcgtccttatgaatttacagaacaacgaggccggccggagagctgtctacaaaatggccgacgtggcatgtaagtgtcacggcgtatcaggctcctgtagtctgaaaacgtgctggttacagctggccgagttccgcaaggtgggggatcgcttaaaagagaagtacgatagcgctgctgctatgcgagtcactagaaaaggaaggttagagctagtgaactcacgtttcacccaacctacgcctgaagacttagtgtacgttgaccccagtcctgactactgcctgcggaatgaaagcactggctctctcggcacgcaaggccgtctgtgtaacaagacttcagaaggcatggatggttgcgagctgatgtgttgcggacggggatacaaccagttcaagagcgtccaggtggagaggtgccactgcaagtttcactggtgttgcttcgtacgatgcaaaaagtgtacagaaattgtcgaccagtatatttgcaagtag

SEQ ID NO: 27038 - DNA, 1080 bp, Artificial Sequence
  Description of Artificial Sequence: Synthetic coding sequence
atgcccagcctgctgctgctgttcaccgccgccctgctgagcagctgggcccagttgctcaccgacgctaacagctggtggtctttggccttaaaccctgtccagagacctgaaatgtttataattggagctcaaccggtctgttcccagcttcccggactctctcctgggcaacgcaaactttgccagttgtatcaggagcacatggcctacattggagaaggagcaaaaaccgggataaaggagtgtcagcatcagttccggcaaagaaggtggaactgcagtacggcagataatgcttcagtgttcggaagggtgatgcaaattggctccagggagaccgccttcacccatgccgttagcgccgctggtgtggtcaatgccatatcccgcgcttgtcgcgagggcgaactgtcaacctgcggatgctcacgaacagctagaccaaaagacctgccacgcgactggctgtggggcggctgcggcgacaatgtggaatacggatatcggtttgccaaagaattcgtggacgcaagggagcgtgagaagaactttgcgaagggcagcgaagaacagggacgggttttaatgaatctgcagaacaatgaagcagggcgccgagccgtttacaagatggctgatgttgcatgcaagtgccatggcgtgagtggctcatgctcacttaagacatgctggctgcaattggccgagttcaggaaggttggagaccgtcttaaggaaaaatacgatagcgctgcagctatgcgggtgactcgaaaagggcgcctggaactggttaattccaggttcacccaaccaaccccggaggatctggtctacgtcgacccaagtcccgactactgcctcagaaatgagtccacggggagcctggggactcagggcagactctgcaataagaccagtgaagggatggacggatgtgagctaatgtgctgtggacgggggtataaccaatttaaatctgtgcaggtggagaggtgccattgtaagtttcattggtgttgcttcgtgcgatgcaagaaatgcactgagatcgtggatcaatacatctgcaagtag

SEQ ID NO: 27039 - DNA, 1398 bp, Artificial Sequence
  Description of Artificial Sequence: Synthetic coding sequence
atgaccggccgggccatggaccccctgcccgccgccgccgtgggcgcagccgccgaggccgaggccgatgaagaagccgatcctcccgctagtgacctccctacgccacaggccatagagccgcaggctattgtccagcaggtaccagctcccagccgtatgcagatgcctcaaggcaatccgctcttgcttagtcatacccttcaggagctactcgcaagagacacagtgcaggtggaactcataccagaaaaaaaaggcttatttctcaagcatgtggaatacgaggtgagttcccaacggttcaagtcaagcgtgtacagacggtacaacgactttgtggtttttcaagagatgctcctccataagttcccttatagaatggtgccagctctgcctccaaagcggatgctgggagcagacagggagttcattgaggccaggaggcgcgcattgaagcgcttcgtgaatctggtcgccagacatccattgttctctgaagacgtggtgctcaagctattcctgtcattctccggctcagatgtccaaaataaactcaaggagagtgcccagtgtgttggagatgagttcctcaattgtaaactggccacccgggcaaaggatttcctcccagcggatatacaggcacagtttgcgatttctcgagaacttattcggaatatctataatagcttccataagctgcgcgatagggctgaacggatcgcctcccgagccatcgacaatgccgctgatctccttatcttcgggaaagagctgagcgctattggaagcgacaccactccactccccagttgggccgcccttaatagcagtacctggggcagcctgaagcaggctcttaaaggcctgagcgttgaattcgctcttctagccgacaaggcagcacagcaggggaagcaggaagaaaacgatgtggtcgagaagctgaatctattcctggacttactgcagtcttataaggacctgtgtgagcgccatgagaaaggggtgctccataaacatcagcgtgcattgcacaaatattccctcatgaagcgccagatgatgagtgccacagcgcagaaccgggagccagagagcgtagagcagctcgaatcacgcattgtggaacaggaaaacgcgatccagaccatggagttaagaaactacttttctctgtactgtttacatcaggagacccaactcatccatgtttatctgcccctcacatcccatatcctccgggcctttgtgaactctcagatccaaggacacaaggagatgtccaaggtgtggaatgacctccgaccgaagctcagttgccttttcgcaggacctcattcaaccctcaccccgccatgttcaccccccgaagacggtctgtgtcctcactag

SEQ ID NO: 27040 - DNA, 174 bp, Artificial Sequence
  Description of Artificial Sequence: Synthetic coding sequence
atgagcagcgtgcagcagcagcccccccccccccggcgggtgaccaatgtcggcagccttctcctgaccccccaggagaacgagtccctgttcactttcctgggaaaaaaatgcgtcaccatgtcgtccgccgtcgtgcagctttatgccgcagaccgcaacctttcgtgttag

SEQ ID NO: 27041 - DNA, 1140 bp, Artificial Sequence
  Description of Artificial Sequence: Synthetic coding sequence
atggcccggcggagcgccttccccgccgccgccctgtggctgtggtctatcctcctgtgcttgctcgccctgagggccgaagctggacctcctcaagaggagagtctctatctgtggatagacgctcaccaagcccgcgtccttattggcttcgaagaagatatcctgattgtgtccgaggggaaaatggccccatttacccacgatttcagaaaagcccagcaaaggatgcccgcaatacctgtcaatatacacagcatgaacttcacctggcaggccgccggtcaggctgagtatttctatgaatttttgagcttacggtctctcgataaagggattatggccgaccccaccgtgaatgttccccttcttgggaccgtgcctcacaaggcctccgtggtgcaggtaggctttccctgcctgggcaaacaggacggggtcgcagccttcgaggtcgatgtcattgtcatgaactccgaagggaataccatcctgcagacacctcaaaatgcaatattttttaaaacatgtcagcaggcagagtgcccaggaggatgtcgaaatggaggcttctgtaatgaaaggcggatctgtgagtgtccagacggctttcatggcccccactgtgagaaagccttgtgcacccctagatgtatgaacggcgggctgtgtgtaaccccaggcttttgtatatgccctcctggcttttatggggttaactgcgacaaagctaactgctccacgacctgcttcaacgggggtacctgtttttatccaggcaagtgcatttgccctcccggtttggagggagagcagtgtgaaatcagcaagtgcccgcaaccctgcagaaacggtggcaaatgtatcggcaaatccaagtgcaagtgcagtaagggttaccagggcgatctttgttctaaacccgtttgcgagcccggttgtggagcacatgggacatgtcacgaacctaacaaatgtcagtgccaagaaggctggcatggacgccattgtaacaagcggtacgaggcgtcactcatccacgcactccggccagcgggcgcacaattgaggcagcacaccccaagtctgaaaaaagccgaggagagaagggacccccccgagagtaattatatctggtag

SEQ ID NO: 27042 - DNA, 120 bp, Artificial Sequence
  Description of Artificial Sequence: Synthetic coding sequence
aagaagcggaaggagaagaagcgggagaagcggcggggcaaggagaggaaggaactgttcaaattagtatcccacgtcttggaaaatagaatgggatggcagcaccttaagtggatgtag

SEQ ID NO: 27043 - DNA, 1095 bp, Artificial Sequence
  Description of Artificial Sequence: Synthetic coding sequence
atggcccgggccagcgaggccgtgagccggatcctggaggagtggcacaaggccaaggtcgaggccatgacgctggacctggcccttcttcgctctgtgcaacactttgccgaggcattcaaagctaagaatgtccctttgcacgtgttggtatgcaacgctgccactttcgcactgccttggagcctgacaaaagacggtctggaaactacattccaagtgaaccaccttggccatttctatttggtccagctcctgagaatgttttgtgccgcgcagctcctacctgtaagcctctggagcccacagagtcccattgatttacagatcctcacgaccccctgggaaaactggacctcagtcgcctctctgcaacagaaaacgaccatagggagatgttggctcattacgggccctagctcagcgacgtctagcagccctacgtcctgcacagtggcaccaactaggggtcacgttgagaggagcgcttcttggaaatatgatgtgctacaacattcaagccagctggtcggcgtgcacaccgcagtgtacctgggcgaggccttccatcaggtccacgccaccgggtcgtgccaccatcgcgtactgtgttgctgcccacgaactggcggctccgggcgtgacgtgctgcagcaactcctccctctgcacgcccttactcggagctctgagaggcgggacgggccggatccagtgggatccgagaggctaatacaagaacgcctcgcctcaccagcaaagtggtcgtctgaaaggatggggacccacacccgccctgtgtgcgtcccatccaggaagtgtcaaggcccactccctaacgtgccccctactcagattcggaaatccaagggcaacaagagctcacacaaccgggtcaagaatctcaaataccagtgggaggctggcaactcctgggggaaggtcagcctgttctggggctgggctcgacaccgtagcctctgtttccttgtcgtcgcttgccttaaagtcaaaacgtgtctggtttgccgctttcgtatatctctggaaaaacatcagcaatttagttttttctactgttataggattgcttag

SEQ ID NO: 27044 - DNA, 570 bp, Artificial Sequence
  Description of Artificial Sequence: Synthetic coding sequence
atggccgccctgcggtacgccggcctggacgacaccgacagcgaggatgagttgcccccaggttgggaagaaagaaccacaaaggacggatgggtgtactacgccaaccacacagaggaaaagactcagtgggagcacccgaagactggtaagagaaagcgagttgccggggaccttccctacggatgggaacaggaaacagacgagaacggtcaggtcttcttcgtagatcatataaacaagcgcacgacatatctcgatccacgcctggccttcaccgtggacgacaaccctactaaaccaacaacacgacagagatatgatggaagcactactgccatggagattctccagggtcgcgacttcacagggaaagtcgtggtagttactggagcgaatagcggcatagggttcgagaccgcaaaaagtttcgctctccacggcgctcacgttatccttgcctgcaggaacatggcgcgggcatcagaggccgtgagcagaatcctggaagaatggaagaccaagtaccatcctccccctgagaagtgcagaatcaaaattttccattag

SEQ ID NO: 27045 - DNA, 936 bp, Artificial Sequence
  Description of Artificial Sequence: Synthetic coding sequence
atggccgccctgcggtacgccggcctggacgacaccgacagcgaggatgaactcccaccagggtgggaggaaaggaccaccaaagacggctgggtatattatgcaaaccacactgaagagaaaacccagtgggaacaccccaaaacgggcaaaaggaaacgggtagctggtgacctgccatacgggtgggaacaggagacagacgaaaatgggcaagttttttttgtcgaccacataaacaaacggaccacgtacctggatccaagactggcgtttactgtcgacgataaccccaccaagcccacaacccgtcagagatacgatggatctaccaccgcaatggaaatcctccagggaagagatttcacggggaaggtggtcgtggtgactggggcgaacagtggcattgcgactgggtcttgtcaccatcgggtgctctgctgttgccctcgcacaggcgggtctggcagggacgtcttgcagcaactgctgcctctacacgccctgacgcgctctagtgagagacgcgatggcccggaccccgtcggggcgcaacgcgaggccgatccgcgcacggcctggcaacctgtgagacttagtggcgcccaatctgggtgggctcacacacccgccctatgtgtttcccctcatgctagcgcgcgggcgggccccctgcccaacgtcccgcccactcaaatacggaaaagtaaagggaataagtccagccataatcgggtaaaaaacctgaagtatcagtgggaggccggcaacagctgggggaaggtctccctattttgggggtgggctagacacaggtcactgtgctttctagtggttgcatgcctgaaggtgaaaacgtgtctggtctgcaggttccgcatttcactggagaagcaccaacagttttcgtttttctactgttataggatcgcatag

SEQ ID NO: 27046 - DNA, 705 bp, Artificial Sequence
  Description of Artificial Sequence: Synthetic coding sequence
atggccgccctgcggtacgccggcctggacgacaccgacagcgaggacgagttgcctcccggctgggaagagcgaaccacgaaagacggatgggtgtactacgcgaaccataccgaagagaaaacacagtgggaacatcccaaaactggaaagagaaaacgcgtggccggagacctgccctacggttgggagcaggagaccgacgaaaatggccaagtgttttttgtggaccatattaataaacggacaacatatctggatcccagacttgcattcaccgtggatgacaatccaaccaaaccaacaacccggcagcgttatgatggatctacgaccgcgatggaaatccttcagggccgcgactttacaggaaaagtggtggtggtaaccggggctaattcaggaattggcttcgagacggctaaaagcttcgcccttcacggagcacacgtgattctggcctgccggaatatggcccgtgcctcagaggctgtttcacggatacttgaggaatggcagcaaggggctgctacaaccgtgtactgcgcagcagtgcctgaactggaaggattaggcggaatgtactttaataactgttgtagatgtatgccatcacccgaggcgcagtctgaagagacagcgagaactctgtgggcactctcagaaaggctcattcaagagaggctgggatcccagtctggatag

SEQ ID NO: 27047 - DNA, 1245 bp, Artificial Sequence
  Description of Artificial Sequence: Synthetic coding sequence
atggccgccctgcggtacgccggcctggacgacaccgacagcgaggacgaactcccccctggttgggaggagaggactaccaaagacgggtgggtatactatgctaatcacaccgaagagaagactcaatgggaacatcccaagactggtaagagaaaacgagtggcgggcgacctcccctacggttgggaacaggaaacagacgaaaacggtcaggtattctttgtcgatcatatcaataagcggactacttacctggacccgcggctggcctttaccgtggatgataatcctactaaacccaccactagacagcggtacgatgggtctacgactgcgatggagatcctacaggggagagactttaccgggaaggtagtggtggtgacaggagctaactctggtatcggtttcgaaacagcaaagtcctttgctctgcacggggcacacgtgattttggcctgcagaaacatggcgcgagctagcgaagccgtcagtcgcatactagaggaatggcataaggccaaagtggaggccatgacccttgacttagcgctgctccgaagcgtacaacatttcgcagaggccttcaaagcaaagaatgttccacttcatgtcctagtctgtaacgctgcgacatttgccctgccttggagcctgaccaaagacggcctcgagactacttttcaagtgaatcacctcggtcatttttacctcgtgcagcttctacaggacgtcctgtgtagaagcgcccctgcccgggtgatcgtggtttcctcagaaagtcatcgctttactgatatcaacgacagcctcggaaaactggactttagccgcttatcacccaccaaaaatgactactgggccatgctggcctataaccgaagcaaactgtgtaatattctgttttcaaacgaacttcacagacggctctctcctcgtggtgtaaccagcaacgcagtgcaccctgggaacatgatgtatagtaacatccatcgtagctggtgggtctacacgttgctgttcaccctggcaagaccattcaccaagtccatgcagcagggcgccgcgactacggtctattgtgccgctgtgccagaactggaggggctgggggggatgtactttaacaactgctgtaggtgtatgccctcccccgaagcccagtccgaggagacggcccgcaccctttgggcgttatcagaacgtctaattcaagaacgcctcggctcccagagcgggtag

SEQ ID NO: 27048 - DNA, 642 bp, Artificial Sequence
  Description of Artificial Sequence: Synthetic coding sequence
atggccgccctgcggtacgccggcctggacgacaccgacagcgaggacgagctacctcccggttgggaggaaaggaccaccaaggatggatgggtgtattacgccaaccatacagaagaaaaaacgcaatgggaacatccaaaaaccgggaagaggaagcgagtggccggtgatcttccatatggatgggaacaagagaccgatgagaatggccaggtattttttgtagatcacatcaacaagcgtactacctatctggatcctcggcttgcttttactgtggatgacaatccaactaagcccacaacgagacaaagatacgacgggagcaccaccgccatggaaatattgcagggtcgcgatttcaccgggaaggtcgttgtggttacgggagcgaacagtggtataggcaaggcctcttgtcatgttggaaggattctaaagcatacacgcgtggaggagttgtccctgctgcccacagccattaaccgggagctgcctcccccgtgcacagtcctcctcagccagaattggagagtgtgggagggttgtaccagcactactgccgcagcagcttgtccccatcagaagctacgggccaaacgaagacccgggccttgtggtaggtccgcgagaggatag

SEQ ID NO: 27049 - DNA, 1245 bp, Artificial Sequence
  Description of Artificial Sequence: Synthetic coding sequence
atggccgccctgcggtacgccggcctggacgacaccgacagcgaggatgagttgccgccaggttgggaggagcgaaccactaaagacggctgggtttactacgccaaccacacagaggagaagactcagtgggagcacccaaagaccggaaagcgaaagcgtgtagccggagatctgccttacgggtgggaacaggagacggatgaaaacggtcaggtcttctttgttgaccatataaataagcgcacgacttatttggatccacgactagcctttactgtggatgacaatcccactaaacccactactaggcagcgctatgatggctcgaccacagccatggaaattcttcagggtcgggatttcaccggaaaggtggttgtggtgacaggggccaatagtggaattgggttcgagacagcgaaatctttcgccctgcacggggcccatgtgatactcgcatgtcgtaatatggcaagggcatctgaggcagtttccaggatccttgaggaatggcacaaagcaaaggtggaggctatgacacttgacctggctctcctccgcagcgtgcagcacttcgcagaagcattcaaggctaagaatgtgccacttcatgttctcgtgtgcaacgctgctacctttgcattaccgtggtccctgactaaagatggcctggagacaacgttccaggtgaaccacctgggacatttctatctggtgcagcttctgcaggacgttttgtgccgtagtgcgcccgctagagttatagtcgtgtcttccgagagtcaccgtttcacagacattaatgattctctggggaagctcgatttcagccgtctgagtcccactaagaacgactattgggcaatgttagcctacaatcgctccaagttgtgcaacatactgttcagcaatgagctgcaccgcaggttgagcccccggggggtgacaagcaatgctgtacatcctggcaacatgatgtatagcaacatccaccgcagctggtgggtatacacactgctttttaccctcgcaagaccattcacaaaatccatgcagcagggggcagccacaaccgtctactgtgccgcagttccagagctagagggactgggtggaatgtatttcaacaactgttgcagatgcatgcctagccctgaggcccaatctgaggagactgcaaggacgctatgggccctcagtgagcgactgatccaggaaagactgggcagtcagagtggctag

SEQ ID NO: 27050 - DNA, 111 bp, Artificial Sequence
  Description of Artificial Sequence: Synthetic coding sequence
atggccgccctgcggtacgccggcctggacgacaccgacagcgaggacgaactgccccctggttgggaggagcgtaccacaaaagacggatgggtctattacgcaaagtag

SEQ ID NO: 27051 - DNA, 1047 bp, Artificial Sequence
  Description of Artificial Sequence: Synthetic coding sequence
atggcccacagccagaacagcctggagctgcccatcaacatcaacgctacccaaatcacaacagcgtacggtcatcgcgcactaccgaaacttaaagaagagcttcagtccgaggacctgcagaccaggcagaaagcgcttatggcgttgtgcgatctgatgcatgatccagagtgtatttacaaagctatgaacataggctgtatggagaatctgaaagcactcctcaaggatagcaactctatggtccgaataaagaccacagaggtgctgcacatcacagccagtcacagtgtggggcgttatgcctttcttgagcatgatatagtattggccctcagcttcctactcaatgaccctagcccagtctgcagaggcaacctgtacaaagcctatatgcagctcgtacaggtgccacggggcgcacaagaaatcatatctaagggcttgattagctccctggtttggaagctgcaggtcgaggtggaagaagaggaattccaggaatttattctagataccctggtactctgtttacaagaagacgctaccgaggcattggggagcaacgtggtcctcgtccttaagcagaagctgctgagcgcaaatcagaatatccgatccaaggcagcacgggcccttctcaacgtctccattagccgcgaaggaaagaaacaggtttgtcactttgacgtcattccaatcctcgtgcatctgctgaaagatcccgtcgagcacgtgaaaagtaacgcagccggggccttaatgtttgccacagtcatcaccgaagggaagtacgcggccttagaggcacaggcgattggcttgctgctagagttactgcatagccctatgacaatcgcacgtctgaacgctacaaaggcacttacaatgttggctgaggcgcctgaggggaggaaggccttgcagacacacgtgcccactttccgggctatggaggtcgagacctacgaaaagccgcaggtcgcggaagctctacaaagagctgcacggattgctatcagtgtgatcgaattcaagccatag

SEQ ID NO: 27052 - DNA, 1131 bp, Artificial Sequence
  Description of Artificial Sequence: Synthetic coding sequence
atggtggtggtggccgccgcccccaaccccgccgacggcacccccaaagtgcttctgctatcagggcaaccggccagcgctgctggagcgcccgccggacaggcccttccacttatggttcccgcccaaagaggggcaagcccagaggccgcctctggggggttaccacaagcgcgcaagcggcagcgcttaacccacctgagtcccgaggaaaaagctctgcgcaggaaattgaaaaacagggtggcggcccagactgcacgtgaccggaagaaagcgcggatgtccgagctggaacagcaggtggtcgacctggaggaggagaaccagaagttgctgctcgaaaaccaactgctcagagagaaaacccatggactggtggtcgaaaaccaggagctccgacagcgcctgggcatggatgcgctggtcgctgaggaagaggccgaagccaaaggcaatgaagtgaggccagtagcaggaagcgcggaatctgctgctggagctgggcctgtggttacacctcctgaacatctgcccatggacagcggaggcatcgactccagcgactctgaatctgacatcttactgggaattctggacaatctggaccctgtgatgttcttcaagtgtccgtcccctgagcctgcttcgttagaagagcttcccgaggtttatcccgaaggcccttcttcccttcccgcgagcttgagcctctcagtggggacctcctccgccaaactggaggcaatcaacgagctgatccggttcgaccatatctatacaaagcccttggtgcttgagattccgagtgaaaccgaatcccaggcaaacgtggtggtcaagattgaggaagcacccttaagcccaagtgaaaacgaccaccccgaatttatcgtatccgtcaaggaggagcccgtcgaggacgacttagtacctgaactggggatatcaaacctcctgagctcttctcattgcccaaagccttccagttgtctgctcgatgcttatagtgactgcggctatgggggctcgctcagtccatttagtgatatgtcatctctgctaggagtgaaccactcatgggaagacacgtttgctaacgagctgtttccacagttgataagtgtgtag

SEQ ID NO: 27053 - DNA, 801 bp, Artificial Sequence
  Description of Artificial Sequence: Synthetic coding sequence
atggtggtggtggccgccgcccccaaccccgccgacggcacccccaaagtgctcctgctgtctgggcagcccgcgagcgccgctggcgcccctgctggccaggcgctgcccctgatggtcccagcccagcgaggcgcatctcctgaagcggcctcaggaggactgcctcaagcgcgcaagcgccagcggcttacacatctgtcccccgaagagaaggcccttagaagaaagctgaagaatagggtggccgcgcaaaccgcacgtgaccgcaagaaggctcggatgtcggagctagagcaacaggttgtcgacttggaggaggaggtgaagctacttaagaaccagaaactgctgcttgagaaccaacttttgcgcgaaaagacacatggattagtcgtagagaatcaggaattgcgacagcgattgggcatggacgccctggttgccgaagaggaggctgaggccaaggggaatgaggtgcgccccgttgctggttcagccgaatctgccgcattgcgcctgcgggcgcctcttcaacaagtgcaagctcaactgtccccactgcagaatatctccccttggattctggctgttctcacgcttcagatacagtcgctaatcagttgttgggcattttggactacatggacccaatcctgctctagcaatgccctgccgcagtctctacccgcctggcgtagcagtcagcggtccacacagaaagatcctgttccttatcaaccaccttttctctgtcagtggggccgacaccagccctcgtggaagccattgatgaattag

SEQ ID NO: 27054 - DNA, 636 bp, Artificial Sequence
  Description of Artificial Sequence: Synthetic coding sequence
atgcgggcccccgtgttccaggccctgctgctgtgcggccggcggctggttgtgcaacccctgaattccgacatgcggaagctgaaaaatcgagtggcagcccaaactgccagagacagaaagaaggctagaatgtctgaacttgagcagcaggttgttgacctcgaggaggagaaccagaagctgctgcttgagaaccagctgctcagagaaaaaactcatggactggttgtcgaaaatcaggagctgagacaaagacttggcatggacgccctcgttgcggaagaagaagccgaggcaaaggggaacgaagtcaggcctgttgcaggctctgctgagtcagctgccctgcgcttgcgggccccacttcagcaggttcaagcacagttatcaccactgcagaatatttcaccctggattctggctgtgctaactttgcaaatccagtccctgatatcttgttgggcattttggacgacttggacacaatcctgttcttcaaatgcactgcctcagtcgctgcccgcctggaggagctcccagagatcaactcagaaagacccagtgccatatcagccgccctttctgtgtcagtgggggagacatcagccatcgtggaaacctctgatgaattag

SEQ ID NO: 27055 - DNA, 822 bp, Artificial Sequence
  Description of Artificial Sequence: Synthetic coding sequence
atggccgccgccgacggcgccctgcccgaggccgccgccctggagcagccagccgagctcccagctagcgttagggcctccatcgagcgcaagcgccagagagctttgatgctgaggcaggcacggctcgcagcccgcccctacagtgctacggctgcagcggcaaccggcggaatggctaatgtgaaggctgcgccaaaaattattgacaccggtgggggttttatcctggaggaagaagaagaggaagagcagaagatcgggaaagtggtgcatcagccgggccctgtcatggaatttgattatgtgatctgcgaagagtgtggtaaggagttcatggactcatatcttatgaaccacttcgacctacccacttgcgataattgtcgtgatgctgacgataaacacaaacttatcacaaaaactgaggccaaacaggagtatctcttaaaggattgcgatttagaaaagcgcgagcctcctcttaaattcatcgtaaagaaaaatcctcaccattcccaatggggcgatatgaagctttacctgaagctccagatcgtgaagcgctccctggaggtctggggcagccaggaggcgctcgaggaagccaaggaagtccgtcaggaaaatcgagagaaaatgaagcaaaaaaaattcgataagaaagttaaagagctcaggcgggccgtcaggtcctctgtatggaaaagagaaaccatcgtgcaccagcacgaatatgggcctgaggaaaacctggaggatgacatgtaccggaagacgtgcaccatgtgtggccatgagctcacctatgaaaaaatgtag

SEQ ID NO: 27056 - DNA, 2823 bp, Artificial Sequence
  Description of Artificial Sequence: Synthetic coding sequence
atggcccggaagcgggccgccggcggcgagccccggggccgggagctgagaagccagaagtccaaagcgaagtctaaggctcggagagaggaagaagaagaggatgcctttgaagacgaaaaaccacctaagaaaagcctgctgtccaaggtttctcaggggaagcgtaagagggggtgttcacatccagggggctcagccgatggtcccgcgaagaagaaggtggcgaaggtgactgtaaagagcgaaaatctgaaggtgatcaaggacgaagccctgtctgacggggacgacctgcgcgactttccttcagacctgaaaaaagctcatcaccttaagcggggagcaacgatgaatgaggattccaacgaagaagaggaggaatctgaaaatgactgggaggaggttgaagagctgtccgagcccgtgctcggggatgtcagagaatcgactgctttttccaggtctctgctaccggtaaaacctgtggaaattgaaattgagacaccggagcaggcaaaaactcgagaacgatctgagaagattaagctcgagtttgagacttatctcagacgagccatgaagcgctttaacaaaggcgtccacgaggacacccataaagtgcacctcctgtgcctcctagcaaacggcttttaccggaataatatctgttctcagcccgacttacacgcaattggcctttctataatcccggctagattcacacgggtcctccccagggacgtggacacttattatctgagcaacttggtgaagtggttcataggcacttttactgttaatgccgagttgtccgcttcagaacaagataatctccaaacaacactggagagaaggtttgccatttatagcgctagagatgatgaagagctggtgcacattttcctcctgatcctgcgggcactgcaacttctaacgagacttgtgttgagcttacaacctatcccgcttaagagcgccaccgctaaggggaaaaaaccatctaaagaacggttaacagctgatcctggcgggtccagcgaaacatcctctcaggttctggagaaccacacaaaaccaaaaacaagcaaaggtaccaagcaagaggagaccttcgccaaggggacatgtaggccttctgccaaaggcaagcgtaacaagggaggaaggaagaaacgttcaaagccaagttcctccgaggaggacgaggggccaggcgacaagcaggaaaaggccacgcagcgtaggcctcatgggcgggagcgcagagtggctagtcgagtctcatacaaagaggaatctggctccgatgaggctggctccggcagtgatttcgagctttctagtggagaggcaagcgatcctagtgacgaggatagtgagcctgggcctcctaaacagaggaaagcccctgccccgcagagaaccaaggctggaagcaaatcagcgagtcgcacacatagaggaagtcaccgcaaggatcctagcctgccagctgccagcagctcatcttcttcatcaaaacgtgggaagaagatgtgttcagatggggaaaaagctgaaaagcgttctatcgccgggattgatcagtggcttgaggtcttttgcgagcaagaagaaaaatgggtgtgcgtggattgtgtacatggcgtcgtgggtcagcctctgacttgttataaatatgccacgaaacctatgacctacgtagtggggattgattctgacggttgggtgcgcgacgtgacccagcggtacgacccggtctggatgactgtgactcgcaagtgtagggtggatgctgaatggtgggctgagactctgaggccctaccaaagcccatttatggatcgtgagaaaaaagaggatttggaattccaagccaaacatatggaccagcctttgcctaccgctatagggctgtacaaaaaccatcctctgtatgcactgaaacgccacctgctcaagtatgaggccatctatcccgagacagctgctatactcggttactgccggggcgaagcggtgtactctcgcgattgtgttcatactctgcacagccgggacacttggcttaagaaggcccgggttgtgcgcttgggagaggtgccctacaagatggtcaaggggttttccaaccgcgccaggaaagctcgtttagccgaaccgcaactccgcgaggaaaacgatctgggtcttttcggctattggcagaccgaagagtaccaaccacccgtcgccgtcgatgggaaagttccgcggaatgaattcggtaacgtgtatttattcctgcccagcatgatgccaatcggatgcgtacagctaaaccttccgaatctccaccgcgtcgctcgcaaacttgatattgattgcgtccaggcaattactggattcgactttcatgggggatattctcacccagtgacagatggctatatagtctgcgaggaatttaaagatgtgctgcttacagcttgggaaaatgagcaggccgtgatcgagcggaaggaaaaagaaaagaaggaaaagcgcgccctgggaaattggaagcttttggctaagggccttctcatacgggagcgactaaaaaggcgctatggcccaaagtctgaggcggccgcaccccatacagacgctggagggggactgtccagcgacgaggaagagggaaccagttctcaggcggaagccgcccgcattctggcagcgagttggcctcagaatcgagaagacgaggagaaacaaaaattgaaggggggccccaaaaaaaccaagcgggagaaaaaggccgctgcttcccatttatttccatttgaacaactgtag

SEQ ID NO: 27057 - DNA, 2712 bp, Artificial Sequence
  Description of Artificial Sequence: Synthetic coding sequence
atggcccggaagcgggccgccggcggcgagccccggggccgggagctccggagccagaagtcgaaggctaagtcaaaggcaaggagagaggaagaggaagaggacgctttcgaagacgagaagccccccaagaagagtctcttgtctaaagtgtcgcaaggaaagaggaagcgtggatgcagtcatcctggtgggtccgcggacggtccggccaagaaaaaggtggccaaagtcactgtcaagtccgaaaatctcaaagttataaaggatgaggccttgtccgacggagacgacctgagggacttcccatctgatctcaaaaaagcacatcatcttaaacggggagcaacaatgaacgaagacagcaacgaggaagaggaggaaagcgaaaatgattgggaagaggccaaaaccagggaacggagcgagaaaattaaactagagttcgagacgtatctgcgacgggcaatgaagcgcttcaataaaggcgttcacgaggatacccataaagtgcatcttttgtgtctcctggccaatggattttatagaaacaatatctgctctcagccagacctgcacgccataggtctttcgataattcccgcccggtttacccgcgtgctgccgagggatgtcgatacctactatctatccaacctcgtgaagtggttcatcggcacttttaccgtaaacgccgaactgagcgcgagcgagcaagacaatttgcagactacattagaacgtaggtttgcaatatatagcgctagggatgacgaggaactggtacacatttttctgctcattctccgcgctctgcaacttctgactagattagtactatctttgcagcctatcccactgaagtctgcaacagcaaagggtaaaaagccttcaaaagagaggctcactgcagaccctggcggatccagcgagactagtagccaggtactggagaaccatacgaagccaaaaacctccaagggtaccaaacaggaagagaccttcgccaaaggaacctgtcgaccttcagccaagggtaaacggaacaaggggggcagaaagaaacggagcaagccgagttctagcgaagaggacgaaggacccggcgataagcaggagaaggcaacccagcgaagaccccacggccgcgaaagacgcgttgccagccgcgttagctacaaggaggagagcggcagcgatgaggcagggtccggctctgactttgaactgagttccggtgaggccagcgacccctctgatgaagactccgagcccggaccccctaagcagagaaaagcacctgccccacaacgcactaaggccgggagcaaaagtgctagcagaacccacaggggcagccataggaaagacccgagcttgccagctgcgagctcttcgtcgtcttcatctaagaggggaaaaaagatgtgtagcgatggagagaaagcagaaaagagatccatagcaggcattgaccagtggcttgaggtgttctgcgagcaggaggagaagtgggtctgtgttgactgcgtgcatggcgtggtgggtcaacccctgacatgttacaaatacgccacaaaacccatgacatacgtcgtaggcatcgattccgatggttgggtgcgagacgtcacccagaggtacgaccccgtatggatgactgtgacccgaaaatgcagggtggacgccgagtggtgggccgagactctcagaccttaccagagtccctttatggacagagaaaaaaaggaggatctggagtttcaggcaaagcatatggatcagcctttaccgactgcaataggactatacaagaatcacccattgtatgcactcaagaggcatctgctcaaatacgaagcaatctacccagagaccgccgccatactgggctactgtcgtggtgaagccgtctattcgcgtgattgtgtgcatacactccacagcagagatacttggcttaagaaggctagagttgttagattgggcgaggtcccttacaagatggtgaaaggtttctcaaatagagcccgaaaagccaggctggccgagccgcagctgcgcgaggaaaatgacctgggcctgtttggttactggcagactgaggagtaccaaccccctgtcgcagtggacggcaaggttcccaggaacgaatttggtaacgtgtatctgtttctcccaagcatgatgcccattggatgtgtccagcttaatctccccaacttgcatcgcgtggctcgcaagctcgacatcgattgtgtgcaggctatcacaggttttgactttcacggcggctactctcacccagtgactgacggttatattgtatgcgaagaattcaaagatgtccttctcaccgcctgggaaaacgaacaagcagttatcgaacggaaagaaaaggaaaagaaggagaagcgcgccctgggaaattggaagctcctggccaaaggcctcctcatccgtgaacgccttaaaaggcggtatggccccaagtcagaggccgcagctcctcatactgacgccggaggagggttgtcctcagacgaggaggaggggaccagcagtcaggcagaggcagcacgaatccttgcagctagctggcctcagaatagggaagatgaagagaaacagaagcttaaaggaggacccaagaaaactaagagggagaagaaggctgcggcctcccacctcttcccatttgagcagctctag

SEQ ID NO: 27058 - DNA, 423 bp, Artificial Sequence
  Description of Artificial Sequence: Synthetic coding sequence
atggcccggaagcgggccgccggcggcgagccccggggccgggagttgaggtctcaaaagagcaaggccaaatctaaagccaggagagaggaagaggaagaggacgcgtttgaggacgaaaagccgccaaaaaagagccttctgtctaaggtcagccagggcaaaaggaagcggggctgtagccatcctggcggctccgctgacggtccggctaaaaagaaggttgcgaaagtgactgttaaaagtgagaacctgaaggtgattaaggacgaggctctttcagacggcgacgatctgcgcgactttccctctgacctgaaaaaggcccatcacctgaaacgcggcgccactatgaatgaggactctaacgaagaagaggaggaaagcgagaatgattgggaggaagtcgaggtgaaaagatag

SEQ ID NO: 27059 - DNA, 507 bp, Artificial Sequence
  Description of Artificial Sequence: Synthetic coding sequence
atggcccggaagcgggccgccggcggcgagccccggggccgggagctgagaagtcaaaaatccaaagctaaatcgaaagccagacacgcatttgaggatgagaagccacccaaaaagagcttacttagtaaagtgtcccagggtaagcgaaagagaggatgcagtcatcccggcgggtcggctgacggacctgccaaaaagaaagtggccaaggtgacggtcaaaagcgagaatctgaaggtgattaaagacgaggctctttctgacggggatgaccttcgagacttccccagtgaccttaaaaaagctcaccatctcaaacggggagctaccatgaacgaggactcaaacgaggaagaagaagagtctgagaatgattgggaggaagtagaggaattatcggaacccgttttgggcgacgtgagagagagtactgccttctctagatcactgctcccagtcaaaccagtggagattgaaatcgagactcctgagcaagcgaagtag

SEQ ID NO: 27060 - DNA, 462 bp, Artificial Sequence
  Description of Artificial Sequence: Synthetic coding sequence
agcagcagcaagcggggcaagaagatgtgcagcgacggcgagaaggccgaaaagcgctcaattgctggtatcgaccagtggctggaggtcttctgtgaacaagaggagaagtgggtctgcgttgactgcgtccacggagttgtgggccagccactcacctgctataagtacgccaccaaacccatgacctacgtggtgggcattgatagcgatgggtgggttagggatgtgacccaaagatatgaccctgtgtggatgacggtgactcgaaaatgccgggttgatgccgaatggtgggcagagactctcaggccttaccagagcccattcatggaccgagaaaaaaaagaggacctggaggggttgtgtgcccacagtgcctttcagggccacgtggctgaggaaagcaagagtggagaggcgtggcgatcgacactccaggacggagagagactcttttag

SEQ ID NO: 27061 - DNA, 177 bp, Artificial Sequence
  Description of Artificial Sequence: Synthetic coding sequence
atgtgcagcgacggcgagaaggccgagaagcggagcatcgccggcatcgatcagtggctcgaagtcttctgtgaacaggaagagaagtgggtgtgcgtggattgcaggtgtggcggtcccgcaagcgacttgctgcaggttagacaccaggcccatgacctgtgcggcggtcactag

SEQ ID NO: 27062 - DNA, 231 bp, Artificial Sequence
  Description of Artificial Sequence: Synthetic coding sequence
aaggccacccagcggcggccccacggccgggagcggcgggtggccagccgggtgagttacaaggaagagagcggctcagatgaggcaggttctggttccgatttcgaacttagctcaggagaggcatctgatccatcggatgaggactccgaaccaggcccacctaagcaacgaaaggcacctgctccccagcggaccaaagccgggtctaagagcgcctcccgcacctag

SEQ ID NO: 27063 - DNA, 849 bp, Artificial Sequence
  Description of Artificial Sequence: Synthetic coding sequence
atggagggcgacttcagcgtgtgccggaactgcaagcggcacgtggtgtctgctaatttcacactccacgaagcttactgcctgagattcctggtactgtgccctgaatgtgaggagcctgtgcctaaggagacaatggaagaacattgtaagctcgagcaccagcaagcgaatgagtgccaggagagacccgtagagtgtaagttctgcaagctggacatgcaacttagcaagctggaattgcacgagtcttactgtggcagtcgtacagagctttgtcagggttgtggccagttcatcatgcatagaatgctcgctcagcatcgagacgtgtgccgttcggagcaggcccagctcggcaagggggagcgcatatccgcaccggaacgtgaaatttattgtcactactgcaaccaaatgatacccgaaaacaagtatttccatcacatggggaagtgttgccctgactcggaattcaaaaaacactttccggtgggcaaccccgaaatcttgccctctagccttccctcccaggccgctgaaaaccaaacatcaactatggagaaagatgtccgacctaaaaccagatccattaaccgatttccccttcacagcgagtcgtccagcaagaaagcgcctcggagtaaaaacaagactttggaccctctgctgatgagcgaacccaaaccaaggacaagttccccccgcggagacaaagccgcctacgatatcctcagaagatgtagtcagtgtggcatcctcttgccactgccaattttgaatcagcatcaggagaagtgtagatggctggcatcttctaagggtaaacaggtaaggaacttctcttag

SEQ ID NO: 27064 - DNA, 906 bp, Artificial Sequence
  Description of Artificial Sequence: Synthetic coding sequence
atggagggcgacttcagcgtgtgccggaactgcaagcggcacgtggtgtcagcgaacttcacattgcatgaggcctattgcctgcgattcctcgttttgtgtcctgaatgcgaggagcctgtacccaaagaaactatggaggagcactgtaagcttgagcaccaacaagtaggatgcaccatgtgccagcagagtatgcagaaatcttccttggaatttcacaaagccaacgagtgtcaggaacgccccgtcgagtgtaagttttgtaaactggacatgcagctgtcgaaactcgagctgcacgaaagctattgtgggtctcgaacggaattatgccaaggatgcggacagtttatcatgcatcggatgttagcccaacatcgggacgtgtgcaggtctgagcaggcacaattggggaagggagagcggatttcggctcctgaacgggaaatctattgtcactactgcaaccagatgatcccggaaaacaaatacttccaccacatgggtaaatgttgccccgactccgagtttaagaaacatttcccagtgggtaatccggagatattgcccagctccttgccatcccaggccgcagagaatcaaacttctactatggaaaaagatgtccggccaaaaacccggtccattaatagatttcctctccattctgaaagttcctctaaaaaggcaccccggagtaaaaataagaccctcgacccgctgctaatgtcggagccaaagccccggacaagttccccacgcggcgacaaagctgcttatgacatcctgcggcgatgctcccagtgtggcattctgctaccactgcccattctgaaccagcaccaggaaaagtgtagatggctggccagcagcaagggaaaacaggtccggaacttcagctag

SEQ ID NO: 27065 - DNA, 600 bp, Artificial Sequence
  Description of Artificial Sequence: Synthetic coding sequence
atgagcctgcactacggctgctgctgccccgagtgcaccagcgtggctataaaggagatgatgtgggtgatccgcccacgggtggcctgcgtagtgaaagacgccggcagtgcaggggagagaatcagcgctcccgagcgcgagatttattgtcattactgcaatcagatgattccggaaaacaaatactttcatcatatgggaaaatgctgcccagacagcgagttcaaaaagcacttcccagttgggaatccggagatactgccttcaagccttcctagtcaggctgctgagaaccaaacatccacaatggagaaggacgttcgccctaaaacccgcagcatcaacaggttcccattgcactcagaatcatcctccaaaaaagcaccgcggtctaaaaataagaccctggaccctctgctcatgtctgagccaaagcccagaactagttctcctcggggtgacaaggcagcatacgacatattacgcaggtgctcacagtgcggtatcctgctgcccctccctatcctcaatcagcaccaggaaaagtgccggtggctggccagctcgaaaggcaagcaagttcgtaatttctcatag

SEQ ID NO: 27066 - DNA, 495 bp, Artificial Sequence
  Description of Artificial Sequence: Synthetic coding sequence
atggagggcgacttcagcgtgtgccggaactgcaagcggcacgtggtcagtgccaatttcaccctgcacgaagcctattgtcttcggttcttagtgctgtgcccagaatgcgaggagccagtgccaaaggagacaatggaggagcactgtaaactggaacaccagcaggtaggatgtacaatgtgtcaacagtcaatgcagaagtccagcctcgaattccacaaggccaacgagtgccaagagcggcctgtagagtgcaaattctgcaagttagacatgcagctgtcgaaactggaacttcacgagagctattgcgggtctaggacggaactgtgccaagggtgcggccaattcattatgcaccgaatgctcgcacagcatagggacgtgtgtagatctgaacaggctcagctgggaaaggaaacgagcccagacccggggaagtgtctgtcaattacagtcgccgccgctctgtctgctcacctgtggccttag

SEQ ID NO: 27067 - DNA, 906 bp, Artificial Sequence
  Description of Artificial Sequence: Synthetic coding sequence
atggagggcgacttcagcgtgtgccggaactgcaagcggcacgtggtgagcgcaaacttcacactccatgaagcttactgtctccggttccttgttttgtgcccagaatgtgaagaacccgtccccaaggagacaatggaggaacattgcaagctcgaacaccagcaggtgtccgagatggggtctggtcgtggcaaatgcagcattttgccagcacgcaaaaaagccaatgaatgccaggaacgtccagtcgagtgcaagttctgcaagctggacatgcaattgagcaagctggagctacacgagtcgtactgtggatctaggacggaactatgccaaggctgcggacagtttatcatgcaccgaatgctcgcgcagcatcgcgatgtgtgccgctctgagcaagcgcaattggggaagggtgaacggatttccgcgccagagcgagaaatctattgccactattgtaaccagatgattcctgagaacaaatacttccaccacatgggtaagtgctgtcccgatagcgaatttaagaagcatttccccgtcggaaacccagagatccttccttcctcactgccctctcaggctgccgagaaccagacctccacaatggagaaggacgtgcgccccaaaacacgctctattaaccgattccctctgcacagtgagtcgagttctaaaaaggccccgagatccaagaataaaaccctggatcccctcctcatgtccgagccaaagcctcgcacaagttccccacggggtgacaaagctgcgtacgatattctgcgacgctgtagtcagtgcggcatcctactgccgctccctattctcaaccaacaccaggagaaatgccgctggctggcatcttcaaaaggaaagcaggtcagaaatttttcttag

SEQ ID NO: 27068 - DNA, 1494 bp, Artificial Sequence
  Description of Artificial Sequence: Synthetic coding sequence
atgaccttcaacagcttcgagggcagcaagacctgcgtgcccgccgacattaataaggaggaagaattcgtggaagagttcaatagactgaagacattcgctaacttccccagcggctcccccgtgtcagcctctaccctggccagagcgggctttttgtacaccggcgagggcgatacagtcagatgtttttcttgccacgccgccgtagacaggtggcagtatggggacagcgcggtcgggcggcaccggaaggtgtcccccaactgtcgctttattaatggcttttaccttgaaaacagtgctacccagtcaacaaactccggaatccagaatgggcagtataaggttgagaactacctcggcagtcgtgaccactttgccttagaccgccctagtgaaacacacgcagactatttgctgagaaccggacaggttgtggacatcagcgacaccatttaccctaggaatcccgctatgtattctgaagaggcgcgacttaagtccttccaaaattggcctgattacgcccacctgactcctagagaattagcaagtgccgggctttattacacgggcataggcgatcaggtgcagtgcttttgttgtggcggaaagcttaaaaattgggaaccatgcgacagagcatggagtgagcaccggagacacttccccaattgcttttttgtcctgggccggaacctaaacatccggtctgagtccgacgcggtcagtagcgatcgcaactttcccaatagtacaaatctacctcggaacccctctatggccgactacgaagctcggattttcacatttggaacttggatctactctgtaaacaaggagcagcttgccagggccggcttttatgccctgggcgagggagataaagtcaagtgtttccactgcgggggtgggcttacagattggaaaccgagcgaggacccttgggagcaacatgcaaagtggtatccagggtgcaagtatctgctggagcaaaaaggacaggagtatataaataatattcaccttacacactcactcgaggaatgtcttgtcagaaccaccgaaaagaccccatctctgacacggcggatagacgataccatcttccagaaccctatggtgcaggaagctatccggatggggtttagtttcaaggacattaaaaaaattatggaggagaagatccagattagcggcagcaattataagtctctcgaagtgctggtggctgacctcgtcaatgcccagaaggattcgatgcaggatgagtcttctcagaccagtttacagaaggagattagtaccgaggagcagctgcggaggctgcaggaagagaagttgtgtaaaatctgcatggacaggaacatcgctattgtcttcgtgccgtgcggccacctcgtgacgtgtaagcaatgtgctgaggctgtcgataaatgccctatgtgctatacagtgatcactttcaagcagaaaatcttcatgagctag

SEQ ID NO: 27069 - DNA, 1494 bp, Artificial Sequence
  Description of Artificial Sequence: Synthetic coding sequence
atgaccttcaacagcttcgagggcagcaagacctgcgtgcccgccgacattaacaaggaggaagagtttgtcgaggagtttaacaggctgaagacatttgcgaactttccttcaggcagtccagtgagcgcctccacgctagccagagctggcttcttatatactggcgagggcgacacagtgagatgcttctcttgtcatgctgcggtggacaggtggcaatatggggacagtgcggtggggcggcatcggaaggtctcccctaactgcaggttcattaatgggttctacctcgaaaactctgcaacccagtcgaccaattctggcatccagaacggccaatacaaggtggaaaactatctgggctcgcgggaccactttgcactggaccggcctagcgagactcacgcggactacttgctacgcaccggtcaggtcgtggacatcagcgatacaatctatcccagaaaccctgctatgtacagtgaagaagcccggctgaaatcatttcagaactggcccgattatgcacatcttaccccaagagaactggccagcgctgggctgtactacaccggcatcggagatcaggtccagtgcttctgttgcggaggcaagctgaaaaactgggaaccctgcgatagagcctggtctgagcataggcgccacttcccgaactgcttcttcgtgcttggccggaatctgaacatcagaagtgaaagcgacgctgtttcctcggacaggaactttcctaacagcacaaatctcccccgcaacccttccatggccgactatgaggctcgcatattcacattcgggacttggatctactccgtgaataaggagcagctggccagagctggcttttacgcacttggagagggtgataaggtgaaatgctttcattgtggaggagggctgacagattggaaaccctccgaggatccctgggagcaacatgctaaatggtacccagggtgtaaatatttactggaacaaaagggtcaggagtacataaataatatccatttgacccactcgttggaggagtgtctggtgcggactacagagaaaaccccgagcctgactagacgaatagacgataccatctttcagaatcctatggttcaggaagccatcaggatgggcttcagcttcaaagatattaagaaaattatggaagagaagatccaaatctctggcagtaattataagtcccttgaggtcctggtggccgatctcgtgaatgcccagaaagactctatgcaagacgagtcctcgcagacatcactccagaaagaaataagcactgaggaacagctgcggagactacaggaagaaaaattgtgtaagatatgtatggatcgcaacattgccatcgtgtttgtgccctgcggacatctggtcacgtgcaagcaatgcgctgaggccgtggacaagtgccctatgtgttacaccgtcataactttcaaacaaaagatctttatgtcttag

SEQ ID NO: 27070 - DNA, 51 bp, Artificial Sequence
  Description of Artificial Sequence: Synthetic coding sequence
atgaccttcaacagcttcgagggcagcaagacctgcgtgcccgccgattag

SEQ ID NO: 27071 - DNA, 471 bp, Artificial Sequence
  Description of Artificial Sequence: Synthetic coding sequence
atgaccttcaacagcttcgagggcagcaagacctgcgtgcccgccgatattaataaagaggaggaatttgtagaggagttcaacagattgaagaccttcgcaaacttcccttctgggtcccctgtttccgcttccacccttgctagagccggcttcctctatacaggcgagggcgatacggtgcgctgtttttcatgtcatgccgcagtcgacagatggcaatatggcgactccgccgttggaaggcaccggaaagtcagccccaactgccgcttcattaatggcttttatctggagaacagtgccactcagagtacaaactctggaatacagaacggacagtacaaggttgaaaactatctggggagcagagatcactttgcactcgaccggccttccgaaacacacgccgactacctcttaagaacagggcaagttgttgacatcagcgacaccatatatccacgctag

SEQ ID NO: 27072 - DNA, 1494 bp, Artificial Sequence
  Description of Artificial Sequence: Synthetic coding sequence
atgaccttcaacagcttcgagggcagcaagacctgcgtgcccgccgacatcaacaaggaagaagaattcgtggaagagtttaatcggctcaaaacattcgccaactttccgtcaggttcccctgtttctgcgagcactttggcccgcgccggattcctgtacaccggcgaaggcgataccgtgcggtgtttcagctgtcacgccgctgtggatcgctggcagtacggggacagcgctgtcgggcgccaccgcaaagtcagcccgaactgtaggtttatcaacgggttttatctggaaaactctgccacccagagtacaaactccggcatccaaaacggccagtacaaggtggaaaactatctgggatctcgtgatcactttgctctagatcggcctagtgagacgcacgccgattaccttctgcgcacagggcaggtagttgatatcagcgatacaatttatccaagaaacccggccatgtattccgaagaggcccgactgaagagttttcagaattggccagattatgcccacctcactccacgggaattggcttccgccggattgtactacaccggcatcggagatcaggtccagtgcttttgctgcggaggtaaactcaaaaactgggagccttgcgatagagcctggagcgaacatcggcgacattttccgaattgtttctttgtccttggccgcaacctgaatattaggtctgagagcgacgcggtgtcttctgacaggaattttcccaactccactaatttgccaaggaatcctagcatggcagactacgaggcccgcatctttacctttggtacgtggatttattccgtgaataaagaacagctcgcgagagccggcttctacgctctcggagagggcgataaggtgaaatgcttccactgcgggggcggattgactgattggaagcctagtgaggacccatgggaacagcacgctaagtggtacccgggatgcaaatatctgctggagcaaaaaggtcaggaatacattaataacatccacctgacccacagtctggaggaatgcctagtaaggaccactgagaaaacaccctcactgacaaggcggattgacgacacaatattccaaaacccaatggtgcaagaagccattcggatggggttcagcttcaaggatatcaagaaaatcatggaggaaaagattcagatttccgggagcaattataaatctctggaagtcctggtggccgatcttgtgaacgcacagaaggactctatgcaggacgagtccagccaaactagcttgcagaaggaaatttccaccgaagagcagctccgaagattgcaggaggagaagctctgtaagatctgtatggatcggaacatcgccatcgttttcgtaccatgtgggcatcttgtgacttgcaaacaatgcgctgaagcggtagacaaatgtcctatgtgttataccgtcattacctttaaacagaaaatctttatgtcatag

SEQ ID NO: 27073 - DNA, 2568 bp, Artificial Sequence
  Description of Artificial Sequence: Synthetic coding sequence
atggtggtgatggcccggctgagccggcccgagcggcccgacctggtgtttgaggaggaggatctaccctatgaggaagaaatcatgaggaaccagtttagcgttaaatgctggctgaggtacatcgagttcaagcagggagctcccaaacctcggctgaatcagctttatgagcgggctctcaaactacttccatgcagctataagctctggtatcgatacttgaaggcgcgcagagctcaggtcaagcatagatgtgtcaccgacccggcatatgaggacgtcaacaactgccatgagcgcgcatttgtgtttatgcacaagatgccacggctgtggctcgattactgtcaattcttgatggatcagggacgcgtaacacacacgcgcaggacttttgacagagcactgagagccctgcctattacacagcactcaagaatctggccactgtatttgcggtttttaagaagccacccgctaccggaaacggctgttagaggatacagaaggttcctcaagctgtcccctgaatcggcagaggagtacattgagtacctgaagagcagcgatcgcctggatgaagccgcccagagacttgcaaccgtggtaaatgatgagagattcgtgagcaaagccggcaaaagtaattaccaactatggcacgaactttgtgacctgatctctcagaacccagataaggtacaatcattgaatgtagatgccattatccggggtgggctgacaaggtttaccgaccagctcggcaaactctggtgttcccttgctgactattacatccgcagcggacactttgaaaaggccagagatgtctatgaggaggcgatccgcacggttatgacagtgagagatttcacccaagtgttcgactcatacgcccaatttgaggaatccatgatcgccgcaaaaatggaaaccgccagcgaattaggaagagaggaagaggatgatgtggatctggagctaaggttggctcgcttcgagcagctgatatccaggcgacccctgcttctgaactcagtccttcttcggcaaaatcctcaccatgtgcacgagtggcacaagcgagtggcgttgcatcaaggacgcccgagggagattatcaacacatacaccgaagcagtgcaaacagtcgatccattcaaggccacaggaaagccgcatacattgtgggtagctttcgcaaagttctacgaagacaacggccaactggacgacgctcgcgtgattctcgagaaagctaccaaggtgaacttcaaacaggtggacgatctggcatctgtttggtgtcagtgcggggagcttgagttgagacacgagaattacgatgaagccctgagattgttaagaaaggccactgcacttcctgccagaagagctgagtatttcgacggctcagaaccggttcagaatcgggtgtacaagtccctgaaggtttggtctatgctggcggacctcgaagagtccctaggcacgttccagagtacaaaggcagtctacgaccgcattctggatcttaggattgcaacgccacagatcgttatcaactacgcaatgttcttggaggagcacaaatattttgaagagtcttttaaggcctacgaacgcggtatttcactgtttaaatggcctaacgtgtccgatatctggtccacatatctgactaaattcattgccaggtacggcggtcgcaaactggagcgcgctagggatctgtttgagcaggctcttgatggatgccctcccaagtatgccaagactttgtatctgctctatgctcagctcgaggaggaatggggcctggccagacacgcgatggctgtgtacgaaagagccacacgagctgtggagccagctcagcaatacgacatgttcaatatttacattaaaagagcagccgaaatctatggagtcacacacacccgggggatatatcagaaagctattgaagttctgtcagacgaacacgcccgcgagatgtgccttcggttcgccgatatggagtgcaagctcggagagatagacagggcgagagccatttattccttttgctcccagatttgcgacccccgaacaacaggcgcattttggcagacgtggaaggatttcgaagtccgccacggcaacgaggacaccattaaggaaatgctgcggatcaggcgttccgtccaggcgacatacaacactcaagtaaactttatggcctctcagatgcttaaggttagcgggtcagctacaggcacagtaagcgacttggctcctggacagtctgggatggatgacatgaaactgttagagcagagagctgagcagctggctgctgaagccgaaagagaccagcccctgagagcgcaatccaagatccttttcgtgagatctgacgccagcagggaagagctcgccgaactcgctcagcaggttaatcctgaagagattcaactgggtgaagatgaagacgaagatgagatggacctcgagccgaacgaagtgcgcctggaacagcagagcgttcccgcagccgtgttcgggtcactgaaggaggattag

SEQ ID NO: 27074 - DNA, 2559 bp, Artificial Sequence
  Description of Artificial Sequence: Synthetic coding sequence
atggcccggctgagccggcccgagcggcccgacctggtgttcgaggaagaagacctcccttacgaggaagagattatgaggaatcagttttctgttaaatgttggttgcgatacatcgagtttaagcagggcgctccaaagccccgcttaaaccagttatatgagagggctttgaagctgctaccttgctcctacaagctgtggtacaggtatctcaaagctagacgcgctcaggtaaaacaccgttgcgttacagaccctgcatatgaggacgtcaataattgtcacgagcgcgcctttgtgtttatgcacaagatgccccgcctttggcttgactactgccagtttctgatggaccaagggagagttactcacacgagacgaacattcgaccgtgcactgcgagctctgcctattacccagcacagtcgcatctggccattatacctgcgctttctcaggtcacacccattacccgagaccgccgtcagaggctaccgacgtttcctgaagttgagtcctgaaagtgctgaagagtacatagaatatctgaagagctccgacaggctggacgaagctgcccaacggctggccaccgtggtgaacgatgagcggttcgtctccaaggccggcaaatcaaactaccagctgtggcatgaattgtgcgatttgatatcccaaaaccctgacaaggtacagagcctaaacgtcgacgctataattcgagggggactgactagatttactgatcagctgggaaagctgtggtgctctttggccgactattacattcgcagcgggcactttgagaaagctcgggacgtgtacgaggaggccatcaggaccgtcatgacggtgcgagactttacccaggtgttcgacagctacgcccagttcgaggagtcaatgatcgctgcgaaaatggaaactgccagtgagttggggagagaggaagaagacgacgtggatctcgagctgaggctagcccgctttgaacagctcatctctcggcgtccattgctcctaaacagtgtgctactaaggcaaaatcctcatcatgtgcatgagtggcataaaagggttgcgctgcaccaggggagaccacgcgagatcattaatacatacacagaagcagtacagactgtggatccttttaaggcaactgggaaaccacacaccctgtgggtcgcttttgctaagttctatgaggacaatggtcagttagacgatgctagagtcattctagaaaaggcgaccaaggtgaattttaaacaggtggatgatctagccagtgtttggtgccaatgcggggagctggagctgaggcatgagaattacgatgaggctctgaggctgctgcggaaggccaccgcactacccgcccgacgtgccgagtacttcgatggaagcgagcccgttcagaaccgggtctacaagagcttgaaggtgtggtctatgctcgcggacttggaagaatccttgggcacgttccagagcactaaggcagtgtacgaccggatcttagatttgcggatcgccactcctcagattgtgatcaattatgctatgttcttggaggaacataagtattttgaagaatcattcaaggcatacgaaaggggtattagtctgttcaaatggccaaacgtctcggatatatggtccacttacttgacaaagtttatcgcccgctacggtggaagaaagctggaaagggcccgggacctgtttgaacaggcccttgacgggtgcccacctaaatatgctaaaactctgtacctgctgtacgcacagcttgaagaggaatggggcctagctcgtcacgcaatggcggtgtatgagagagccaccagggccgtggaacctgcacagcagtacgacatgttcaatatctacataaagcgggccgctgaaatctatggcgtgacacacaccaggggaatctatcagaaggctattgaggtgttgagcgacgaacatgcccgcgaaatgtgtctgcggttcgcagatatggagtgtaagctgggtgaaattgacagagccagagcgatctactccttctgcagccagatatgtgaccctagaactaccggggcattctggcagacttggaaagactttgaggttagacacggcaacgaagacacaattaaagagatgctgcgtattcggaggagcgtccaggccacgtacaacacacaagtcaacttcatggcatcacaaatgctgaaagtcagcggctccgcaactgggacagtatctgacttggccccaggccagtccgggatggatgatatgaagctgctggaacaacgggccgaacagcttgcagcagaagccgagagggaccagccgctgagagcccaaagcaaaatactattcgtgaggagtgatgcctcgcgcgaggagctcgccgagctcgcccagcaggtgaacccggaggagattcaactgggcgaagatgaggatgaggatgaaatggacttagagcccaatgaagtgcggttggagcagcaaagtgtgcccgctgcagtcttcggttcactgaaggaagactag

SEQ ID NO: 27075 - DNA, 1902 bp, Artificial Sequence
  Description of Artificial Sequence: Synthetic coding sequence
atgcccgagatccggctgcggcacgtggtgagctgcagcagccaggactccacccattgcgctgaaaacctactcaaagccgacacgtatagaaaatggcgggcagcgaaggctggcgagaaaacgataagcgtggtccttcagctagagaaagaggaacagattcactctgtagacatcggcaatgacggctccgccttcgttgaagtgcttgtcggaagctcagcgggtggggccggggagcaggattacgaggtgcttttggtcacaagttcgttcatgagcccctccgagtctcgaagcggcagcaatcccaatagagtgcggatgttcggcccggacaagctagtacgtgcagccgcagagaaaagatgggatcgggtaaaaatcgtgtgcagccagccttacagcaaagattctcccttcggcctttcctttgtccgattccactcgcctcccgacaaagatgaggccgaggccccttcacagaaggttactgtcaccaaactgggacaattcagagtcaaagaggaggatgagagcgcgaattcccttcggcccggggccctgtttttttctcgtattaacaagacctctcccgtgacagcctccgatccggcagggccaagctatgcggccgctacgctgcaagcatcttctgccgccagctctgcttcccccgtatctcgcgctatcgggagcacttccaagcctcaagagagtccaaagggcaaaaggaagttagacttgaaccaggaggaaaaaaagaccccctccaagcccccagcccagctaagcccttccgttccaaagcgacctaagcttcccgcccccacccgaacaccagcgaccgcccctgttcctgccagagcccagggggcagtcacaggcaagcctagaggcgagggtaccgagcctagacgaccgcgggccggccccgaggaacttggtaagatactgcagggggtggtagttgtgctgagtgggttccagaatccctttcggtccgagcttcgcgacaaagcactggaactcggcgcaaagtacagacctgactggactagggatagcactcacctcatctgcgccttcgccaacactcctaagtactctcaagtcctaggattgggaggccggatcgtacggaaagagtgggtgttagactgccacagaatgcgccgaaggcttccttctcagaggtatcttatggctggaccggggtcgagctcagaggaagacgaagcatcgcatagtggtggctctggcgacgaagcacctaagctccctcagaagcagcctcagacaaagactaagcccacgcaggctgccggccccagttcacctcagaagcctccaacaccggaagaaacgaaggctgccagtccggtgctccaagaggatatcgacatagaaggcgtgcagtcagaggggcaggacaatggagctgaagactctggcgacactgaggatgagctgcggagagttgccgagcagaaggaacataggctacctccgggacaggaagagaacggcgaggacccgtacgcaggatccacagacgaaaacaccgatagtgaggaacaccaagagcctcctgaccttccagtgccagagctacccgatttctttcagggcaaacacttttttctctacggcgaatttcccggtgacgagcgccggaagctcatacggtacgtgacagcttttaacggagaactggaggataatatgtctgacagggtacagttcgtgatcaccgcacaggagtgggacccctccttcgaggaagccttaatggacaatcccagtctggccttcgtgaggcccaggtggatttatagctgtaatgaaaaacagaagcttctgccgcaccagctgtacggtgtcgtgccacaggcttag

SEQ ID NO: 27076 - DNA, 1944 bp, Artificial Sequence
  Description of Artificial Sequence: Synthetic coding sequence
agcaccagcagcttctggcccggcgaggcccacgacgtggacatgcctgagatccggctccggcacgtagtcagctgttctagccaagacagtacacattgcgccgaaaatctgctcaaggctgacacctatcggaagtggagagctgccaaagctggcgaaaagactatctccgtggttcttcaactggagaaagaggaacagattcattcggttgacattggcaatgatggatccgcctttgttgaggttctggtgggaagttcagcaggaggggcaggtgaacaagattacgaggtccttttggttacttcaagtttcatgagcccttccgaatctagatccgggagcaatcccaatagggttagaatgtttggacctgataaactcgtgcgtgcagccgccgaaaaacggtgggacagggtgaaaatcgtgtgtagtcagccctactccaaggattccccattcggactttcatttgtgcgtttccacagcccaccagataaagatgaggccgaggctccgagtcagaaggttaccgtgacaaagctcggccagtttagagtgaaggaagaagatgaatccgccaacagcctgcgcccaggcgcactgttttttagtagaatcaataaaacgtcgcctgtcaccgcctctgaccccgcaggaccgagttacgcagctgctaccctgcaggcatcttctgcagcgagctcagccagccccgtgtctcgcgctattggaagcaccagcaagccacaggagagtcctaaggggaagaggaagttggatctgaaccaagaggaaaagaagacccccagcaaaccacccgcgcagctgtcaccctccgtaccgaagaggccgaaactgccagcacctactcgcacccccgctaccgcccctgtgccagcacgagctcagggggctgtcaccggcaagcctcgcggcgagggtacagagccgagacggcctagggcaggaccggaagagctcggtaagatactacagggcgtcgtggtcgtgctgagcggatttcaaaatccctttcggagcgagctacgggacaaagcccttgagctgggtgccaaatacaggcccgactggacaagggactcaactcatctgatctgtgcctttgcaaacaccccaaagtattcccaggtgttaggactgggaggcaggatcgtgcggaaagagtgggtgctggactgtcaccggatgagaagacggttgccaagtcagaggtacttgatggctgggccaggcagcagcagcgaggaggatgaggcttctcattcaggagggagtggcgacgaagcccctaagctgcctcagaagcagcctcagacaaagaccaaacccacacaggctgccggaccctcctcccctcagaagcctccaacacccgaggaaactaaggcagcatctcctgtcctgcaagaagatatcgatatcgagggcgtacagtcggagggtcaggataacggtgctgaggattctggggatactgaggatgagctacgccgggtcgcagaacaaaaggagcataggctgccccctggccaggaagagaacggcgaagatccctacgcaggcagtacagatgagaacacagacagcgaagagcaccaggagccgcccgacctgccagtgcccgagttgccagatttttttcagggcaaacactttttcctgtatggagagtttccaggtgacgaacgtcggaagcttataagatacgtaactgcctttaacggtgaattagaggataatatgtcggatagggtccaattcgtgatcactgcacaggagtgggatcctagtttcgaggaagcactaatggataacccatctttggcctttgtccggcctaggtggatctatagttgtaatgagaaacagaaactgcttccacaccagctttacggagtggtaccgcaggcctag

SEQ ID NO: 27077 - DNA, 1203 bp, Artificial Sequence
  Description of Artificial Sequence: Synthetic coding sequence
atgcccgagatccggctgcggcacgtggtgagctgcagcagccaggacagtactcattgtgccgagaatctactcaaagcggatacttatcggaaatggcgggctgctaaagccggggaaaagaccataagcgttgtcttgcagcttgagaaagaggagcagattcattccgtcgatattggaaacgacgggtccgcttttgtcgaagtccttgtgggttcctccgccgggggagctggggaacaagactacgaggtgctcctagtgacctccagctttatgagcccttccgaatcacggtcagggtccaaccctaaccgggtgaggatgttcggacctgataagctggtgcgtgcagcagcagaaaaacggtgggatagagttaagatagtctgcagtcagccatattcaaaggatagtccattcgggctgtcttttgtccgtttccactcgccaccagacaaagacgaggctgaggccccatcacagaaggtaactgtcactaaattggggcagtttagggttaaggaagaagatgagagcgccaactcactgcgacctggcgcgttgtttttctctcggatcaacaagacctcccccgtcaccgcatccgacccagcaggaccaagttacgccgcagcgacccttcaggcatcttccgcggccagctctgcttcaccagtatccagagccattggatctacgagcaaacctcaggaaagtccaaagggcaaaaggaagttggatctgaaccaagaagaaaaaaagaccccaagtaagcccccagcccagctgagtcctagcgtgccaaagcgcccgaaactgccagcccctaccaggacaccagccactgctcccgtccccgctcgggctcagggggccgtgactggtaagcccagaggggagggtacagaacctcgccggcctagggccggacccgaggaactcggcaaaatattgcaaggggtcgtggtggtccttagtgggtttcagaaccccttcaggagtgagctgcgtgataaggctttggaattgggcgccaaataccgccccgactggaccagagattccactcacttgatctgtgcctttgccaatacacccaagctgccccagaaggttccacctcaacacacgcctgatcagaaccaggcccactcaggatcctggacccaattgacccccgaggcacctaacccttag

SEQ ID NO: 27078 - DNA, 1809 bp, Artificial Sequence
  Description of Artificial Sequence: Synthetic coding sequence
atgcccgagatccggctgcggcacgtggtgagctgcagcagccaggactctctggaaaaagaggagcagatccattcagtggatattgggaatgatggttccgcattcgttgaagtgctcgttgggagctccgccggaggagcaggcgaacaagattacgaggtcctgttagtcacctcatcttttatgtccccgtctgaaagccggagcggctctaatcccaatcgagtcaggatgttcggcccagacaaactggtccgcgctgccgcggagaaacggtgggatcgcgttaagatcgtctgctctcagccttatagcaaagactctccatttggcttaagctttgtgcgattccattcacccccagacaaagatgaggctgaggcacccagccagaaagtcaccgttactaagttgggccagttccgcgtcaaggaagaggatgaaagcgcgaactccctaaggccaggcgctctcttttttagcaggatcaacaaaacatcacctgtgacagcttccgatcctgccgggccctcctacgccgccgcaactctgcaggcatcgtccgcagctagttccgcctcccccgtgtcccgcgccatcgggagcacctccaaacctcaagaatctcccaaggggaaaagaaagcttgatttaaatcaggaagagaagaagacccctagcaagccccctgcacagctcagtccatccgttcctaagcgccccaagctgccagctccaacccgaactcccgcaaccgctccagtgccggcgagggcccaaggcgcggtaacaggaaagccacgcggggaaggtacagagccacggaggccaagggctggtccggaagagttaggaaaaatcctgcagggagtggtcgttgtgctcagtgggtttcagaacccatttcgctccgaactccgagacaaggccctggagctcggcgccaagtacagacctgattggactagagacagtacccacttgatttgtgcctttgcgaacacgcccaagtattcacaggtccttggactcggaggaagaattgtgagaaaggagtgggtactggactgccacaggatgaggcggaggctgccatcccaacggtatctgatggctggccccggaagctccagtgaggaggatgaagcttcgcatagcggtggatctggtgacgaggcacccaagctgccacagaaacagcctcagaccaagacaaagccaactcaggcagctggccctagttcgccacagaaacctccaacccccgaagagacaaaagcagcctccccagtgctccaggaagacatcgacatcgagggggtccagtcagaaggacaggataacggagcggaggactccggcgataccgaagatgaactgcggcgcgttgcggagcaaaaggagcacagactgccaccaggccaggaggagaatggagaagacccatacgctggttccacagatgagaatacggacagcgaagaacatcaggaaccccccgacctgccagtgccggaactcccagattttttccagggaaagcacttctttctatatggcgaatttcctggcgacgagcgcagaaaactcattcggtacgttaccgcctttaatggagagctggaagacaacatgtccgaccgagttcagttcgtgattacagctcaggagtgggacccttcctttgaagaggctctgatggacaatccctcattggccttcgtcagacccaggtggatctactcttgtaacgagaagcagaaattgctgccacaccaattgtatggagtcgtgccccaagcatag

SEQ ID NO: 27079 - DNA, 843 bp, Artificial Sequence
  Description of Artificial Sequence: Synthetic coding sequence
atgtgcagcgccttccaccgggccgagagcggcaccgagctgctggcccgtctagagggaagatcctctctgaaagagatagagccgaacctcttcgcagacgaggattctcccgtgcacggagatatcttggaatttcacggtccagagggcacaggcaagaccgaaatgctttaccatctgacagcccgctgcattctcccaaaaagtgagggaggcctagaggtggaggtcctctttatcgacacagattaccacttcgatatgcttagactggttaccatcctcgagcacagactttctcagagcagcgaggagatcatcaaatattgcctcggcagattttttctggtgtattgctctagctccacccatctgctgctcaccttgtactctttggaatccatgttttgcagccacccatctctgtgtctactgatccttgactcactgagcgcattctactggatcgatagggttaatggaggggaaagcgtgaacctccaggagagtaccctgcgcaagtgcagtcagtgtcttgagaaactggtgaacgattacagactcgttctgtttgcaacaacacaaaccataatgcagaaggcctcaagtagcagtgaagagccttcacatgcatcccggaggctgtgtgatgtggacatagactacagaccctatctttgtaaggcttggcaacaacttgtgaaacatcggatgtttttcagcaagcaggacgattcccagtcttcaaatcaatttagccttgttagtcggtgtctgaagagcaacagtctcaaaaagcactttttcatcattggtgaatccggcgtggagttttgctag

SEQ ID NO: 27080 - DNA, 1041 bp, Artificial Sequence
  Description of Artificial Sequence: Synthetic coding sequence
atggacctggacctgctggacctgaacccccggatcatcgccgccatcaaaaaggccaagctgaaaagcgttaaggaggtcctgcacttttccggacctgacctcaagcgcttaactaacctcagcagtcccgaagtctggcatctcttacggaccgcatccctacacttaagaggatcatcaattctgacagctctgcagctgcaccagcagaaggagaggtttcccactcagcatcaaaggctgagtcttgggtgtcccgtcctggatgctttgctccgcggcggtctgcctctggatggcatcactgagctggccggaagatcctccgcagggaagacgcagcttgccctgcagttatgcctcgccgtgcagttcccgagacagcacggcggacttgaggccggcgcggtatatatttgtacagaggatgcgtttccccataagcgactgcagcagctgatggctcagcagccaagactacgcactgatgtgccgggtgaactgctgcaaaagttgaggttcggcagccaaatctttatagagcatgtagccgatgtcgacacccttttagagtgtgtgaacaaaaaggtgccggtgctgctgtcaaggggaatggctcgcctggtcgtgattgattctgttgccgctcccttcaggtgcgaatttgattctcaggcgtcggcgccccgggcccgacatctgcagtctctgggagctacactgcgagaactgtcgagcgcttttcagagccccgttctctgcattaaccaggtaaccgaagctatggaagagcagggggctgctcatggtccacttggattttgggacgagagagtgtcccccgcactggggattacttgggcgaatcagctgttggtccgtctcttggcagatcgtttgagagaagaggaggccgccctgggctgtccagcacgaaccctgcgagtgctgtccgcaccccatctaccacctagctcgtgctcatacaccataagcgcagaaggggtcaggggcactcctggtacccaatcgcattag

SEQ ID NO: 27081 - DNA, 1041 bp, Artificial Sequence
  Description of Artificial Sequence: Synthetic coding sequence
atggacctggacctgctggacctgaacccccggatcatcgccgccatcaagaaagccaagctcaagtctgtgaaggaggtgttacatttttccgggcctgatctgaaacgcctgactaatctatccagcccagaggtctggcacctgctaagaaccgcatcactgcacctgagagggtctagcatcctcacggcgttgcaactgcatcagcaaaaggagcgtttcccaacacagcatcagcgactgagcctagggtgtcccgtgctagatgcactgctgcggggcggcctccccctagatggtatcacggagttggccgggagaagctccgcggggaagacccaactggctctccagctatgtctggctgtacagttccccagacaacacgggggccttgaagctggcgcagtgtacatttgtactgaagacgcatttccacataagaggctgcagcagctcatggcgcagcagccacgacttagaaccgacgttcctggtgagcttttgcaaaaactgcgcttcggttcccagatatttattgaacatgtggctgatgtggacaccctcctggaatgcgtgaataagaaggttcctgttcttctcagccgggggatggcccggctggtggtgatcgacagcgtggctgctcccttccggtgtgagttcgactcacaagccagcgcgcccagggcccgacaccttcagagtctgggtgctacactcagagagttaagcagcgcattccaatctcccgtgctctgcataaatcaggtgacagaggccatggaagagcagggagctgcccacggtccactcggtttttgggatgagagggtgtccccagcccttggaataacatgggcaaaccaactcctggtgaggctgctggccgacagattgcgagaggaagaggcggcactgggctgcccagcccgcactctgcgcgtcctgagcgccccccacttgcccccgtcttcatgctcatacacaatttctgcagagggcgtcagaggcacacccggcactcaatcccattag

SEQ ID NO: 27082 - DNA, 1041 bp, Artificial Sequence
  Description of Artificial Sequence: Synthetic coding sequence
atggacctggacctgctggacctgaacccccggatcatcgccgccatcaaaaaggcaaaactgaagtcagtgaaggaggtgctgcactttagcggcccagacctcaaaaggctgacaaacctctcttctcccgaggtttggcacttgctgcgtactgcgagcctccacttgaggggaagctctatcttaactgcgctgcagctgcaccagcagaaagagcgatttcccacccagcaccagcgcctgagcctggggtgtcccgtgctggatgccctcctacgagggggtcttcctctggatggcattaccgagttagcagggaggagtagcgcaggcaaaacacagcttgccctgcaattatgcctggcagtccagtttccccgccagcacggcggccttgaagctggggccgtatacatctgcaccgaggacgcatttccccacaagcgcctccagcaacttatggctcagcagcccagattaaggactgatgttcctggcgaactactccagaaactgcggtttggatcccagattttcatagagcatgttgctgacgttgataccctgctagagtgcgtcaataagaaagtgcctgttctgctgtcccgaggtatggcccggctagtggtaattgattccgtcgcagcaccatttcgctgcgagtttgatagccaggcatccgcccctcgagcaaggcatcttcaaagcctgggagccacgttgagagagctgtctagcgctttccagtctccagtcctctgtatcaaccaggtgaccgaagcgatggaagaacaaggagcagcacacgggccccttggcttctgggacgaaagggtcagtcccgctcttggcataacatgggcaaaccagcttctggtgcgccttcttgccgatcgtcttagagaagaagaggcggccctcgggtgccctgcacgcacattaagggttctcagtgccccacacctgccccccagcagctgctcttacacaatttcagcggagggtgtgagaggtactccggggacccaaagccactag

SEQ ID NO: 27083 - DNA, 144 bp, Artificial Sequence
  Description of Artificial Sequence: Synthetic coding sequence
atggacctggacctgctggacctgaacccccggatcatcgccgccataaaaaaggccaagctgaaaagtgtgaaggaagtcttgcacttttccggaccagatctcaagcgccttacgaatctgtcctcccctgaggtttggtag

SEQ ID NO: 27084 - DNA, 138 bp, Artificial Sequence
  Description of Artificial Sequence: Synthetic coding sequence
atggacctggacctgctggacctgaacccccggatcatcgccgccattaaaaaagcgaaactgaaaagcgttaaagaggtactccatttcagcggccctgacctaaagaggctgaccaacctctctagcccagagtag

SEQ ID NO: 27085 - DNA, 1041 bp, Artificial Sequence
  Description of Artificial Sequence: Synthetic coding sequence
atggacctggacctgctggacctgaacccccggatcatcgccgccatcaagaaagcaaagctgaaaagtgtcaaggaggtgctccatttctctggaccagacctcaaacgcctgacaaacctctctagccccgaagtttggcacctcctccgtaccgcatctcttcacctgaggggctcatccatcctgactgctctccaattgcatcaacaaaaggaaagattccccacacagcatcagaggctcagcttgggctgtccagtgctggacgcactgctccgtggagggctgccactggacggcattacagaactggccggacgaagtagcgcggggaagacccagctggcgctgcagttgtgtcttgccgtgcagttccctcgacagcacggagggttagaagctggagccgtgtacatctgcacggaagatgcatttccgcacaaaagattgcaacagctgatggcccagcagccccgcctgcgcacagatgtgcccggggaattactgcagaaactgcggttcggatcacagattttcatcgagcacgttgctgacgtcgacactcttcttgagtgtgtgaataaaaaggtaccagtgcttctctctcgaggcatggctcgcctcgtggtgatcgattccgtcgccgccccgttccgatgtgaattcgattcccaggcatcagctcctcgggctcgacacctacagagcctgggtgcaaccctgagagaactgtcctcagcattccagtctcctgttctgtgtataaatcaggtgacagaggcaatggaggaacagggcgccgcacacgggcctctgggcttctgggatgagcgggtgagccctgcccttggcatcacctgggctaatcagctgctggttcgtctgcttgctgatcgactccgagaggaagaggcagcccttgggtgccccgccaggactcttagggttcttagcgcccctcatctcccaccctcgagctgtagctacaccatctctgccgagggagtccggggtactccaggcacacagagccactag

SEQ ID NO: 27086 - DNA, 1041 bp, Artificial Sequence
  Description of Artificial Sequence: Synthetic coding sequence
atggacctggacctgctggacctgaacccccggatcatcgccgccattaagaaggcaaagctcaagtccgttaaggaagtgctccacttttccggacctgacctgaagcgtctgacaaacctgagctcccccgaggtgtggcatctcttgagaacagcttctcttcacctcaggggctcatctattctgactgcccttcagcttcaccagcaaaaggaacgcttcccaacgcagcaccagaggctctcactcggttgccccgtcctcgacgccctcctgagaggtggcctcccccttgatggtattacagaattagctgggcgctctagcgctggcaaaacccagttggccctgcagttgtgtctcgcagtacagtttccccgccagcatggggggctggaagccggggctgtctatatttgcacggaggatgctttcccacacaagagattacagcagctgatggcccagcagccaagactgcgcactgacgtgccaggggaactccttcagaaattacgctttggctctcagatcttcatcgagcacgtagccgatgtagacacactgctggagtgcgtgaataagaaggtgcctgtactgctcagcagagggatggcccggctcgtggtaatcgactcagttgccgccccttttagatgcgaatttgactcccaagcatcagcccctagggccaggcacctgcagagtcttggcgccacactgcgggagttgagctccgcttttcagagtccagtgctctgtatcaaccaagtgaccgaggccatggaagagcagggtgcggcccatgggcccctgggcttctgggacgaaagagtttctccagccttgggtatcacctgggcaaatcaattgctagtccgtctccttgccgataggctgcgtgaagaggaagcagccttgggatgtcccgcacgaaccttgcgcgttctttcagcgcctcacctgcccccctcttcttgttcatacacgataagtgccgagggcgtgagggggaccccaggcacacagagtcactag

SEQ ID NO: 27087 - DNA, 309 bp, Artificial Sequence
  Description of Artificial Sequence: Synthetic coding sequence
atggacctggacctgctggacctgaacccccggatcatcgccgccatcaaaaaagctaaactaaagtcagtcaaggaggtcctgcacttttcaggccccgacctgaagaggctaaccaacttgtcttccccggaggtttggcaccttctccgaacagcatctctgcatttgcgcggttctagtatcctgacggcgctgcagcttcaccagcaaaaagagcgctttcctactcagcatcagaggttatcgctgggctgtccggtcttggatgcccttctccggggggggctgcccttggacggcatctag

SEQ ID NO: 27088 - DNA, 186 bp, Artificial Sequence
  Description of Artificial Sequence: Synthetic coding sequence
atggacctggacctgctggacctgaacccccggatcatcgccgccatcaagaaagcgaagctcaagtccgttaaggaagtgctgcacttctccggacccgacctgaaaagactcacaaatctgtccagtcctgaggtctggcatctgctgagaactgcgtctctgcacctgcgagggtctagctag

SEQ ID NO: 27089 - DNA, 339 bp, Artificial Sequence
  Description of Artificial Sequence: Synthetic coding sequence
atggacctggacctgctggacctgaacccccggatcatcgccgccatcaagaaggcgaaacttaaaagtgtcaaggaagttctgcacttttccggccctgacctgaaacggcttacaaatctgtccagtccagaggtttggcatctgctgaggaccgcttccctgcacctcagggggtccagcatcctgacagcactgcagctgcatcagcaaaaagaacgctttcccacccaacaccagcgcctatctctgggctgcccagttctagatgccctgctgcggggaggactgcctcttgatgggatcacagaacttgccggacgcagctctgcaggttag

SEQ ID NO: 27090 - DNA, 1005 bp, Artificial Sequence
  Description of Artificial Sequence: Synthetic coding sequence
atggagcggaagatcagccggatccacctggtgagcgagcccagcatcacacactttcttcaggtttcctgggaaaagacccttgaaagtggcttcgtgatcactctgacagatggccattcagcatggacaggtaccgtgtcggaaagcgagatcagtcaggaagccgatgatatggctatggagaagggtaaatatgttggagagcttagaaaggccctgctctccggcgccggtcctgccgatgtgtacacgtttaatttttcaaaagaaagctgttattttttcttcgagaagaacttgaaagatgtctcgttccgcctcggctcatttaatttggagaaagtggaaaaccctgccgaggtaattcgcgagcttatatgctattgcctggatacgattgccgaaaatcaagccaaaaatgaacacctgcagaaggagaatgagagattactgagagattggaacgatgtccaggggaggttcgagaaatgcgtttccgccaaggaagccctcgagactgatctctataagagattcattctggttttgaacgaaaagaagaccaagattcgctctcttcacaacaagcttcttaatgccgcccaggagcgcgagaaggatatcaaacaagaaggcgagactgccatatgtagcgaaatgacggctgaccgggaccccgtttatgacgagtctactgacgaggagagcgagaaccagaccgatctgagcggccttgctagcgctgccgtctcaaaggacgattccattatctcctcccttgatgtgaccgatatcgcccccagtcggaaaagaagacagcgcatgcaaagaaacctagggacggaaccaaagatggcccctcaggagaatcaactccaggagaaggagaaacctgattcatctttacccgagacctcaaaaaaggagcacatctccgctgagaacatgtcactggagacccttagaaattcaagtcctgaggacctattcgacgaaatttag

SEQ ID NO: 27091 - DNA, 1011 bp, Artificial Sequence
  Description of Artificial Sequence: Synthetic coding sequence
atggagcggaagatcagccggatccacctggtgagcgagcccagcatcacgcacttcctgcaagtctcatgggaaaagaccttggaaagcggattcgtcataactttgacagatgggcactccgcttggacaggtaccgtgtccgaaagcgaaataagtcaggaggctgacgatatggccatggaaaaaggtaaatacgtgggagaactgaggaaggctctgctcagtggtgctggacccgcagatgtatacactttcaatttcagcaaggagtcttgctatttttttttcgagaaaaacctgaaggatgtaagcttcagactcgggagcttcaatctggaaaaggtcgagaatccagcagaggtgattcgcgagctgatctgttactgcctggatactatcgccgaaaatcaggctaagaacgagcacctccagaaggagaacgagaggcttctgcgcgattggaatgatgttcagggccgctttgaaaaatgtgtctctgccaaggaagcccttgagactgacctgtataagagattcatactggtcttaaatgagaaaaagaccaagattcgttcccttcataataaattactcaatgccgcacaggaaagagaaaaagacattaagcaggagggtgaaaccgccatttgttccgagatgacggccgaccgggatcccgtgtatgacgaatccaccgacgaggagagcgaaaaccaaactgatctcagcggacttgctagtgctgccgttagtaaggacgactcaatcattagttccctggatgtcactgacattgccccatctagaaagagacgccaacggatgcaaagaaacctcggtactgagcctaagatggctccccaggaaaaccagctccaagagaaggagaactctaggccagacagtagtctgcccgaaacctccaaaaaagagcatatctcggcagagaatatgagtctggaaactcttcggaactcctctcccgaggacttatttgatgagatctag

SEQ ID NO: 27092 - DNA, 1005 bp, Artificial Sequence
  Description of Artificial Sequence: Synthetic coding sequence
atggagcggaagatcagccggatccacctggtgagcgagcccagcatcacacatttcttgcaggtttcctgggagaagacgctggaatcaggcttcgtcatcacattgaccgatgggcattcagcatggacaggtacagtgagtgaaagcgagatcagccaggaggctgacgacatggcaatggaaaagggcaagtacgttggagagctacgcaaggctctgttatcgggtgccggaccagccgacgtgtacacctttaatttctccaaggagtcttgttacttctttttcgaaaagaacctgaaagacgttagctttcggctgggctcattcaacctcgagaaggtggaaaatcccgccgaggtgattcgtgaactgatttgctactgtcttgatacaatcgcagagaaccaggccaagaatgagcatctgcagaaagagaacgaacggcttctccgagactggaacgatgtgcaggggaggttcgaaaagtgcgtctcagcaaaagaagccctggaaaccgatctctataaacggttcattctggtgctcaatgaaaaaaagacaaaaattcggtcactgcacaacaaactactgaatgccgcccaagagcgagagaaggacattaaacaggaaggagagacagccatatgcagtgagatgacagcggatcgggatcccgtttacgatgagagcactgatgaagagtctgagaaccagacagatctcagcgggcttgccagtgcggccgttagtaaagacgattccattatctccagcttggacgttactgacattgccccttctcgaaagcggagacagagaatgcaacggaacttagggactgagcctaaaatggccccccaagagaaccaactgcaagagaaagaaaagccagattccagtttgccagagacatccaagaaggagcacatctcagcggagaacatgtcacttgagacgcttaggaatagtagcccagaggatctgttcgatgaaatctag

SEQ ID NO: 27093 - DNA, 1011 bp, Artificial Sequence
  Description of Artificial Sequence: Synthetic coding sequence
atggagcggaagatcagccggatccacctggtgagcgagcccagcatcacgcacttcctgcaggtgtcttgggaaaagacgctcgaaagcggttttgtgataacactgaccgatggtcactctgcctggaccggcactgtctccgaaagtgagatcagccaagaggccgatgatatggctatggaaaagggtaagtacgtgggcgaactgaggaaagccctcctgtctggagctggcccagctgacgtatacacttttaatttctcaaaggagagctgctattttttttttgagaaaaatctgaaggacgtgagctttcgactgggatcatttaatcttgaaaaagtggaaaatcccgccgaggtgatcagggagctgatctgttattgcctggacaccatagcagaaaaccaggctaagaacgagcacctgcagaaggagaacgaacgactgcttcgggactggaacgatgtgcagggccgctttgaaaaatgcgttagtgctaaggaagcactggagacagatctctacaagaggtttatcctcgtcctgaatgaaaagaagactaagatccggagtttgcataacaagctgctgaatgcagcgcaagaacgggaaaaagacataaaacaagaaggagaaacagcgatctgctcagaaatgaccgcggaccgcgatccagtgtatgacgagagtaccgatgaggagagcgagaatcagacggacctgtcagggttagcctccgccgccgtttctaaagacgattcaattatcagttcactggacgttacagatatcgccccatctagaaagcgcaggcagcgaatgcagcgcaacctcggaacagaacccaagatggcccctcaggagaatcagctgcaggagaaagagaactcccgaccggactcaagcctgcccgaaacgagtaagaaagagcatatcagtgccgagaatatgagcttggagactcttaggaactcctcacctgaagacctttttgacgaaatttag

SEQ ID NO: 27094 - DNA, 186 bp, Artificial Sequence
  Description of Artificial Sequence: Synthetic coding sequence
atgcagcggaacctgggcaccgagcccaagatggccccccaggagaaccagctccaagagaaggagaattcaaggcccgacagctcattgcctgagacgtcaaagaaagagcacatctccgcagagaatatgtccctggagacacttagaaatagttctcctgaggatttgtttgtgtccatctag

SEQ ID NO: 27095 - DNA, 2199 bp, Artificial Sequence
  Description of Artificial Sequence: Synthetic coding sequence
atggtgcggagcggcaacaaggccgccgtggtgctgtgcatggacgtaggctttactatgtccaatagtatccctggtatcgaatcccctttcgaacaggccaaaaaagttatcacaatgttcgtccagaggcaagtgttcgcagaaaacaaggacgagatagccctcgttctgttcggtaccgacggcacggacaacccgctgagtggcggcgatcagtatcagaacattaccgtccaccggcacctaatgcttcctgatttcgacttattagaggatatcgagtccaagatacagccaggatcacagcaagccgatttcctagacgcactcatagtgtctatggacgtgatccagcatgagacaatcgggaaaaagtttgagaagcgccatatcgagattttcaccgacctgtctagtagattctctaaatcacagctcgacataattatccacagcctgaagaagtgtgacataagcttgcagttctttctacccttcagcctcggaaaggaggacggttctggcgaccggggcgatggtcctttccggctgggtggtcacggcccgtcttttcctctgaagggtattactgaacagcagaaagaaggccttgagattgtgaagatggtcatgattagcctcgagggagaggacgggctggacgagatctattcgtttagcgagtctcttagaaagctgtgcgtgtttaagaagatcgaacggcattcaattcattggccatgtcggctgaccatcgggtccaatcttagcataagaatcgccgcatacaaaagcatactccaggagagagtaaagaagacatggactgtagtggacgcgaaaaccctaaagaaggaagatatacagaaagaaacagtgtattgtttaaacgatgatgacgagacagaggtcctgaaggaggacatcattcaggggtttaggtatgggtccgacattgtgcccttctccaaagtggacgaagaacagatgaagtataagtccgagggtaaatgtttttcggtgctaggcttttgcaagagctctcaggtgcagaggcgattctttatgggaaatcaggttttgaaggtattcgctgcacgcgacgatgaggccgctgcagtggcattgagcagcctaatacatgcattggatgatctggacatggtcgcgattgtccgctacgcgtacgacaagagagctaatccgcaggtcggtgtcgccttccctcatatcaagcacaattacgagtgcctggtgtacgtccagttacccttcatggaagatcttaggcaatatatgttctcttctttgaaaaattcgaaaaaatacgcaccaactgaggcccagctgaatgccgtggacgctctgatcgactccatgagcttggcaaaaaaagacgagaagacggataccctggaagacttgttccctaccaccaagatcccaaacccccgctttcaacgattgtttcagtgcctgttgcaccgtgctctgcatccacgtgagcctctccctcccattcagcaacacatatggaacatgctgaacccacccgctgaagtcacaacaaagagccagattcccctatctaagataaagactctgttccctctcatagaggctaagaagaaggaccaggtcactgcgcaggagatttttcaggacaatcacgaggatggccccactgccaaaaaactgaagacggagcagggtggagcccatttctccgtgagctccctcgctgaaggctccgtaacgagtgtcggctctgtaaaccccgcagagaacttcagagtattggtaaaacagaagaaagccagtttcgaggaggcctcaaaccagctaattaaccacattgagcaattcctggataccaatgaaacaccctatttcatgaagagcattgactgcattagggcattcagagaagaggccattaagttctccgaggaacaacgcttcaacaattttctgaaggctctccaagagaaggtagagattaagcagctgaatcacttttgggagatcgtcgtgcaggacgggattaccttgatcactaaagaggaggcatctggatcatcagtgaccgccgaggaggccaagaaatttctcgctcctaaggacaagccgtccggtgacaccgcggctgtgttcgaagaagggggcgacgtggacgatttgctggatatgatttag

SEQ ID NO: 27096 - DNA, 2199 bp, Artificial Sequence
  Description of Artificial Sequence: Synthetic coding sequence
atggtgcggagcggcaacaaggccgccgtggtgctgtgcatggacgtgggcttcacaatgagcaacagtatccccggaatagagagccctttcgaacaggctaaaaaggtgatcacgatgtttgtacagcgacaagtattcgcagagaacaaggacgagatcgcccttgttctgtttggaactgacgggactgataaccccctgtctggtggagatcagtaccaaaacataacagtgcaccggcatctgatgctcccagactttgatctgttggaggatatcgagtctaaaattcaacctgggtcacaacaggccgattttctcgatgccttgatagtgagcatggacgtaatccagcacgaaaccattgggaagaaattcgagaagaggcacatcgaaattttcactgacctcagctcccgcttttcaaagtcccagctggatatcattatccatagtctgaaaaagtgcgacatttctctccaattcttcctgcctttctctctcgggaaggaggacggctctggcgatcggggagacggaccctttcgactggggggacacggaccaagcttccccctgaagggaatcactgagcaacagaaagaaggtctggagatcgttaaaatggtgatgatcagcttggagggcgaagacgggctagatgagatctacagcttcagcgaatcactaaggaagctttgcgtgtttaagaaaattgaaaggcattccatccactggccctgtcgtcttactatagggtccaatctaagtattcggattgctgcctacaaatccatcttgcaggaacgggtgaaaaagacgtggacagtggtggatgcaaaaaccctgaaaaaggaggatatccaaaaggagacagtgtactgcttgaatgatgacgatgagaccgaggtgctgaaggaggacattattcagggcttccgctacggaagcgacatcgtcccattcagcaaagtggatgaggagcagatgaagtataagtctgaaggcaagtgtttcagcgtgttagggttttgcaagagctcgcaggtgcagcgccggtttttcatggggaatcaggtactaaaggtcttcgccgcaagagacgacgaagcagccgctgtggccctgtcaagtcttatccatgctctggacgacctggacatggttgctatcgtgagatacgcctacgacaagcgcgccaaccctcaggtcggcgtggcttttccacacataaaacataactacgagtgtttggtatacgtgcagctcccttttatggaagaccttaggcaatatatgtttagcagcctaaagaacagcaaaaagtacgctcctacagaagcccaactcaacgctgtcgatgcattgatcgattccatgtctctcgccaaaaaagacgaaaaaactgacactcttgaggacttgtttcccaccacaaagatcccaaacccaaggtttcaacggctattccaatgtctcctgcaccgggctctgcatccccgcgaaccacttcctccaattcagcagcacatatggaacatgctgaatccccctgctgaggttacgacaaaatcacaaatccctctcagcaagatcaaaaccctttttccactcatcgaagctaaaaagaaggaccaagtgacggctcaagaaattttccaggacaaccacgaggacggccccacggctaagaagttaaagacagagcagggtggcgcccatttcagcgtttcatctctggccgaggggagcgtcacttcggtaggttcagtcaaccccgctgagaatttccgggtgctcgtgaagcagaagaaagcatctttcgaggaagcttctaatcagcttattaatcacattgagcagtttctggatacaaacgaaactccatacttcatgaaatccatcgattgcatccgcgcctttcgcgaggaagctatcaagttcagcgaggagcaacggttcaacaactttctgaaagccctgcaggagaaagtggaaattaaacaactgaatcacttctgggagatcgtcgtacaggacggaataacactcattaccaaagaggaggccagtgggagttctgtgacggcagaggaggccaaaaaatttttagctccaaaggacaagccgtcgggagacaccgcagcagttttcgaggaaggcggcgatgtggacgatttgctggacatgatctag

SEQ ID NO: 27097 - DNA, 1830 bp, Artificial Sequence
  Description of Artificial Sequence: Synthetic coding sequence
atgagcggctgggagagctactacaagaccgagggcgacgaggaggcagaagaggagcaggaagaaaatctggaagcatccggggattacaaatattctggacgggattccctcatttttctcgtggacgctagcaaggccatgttcgagtcacagagtgaagacgagctcactcctttcgatatgagcattcaatgtatccagagtgtgtatatctccaagattatatcaagtgatagggatcttctcgctgttgtgttttacggcacagagaaagataagaacagtgtgaattttaagaatatttacgtgctgcaggaactggacaacccaggcgccaaacggatcttggaattggaccagttcaagggccagcaggggcagaaaaggtttcaggatatgatgggccacggaagtgattatagcctctccgaggtgctgtgggtctgtgcgaacctcttctctgatgtccagttcaaaatgagccacaagagaatcatgttgtttacaaacgaagataatccccatggcaacgactccgccaaagcctctagggccaggacaaaagccggagacctgagggacacgggcatttttttggacctgatgcacctcaaaaagcccgggggatttgacatcagcctgttctaccgcgacattatttcaatcgcggaggatgaggatttgagggtgcattttgaggagagcagtaaactcgaagacctgctgaggaaggtgagagcaaaggagaccagaaagagggccctgtctaggctgaaactgaagttgaataaggacattgtaatatctgtcggtatctacaaccttgtccagaaggctctaaaacctcctccaatcaaactctaccgggaaacaaacgaacctgtcaagaccaaaactcgaaccttcaacacctcaaccggaggactactgttgcccagcgatacaaaacgctcccaaatctacgggtctcggcagatcatcctggaaaaagaggaaacggaagaactcaagcgtttcgacgaccccggactgatgctaatgggattcaagcctctcgtgttgctgaaaaaacaccactacctgcgccctagcctattcgtgtacccagaggaaagtctcgtcattggctcaagcaccctgttttccgccttactgatcaaatgtcttgaaaaggaggtggccgcgttgtgccgctatactcctaggagaaatatccccccgtattttgtcgccctggtgcctcaggaggaagaattggatgatcagaagatccaggtcacacccccgggtttccagctcgtgttcctaccctttgccgatgacaagagaaaaatgccatttactgaaaaaataatggcaacccccgaacaggtcgggaagatgaaagctatcgtggagaagctcaggtttacttaccggtctgatagcttcgagaaccctgtgctgcagcagcactttaggaaccttgaagcactggcactggacttgatggaaccagaacaggcggtggatctgacccttcccaaagtggaagccatgaataaaaggctgggcagtctagtagacgagttcaaggagctggtttacccgccagactacaaccccgaaggcaaggtaacgaagcggaagcacgataacgaaggctccggcagcaagagacctaaggtggagtacagtgaagaagagctcaaaacacacatctccaaaggtacactggggaaatttacggtcccaatgctgaaggaggcatgtagggcctatggactgaaaagcggtctgaaaaagcaggagctgttagaggctttaactaaacactttcaggactag

SEQ ID NO: 27098 - DNA, 1830 bp, Artificial Sequence
  Description of Artificial Sequence: Synthetic coding sequence
atgagcggctgggagagctactacaagaccgagggcgacgaggaggctgaagaggagcaggaggagaacctggaggcctccggcgactacaagtatagtggtcgcgattccttgatctttttggtggatgcttcgaaagccatgttcgaatcccagtcagaagacgagctgacaccgttcgacatgagtattcaatgtatacagagcgtttacattagcaaaattataagctcggatcgcgatcttctggccgtcgtgttttatggaactgagaaagacaagaactcagtgaactttaaaaatatttacgttctgcaggaactggataacccaggcgccaagagaatacttgagctcgatcagtttaaggggcaacagggccagaaaagatttcaggacatgatgggtcacggttcagactattctctgagcgaggtcctttgggtttgtgcaaatctgttctcagacgttcagtttaaaatgtcccacaagcgcataatgctgtttaccaatgaagataatcctcacggaaatgatagcgcaaaggcctctcgggctagaactaaggccggcgacttgagggataccgggatcttccttgaccttatgcaccttaagaagcctggcgggtttgatatcagcctattctacagggatatcatatcaattgccgaagatgaagatcttcgcgtgcatttcgaggagtcatctaagttagaggacctgctgcggaaagtacgcgcaaaagagacccgcaagcgcgccttaagtcgactgaaacttaagcttaataaggacattgtgatatctgttggaatctacaatctcgtgcagaaagctttgaaaccccccccaattaaactctatagggagactaatgagcccgtcaaaacgaaaactaggaccttcaatacctcgacgggcggacttctccttccatctgatacaaagaggagccagatttacggaagcagacaaataatactggagaaggaggaaacagaggagctcaaacgtttcgacgacccagggctgatgctgatgggtttcaagccactcgtcctcctcaagaaacatcattacttgagaccctcattgttcgtgtaccccgaggagagtctcgttataggaagcagcaccctgtttagcgccctcctcatcaaatgcctggagaaagaagtggccgcactgtgtagatatacccctaggcgcaatattccgccatactttgttgcactcgtgccgcaggaggaggagctggatgatcagaaaatacaagtgacaccacctggtttccagttggtgttcctcccctttgcagatgataagagaaagatgccgtttaccgagaagatcatggcaacaccagagcaggtaggcaagatgaaagccattgtggaaaagctgcggtttacctatagaagtgattcttttgaaaacccagtgctgcagcagcattttagaaatctggaggctctggcccttgatctaatggagcctgagcaggccgtcgacttgacactacccaaagtggaggccatgaataagagactcggatccctggtggacgagtttaaggagctcgtctatccaccagactacaatccagaaggtaaagtgacgaagcgaaagcatgacaacgagggatccggctctaagaggccaaaggtggagtattctgaggaggaacttaaaacccacattagtaagggtactctaggtaagttcacggtgccaatgctcaaagaggcttgtcgcgcctacggtctgaaatccggactcaagaaacaagagctgctagaggccttgacaaagcatttccaggactag

SEQ ID NO: 27099 - DNA, 1674 bp, Artificial Sequence
  Description of Artificial Sequence: Synthetic coding sequence
atgagcggctgggagagctactacaagaccgagggcgacgaggaggccgaggaagaacaggaagagaatctggaagcatccggggattacaagtactctggacgggactcactgatctttctggtggatgctagcaaggcaatgtttgagagccaaagcgaggacgagctgaccccctttgacatgtcaattcagtgtatacaaagtgtctacatctctaagattatttcttctgatagagacctgctggccgtggtgttctacggcaccgaaaaggataaaaactccgtcaacttcaaaaatatctacgtactgcaagagctcgataacccgggggccaaaagaatcctcgaactggaccagtttaaggggcaacagggccaaaagcgtttccaagacatgatgggccacgggtccgactacagtctctccgaggtcctgtgggtctgcgctaatctgttcagtgatgtgcagttcaaaatgagccacaagaggattatgctctttaccaacgaggataacccacacgggaacgatagcgctaaagcctcaagggctcgcactaaggcaggcgacctgcgcgatactggcatcttcctggatttaatgcatctaaagaagcccggcgggttcgatataagcctcttctaccgggacataatcagcatcgccgaggacgaggacctgcgggtgcatttcgaagagtctagtaagctagaagacttgctcaggaaagtgcgtgccaaagaaacgagaaaacgcgccctcagccgcctcaaactcaagttgaataaagacatagtaatctccgtcggcatttacaaccttgtccagaaggcgctgaaaccgccccccatcaagctgtatagagagacgaacgagcctgtgaaaactaagacacgcacatttaacacctcgaccgggggattgctgctgccatccgacactaagaggtcccagatctatggctcccgtcagatcatcctggagaaggaagaaactgaagagctcaaaagatttgatgacccaggccttatgcttatggggtttaaacctctcgtgctgcttaaaaagcaccactacctgcgaccttcactttttgtgtatcctgaagaatccctcgttataggctctagcacactcttttctgccctactgatcaaatgtctagaaaaggaggtcgctgcactatgccgttataccccccgccgcaatattcctccctacttcgtggccctggtcccacaggaagaggagctagacgaccagaagatccaagtcaccccacccggcttccagttggtgttccttcccttcgcagacgataagaggaaaatgcctttcaccgagaagatcatggctacacctgaacaggtcggcaagatgaaggcgattgtggaaaaattgaggtttacttatcgctcagatagttttgaaaatcctgtgttacaacagcactttcgtaatctcgaagccctcgccctggacctcatggaaccagaacaggctgtggacttaaccctcccaaaggtggaggcgatgaataaaagacttggatccttggtggacgagttcaaggaactggtttacccaccagactataaccctgagggtaaggtgaccaagcgaaagcacgctaaagggcctaggtggtcgatacaaaagcggtcgtag

SEQ ID NO: 27100 - DNA, 1707 bp, Artificial Sequence
  Description of Artificial Sequence: Synthetic coding sequence
atgagcggctgggagagctactacaagaccgagggcgacgaggaggcagaggaggaacaggaagaaaatcttgaagcttctggtgactacaagtattccggcagagattccctgatcttcttggtcgacgctagcaaggctatgttcgagagtcagagtgaggacgagcttacgccttttgatatgtcaatccaggaattggataatcccggagctaaaaggatcctggaactggatcagttcaagggccagcagggccagaaacgctttcaggatatgatggggcatggatcagactacagcctgagtgaggtgctatgggtctgtgccaatttgttcagcgacgtgcaattcaagatgtctcataagagaatcatgctattcacgaatgaggacaaccctcacgggaatgatagcgcgaaggcatcccgggcccgtactaaggcaggcgacctccgcgacaccggcatattcctggacttaatgcacctaaaaaagccaggcggctttgacataagtcttttttaccgtgatattatcagtattgcggaggacgaggaccttcgagtgcacttcgaggaatcctccaaacttgaggaccttctccggaaagtgcgcgctaaagaaaccagaaagagagctctgtctcgactgaagctgaagctcaacaaggacatcgtgatctcagtggggatctacaatctggtgcagaaagcgctgaaaccacctccaattaaactgtatagggagaccaacgagccagtaaagactaaaacccgaacttttaatacatccaccggagggctcctgttgccctcagacaccaagcgctctcagatttacggctcccgccagatcattctcgagaaggaggaaaccgaggaactgaaacggttcgacgatccgggactgatgttgatgggtttcaaaccactggtgctgctgaaaaaacaccactatctgcgcccatcactgtttgtttaccctgaggagagcttggtgattggaagtagcacacttttttctgctctgctgattaaatgcctggaaaaagaggtggctgctttatgcaggtatacccctcggagaaacataccgccatattttgtggctctcgtccctcaagaggaggagctcgatgatcagaagatccaggtaacgccacccggctttcaactcgtatttttgccatttgccgacgacaaacgaaagatgccctttacagagaagatcatggcaaccccagaacaggtcggtaagatgaaagctatcgtggagaagcttagattcacctatcggtctgacagcttcgagaaccccgtccttcagcaacatttcagaaatttagaggctcttgctcttgacctcatggagcctgaacaggctgttgacctgacactgcctaaagtggaggccatgaacaaaaggttgggcagcctcgttgacgagtttaaggagctcgtctatccgccagattataacccggagggcaaggtgacaaagcgcaaacatgacaatgaagggtctgggagcaagcggccgaaggtagaatattcggaggaggaactgaaaacacatataagcaagggtactctgggcaagttcaccgtgcccatgctgaaagaagcctgccgggcttatggcctgaagagtggcttgaaaaaacaagagcttcttgaagcactgaccaaacactttcaagactag

SEQ ID NO: 27101 - DNA, 1680 bp, Artificial Sequence
  Description of Artificial Sequence: Synthetic coding sequence
atgaagaagcagcggaagaacaagaagcggaccctgaagcaggtgtgtatccagtcggtctacatcagcaaaatcatatcctcggatagggatctgcttgcggttgtcttctatggaacagagaaggacaaaaatagcgtgaatttcaagaacatttatgtgctgcaggaactggacaatccgggagctaagagaatcctggaactggaccagtttaaggggcagcagggacagaaacggttccaagatatgatgggccatggctctgactactcgttatctgaggtgctgtgggtatgcgcgaatctgttctcggacgtccaatttaagatgtctcataaacggatcatgctgtttaccaacgaagacaacccccatggaaacgacagcgccaaagcttcaagagcccgtaccaaagctggcgacctccgggatactggcatattcttagatctgatgcacttgaaaaaaccaggcgggtttgacatatccctattctatcgcgatataatcagcatcgcagaggacgaggacctccgagtgcacttcgaggaaagcagtaagctggaggatcttctacgcaaggtgcgcgctaaagaaacccgcaagagagcccttagccggctgaagctcaaactcaataaggatattgtgataagcgtcggaatctacaatctggtccagaaggcactgaaacctcccccaatcaagctttatcgcgagacaaacgagccagtgaaaactaagacaaggacattcaacacgtcgaccggcggcttgctcctgccgagtgacactaagcgtagccagatttatggatccaggcagatcatcttagagaaggaagagactgaagagctaaagcggttcgatgaccctgggttgatgctgatgggattcaagccactggtgctccttaaaaaacatcactatttgaggccttccttgtttgtgtatcccgaagaaagtctcgtcataggatccagcactctattcagcgctttgctgattaagtgcctggagaaggaggtggcagcgttatgcaggtacaccccaaggagaaacattccaccttactttgttgcgctggtacctcaggaggaggagttggacgatcagaagattcaggtgacacccccggggtttcagctggttttcctgcctttcgccgatgataagcggaagatgccttttacagagaagatcatggcaacccccgaacaggtcggcaaaatgaaagccatcgtggagaaacttaggtttacctacagatctgattcttttgaaaatcctgtgctgcagcagcacttcagaaacctggaggcccttgccctcgacctgatggaacccgagcaggctgtggacctgacccttcctaaggttgaagccatgaataaacggttaggtagcttagtagacgagttcaaagagttagtttacccaccggactataatcccgaaggcaaggtgacaaagcggaaacatgacaatgagggcagcggatccaagcggccaaaggtcgaatacagcgaggaggagctgaagactcacataagtaaaggcaccctgggcaagttcacggtgccaatgctcaaagaggcttgccgcgcctacgggttgaaatcaggactgaaaaaacaggagctgctggaagctctgacaaagcacttccaggactag

SEQ ID NO: 27102 - DNA, 1830 bp, Artificial Sequence
  Description of Artificial Sequence: Synthetic coding sequence
atgagcggctgggagagctactacaagaccgagggcgacgaggaggctgaagaggagcaggaagagaaccttgaagcgtctggggactataaatatagcgggcgtgacagtctgatcttcctggtggatgctagcaaggccatgttcgagagccagagcgaggatgagctcactcctttcgatatgtctattcagtgtatccagtccgtgtatatttctaagatcatctcatcagacagggaccttctggccgtcgttttttatgggacggaaaaggataagaactcagtcaactttaagaacatatacgtgttgcaggagctggacaatcctggcgctaaacggattcttgagctggaccagtttaagggccagcagggacagaaacgattccaggatatgatgggacatggtagcgattacagcctgtctgaggtcctttgggtgtgcgcgaatttgttttccgacgtacagtttaaaatgagccataaacggatcatgctgtttaccaatgaggacaaccctcacgggaatgatagcgcgaaagcctcccgcgctcggaccaaggcaggtgatctcagagacactggtatcttcctggacctgatgcacttgaaaaaacctggtggattcgatatctccttgttctaccgggatatcatttctatagcagaagacgaagaccttagggtgcatttcgaagagagcagcaagctggaggacctcttgcgtaaagtgcgggccaaggaaacacggaagcgggccctgagcagactgaaacttaaattgaataaggacattgtgatctctgtagggatctacaatttagtccagaaggccttgaagccacctcctataaaactgtatagagaaacaaatgagccagttaagacaaagacgcgcactttcaacacatctaccggtggcttgttgctcccttctgatacaaagaggagccaaatttacggcagtcggcagatcattctggagaaggaagagactgaggaactcaaaagatttgacgaccctggactgatgctaatgggttttaagcctctggttctgttgaagaagcaccactacctgaggcctagcctattcgtttacccagaagagtctcttgtgatcggaagttcaacattgttctcagccctcctaattaagtgtctggaaaaagaagtcgccgccctctgccgatataccccgcggagaaacatacctccatacttcgtggctttagtaccacaggaagaggagcttgacgatcaaaagatacaggttactccgcccgggtttcagctggtcttcctcccatttgctgatgataaacgtaagatgccgttcaccgaaaaaatcatggctacacctgaacaggttggaaaaatgaaggccatcgtcgagaagctgagattcacatacagatcagacagcttcgagaatcctgttctgcagcagcacttccgaaatctcgaagccctggccctcgaccttatggaacctgagcaggctgtagatctgaccctgcctaaggtggaggctatgaacaaacgattgggctcgttggtcgacgagtttaaagaactagtatatcctcctgattacaatcccgagggaaaggtcacaaaacggaaacacgacaatgagggaagcggctcaaaaaggccaaaggtggagtatagtgaggaggaactcaagacccatatctccaagggaactttaggaaagttcacagttcccatgctcaaagaagcctgccgggcctacgggctcaagagtgggcttaagaaacaggaactcctcgaagctttgaccaaacacttccaagactag

SEQ ID NO: 27103 - DNA, 1431 bp, Artificial Sequence
  Description of Artificial Sequence: Synthetic coding sequence
atgatgggccacggcagcgactacagcctgagcgaggtgctgtgggtgtgtgccaatctgttctcagatgtccagtttaagatgtctcacaaacgcattatgttgtttacgaacgaggacaacccacacggaaatgattctgctaaagcatcccgcgcgcgtactaaggctggagatctgagggacaccggaatattccttgacctgatgcacctgaaaaagcctggtggattcgatatcagcctgttctacagggatatcatttcgatcgctgaagacgaggatctgcgggtccacttcgaagagtcctctaaactcgaggacctgctgcgaaaagtacgggcaaaggagactcgcaaacgggctctaagtcggttgaaactgaagcttaataaagacattgtgatttctgtgggcatatacaatctggtgcagaaggctctcaaaccaccaccaattaagctttaccgagagaccaacgagcccgtcaagacgaagactaggactttcaacacctctactggtggcctccttctcccaagtgatacaaagcggtcgcagatttatggcagccgccaaatcatcctggaaaaggaagagaccgaagaattgaaaaggttcgatgatcctggcctgatgcttatgggtttcaagcccttggtactccttaaaaaacaccactatctgcggcctagtttatttgtgtacccggaggagagcttagtcataggcagtagtactttattctcggcactgttgattaagtgcctggaaaaagaggttgccgccttatgccggtatactcccaggcgcaacattccaccatatttcgttgccttagtccctcaggaggaagaactggatgatcagaaaatccaggtaacaccccccggcttccagcttgtctttctcccatttgctgatgacaagcggaagatgcctttcaccgagaaaattatggcgacaccagagcaggtcggaaagatgaaggccatagtggagaaactacgttttacttaccggtccgactcctttgagaaccctgttctccagcagcatttcaggaatctggaggcactcgctctcgatttaatggaaccggaacaggcggtcgacctgactctgccaaaggtcgaggccatgaacaaacgtctcggtagcctcgtagacgaatttaaggagttggtctacccgcccgactataacccagaggggaaggtgacaaaacggaagcatgataacgaggggtctggatctaaacggccaaaggttgagtacagcgaggaagaacttaaaacccacatttcaaaagggacactgggaaagttcaccgtgcctatgctgaaggaagcgtgtcgagcctatgggttgaagtccggtttgaagaagcaggagttgcttgaagctctgacgaagcacttccaggactag

SEQ ID NO: 27104 - DNA, 741 bp, Artificial Sequence
  Description of Artificial Sequence: Synthetic coding sequence
atggccggcgcccccgacgagcggcggcggggccccgccgccggcgaacagctccagcagcaacatgtgagttgtcaggttttcccggaacgcctggcccaaggaaatcctcaacaaggcttcttctcctctttttttacctctaaccagaagtgtcagcttaggctgctcaaaaccttagagactaatccatacgtgaaactgctattggatgccatgaagcattcagggtgcgcagttaataaggataggcatttcagttgtgaggattgtaacgggaatgtctccggcgggtttgacgcctcaacaagccagatcgtgttgtgccagaacaacatccataaccaggctcatatgaatcgcgtcgtgactcatgagctgattcatgcattcgaccattgcagggcacacgtcgactggtttacgaacattagacacctggcttgcagcgaagtgcgggctgccaacctgtctggagactgctccttggttaatgaaatcttcaggctccactttgggttgaaacaacaccaccagacttgtgtccgcgacagggccacgctctcaatcctggcagttaggaatatctcgaaggaggtagccaagaaggctgttgacgaggttttcgagagctgtttcaacgaccacgaaccatttggccggatcccccacaacaagacctatgctaggtatgcccaccgggacttcgaaaacagggacaggtactatagtaacatctag

SEQ ID NO: 27105 - DNA, 1515 bp, Artificial Sequence
  Description of Artificial Sequence: Synthetic coding sequence
atggaccccggccagcagccccccccccagcccgccccccagggccaggggcagcctcctagccaaccaccccagggtcaggggccgccatccggcccggggcagcccgccccggccgccactcaagccgcacctcaggcccctcccgccgggcatcagattgttcatgtccgaggcgatagcgagacagatctggaggccctgttcaatgccgtcatgaaccccaagacagcgaatgtccctcagactgtccctatgaggttacgcaaattgcctgactcattctttaagcccccagagccaaagtctcacagtagacaagcctccaccgacgctggcactgccggcgcacttaccccccaacatgttagggcccacagttcacccgctagtctccagctcggagcggtgagccctggtactctcacacccacaggagtggttagcggccccgcagctacacctaccgcccagcacctccggcaaagcagcttcgaaattcccgatgatgtccccctgccagcgggctgggagatggccaagacaagttctggccaacgctacttcctgaatcatatcgatcagactactacttggcaggatcctagaaaagccatgctgagtcagatgaatgtgaccgctcccacctcacccccagtccaacaaaatatgatgaactctgcttcgggccctttgcccgatggctgggaacaggccatgacccaagatggcgagatttactacattaatcataagaataaaacgacttcttggttggacccaaggctggacccaagattcgccatgaatcaacggatttctcagtcagctcctgttaaacagcccccccccttagcccctcagagtcctcagggaggtgtgatgggaggcagtaattccaaccaacagcagcagatgcgactgcaacagctccaaatggagaaggaacgactgcggctcaagcaacaagaactgctcagacaggctatgagaaacatcaacccttccaccgccaactcacccaaatgccaggaactcgctttgcggtcccagctgcctacacttgaacaagatgggggcactcagaaccctgtttcatctcctggcatgagccaagagttgcgaaccatgacaacaaattcttctgacccctttctgaactctggaacgtatcattcaagggatgagtcaaccgattccgggctctcaatgtctagctatagcgtcccccggacacctgatgatttcctgaactctgtggacgagatggacacgggggacaccatcaaccaaagcacactcccttcacagcaaaacagatttcctgattacctggaagcgatccccggcactaacgtcgacctggggacactggagggggacggcatgaacatcgaaggtgaagaactaatgccttctctgcaagaggctctgagtagcgatattttaaacgatatggagtcagtgctggctgctacaaaactcgacaaggagtcttttctgacctggttatag

SEQ ID NO: 27106 - DNA, 1365 bp, Artificial Sequence
  Description of Artificial Sequence: Synthetic coding sequence
atggaccccggccagcagccccccccccagcccgccccccagggccagggccagccaccctcccagcctccccagggccaggggccaccttcgggcccaggccaacccgcacctgcagcgacgcaagcggcacctcaggccccccccgccgggcaccaaattgtgcatgtgcggggagatagcgagacagacctggaggctttgttcaacgctgttatgaacccaaagaccgcgaatgtgccccagaccgtcccgatgcgcctcaggaagctgccagacagctttttcaaaccacccgagccgaaaagtcattcccgccaggctagcacagacgctggaactgctggggccttgaccccgcagcacgttagggctcactcaagcccggcctcacttcagctgggggccgtgtcccctggaacgctgacacctacaggtgtcgtctccgggccagcggctacacccaccgcccagcatctacgtcaatctagttttgagatccccgatgatgtcccactgcctgcaggctgggaaatggcaaagacaagctccggtcaacgatatttcctcaatcacattgaccaaacaactacttggcaggacccacgcaaagcaatgctatcccagatgaatgtcaccgctcccacctccccacctgtccagcagaacatgatgaattctgcgagcgctatgaaccagaggatcagtcaatccgccccagtgaagcagccacccccactggctccgcaatcacctcagggaggggttatgggcggctccaacagtaaccagcaacagcagatgcgcctccaacagcttcagatggaaaaggaaaggctgcgtctgaaacagcaagagttgctgcgacaggtgaggcctcaggagctggctctcagaagccaactgcctactcttgagcaagacggaggcacgcaaaaccccgtcagttctcccgggatgagtcaggagttgcgcaccatgacaactaattcgtccgatccattccttaattcaggaacatatcactctagagacgagtctactgatagcggactcagcatgagtagctactcagttcctcgcactcctgatgattttctgaattctgtggacgagatggacactggcgacacaataaatcagtctacactccccagccagcagaacaggttccccgactacctggaagcgattcccggtaccaacgtcgacctcggtacgcttgagggggacggcatgaacatcgaaggagaggagttgatgccctcactgcaagaggctctgtcctccgacatcttgaatgatatggaaagcgttcttgctgcaaccaagctggacaaagaatctttcctgacctggctgtag

SEQ ID NO: 27107 - DNA, 1266 bp, Artificial Sequence
  Description of Artificial Sequence: Synthetic coding sequence
atgcggctgcggaagctgcccgacagcttcttcaagccccccgagccaaagtcccattcccgccaggcatcaacagatgcggggaccgctggggcacttactccccagcatgtccgcgcacatagttctccagcttctttgcagcttggtgccgtgtcacccggaaccctgacgcctacaggggtggtaagtggtccggcagcgacccccactgcccaacatctgaggcaatcttcatttgagatccccgacgatgtccctctcccggcagggtgggaaatggcaaagacctcaagcgggcagcgatacttcttaaaccacatagatcagaccaccacgtggcaagatccgcggaaagcgatgctctcccaaatgaacgtcaccgccccgactagtccccctgtgcagcagaacatgatgaattccgcaagcgggcctctacctgatggatgggagcaagccatgacacaggatggtgagatttattatatcaatcataagaataagactacgtcctggctggaccccaggctggatccaagattcgggaaggcaatgaaccagaggatcagccaaagcgctcctgtgaagcagccacctcctctggccccacagtctccccaaggcggggtaatggggggctcgaactcaaaccagcagcagcagatgcgcctacagcagcttcagatggagaaagaacgtttgaggctcaagcagcaagaactgctgcggcaggcgatgcgtaatattaatccaagcaccgccaattctccaaaatgtcaggagctggctctgcgcagtcagctcccaaccctcgagcaggatgggggcacacagaaccccgtgtcatcgcccggtatgagccaggaactgaggactatgactaccaactcctcggaccctttcctcaacagcggaacctaccattcaagagatgagtccactgatagcgggttgtccatgagcagctactcagtgcctagaacaccggacgatttcctgaacagcgtggacgagatggataccggtgacacaatcaatcagtccacactcccatcccaacagaaccggttcccagattatctggaggccatcccaggcaccaatgtagatctgggcaccttagaaggggatggtatgaatattgaaggtgaggaactgatgcccagcttacaggaggccctgagttcagacattcttaacgatatggaaagcgtcctggctgcaaccaagctcgataaagagagtttcctcacttggctgtag

SEQ ID NO: 27108 - DNA, 981 bp, Artificial Sequence
  Description of Artificial Sequence: Synthetic coding sequence
atggccaagaccagcagcggccagcggtacttcctgaaccacatcgatcagacgacaacatggcaggacccccggaaagccatgctgagccaaatgaatgtgacggcaccgacatccccgcccgttcagcagaacatgatgaactccgcctcaggccctttgcccgatggctgggagcaggccatgacacaggacggagagatctactatataaatcacaagaataaaactaccagctggctcgatcccagactcgatcctcggtttgccatgaatcagagaatttcacaatccgcacccgttaagcagcctcctccccttgccccccagagtcctcaggggggcgtcatgggcggatccaactccaatcagcagcagcagatgcggctccagcaattgcaaatggaaaaggagcgcctcagactgaagcaacaagaactcctcaggcaagcgatgaggaacatcaatccctccaccgcaaatagccccaagtgccaggaactcgctctccgctcccagctgccaaccctggaacaagacggcgggacgcagaatcccgttagcagcccaggcatgtcacaggaattaagaaccatgacaaccaactcttctgatccctttctgaacagcggaacctaccacagccgggacgagagcaccgattctggcttatctatgagctcatactctgtccctaggactcctgacgacttcctgaatagcgtggacgagatggatacgggagatacgattaatcagagtactctcccctcacagcagaacagattcccggactacctggaggcgatcccagggactaatgttgacctgggaaccctggaaggcgatggtatgaacattgaaggcgaggagctgatgccaagcctccaggaggcattgtcctccgacattctgaacgacatggagagcgtcctcgctgcaaccaaactggataaggaatcctttttgacttggttgtag

SEQ ID NO: 27109 - DNA, 1467 bp, Artificial Sequence
  Description of Artificial Sequence: Synthetic coding sequence
atggaccccggccagcagccccccccccagcccgccccccagggccagggacagccccccagccagcccccacaaggccaggggcccccctctggtccgggccagcctgcccccgctgccacccaagccgctccccaagccccccccgcaggccaccagatcgttcacgtgcgtggggattcagagacagaccttgaggccctttttaacgccgtgatgaacccaaagactgccaacgtaccacagacagtccctatgaggctgcggaagctacccgacagcttcttcaaacctcccgaaccaaagtcccactctcggcaggcaagcaccgatgctggaactgctggggcccttaccccccagcatgtacgcgctcactcttcccctgctagtttgcagctgggtgccgtatcccccgggactctgaccccaacaggcgtggtgtccggaccagcagcaacgccaacagcccagcatttgcggcagtctagcttcgagatacctgatgacgtgccccttcctgccggttgggaaatggccaagacaagttccgggcaacgctatttcctgaaccacattgaccagaccacaacatggcaagatccaaggaaagcaatgctgtcacaaatgaacgtaacagcaccgacaagtccgcctgtgcaacagaacatgatgaatagcgccagcggacccttacccgacggctgggaacaggcaatgactcaagatggcgaaatatattacattaatcataagaacaagacaacaagttggttagaccctcgcctagatccaagatttgcaatgaatcagcgcattagccagtcagctcccgtcaaacagccacctccgctggcccctcagagcccccaagggggcgtcatgggaggaagtaacagcaatcagcagcaacagatgcgccttcagcagctgcagatggaaaaagaacgccttagacttaagcagcaggaactgctcagacaggaactggctttaaggtctcagcttcctacactcgagcaagacggagggactcaaaaccctgttagttctccgggcatgtctcaagaacttaggactatgacaaccaactcctccgacccattcctcaacagcggcacttaccattctagggatgagtcaaccgacagcggcctgagtatgtccagttactccgtccccagaactcccgacgattttctcaattcagtggatgagatggataccggcgataccataaatcagtctacccttccttcccaacaaaacagattccctgattacctcgaggccatccccggaaccaacgtggacctcgggacactcgagggggacggtatgaacattgaaggcgaagaactcatgccgtctctacaggaagcactgagtagcgacatcctcaatgatatggagtctgtgctagccgccactaaactggataaagagagcttcctgacctggctgtag

SEQ ID NO: 27110 - DNA, 1479 bp, Artificial Sequence
  Description of Artificial Sequence: Synthetic coding sequence
atggaccccggccagcagccccccccccagcccgccccccagggccagggccaacccccctctcaacctccacagggtcaaggccccccaagcggacccggacagcccgctccagctgccacccaagcagccccccaggctcctccagcgggtcatcagattgtgcacgttcgcggtgactctgaaacagatttggaggcactgttcaacgcagtgatgaatccaaagacagcaaatgtgccccagactgtgcctatgcgcctccggaagttaccagacagttttttcaaaccgcctgagcccaaatcacactcccgccaggcttcgacagacgctggaaccgcgggtgcgctgacccctcaacatgtacgagcccactccagccccgcctccctacagttgggcgctgtgtccccgggcactctgaccccgaccggggtggtgtccggtcccgccgccacacccacagcacagcacctgagacagagctccttcgaaattcccgacgatgtgccactgccagcggggtgggagatggcaaaaacaagtagtggacagagatacttcttgaatcatatcgatcagaccacaacttggcaggaccctcgcaaggccatgctctctcaaatgaacgtgaccgcccctacgagtccaccagtccaacaaaacatgatgaactctgcttccggcccacttcccgatggatgggagcaggccatgactcaagacggagaaatttactatatcaaccataagaacaaaaccactagctggcttgaccccagacttgatccgaggttcgctatgaaccagaggatttcccagtctgcccctgtaaagcaacctcccccactggcaccccagtccccccagggtggcgtgatgggcggctcaaatagcaaccagcaacagcagatgagactccagcaattgcaaatggagaaggaacgccttaggttaaaacagcaggagttgctccggcaggttcggccccaggaactcgcgctgaggagtcaacttcctaccctggagcaagacggtggtacccaaaatcccgttagctcgccaggaatgtctcaggagcttaggacaatgactactaatagtagcgatccattcttaaatagcggcacataccacagcagagacgagtctaccgatagcggactgagcatgagctcatattcagtgccacggactcctgacgatttcttaaactctgtggatgaaatggatacgggagacacaatcaatcagtctactctgccgtcacagcagaacaggttccctgactatctggaggccattccaggcacaaatgtcgatttaggaaccttagagggagatggcatgaatattgagggcgaagagcttatgccctctctgcaggaggcactttcgtctgacatactgaacgacatggagtccgtgctagccgcaactaaactggacaaggagtcgttccttacatggctctag

SEQ ID NO: 27111 - DNA, 1353 bp, Artificial Sequence
  Description of Artificial Sequence: Synthetic coding sequence
atggaccccggccagcagccccccccccagcccgccccccagggccagggacagcctcctagccagcctccccaggggcagggtcctcccagtggccctgggcagccggcgcctgcggccacacaggctgcgccgcaagctccccctgctggccaccagattgtgcacgttaggggggactcagagaccgatctagaggccctattcaacgcagtgatgaaccccaaaacggctaatgtgcctcagacagttcccatgcgcctgcgcaaactcccagacagcttctttaaaccgcccgagcctaaatctcattcaaggcaggctagcaccgacgccgggacagcaggcgctctgactccacagcatgtgagagcccacagcagtccagcgtccctgcaacttggggccgtttctcctggcaccttgacgcctactggggttgtttccgggcctgccgccacccctacggcacaacacttgaggcaatccagtttcgaaattcctgatgacgtgcctctgcccgcagggtgggaaatggccaagacgtccagcggtcagagatactttttgaaccatatcgaccagactacaacatggcaggatcctagaaaagccatgctcagccaaatgaacgtcacagctcctacctcacctcccgtccagcagaatatgatgaactcggcttccgctatgaaccaacgcatctcccaatcagcccccgttaaacagccccctcctctggccccgcagtcaccgcaggggggagttatgggagggtccaacagcaatcagcagcaacagatgaggcttcagcagctgcagatggagaaggagaggttgcgtcttaaacaacaggagctcctgcggcaagagctcgccctgagatcccagttgcctaccctggagcaagacggtggaacgcagaacccggtctcctctcccggaatgtcccaagaactgcgaactatgacgactaattcaagtgatccgttcttgaattcaggaacatatcactcccgagacgaatccacagattccggcctgagcatgagctcttattccgtgccacgcactcctgacgattttttgaatagcgtggacgaaatggatacgggagacaccattaaccagagtacgctgccttcccagcagaataggttcccagattatctcgaggcgatccccggtacaaatgttgaccttggcactctcgaaggagatggcatgaacatcgagggagaagagcttatgccgagtctccaagaggccttaagtagtgatatccttaatgatatggaaagcgtgctggccgcaacaaagcttgacaaggaaagcttccttacctggctgtag

SEQ ID NO: 27112 - DNA, 1860 bp, Artificial Sequence
  Description of Artificial Sequence: Synthetic coding sequence
atggccaacgacatcgacgagctgatcggcatccccttccccaaccattctagcgaagtgctgtgcagcctgaacgaacaacggcacgatggcctcttgtgcgatgtgctgcttgtcgtgcaggagcaggaataccgaacccacagatccgtgctggcagcctgctccaaatacttcaaaaagctatttacagccgggacactggcatctcaaccctacgtgtacgagatagacttcgtacagccagaagcacttgcggccatcctagagttcgcctatacatcgactctcactatcactgcaggtaacgtgaagcacattctaaacgcggcccgtatgttggagattcaatgcattgttaatgtctgcttggagatcatggagccaggcggggatggaggcgaggaggacgataaagaggacgatgatgatgacgaggacgatgacgatgaagaggacgaggaggaagaggaggaagaagaagaagatgacgatgatgacactgaagacttcgccgaccaggagaatctgccagacccccaggatattagctgtcaccagtccccatccaaaaccgatcaccttactgagaaggcatacagtgatacccctagagactttccagactcctttcaagcagggagccctgggcacctgggtgttatacgtgatttttcaatcgaaagtctgctgagagagaatctgtacccaaaagccaatattccggaccgcaggcctagcctgtcaccatttgctcctgatttctttccccatctgtggccaggcgatttcggagcatttgcccagctacctgagcagcctatggattcaggccccctggacctggtgataaaaaacagaaagattaaagaggaagagaaagaagaactccctcccccacctcctcctccctttcctaatgatttcttcaaggacatgttccctgatctgcccggggggcctttaggcccaattaaagcagaaaacgactacggtgcctacctaaacttcctgtctgcaactcacctgggggggctgtttcctccctggccactggttgaggagcggaaattaaagcctaaggccagccagcaatgccccatttgccacaaagttatcatgggtgcgggaaaactcccaaggcatatgaggacccacactggagagaagccctacatgtgcactatatgtgaggtgcgattcaccagacaggacaaactgaagattcacatgagaaaacataccggggagcgtccttatttgtgcattcactgcaatgcgaagtttgtacacaattacgacttgaagaatcacatgaggatccacaccggagtcaggccctatcaatgtgagttttgttataaatcgttcacccgttccgatcacctccatcgacatataaaacgacagtcttgcagaatggctcggccacgtaggggccggaagcccgccgcctggagggctgctagcctcctttttgggccagggggccctgcccctgacaaagctgcgtttgtaatgccccccgctctgggggaggtgggcggtcatttggggggagctgccgtatgcttgcccggccccagcccagcaaagcactttctggccgcccccaaaggcgccttgtctctccaggagctggaaaggcagttcgaagaaactcagatgaagcttttcggccgggcccagctggaagccgagagaaacgctgggggtctcctggcgtttgcactcgccgagaatgttgccgcagcacgaccctactttcctctaccagatccatgggcagcgggactcgccgggcttcccggcctggcaggcctgaaccacgtggcttcaatgtccgaagcaaacaactag

SEQ ID NO: 27113 - DNA, 1860 bp, Artificial Sequence
  Description of Artificial Sequence: Synthetic coding sequence
atggccaacgacatcgacgagctgatcggcatccccttccccaaccactcgagcgaggtgttgtgctccctgaatgaacagcgccacgatggtctcctgtgtgatgtactgctcgtcgtgcaggagcaggagtatcggacacacagatccgtattagccgcttgttctaaatacttcaaaaaactgttcacggccggtacccttgctagtcagccttacgtgtatgagattgacttcgttcagccagaggccctggctgctattctcgagttcgcctacacttccactctcacaatcaccgccggtaatgtgaagcatattctgaatgcagcacgtatgctggagatccagtgcattgttaacgtgtgcctggagattatggaacccggcggagatgggggggaagaggacgacaaggaagatgacgatgacgatgaggacgacgacgatgaagaagatgaggaggaggaagaggaagaggaggaggatgacgatgacgacaccgaggatttcgccgatcaagagaatcttccagacccccaggacatctcatgccatcagtcccccagcaagaccgaccacctgaccgaaaaggcctattctgataccccccgagacttccctgatagctttcaagcaggatctcccggccacttgggcgttattagggacttctctattgaatccctgctgcgagagaacctttatcctaaagccaatattcctgatcggcgcccttcgttatccccattcgcaccggactttttcccccacctatggccaggagattttggtgccttcgcccagctgccggaacagcctatggacagcgggccactcgacctcgtcattaaaaatcgcaaaataaaggaggaagaaaaagaggagctgccacccccaccaccccccccgttcccaaacgattttttcaaggacatgttccccgacctgccagggggacctctgggtcctattaaggcagaaaacgactacggggcgtatctcaactttctttcagccacccatctggggggattgttccctccatggccgctggtagaggagaggaagcttaaacctaaagcttctcaacagtgtccgatttgtcataaggtgatcatgggtgctggcaagttaccgcgccacatgcgtactcataccggcgaaaaaccatatatgtgcacgatctgtgaggttaggttcacgagacaggacaagttgaaaattcacatgaggaaacatactggagaacgaccatatctgtgtatccattgtaatgccaaattcgtgcataattacgacttaaagaatcatatgagaatacatacaggcgtccgaccttaccagtgtgaattctgttataagtcctttacacgatctgatcaccttcataggcacatcaaacgccagtcctgcagaatggcacgcccaaggagggggcgtaaacctgctgcatggcgtgccgcttccctgctattcggccctggagggccggcgccggacaaagcagcattcgtcatgcccccggccctgggggaagtgggcggccatttgggcggcgccgcagtgtgtttgcccgggccctcacccgccaagcactttttggcagcacctaaaggcgcgctttcgcttcaggaactggaacggcaatttgaggagacacagatgaaactcttcggccgggcacagctcgaggctgaacgcaacgcgggtggactgctggccttcgccctggccgagaacgtagccgccgctaggccatacttccccctacccgacccctgggctgctggcttggcaggtttacctggactggccggcctcaatcacgtggcgtctatgagcgaggcaaacaactag

SEQ ID NO: 27114 - DNA, 78 bp, Artificial Sequence
  Description of Artificial Sequence: Synthetic coding sequence
atggccaacgacatcgacgagctgatcggcatccccttccccaaccacagtagtgaagtcctgtgttccctgaactag

SEQ ID NO: 27115 - DNA, 57 bp, Artificial Sequence
  Description of Artificial Sequence: Synthetic coding sequence
atggccaacgacatcgacgagctgatcggcatccccttccccaaccactcatcctag

SEQ ID NO: 27116 - DNA, 3375 bp, Artificial Sequence
  Description of Artificial Sequence: Synthetic coding sequence
atggccgacggcccccggtgcaagcggcggaagcaggccaaccccaggaggaacaacgtaactaactataataccgtggttgagaccaacagcgactcagacgatgaagataagctgcacatagtggaagaggagtctgtgactgatgccgccgactgcgagggagtgcccgaggacgatctacctacagatcagactgtgttacccgggcggagcagcgagcgcgagggtaacgccaagaactgctgggaagatgaccgtaaggagggccaagagatcctgggtcccgaagctcaggctgatgaagctggctgtacggtcaaggacgatgagtgcgagtccgatgcggagaacgagcagaaccacgacccgaacgtcgaggaattcctgcaacagcaggacactgctgtgatcttccctgaggcccctgaggaagatcagaggcagggtacacccgaggcatctggtcatgacgaaaatgggacccccgatgctttctcccagctccttacatgcccatactgtgacagggggtacaaaaggttcacatcactgaaagagcacatcaagtatcgtcacgagaaaaatgaggacaacttctcctgcagcctgtgcagctacacctttgcttaccgcacacaactggagcgccatatgaccagtcacaaatcagggcgggaccaacggcacgtaactcagtcggggtgcaacaggaagttcaaatgcactgaatgcgggaaagcttttaaatataagcaccacctaaaggaacacctgaggatccacagtggcgagaaaccttacgaatgccctaattgtaaaaagcgattcagtcacagcggatcctactcctcacacatcagctccaaaaaatgtatctcactcatcccggtaaatgggcggccaaggactggcttaaagacaagtcagtgttcctctccttcgctgtccgcttcacctggctcgccaacccgaccgcagattcgtcagaagattgaaaacaaacccctccaggagcaactcagcgttaatcagatcaaaacagaacctgttgactacgaattcaagcccatagtcgtggcctcaggcatcaactgtagtacaccactgcaaaatggagtgtttactggcggcgggccactgcaggctacatcatctcctcagggaatggttcaggccgtggtgttgccaaccgtgggattggtgtctcccatttctattaatttaagtgacattcagaacgtcctgaaagtagccgtggatggcaacgtcataagacaagtgctggaaaacaaccaagccaacctggcttcaaaggaacaagaaacaatcaatgctagtcccatacagcaagggggccactccgtgattagtgctatttcactgcctctggttgatcaggatggcacgacaaaaattattatcaactatagcctcgagcagccctctcagctgcaagtggtgccacaaaacctcaagaaagaaaatccagtggcaaccaatagctgcaaaagtgaaaagctgccggaagacctgaccgtaaaaagcgaaaaagacaagagtttcgagggtggagtcaacgactccacctgcttactgtgtgatgactgcccaggagatatcaatgcactgcccgaactgaaacactacgatctcaagcaaccaacacagccccccccgctccctgcagctgaggcagagaagcctgagtcctctgtctctagtgccactggagacggcaacttgtcgccttcccagcccccactaaaaaaccttttatcactgctgaaggcctactacgcactcaacgcccagccttctgccgaggagttatccaagatcgcagacagcgtcaacctgcccctggatgtagtgaaaaagtggttcgagaagatgcaggccggccaaattagcgtccaatcttccgaaccttccagtccagaacctggaaaggtaaacataccagctaagaacaacgatcaaccccagtctgctaatgcgaatgagccgcaggactctaccgtcaacctgcagtcgcctttaaaaatgacgaattcccccgtcctcccggtagggagtaccactaacgggagcaggtccagcacacccagtccctcacccctcaacttatcatcaagccgcaatacgcagggatacctttataccgctgagggggctcaggaggagccacaggttgaacctctagacctgagcctccccaaacagcagggcgagctgttagaacggagtacaatcactagtgtgtaccaaaatagtgtatacagtgtgcaggaggaaccactcaatttgagctgcgccaagaaggaacctcagaaggacagctgcgttactgatagtgaacccgtcgtaaacgtcatcccaccatcggcaaaccccataaatatagcgatcccaaccgttaccgcacagctgcctactatcgtggcaatcgctgatcaaaattccgtcccttgcctccgcgccctagccgcgaacaagcagacaatactgatccctcaggtggcatacacctatagcaccacagtgagcccagctgtgcaggagcctccactaaaggtgattcagcctaacggcaaccaggatgaaagacaggatacaagctctgagggagttagcaatgtggaggaccagaatgattctgacagtactcctcctaaaaagaagatgcggaaaaccgaaaatggaatgtacgcttgcgacttgtgtgataagatctttcagaaaagcagttcactacttaggcataaatacgagcatactggcaagcggccccatgaatgtggaatttgcaagaaggcattcaaacacaagcatcatctgattgagcacatgcgactgcactctggcgagaagccgtatcagtgcgataagtgcggtaagagatttagccattccgggtcatactcgcagcatatgaaccacagatatagttattgcaaacgggaagccgaagaaagagatagtacggagcaggaagaagccggcccggagattctgagcaacgaacatgtcggggcgcgcgctagccccagtcagggcgatagcgatgaaagggagtcactgacgagggaggaagatgaagatagcgaaaaggaggaagaagaggaggataaagaaatggaagaactacaggaagagaaagagtgtgagaagcctcagggagacgaagaggaggaggaagaggaggaggaggttgaagaggaggaagttgaagaggccgagaacgagggagaagaggctaagacagaagggctgatgaaggacgatcgtgcagagagtcaagcgagctcccttgggcagaaggttggtgaatcttcagagcaggtgagtgaggaaaagacaaacgaagcatag

SEQ ID NO: 27117 - DNA, 3378 bp, Artificial Sequence
  Description of Artificial Sequence: Synthetic coding sequence
atggccgacggcccccggtgcaagcggcggaagcaggccaacccccggagaaacaacgtgacgaattacaacaccgtggtggagacaaactcggacagtgacgacgaagacaaactacatatagtggaggaagagagtgtgacggatgcagccgactgcgagggcgtccctgaagacgatctgcctacagatcagacagtgcttcccggaagatcctcggaacgcgagggaaatgcgaagaactgttgggaggatgacacaggcaaggagggccaggagattcttgggccagaagcccaggcagacgaggccggatgcactgtgaaagacgacgagtgtgagtcagatgcggaaaatgagcagaaccacgatccgaacgttgaagaattccttcaacagcaagatacagcagtcatttttccagaggcaccggaagaagaccagagacaaggaacccctgaggcctcgggacacgacgaaaacggaacaccagatgctttctcccagcttctcacctgcccgtactgtgaccggggctataagcgattcacctctctgaaggagcatatcaaatataggcatgagaaaaacgaagacaattttagctgcagcttatgctcctacaccttcgcctaccggactcagctagagcgtcatatgacctcccataagagcgggcgggaccaaagacatgtaactcaaagcgggtgtaataggaagttcaaatgtacagaatgtgggaaagcttttaaatataagcatcatctgaaggagcacttgagaattcatagtggggagaagccttacgaatgccccaattgcaaaaagcgtttctcccactctggaagttacagctctcatatatcaagcaaaaagtgcatttctttgatcccagtgaacgggcgcccgcgaactggcctgaaaacaagccagtgttcttcaccaagtctatcggccagtcctggctcccccaccaggccgcagatccgtcagaaaattgaaaacaaacctttgcaagagcagctgtcagtgaatcagattaagaccgaacctgttgattatgaatttaagcctattgtggtcgcgagcggtatcaactgctcaacccctttgcagaacggcgtgttcacgggcggtggtccactccaggcgaccagttccccacaaggaatggtacaagccgtggtgctgcctactgtgggactagtgagccccatatctattaacctctcggatattcagaatgtgctgaaggtcgccgtggacggtaacgtgattagacaggtactggaaaacaaccaggctaatctcgcatctaaagaacaggaaactataaacgccagtcccatccagcagggtgggcattcagtcatctcagccatttctctccctctggtggatcaagatggtactaccaaaatcattattaattacagcctcgaacagcccagtcagctgcaggtggtaccgcagaaccttaaaaaggaaaaccccgtggccacaaatagttgtaaatccgagaaactccccgaggacttgacggtcaagagcgagaaagataagagtttcgaagggggggttaatgactcaacatgcttgctgtgtgacgattgccccggggatattaacgccctgccggagcttaagcactacgaccttaagcagccgactcagccccctccgctgcctgcagccgaagcggaaaagcccgaaagcagtgtaagcagcgccacaggggacggaaacctgagtccgtctcagcccccactcaagaacttacttagtctcctaaaggcctattatgctctcaatgctcagccctcagccgaggagttatcaaaaattgcggattcagtgaatctgcccctcgatgtcgtaaaaaagtggttcgagaagatgcaagcaggacagatctcagtgcagagcagcgagcctagcagtccagagccaggaaaggttaatattccagctaagaacaatgatcagccccagtccgcgaacgcaaacgaaccacaggacagtacagtaaacttgcagtctccccttaaaatgacgaactcccctgtcctccccgtcggctccacaacaaacgggtctcggtcttccacaccaagcccctcgcctctgaatctttcgagcagtagaaacacccaaggctacttgtataccgctgagggagcccaggaggagccgcaggtagagcccctggacctgtctctgccaaaacagcagggggaacttttggagaggagcacgattacctcagtctatcaaaacagcgtctactccgtacaggaggagcctctcaacctgtcctgcgccaaaaaggagccacaaaaggattcatgtgtaactgattctgagccagtggtcaacgtcatacccccttcagccaatccgatcaacatcgcgatacccacagtgaccgctcagctgcctactatagttgccattgctgatcagaactccgttccatgtttacgggcactcgctgcaaacaagcagaccatactaatcccgcaggtggcttacacatattcaactaccgtgtcaccagccgttcaggagccacccttgaaggtgatccagcctaatggcaaccaagacgagagacaggacacaagttccgagggtgtttctaacgttgaggatcagaacgatagcgactcgacgccccccaagaagaagatgcggaagaccgaaaatggtatgtacgcctgtgatctctgcgacaagatctttcagaaaagctcgagcctccttagacacaagtatgaacacaccggcaagaggccccacgaatgtggaatctgtaagaaggctttcaagcataaacaccatcttattgaacacatgcggctgcacagcggcgagaagccctatcagtgcgacaagtgtggcaagaggtttagtcacagtggatcttactcgcagcatatgaatcacagatactcatattgcaaaagagaggcagaggagcgagactctacagagcaggaggaagccggaccagaaattcttagcaatgaacatgtgggcgcaagggcaagccctagccagggcgatagtgacgaaagagagagcctgaccagagaggaagatgaagattctgaaaaagaggaggaggaggaggacaaggagatggaggaattgcaggaagagaaggaatgcgaaaagccgcagggcgatgaggaggaagaagaagaagaagaagaggtggaagaggaagaagtcgaggaagcagaaaacgagggtgaagaggcaaagacagagggcctaatgaaggatgaccgcgcagaatcacaggcatcttccctgggtcagaaggttggggagagttctgagcaggtgagcgaggaaaagacaaatgaggcctag

SEQ ID NO: 27118 - DNA, 870 bp, Artificial Sequence
  Description of Artificial Sequence: Synthetic coding sequence
atggccgacggcccccggtgcaagcggcggaagcaggccaacccccgcaggaacaacgtcacgaattataataccgttgtggaaacaaacagcgatagcgacgacgaagacaaactccacattgtggaggaagaaagtgtcaccgatgccgctgattgcgagggcgtacccgaggatgatctccccactgaccagaccgtactcccagggcggagctccgagcgggagggtaatgctaaaaactgctgggaagacgacacaggtaaagagggacaggaaatcctgggtccagaagcacaggccgatgaagccggttgtactgtgaaggatgacgaatgcgagtccgatgccgagaacgagcaaaaccacgaccccaacgtcgaagaattcctccagcagcaggacaccgctgtcatatttcctgaggctcccgaggaggaccagcgccaaggtaccccagaggccagtggtcatgatgagaacggtacgcccgacgcgttcagccagctgctgacgtgcccatattgtgacaggggctataagcgctttacctcccttaaggaacacataaaatacaggcatgaaaagaatgaggacaactttagctgttctctgtgttcatacacatttgcatacagaacccagctagagagacatatgaccagccacaagtccggacgcgatcagcgccacgtgactcagagtggctgtaataggaagttcaaatgcaccgaatgtggcaaggcattcaagtacaaacatcacctgaaggaacatctgcgcatccattccggggagaagccatacgagtgccccaattgtaagaaaagattttctcattccggttcatactcctctcatatcagttag

SEQ ID NO: 27119 - DNA, 2721 bp, Artificial Sequence
  Description of Artificial Sequence: Synthetic coding sequence
atgaccagccacaagagcggccgggaccagcggcacgtgacccagagtgggtgcaatcgcaagttcaaatgcacggagtgcggtaaagcctttaagtacaaacaccatctgaaagaacacttacgcatacactcaggggagaagccatacgagtgccctaattgtaagaaacgttttagtcacagcggtagctactcttctcacatctcaagcaaaaaatgcatctctctgatccctgtcaacggtcgcccccggacgggcctcaagactagccagtgtagtagccctagcctgagcgctagtcctgggagcccaacccgaccgcagatccgccagaagatagagaacaagccgttgcaagaacagctttccgtcaatcagattaagacggagcctgttgactacgagttcaagcctattgttgttgcctcgggaataaattgcagcacacccctgcaaaatggagtcttcacaggaggcggtcccctccaggcgaccagtagcccacagggaatggttcaggcggttgtactgccaacagtcggcttagtgagccctatcagcatcaaccttagcgacatccaaaacgtgctaaaagtggcagtcgatgggaacgttataagacaggtcctagaaaacaaccaggcaaacttggctagcaaggaacaggaaaccatcaacgccagtcccatccagcaaggtgggcatagcgtaattagtgcgatcagcctgccgctggtcgatcaggacgggaccactaaaattatcatcaattactctctggaacagccctctcagctgcaggtggtgccccagaacctaaagaaggagaaccccgtcgcaaccaattcatgcaaatctgaaaaactgccagaagatctgactgtgaagtcagagaaggataaatccttcgagggaggggtgaacgatagtacgtgcctgctttgtgacgactgccccggcgatatcaatgctctgccagagctgaaacattacgatctgaagcagccaacccaaccacctcctttgcccgcagccgaggctgaaaaacctgaatcctctgtgtcatctgctacgggagatggcaacctgagtccaagtcagcctcctcttaaaaacttactcagcctactaaaagcatattatgcccttaatgcacaacctagtgcagaggaactgtctaaaattgccgactccgtcaatcttccactggatgtggtcaagaagtggtttgaaaagatgcaggccggacaaattagcgtgcaatcatccgagccttctagccccgagccaggtaaagttaacataccagccaagaacaatgatcagccacagtccgccaatgccaatgagccacaggatagcacagtgaatctccaatctccgcttaagatgacaaacagcccagtcttgccagtggggtccacgacaaatggctctagatcatcaactcccagcccttccccactgaatctgagttccagcaggaacacccagggctatctgtacactgccgagggcgctcaagaagaacctcaggtcgagcccctcgacttatccctgccaaagcagcaaggggagctgctggagaggagcaccatcacttctgtgtaccaaaacagcgtgtacagcgttcaagaagagccactgaacttgtcctgcgccaagaaggagcctcagaaagattcctgcgtgaccgacagcgagcccgtggtcaacgtgatcccaccaagcgcaaacccaattaatattgccattccaactgttactgcacagcttccgaccatagtcgccatcgccgatcagaacagcgtgccctgtctgcgagcactagcagcaaacaaacagactatactcatcccccaggttgcttacacttattcgacaactgtgtcgcctgccgtccaagagcctccactgaaagtaatccagccgaatggcaatcaggacgagaggcaggataccagtagcgagggagtcagtaatgttgaagaccaaaatgacagcgacagcacaccacccaagaaaaagatgagaaaaactgaaaatggcatgtacgcatgtgatctttgcgataaaatattccaaaagagttcatctcttctgcgacacaagtatgagcatactggaaaacggccacatgagtgtggaatttgtaagaaagcctttaagcataaacatcacttaattgagcacatgaggttacatagcggtgagaagccataccaatgtgacaagtgcggcaagaggttcagtcattctggaagttatagccagcacatgaatcatcggtacagctactgcaagagagaggcggaggaaagggacagtaccgaacaggaagaagccggtcctgaaatcctatctaatgagcatgtcggggcaagagcctccccctctcagggagattctgacgagagagaaagtctgacacgcgaagaggacgaagattcggaaaaagaggaagaagaagaagacaaagagatggaggaattacaggaggagaaggagtgtgaaaaaccccagggagatgaagaggaagaagaggaagaagaggaggtagaggaggaggaggtggaggaagccgaaaacgaaggagaggaagctaagaccgaggggctgatgaaggatgaccgcgcagaatctcaagcaagctctctgggacagaaggtgggagagtcgtctgagcaagtgagtgaagagaaaacaaatgaggcttag

SEQ ID NO: 27120 - DNA, 3327 bp, Artificial Sequence
  Description of Artificial Sequence: Synthetic coding sequence
atgaaggtgaccaactacaacaccgtggtggagaccaacagcgacagcgacgacgaagataagcttcatatcgtggaggaggaaagcgtgaccgacgccgcagactgtgaaggtgtgcctgaggatgaccttcctacagaccagaccgttctcccaggtaggtcctccgaaagggagggaaatgccaagaactgttgggaggatgatactggcaaggagggccaggagattttggggcctgaggctcaggccgacgaagccggttgtaccgtgaaggacgacgagtgtgagagcgatgctgagaatgaacaaaatcacgaccccaacgttgaggagttcctccaacaacaggacacagccgtgatatttcccgaggccccggaggaagaccagagacaagggacaccggaagcaagcggccatgacgaaaacgggacaccggacgcatttagtcagttacttacgtgtccatactgcgatcgcggatacaagcgatttacttctctgaaagagcacattaaatataggcacgaaaaaaacgaggataacttctcctgcagcctttgctcatatacattcgcttataggacccagctggaacgacatatgacatcccataagtccgggagggaccagcgtcacgtcacccaaagcggatgtaataggaagttcaagtgcactgagtgcggcaaagcgtttaagtataaacaccatctcaaggagcatctccgcatccatagtggtgagaagccctatgagtgccccaactgtaaaaagaggttctctcatagcggctcctatagttcccatatctcttccaaaaagtgcattagtttaatccccgtcaatggtagaccgcggacaggcctgaagacaagtcaatgcagttcaccttcccttagcgcgtctcccggcagccccacgagaccccagatccgccagaaaatcgagaacaagccactccaggaacagctatccgtgaatcaaataaaaacagaacctgtcgattacgagtttaaacctattgtggttgcctccggaataaattgtagcactcctctgcagaatggagtgtttaccgggggcggccctctccaagctacatcgagcccacagggaatggtgcaggctgtggttctcccaacagttggtctggtctcgccaatatccattaatttgagcgatattcagaatgtgctcaaggtggctgtggatggcaacgtgatacgccaggtactcgaaaacaatcaggctaacctggcctctaaggagcaagagactattaatgctagcccgattcaacagggcgggcactccgttatttccgctatcagcctgcccctggttgatcaggacggcacgacgaagattattatcaattacagtcttgagcaaccaagtcagctgcaggtggtgcctcagaatttgaagaaggagaatccggtagccacaaattcgtgtaaatccgagaaattaccggaggacttgacagttaagagtgaaaaggacaaatctttcgaggggggtgtgaacgacagtacctgcctgctctgtgacgactgccctggtgacataaatgctcttccagagctgaagcactatgacttgaaacaacccactcagcctccaccactcccggcagcggaagcagagaagccggaatcctccgtttcctcagccaccggggatggcaacctgagtccatcccagcccccattgaagaacttactttcgctgctgaaagcatattacgcactaaatgcacaaccatcagccgaagagctgtcaaagatcgctgacagcgtgaatctgcctttggatgtagtgaaaaaatggtttgagaagatgcaggcagggcaaatttcggtccagtctagtgaaccatcttcccccgagcctggtaaagttaatattccagctaaaaacaacgaccagccccagtctgccaatgccaacgagccacaggactcgacagttaacctccaatcccccctgaagatgacgaatagcccggttctgccggtaggaagtacaacaaacggctccaggtcttctacaccctccccttctccgcttaatctttcatcctccagaaacacccaggggtacctgtataccgccgaaggagctcaggaagagccgcaagtggaacctctcgatttaagcctcccaaagcagcagggcgagctcttagagcgcagcaccataaccagcgtttatcaaaactctgtctactccgtccaggaggagccactcaatctgagctgcgctaaaaaagagccacaaaaagacagttgtgtgacggattctgagcccgtggtgaatgtgataccgccttcagccaaccccatcaatatcgccattcctaccgttacggctcagctccccacaattgtcgcaattgccgatcagaactccgtaccctgcttacgcgctctcgcagctaacaaacagaccatcctaatcccccaggtggcgtacacttactccaccaccgtctctccagctgtccaggaaccccccctgaaggtgatccaacccaacgggaaccaggatgaacggcaagacacttctagtgagggggtaagcaatgtggaggaccagaacgatagcgacagcaccccccctaaaaaaaaaatgcgcaagaccgaaaacgggatgtatgcttgcgacctctgcgacaagattttccagaaatcatcttccctgctgaggcacaaatatgagcacaccgggaaaaggccccacgagtgcggcatttgcaaaaaggccttcaaacacaagcaccacctgatagagcacatgcggctgcactccggcgagaagccctaccaatgcgacaagtgcgggaaacgcttctcccattccgggagttatagtcagcatatgaaccatagatacagctactgcaagcgggaggcggaggaacgggacagtactgaacaggaggaggcaggccctgaaatactcagcaatgaacacgttggcgctagagcatctccaagccagggcgactctgacgaacgggaaagcctgactagggaagaggatgaagattcggaaaaagaggaggaggaggaggacaaagagatggaggaattgcaggaggaaaaagagtgcgaaaagccacagggcgatgaggaagaggaggaggaggaagaggaagtggaagaggaagaagtggaggaagcggagaatgagggtgaagaagctaagacagagggtctgatgaaggacgacagggccgaaagccaggcttcatctctcggtcagaaggtcggggagtcctcagagcaggttagtgaggaaaaaacaaacgaggcttag

SEQ ID NO: 27121 - DNA, 3180 bp, Artificial Sequence
  Description of Artificial Sequence: Synthetic coding sequence
atggccgacggcccccggtgcaagcggcggaagcaggccaacccccgcaggaacaacgtaacgaattacaatactgttgtggagactaactcagactctgatgacgaggacaagttacatatcgtagaggaagagtccgtgacagatgcagccgattgtgagggtgtgcccgaagatgacctcccgaccgaccagactgtgctgcctggcaggagtagcgaaagggaaggcaacgctaagaactgctgggaagatgatcgcaaagaaggtcaggaaatcctcggacccgaggcacaggccgatgaggctggttgcacagtcaaagacgacgaatgcgagtcagacgcagaaaacgagcagaaccacgatcccaacgttgaggagtttcttcagcaacaggacacagccgtcatttttcctgaggctccagaagaagatcagcgacaggggacccctgaggcctcaggacacgacgaaaatggcactcccgatgccttctctcagcttttgacctgtccttattgtgatagggggtataagaggttcactagcctcaaggagcacattaaataccgacacgaaaaaaatgaggataacttttcgtgtagcctatgctcgtatacctttgcataccgcacacaactcgaaagacacatgacctcacataagagcggtcgagatcagaggcacgtcacccagagtggttgcaatagaaagtttaagtgcaccgaatgcggcaaagcgttcaagtacaagcaccacttaaaggagcacctcaggattcactcgggcgagaagccatacgaatgcccgaactgcaagaaacgtttttctcattcagggtcctattccagccacatttccagtaaaaagtgcatcagtctgattcccgtcaatggtcgaccgaggactggactcaaaacaagccagtgttcatcgcccagtttgagtgcctctcctgggagccctaccagaccacagatcagacagaagatagagaacaagccgctacaggaacaacttagtgtaaaccaaattaagacagagccagtagactacgaattcaagcccattgttgtagccagcggcattaattgcagtacgccgttgcaaaacggggttttcacagggggaggtccgctccaggcgacctccagccctcaaggcatggttcaagctgtggtcctgcctactgtggggctagtttcacccatctccataaacctttcagatatccaaaatgtcttgaaagttgccgtggacggaaacgtgatccgccaggtgctggagaataaccaggccaatctcgcctccaaggagcaggagaccatcaatgccagccccattcagcagggtggacactcagtcatttcagccattagcttgcccctggtcgaccaggacggtactacaaaaatcatcatcaattattctttggagcagccctcccagctgcaggtggttccccagaacctgaaaaaagaaaatccagtagccaccaactcctgtaagtctgaaaagcttcctgaagatttgacagtgaaatccgagaaagacaagtcgtttgagggcggggttaatgatagtacatgcttactctgtgacgattgcccgggagacataaatgctctgcccgaattaaaacactacgacctgaagcaacctacccagcctccccctctgcctgctgccgaagcagaaaagccagagagcagcgtgtctagcgccactggcgacggcaatttatccccatctcagccccctctcaagaatctcctttccctgctgaaggcttattatgccctgaatgcccagccaagcgccgaggaattgtccaagattgccgactccgtgaatctcccgctcgacgtggttaaaaaatggtttgagaagatgcaagccggccagatatcagttcagagttcggagccatcttctccagaaccggggaaggtgaatatcccggccaaaaataacgatcaaccacagtctgccaacgcaaacgagcctcaggattctaccgttaacctgcaatcccctctgaaaatgactaattccccagttctgcctgtgggatccactaccaatggaagccgatcttccacgccatcgccatcgccccttaatctttcatcctccaggaatacccagggatacctctatactgctgagggagcccaagaagaaccgcaagtggaaccactggatctgagcttacctaagcaacagggtgagctgctagaacggtcaactatcacttcagtctaccagaacagcgtgtacagcgtgcaagaggaacctttaaacctgtcctgcgccaaaaaggagccccagaaggacagctgtgtgacagattcagagccagtggttaacgtcatacccccatctgcaaatcccattaatattgcaatccctaccgtgaccgcacagctccccacgatagtcgcaatagccgatcaaaactccgtcccctgccttagggctctggccgccaacaagcagacaattctcatccctcaagtggcctacacttacagtactacagtttcccccgccgtccaggaacctccactaaaagtgatacaacccaacggaaaccaggatgagagacaggacacatcgtctgagggagtgtccaacgtggaggatcagaacgacagcgatagcaccccccctaagaaaaagatgagaaagacagaaaacggcatgtacgcttgcgatctgtgtgataaaatttttcaaaagtctagctccctgttgagacataagtacgaacacaccgggaaacgcccacatgaatgcggaatctgtaaaaaggcttttaagcacaagcaccacctgatcgagcatatgcgactgcacagcggggagaaaccttatcagtgtgataagtgcggaaaacgttttagccattctggttcctactcacagcatatgaatcaccgatacagttactgtaagagggaagctgaggagcgggactccacagagcaggaggaagctggaccagaaatcctgagcaatgaacacgtcggagcacgggcgtcccctagtcaaggcgactccgatgagcgcgagtcactgacacgagaggaggatgaggattccgagaaagaggaggaagaggaggacaaggagatggaagaattacaggaggagaagcacaaaaagaaaaagtag

SEQ ID NO: 27122 - DNA, 1932 bp, Artificial Sequence
  Description of Artificial Sequence: Synthetic coding sequence
atggccgacggcccccggtgcaagcggcggaagcaggccaacccccggcgtaacaacggcactccggacgccttctcacaactgctgacctgcccgtactgcgacagaggctataagcggttcacttctctgaaagagcacattaaataccgccacgaaaagaacgaggataatttctcgtgtagtctctgttcatatacctttgcctaccgaacacagctagagagacacatgaccagtcacaagtccggtcgagaccaacgccatgtgacacagagtggctgcaaccgcaaatttaaatgcacggaatgcggcaaggccttcaaatacaagcatcaccttaaggagcacctacggatccattccggcgagaagccttatgagtgtcccaattgtaagaaacgtttctcccactctggctcctattcgtcccacattagttcaaaaaagtgcatctcactcattcctgtgaacggcaggccacggacagggctcaaaactagtcagtgtagttcccctagcttgtcagctagtcccggctcgccaacccgtccccagatccggcagaagatcgagaacaagccactacaggagcagttatcagtcaaccagattaaaacggagccagtggactacgagttcaagcctatcgtggtcgcctccgggatcaattgctctacaccccttcagaacggagtgtttacaggaggtggccccctgcaggcgacttcctcgccacagggcatggttcaggctgttgtcttgcctactgtgggactggtttctcctataagcatcaaccttagtgatatccagaacgtgctcaaagtggcagtcgacggtaacgttatcagacaggtgctcgagaataaccaggcaaacttggcgtccaaagagcaggagacaatcaatgctagtcccattcagcagggtggtcactctgtaatcagcgctatctctctgcccttagttgaccaagatggaacaaccaaaatcatcatcaattattcactcgagcagccttcacagctgcaggtcgtgcctcagaacttgaaaaaagagaacccagtagctactaactcgtgtaaatcggaaaagctacccgaggatctcacagttaaatcagagaaagataagtctttcgaagggggcgtaaatgattcgacctgcctcctatgcgacgactgtccaggcgacattaacgccctgcccgaattgaaacattatgatttaaagcaacccacccagcctcctccgctgcccgctgccgaggcggagaaacccgagtcttctgtaagttccgctactggggatgggaatttgagcccctcccagccacctctgaagaatctgctgagcctcctaaaggcgtactatgctctgaatgcacagccttccgccgaggagttgtccaaaatcgcagattccgtaaatcttccattggatgtagtgaagaagtggtttgaaaagatgcaggccgggcaaatatccgtgcagtccagcgagcctagcagccctgaaccagggaaagttaacatacctgcaaagaataacgaccagccacagtcagcaaacgccaacgaacctcaggactccacagtgaacctgcaaagtccgttgaagatgacaaactcccccgtattgcctgttggaagtactaccaacggctcccgtagcagcacgccaagtccgtcaccgttgaacctgagctccagtcgaaacacacagggttatctgtataccgccgaaggagctcaggaggaaccccaggttgagcccctggacctctccctgcccaaacagcagggcgaggaagcgaagaccgagggattgatgaaggacgacagagccgaatcccaggcctccagcctaggtcagaaagttggcgagagcagtgagcaggtgtccgaggagaaaaccaatgaggcctag

SEQ ID NO: 27123 - DNA, 3174 bp, Artificial Sequence
  Description of Artificial Sequence: Synthetic coding sequence
atggccgacggcccccggtgcaagcggcggaagcaggccaacccccgtcgaaataacgggaaggagggacaggagattttaggcccagaggctcaagcagacgaagccggatgcactgtgaaagacgacgaatgcgagtctgatgctgagaatgagcaaaatcatgatcctaacgtcgaggagtttctccagcaacaggataccgctgtgatctttccagaggcccccgaggaggatcagagacaaggtacccctgaagctagcgggcacgatgagaacggaactccggacgctttctctcaattgctgacctgcccatattgtgaccggggatataagaggtttacatcactgaaggaacacatcaagtataggcatgaaaagaacgaagataacttcagctgctcactatgctcctatacatttgcctacagaacacaacttgaacggcatatgacatcccataagtcaggccgggaccagcgccatgtgactcagagtggctgcaaccgaaaatttaaatgcaccgagtgcggcaaggccttcaaatacaaacaccacctgaaagaacatctccggattcactcaggcgaaaagccctacgagtgtcccaattgcaaaaagagatttagccacagcggctcatattccagtcacattagctctaagaagtgcatcagcttgatcccagtgaacggccgcccacgtactggtctgaagacctctcagtgtagttctcccagcctatcagcctcacctgggagtccaacacggccacagatacgacagaaaattgagaacaagcctctccaagaacagctctccgtcaaccaaatcaagacagagcccgtggattacgagtttaaacctatcgtggtggcgagtggcatcaactgctccactcctctccagaacggcgtttttacaggagggggtccgctgcaggcaacaagtagtccccagggcatggtccaggcagtggtacttcccacagttggactggttagtcccatttccatcaatctgtctgatatccagaatgttctcaaggtcgccgtggacggcaatgttatacgtcaggtcttggagaataaccaggcaaacctagcaagtaaggagcaggagacaatcaacgcaagcccaatccagcagggcggccattcagtgatctctgcgatcagtctgccccttgtcgatcaggacgggacgactaagattatcataaactattcactcgagcagccaagccagttacaggtggttccgcagaaccttaagaaggagaaccctgtggctacgaacagttgtaagagcgagaagctgcccgaagatctgaccgtgaaaagtgagaaggacaagtctttcgaaggaggcgtgaacgattccacctgcttgttgtgtgatgattgcccgggagacatcaacgcgctaccagaactgaaacactacgacctgaagcagccaacacagcctcccccgctccccgcggctgaggctgaaaagcccgagagtagcgtatctagtgctactggagatggaaacttgagtccgtcacagccacctctcaaaaaccttctgtcgctgctaaaggcatactacgcccttaatgctcagccatcagccgaggagctctcaaaaatagccgacagcgtaaacctgcctctcgatgtcgtgaagaagtggtttgaaaagatgcaagctggccaaatttctgttcagtcctccgaaccctcttctcctgagccagggaaggtaaacatacccgcaaagaacaacgaccaaccacagagtgccaacgcaaatgagcctcaggactcgactgtgaatctccagtcccccctgaagatgacaaactcacctgttctgcctgtcggctccaccacaaacgggtcaagatccagcacccctagcccatctccgttaaacctgtccagtagccgaaatacacagggttacctttataccgcagaaggagcccaggaggagcctcaggtggagccactggaccttagtcttcccaaacaacaaggggaactcctcgaacggtcaacaatcacctcagtgtaccaaaactctgtgtacagcgttcaggaggaaccccttaacctgtcctgtgctaaaaaagagcctcaaaaagactcatgtgtgactgattctgagcctgtggtgaacgtcattccaccatcagccaatccaatcaatatcgccattccgaccgtgactgcgcaactgccaactatcgtagcaattgctgatcagaattccgttccctgtcttcgggctctcgcagccaataaacaaaccattcttatcccgcaggtggcgtatacatacagtaccacggtctcacctgctgtacaagagccacccctgaaggtgattcagcctaacggtaatcaggacgagcggcaggacacttcttctgaaggggtaagtaacgtcgaggaccaaaacgattctgacagtaccccccccaaaaaaaaaatgaggaaaaccgaaaatggaatgtacgcttgcgacctgtgtgacaagatcttccagaagtcaagctccctactgaggcataagtatgagcacactggcaaacgaccccacgagtgcgggatctgcaagaaggcctttaagcacaaacaccatctgattgaacatatgcgccttcactcaggcgagaagccttaccagtgtgataagtgcggaaagcggttctcccatagcggctcatactcacagcatatgaatcatagatattcctactgtaagagagaagcggaggagagggacagtacagaacaggaagaggctggtccggagattctgtcaaatgaacacgtcggcgcccgtgcatccccatcacagggcgacagcgacgaacgtgagtcactcacacgagaagaggacgaagattcagaaaaggaagaagaagaggaggataaagagatggaggaactccaggaggagaaggaatgcgagaagcctcagggtgatgaagaggaggaggaagaggaggaagaggtagaggaggaggaagtggaggaggccgaaaacgaaggcgaggaagcgaaaacagaaggcctcatgaaggatgacagagccgaaagtcaggcatcttctcttgggcagaaagtcggcgagtcttccgaacaggtctccgaggagaaaacaaacgaagcttag

SEQ ID NO: 27124 - DNA, 3048 bp, Artificial Sequence
  Description of Artificial Sequence: Synthetic coding sequence
atgatgaacgccagccagatgcagaagatgagcaagaccatgatccttatgttgaagtctttttataacaataaaacccttctgagcttcttcctgcgccatttgaagagaacacgaggccgagcccatcagaaaccggtggttatgatgaaaatggaacatcagatgcactttcacaactacagtcccgttcatatagtgatcggctacaaaaggttcactagcctgaaggaacatatcaagtataggcacgaaaagaatgaagacaacttctcatgcagtctatgttcctacacatttgcctatcggactcagcttgagaggcatatgaccagccataaaagtggaagggatcagcggcacgtgacccagtccggatgcaatcggaaatttaagtgcaccgagtgcgggaaggcgttcaaatacaaacaccatctcaaagagcatctgaggattcattctggtgaaaagccatatgagtgccctaattgtaagaagcgcttcagccattctggctcctattcgtctcatatatcatctaaaaaatgtatctcactcattccagtgaacggacgacccaggaccggcctcaaaacgagccagtgttcttccccttccctttccgccagtcctggctctcccacccgccctcagatcaggcagaaaatcgagaataaacctctccaggagcagctcagcgttaatcagataaagaccgagcccgtggactatgaattcaagccaattgtggtcgcaagtgggatcaattgttctactccactgcaaaacggggtatttaccggaggcggtcccctacaggccactagtagccctcagggcatggtgcaagccgtggtgctgcccactgtagggctcgtgtccccaatcagtatcaatctgtcagatatacagaatgtcctcaaggtagcagtcgatggaaacgtgatacggcaagtgcttgagaacaaccaggctaatctggcgtccaaagagcaggaaactataaatgcctctccaattcagcagggcggacactccgtcatctccgctatttctctgccactggtcgaccaggacgggaccacaaagatcatcatcaactatagtcttgaacagccaagtcagctccaggttgtaccccagaaccttaagaaggagaaccctgtggcaactaattcatgcaagagcgaaaaactgcccgaagatttgactgtgaagtcagaaaaagacaagtctttcgagggaggcgtcaacgattccacctgcctgctgtgcgacgactgtcctggagatattaatgcccttcctgaattgaaacattacgatctaaaacaacccacccaacccccccccctgcccgccgcagaagcagagaagccagagtcctcggtgagcagcgccaccggcgatgggaatctctcaccaagccagccccctttaaaaaacctgctctcattgctaaaggcttattacgcccttaacgctcaaccgtctgcagaggaactgtcaaaaatcgccgacagtgtgaatctgcccttggacgtggtgaaaaaatggttcgaaaagatgcaagccggccagatcagtgttcagagcagcgagccaagcagtccagaacctgggaaagttaatattccagccaagaacaatgatcaaccgcaatccgccaacgccaatgagccacaagatagcacggtcaacctgcaatcccctttaaagatgaccaatagcccagtcctgcccgttgggagtactactaacggtagcaggtctagtacgccgagtccatccccgctgaacctatccagctcaagaaacacccaggggtatctgtataccgccgagggggcacaggaggaaccgcaggtagaaccgttagacttatcgcttccaaaacagcagggagagttgctggaaaggtccacaattaccagcgtttaccagaacagtgtgtactcagtccaggaagagcccttaaatctgagctgcgccaaaaaggagccccagaaagacagctgcgtcactgacagcgagcccgttgtgaatgtgatccctccctccgcaaaccccatcaacatcgccattcccaccgtgactgcacaattgccaaccatagtcgcaattgccgaccagaatagcgtcccttgtctaagagctttggccgctaataaacagacaattttgatccctcaagtggcctacacatactcaaccactgtgagtccagccgtgcaggaaccccctttaaaggtgatccagcccaacgggaatcaagacgagagacaagacacgtcttccgagggcgtgagtaacgttgaagaccagaacgacagtgattcgacaccacccaaaaaaaagatgagaaagaccgaaaatggcatgtatgcctgtgacctttgtgacaaaatctttcaaaagagctcctccctactcaggcataaatacgagcatacaggaaagcgcccccatgaatgtggtatttgtaagaaagcctttaaacacaagcaccacctcatcgaacacatgagactgcacagtggcgaaaagccatatcagtgtgataagtgcggaaagaggtttagccattccggctcatattcccagcacatgaaccatcgctattcttattgcaagagggaagcagaggaacgtgactctacagagcaggaggaggcaggcccggaaatattatcaaacgagcatgtgggggctcgcgccagcccttctcaaggagacagtgatgaacgggagtccctcacccgcgaggaggacgaggacagcgaaaaagaggaagaggaggaggacaaagagatggaagagctgcaagaggagaaagaatgtgaaaagccccagggagatgaagaggaggaagaggaggaagaagaagtcgaagaggaggaggtggaggaggctgagaatgaaggtgaggaagctaagactgagggtctgatgaaagatgacagagctgaatcgcaggctagtagcttgggccaaaaagtgggtgagtctagtgagcaggtcagtgaggagaaaaccaatgaggcctag

SEQ ID NO: 27125 - DNA, 3360 bp, Artificial Sequence
  Description of Artificial Sequence: Synthetic coding sequence
atggccgacggcccccggtgcaagcggcggaagcaggccaacccccgacgcaacaatgtcacaaactacaatactgttgtggaaactaatagcgattcagacgacgaagacaaactgcatatcgttgaggaggagtctgtgacagatgctgcagactgtgagggggtccccgaagacgacttaccaaccgaccagacagtcctgcctggaaggagctccgagagggaaggtaacgcaaaaaactgctgggaagacgatagaaaagagggccaagaaatactggggcccgaagcccaggctgatgaagccgggtgtactgttaaagacgacgagtgtgagtccgacgctgagaacgagcagaatcacgatcctaatgtggaagagttcttgcagcagcaggacactgcagtgatctttccggaagccccagaggaggatcagcggcaggggacccccgaggctagcggtcacgacgagaatgggacccccgacgccttttcccagctcttaacctgcccatactgtgaccgagggtacaagcggtttactagcctcaaggaacacatcaagtataggcacgagaagaacgaggataatttttcctgctcattatgctcttacacctttgcatataggacccagcttgagaggcatatgactagccataaaagtgggcgggaccagaggcatgtgacacaatcaggatgcaatcgcaaattcaaatgtaccgaatgcgggaaggcctttaagtacaagcaccacctgaaggagcacctgagaatccacagcggcgaaaagccatacgagtgcccgaactgcaaaaagcggttttctcattctggctcctactcctctcatatatcatccaagaagtgtatcagtctcatacccgtgaatgggagaccgcggacaggcttaaagacaagccaatgcagctctccctctctgagcgcatcacccggaagcccgaccagacctcagattagacagaaaatagaaaataagcctttacaagaacagctgagtgtgaatcagattaagaccgaaccagtggactacgagttcaaaccgatcgtcgtggccagcgggataaactgctcgactccactgcaaaacggagtgtttacaggcggtggcccgctgcaagctacgtcctctccccaggggatggtgcaagccgtcgtcctccctactgtggggctcgttagcccgatatccattaacctgagcgacattcagaatgtgctgaaggtggctgtggacggcaacgtaatcagacaagtactggagaacaatcaggccaacctggccagtaaggaacaggaaactattaacgcatccccgatacagcagggagggcacagcgtcataagtgcaatctccttaccccttgtcgatcaggatggaacgaccaagatcattataaactatagcctggagcagccttcacagcttcaggttgtaccccaaaatctcaaaaaagaaaacccggtggctaccaacagttgtaaaagcgaaaagcttccagaggacctgacagttaaaagcgaaaaggataagtccttcgagggcggagtcaatgacagcacatgtctcctgtgtgacgattgtcctggagacatcaatgccctacctgaactgaaacactatgacttaaaacagccaacccagcctccacccttaccggcggcggaggccgagaaacccgaaagcagtgtgagtagtgccacgggcgacggcaatttgagcccctcccagcctccattgaagaatctgctgagccttctgaaagcatattatgctttgaatgctcagccgagtgctgaggagctgtcaaagatcgccgacagcgttaatctgccattagacgtcgtaaagaagtggtttgaaaagatgcaggccggacaaatcagcgtgcagtcatcggagccgtcatcaccggagcccggtaaggtgaatataccggccaagaacaacgaccagccccagtctgcaaacgcaaatgagccgcaggacagcacggtcaatctgcagtcgccgctgaaaatgaccaatagcccagttctgccggtggggtcaacaacgaatggcagccggtcctctactcccagcccatcccccctgaatctcagttcttctcggaacacacaaggttatctctacacagccgaaggtgcccaggaggaaccgcaggtcgagccgctggatctctcactacctaaacaacagggggagctgctggaaagatcctcgctcccggagcagtgtctcttctgcccagggcggaccctcgagttagtgctcaagaaagagcctcagaaggatagttgcgtcacagactcagagccagtggtgaacgtgataccacctagtgcgaatcccatcaacattgccataccgacagtgacagctcagctccctacgattgtagcgattgccgaccagaattctgtgccgtgcttgagggctttagctgcgaacaaacagacaatcctcattcctcaagtggcgtacacatacagcactactgtgagccctgctgtgcaagagccccccctcaaagtgatccagcccaacggaaaccaagacgagcgccaagataccagctctgagggcgtaagtaatgtagaagatcagaatgattcagactccacccctcctaaaaaaaagatgcgcaaaaccgaaaacggaatgtatgcctgcgacctttgcgataaaatcttccagaaatcatctagcctgctgagacacaagtatgagcacaccggaaaacgtcctcatgagtgcggaatatgcaagaaagcttttaaacacaaacatcacctaattgagcatatgcgtctgcattccggtgaaaagccatatcagtgtgataaatgtgggaagcggttcagccattccggctcgtattcacagcacatgaaccaccgctattcctattgtaagcgcgaggcagaggagcgggatagtacagaacaggaagaggccggcccagagatcctcagtaacgaacacgttggcgctcgcgcgagcccttctcaaggtgatagcgatgagcgcgagtcattaaccagggaggaggatgaggattccgagaaggaagaagaagaagaagataaggaaatggaggaactccaggaggagaaggaatgtgagaaacctcaaggcgatgaggaggaagaagaagaggaggaagaggtagaggaggaagaagtagaggaggcagagaacgaaggcgaggaggctaagactgagggactgatgaaggatgatcgggcagaatctcaggccagttctctgggtcagaaggtgggggaaagttcagagcaggtctccgaggagaaaactaatgaagcatag

SEQ ID NO: 27126 - DNA, 834 bp, Artificial Sequence
  Description of Artificial Sequence: Synthetic coding sequence
atgaaggtgaccaactacaacaccgtggtggagaccaacagcgacagtgatgatgaagacaaacttcacattgtggaagaggaatctgttacagacgcggccgattgtgagggtgtccctgaggatgacctgcctaccgaccagacagtccttcctgggcgatcttccgagagagaggggaatgctaaaaactgctgggaggatgacaccgggaaagaaggccaggagattttgggccccgaagcccaggccgacgaagcgggatgcacagttaaggacgatgagtgtgagtctgacgctgaaaacgaacaaaatcatgaccctaacgtggaagaattcctgcagcagcaggacacagctgttatttttcccgaggccccagaagaggaccagaggcagggcacacccgaagcttctgggcacgatgagaatgggacgcctgatgccttttcgcagctcctcacatgcccatactgtgatagggggtataaacgattcacctcacttaaggaacacatcaaatatcggcacgagaagaatgaagataacttttcatgctctctctgttcctataccttcgcctaccgcacacagctagaaaggcatatgacgtctcacaaatcagggcgcgaccaacgccatgtgacacaatctggttgtaaccgcaaatttaagtgcaccgaatgcgggaaagcgttcaagtataaacaccacctgaaggagcatttaagaatccactcgggtgagaaaccttatgagtgccctaactgtaaaaagagattctcgcattctggcagttactcctcccacatcagttctaagaagtgtatctag

SEQ ID NO: 27127 - DNA, 3315 bp, Artificial Sequence
  Description of Artificial Sequence: Synthetic coding sequence
atggccgacggcccccggtgcaagcggcggaagcaggccaacccccgccgaaacaacgttaccaactataacactgtggttgagactaattccgactcagacgatgaggacaagttacatatcgtggaggaagagtcagtgaccgatgccgctgactgcgagggtgtccccgaagatgacctgcctacggaccagaccgtgctgcctgggcggagttccgagcgtgaaggcaatgctaaaaattgctgggaggacgacattaaggacgacgagtgtgaaagcgatgctgagaacgagcagaaccatgaccccaacgttgaggaatttctgcaacagcaagataccgccgtgatctttcctgaagctccagaagaggatcaaaggcagggcacacccgaggcgtccggacacgacgagaacggtacgcccgacgccttctcccagttgcttacctgtccgtactgcgatagaggatacaaacgatttacttcactgaaagaacatattaagtaccgccacgagaagaacgaggacaactttagctgtagtctttgcagttacacttttgcgtacaggactcagctggagaggcacatgacgagccataagtcagggcgggatcagcggcacgtgacccaaagcggctgtaatcggaagttcaagtgcactgagtgcggcaaggcattcaaatacaagcatcacctgaaagaacacctgcggatccattccggagaaaaaccctacgaatgtccaaactgtaagaaaaggttttcacacagcggttcctactcctctcacatctcatccaagaaatgtatatcattgatacctgtaaacggccggccgaggactggcctcaaaactagccagtgctcgtcaccatccctgtccgcatctcccggcagccccacgcggccacagatcagacagaaaattgagaacaagcctctgcaggagcagctctcagtcaaccagattaaaacagagccagtggactacgagttcaaaccaatcgtggtagcatctggcatcaactgctctacaccactccagaacggggtgtttactggagggggacctctgcaggcaacttcctctcctcagggaatggtacaggccgttgtactgcctacggtgggcctggtctctcccatttccataaatctctctgacatacaaaatgtgttaaaggtggcagtggatggaaatgtgattcgccaggtgctggaaaataatcaagccaatctggccagtaaggagcaggagacaatcaatgcctcccctatacagcaagggggtcatagcgtgatatccgccatcagcctccccctcgtggatcaggatggaactactaaaatcataatcaactacagcctcgagcagccctcccagctgcaagtcgtccctcagaacctgaaaaaagagaacccagtcgctaccaactcatgcaaatcagaaaaattgcctgaggacctgaccgtaaaaagtgaaaaagacaagtccttcgagggcggcgtgaacgattcgacatgccttctttgcgatgactgtccaggcgatatcaacgctctgcccgagctgaagcattatgatttgaagcaaccaacgcagcccccacctctcccagctgctgaagctgaaaaacccgagtcgagtgtgtcctccgccaccggcgacggaaacttaagcccttcccaaccccccctcaagaatcttttgagcctcttgaaggcatattatgcccttaatgcccagccgtccgctgaggaattatccaaaattgctgatagtgtgaatctacccctagacgttgtgaagaaatggtttgaaaagatgcaggcagggcaaatctcggtccagtctagtgaaccctcaagtccggagcctggcaaggtgaacatacccgcgaaaaacaacgaccagccacagtccgccaatgcaaatgaaccccaggatagtacagtgaatctgcaatctccattgaagatgactaacagtccagtgctgcctgtcggatccactaccaacggatcacgatccagcacaccatctcctagccccctgaaccttagtagctcccggaatactcagggctacctttacactgcggagggcgcacaggaggagccacaagtcgagcctctggatttgtccttgcccaagcaacaaggcgagctactggagcggagcacaattaccagtgtgtaccagaacagcgtttacagtgtgcaggaggaaccattaaacctgagctgcgccaagaaagagccacagaaggattcctgcgtgaccgatagtgaacctgtggtgaacgtgattccgccaagcgcgaatccaatcaacatcgctattcccacagtcactgcccagctccccactatcgtcgccatagctgatcagaactccgtgccctgcctacgtgcgctggcagcaaacaaacaaactattctgattccccaggtagcctacacttactctacgactgtgtccccagcagtgcaagaacctcctcttaaagtgatacaacccaatggaaaccaggacgagcgccaggacacctcttccgagggcgtgtctaacgtcgaggatcagaatgatagcgatagcacacctcctaagaaaaagatgaggaagactgagaatggaatgtatgcctgcgatttgtgtgataaaattttccaaaagtcttcttcacttttacgccacaagtacgaacataccgggaagcgaccacatgaatgcggtatttgcaagaaggcgttcaaacataaacaccaccttattgaacacatgagactgcattccggagagaagccttaccagtgcgacaaatgtggtaaaaggtttagccatagtggaagctacagccagcacatgaatcacaggtattcatactgtaaacgtgaagcggaagaacgagacagtacagagcaagaggaagcaggcccagaaattctgtccaacgagcatgtgggtgcgagggcatcaccatctcagggagactctgatgagagagaaagcttaactagagaggaggacgaagattccgaaaaggaagaggaggaagaggacaaggaaatggaggaacttcaggaggaaaaagagtgtgagaagccacaaggcgacgaggaggaggaagaagaagaggaagaggtagaagaagaggaggtcgaagaagcagagaacgaaggcgaggaagccaaaacggagggtcttatgaaggatgatcgggcggagtcgcaagccagttcactgggccagaaggtgggggaaagtagtgaacaggtgtccgaggaaaaaaccaatgaagcctag

SEQ ID NO: 27128 - DNA, 3645 bp, Artificial Sequence
  Description of Artificial Sequence: Synthetic coding sequence
atgaagcagcccatcatggccgacggcccccggtgcaagcggcggaaacaggcgaacccaaggcgtaaaaacgtcgttaattacgacaatgtagtggacaccggatctgaaacagacgaagaagacaaattgcatatcgccgaagatgacggcatcgccaatccactcgatcaggagacgtctcctgctagcgtgcctaatcacgagtcatccccacacgtgtcacaggctctgctgccacgagaagaagaagaggacgagattagagaaggcggagtggagcacccttggcacaataacgagatcctacaggcttctgtcgacgggcctgaagagatgaaagaggactatgacaccatgggtcccgaggccaccattcagaccgcaattaataatggaacagtcaagaatgccaactgtacaagcgatttcgaggagtactttgccaagcgcaagctcgaggaacgagatggacatgctgtcagtatagaagagtatttgcaaaggtctgataccgctatcatctacccagaagcacctgaagagcttagcaggcttgggacccctgaagcaaacggccaagaagagaatgaccttccgcctggcaccccggatgcgtttgcacagctgctcacctgtccctactgcgatcggggttataaaagactaacctccctgaaggagcacatcaagtacagacatgagaagaatgaggagaatttctcgtgccccctctgtagctacacttttgcctaccgcacccagttagagagacatatggtgactcacaaaccaggtaccgaccaacaccaaatgctcacgcagggcgcagggaaccggaagttcaaatgcacagaatgcggaaaggcctttaagtataaacatcaccttaaggagcacttgcgcatacacagcggagagaaaccctacgaatgtcccaactgtaaaaagagattctcccatagcggctcgtacagttctcatatcagtagcaaaaaatgcattggtctcatttctgtgaacgggcgaatgcgcaataatatcaaaacggggtcctctccgaactcagtctcctcgagtccaaccaactccgccattacccagctgcgcaataagctggaaaacgggaaaccactctctatgtctgagcagacaggactccttaagatcaaaaccgagcctctagactttaacgattataaggtgctgatggccacacacggattttcaggaacctctccttttatgaatggcggcttgggagccacatctcccctaggggtccatccgagcgcccagtcccccatgcagcacttgggcgtcggcatggaggcacccctgttgggattccctacaatgaattctaatctgtctgaagtgcagaaagtgcttcagatcgtggacaacaccgtgtcccgccagaaaatggactgcaaagccgaggagatttccaaattgaagggttaccacatgaaggatccgtgctcccagcccgaggagcagggtgtgacatctcccaatattcctccagtaggccttcccgttgttagtcacaacggtgcaacaaagagcataatcgattatactcttgaaaaggtgaacgaggcaaaggcctgtttgcagagcctgacaaccgatagcagaaggcagatcagcaacatcaaaaaagagaagctaaggactttgatagatttagtgacagatgacaagatgatcgaaaaccataatatatccacccccttctcgtgtcagttttgtaaagaatctttccccgggccaatacctctgcatcagcacgagaggtacctgtgtaagatgaacgaagaaataaaagcagttctccagccacacgagaatatcgtgcctaataaggccggggtctttgtggataataaggcccttctgctctccagtgtgttaagtgagaagggaatgaccagcccaattaacccctataaggaccacatgtccgtgctcaaggcgtactacgctatgaatatggagccaaatagtgatgaattgctcaagatttctatcgctgtcgggttgccccaggaattcgtgaaggagtggttcgagcagcgaaaagtctaccaatactctaattctcgaagtccatcactggaacgaagttccaagcctttggctccaaattctaatccccccactaaggatagcctgctcccaaggtccccagtcaaaccgatggatagcattactagcccctccatcgccgaacttcacaattctgtgaccaattgcgacccaccacttcgcttaaccaagcctagtcattttacaaacattaaaccagtggaaaaattggatcattcccgatccaataccccctcacctttgaacttgtcatccacatcctctaaaaatagccattcgagctcttatacccctaactctttcagctcggaagaactccaggccgagcccttagacctctccttgcccaaacagatgaaggaacctaaatccataatcgcaacgaagaataagactaaggctagtagcattagtctggatcataacagcgtctcaagctcgagcgaaaattcagatgaaccccttaacctcaccttcatcaagaaagaattttcaaattccaacaatttagataacaagtcaacaaacccagtttttagcatgaatccttttagcgctaagccactctacacagctttgcctccacagtccgcatttccacctgccacattcatgccacccgtgcagacatcaattccaggactgcgcccgtatccgggcttggaccagatgagcttcctgccccacatggcatacacttaccccaccggcgctgctacttttgccgatatgcagcagcggcggaagtaccagcgcaaacaagggttccagggagagttgctggatggcgcccaggattatatgagcgggctggatgatatgactgactctgactcctgcctaagtagaaagaaaattaagaagactgaaagcggtatgtacgcctgcgacctctgcgacaaaacattccagaaatcgtcttccctcctacgtcataagtacgagcatacaggcaaacgccctcatcagtgccagatctgtaagaaagcgttcaaacataaacatcacttaatagagcatagccgcttgcatagcggagagaaaccctaccagtgtgacaagtgcggcaaacggttttcccacagtggctcatacagccaacatatgaatcaccgctactcctattgtaaacgcgaggctgaagaaagggaagccgccgagagggaagccagggaaaaaggtcacttagagcccactgaactcctcatgaaccgcgcttacctgcaatccatcacccctcagggatactcagactctgaggagagagaatccatgccacgcgacggagaaagtgagaaggagcacgagaaggaaggtgaagacggctacgggaagctcgggagacaagatggggatgaagaatttgaggaagaggaagaggagagcgaaaataaatctatggacaccgacccggagacaattcgtgacgaagaggagacgggggaccattcaatggatgatagctctgaggatggtaaaatggagacgaaaagcgaccacgaggaggataacatggaagacgggatgtag

SEQ ID NO: 27129 - DNA, 1275 bp, Artificial Sequence
  Description of Artificial Sequence: Synthetic coding sequence
atggccgacggcccccggtgcaagcggcggaagcaggccaacccccggcggaaaaatgtggttaattacgataatgtcgtggatacgggatcagaaaccgacgaggaggataaactccacattgcagaagacgatggcatcgcaaacccgctggatcaagagacctcccccgctagtgttccaaaccatgagagctccccccatgtctctcaggcacttttgccgagagaggaagaggaagatgagattagagagggcggggtggaacacccatggcataacaacgagatcttgcaggcttctgttgacgggcctgaggaaatgaaagaggattacgacacgatgggccccgaggcaactattcagactgccatcaacaacggaacagttaagaatgcgaactgcacaagcgacttcgaagagtactttgccaagcggaaactagaggaacgagacgggcatgcggtgtctatcgaagagtacctgcagcggagtgataccgcgatcatataccctgaggcccccgaagagctgtcaaggctagggacccctgaggcaaacggtcaggaggaaaacgacttgccccccggaacacctgacgcgttcgctcagctactcacgtgtccctactgtgatagaggctacaagagattaaccagcctcaaggagcacatcaaataccgccatgagaagaacgaagaaaacttcagttgccctctgtgttcgtacacctttgcataccggacccaactcgaaaggcacatggtgacacataagccgggtaccgaccagcaccagatgctgactcagggggccgggaatcgtaaattcaagtgcaccgagtgcggaaaggcattcaagtataaacaccacctgaaggaacacctgcggatacatagcggtgagaagccctatgagtgtcccaattgtaaaaaacggttcagccattcaggcagttactcatcccacatctcatctaagaagtgcataggactcatcagcgtcaatggccgaatgcggaacaatatcaagacagggtccagtccaaacagcgtttcctccagtcctactaactcagccatcacacagctgcggaacaaattggagaacggaaaaccgctgtctatgtctgagcagacagggctgctgaagtcgggtagagcccagtggcttaccccactcattccagctttactggaggctgaggtcgggcggagtcggggacagaagatcgagacgctcctggctaacatggttgaacctagactttattag

SEQ ID NO: 27130 - DNA, 1320 bp, Artificial Sequence
  Description of Artificial Sequence: Synthetic coding sequence
atgaagcagcccatcatggccgacggcccccggtgcaagcggcggaagcaggcaaatccacgacgcaagaatgtagtgaactacgacaatgttgtggacacaggaagcgaaacagatgaggaagataagctgcacattgccgaggacgatggaattgctaaccccctcgaccaggagacatctcctgcttccgtgccgaaccatgagtcctccccgcacgtgagccaggctcttttgccccgtgaagaagaggaagatgaaatacgagaaggaggagtggagcacccctggcataacaatgagattctgcaggcttccgtggatggacccgaggagatgaaagaagattacgacacgatgggacccgaagcgacaattcaaacagcgataaacaatgggaccgttaaaaatgctaattgcacgtcggactttgaggaatattttgcaaagaggaagctggaggaaagggacggtcacgcagttagcattgaggagtacctgcagaggagcgacaccgctatcatttaccctgaggccccagaggagctcagtcgtctaggcacccccgaggcaaatggtcaggaagagaatgaccttccacctgggaccccagacgcttttgcccaattactgacttgtccttactgtgacaggggttacaaacgtctgacttcccttaaggaacacatcaagtatcgccatgagaagaacgaggaaaattttagttgtcctctctgtagttatacttttgcttatcggactcagctggaaaggcatatggttactcataagccaggcaccgatcagcatcagatgctcacacaaggagccggaaaccggaaatttaagtgtaccgaatgcggcaaagcttttaagtataaacaccacctgaaggagcacctgcggatacactccggtgagaaaccatatgaatgtccaaactgtaagaaacgtttcagtcactctggtagctacagctcccatatctccagcaaaaagtgcatcggcttaatttcagtgaatggccgaatgaggaacaacataaagactggctcgtccccaaatagcgtctccagttctcctactaactctgccattacccagctacggaacaaactggagaatggaaaacctctctccatgtccgaacagacaggcctcttaaagatcaagacggagcctttggattttaatgactacaaagtcctgatggcaactcacggcttttctggcacgtctcccttcatgaacggaggcctcggggctacatcgcccctgggtgtgcacccatccgctcagagtccgatgcagcatctttag

SEQ ID NO: 27131 - DNA, 408 bp, Artificial Sequence
  Description of Artificial Sequence: Synthetic coding sequence
atgaagcagcccatcatggccgacggcccccggtgcaagcggcggaaacaggccaatccacggaggaagaacgtcgttaactacgataacgtggtggacaccgggtctgaaacagatgaagaagataagctacatattgcagaggacgatggcatcgctaacccactggatcaagagacgagccccgccagcgttccgaatcacgagtcatcccctcacgtatcacaggctctgcttcctagagaagaggaggaagatgaaattagagaaggcggagttgaacatccatggcacaacaacgaaattctgcaagctagtgtggacggacccgaggagatgaaagaggattatgataccatgggaccagaggctaccatccaaaccgcaattaataacggaaccgggtag

SEQ ID NO: 27132 - DNA, 3645 bp, Artificial Sequence
  Description of Artificial Sequence: Synthetic coding sequence
atgaagcagcccatcatggccgacggcccccggtgcaagcggcggaagcaggcaaatccaaggaggaaaaatgtcgtgaattatgataacgtcgtggacaccggttccgagaccgacgaggaggacaaattgcacattgcagaagacgatggaattgctaaccccctcgaccaagagacctccccggcaagcgttcctaaccacgagagttcaccccacgttagccaggcactcttgcctagggaagaagaggaggatgagatcagggagggcggcgtcgagcacccatggcataacaacgagattttacaagcctccgtcgacggcccagaggagatgaaggaagactacgacacaatgggccccgaagccactatccagacggccatcaataatggcactgtcaagaacgccaactgtacatctgactttgaagagtattttgccaaacgcaagctcgaggaaagagacggacacgctgtgtccatcgaggagtatctgcagcgcagcgatactgctatcatataccccgaagcacccgaggagttgtctaggttggggacccctgaggccaacggtcaagaagaaaacgatttgccacccggaacgcccgatgcctttgcccagttgctcacctgtccatattgcgatagagggtataaacgtctgacgagcctcaaggagcacatcaaataccggcacgagaagaatgaagagaacttctcttgtcctctgtgctcgtatacgttcgcctatcgtacccaactggaacgtcacatggtgacccacaaacctggtacggaccagcaccagatgctgacacagggagccggaaataggaaatttaaatgcaccgaatgtggcaaggccttcaagtataagcatcacctcaaggagcatctgcgcatccattcaggagaaaaaccttatgagtgtccaaactgcaaaaagcgattctcacattcgggatcctacagcagccatatctcgagtaagaaatgcataggccttattagtgtgaatgggaggatgaggaacaacataaaaaccggaagctcccctaactcggtgtcctcttctcctaccaactctgccattacacaattacgtaataagctcgagaatggcaagcctttgtctatgtcagaacagactgggctcctgaaaatcaagactgagcctctggatttcaacgattataaggtgctcatggccacgcatggatttagcgggacctctccgtttatgaatggcggattaggtgcaacgtctccattaggggtacatcccagtgcacagagcccgatgcaacatttgggagtcgggatggaagcgccgctcctgggctttccaacaatgaatagtaatttaagcgaagtgcagaaagtcctgcagatcgttgataacaccgtcagtcgacagaaaatggattgtaaagcagaggaaatctctaaactgaaaggctatcacatgaaagatccttgctcccaacccgaggagcagggagtcacctctcctaacatccctccagttggcctgcctgtcgtcagccataacggggcaaccaaatccatcattgactacaccttggagaaggttaacgaggcaaaggcctgcctgcaaagtttgacaaccgatagccgcaggcaaatatccaacatcaaaaaggaaaagctgaggacgctgattgatttggtgaccgatgataaaatgattgagaaccataatatcagcacccctttctcttgccaattctgcaaggagtcctttcccggcccaatccctttgcaccagcatgagcgatacctctgcaagatgaatgaggagatcaaggcggtgctccagccacatgagaatattgttcccaataaagccggggtcttcgttgataataaagccctactcctgtcctctgtccttagcgagaaaggaatgacaagtcccattaatccatacaaagaccatatgagtgtgctgaaagcctactacgctatgaacatggagcctaatagcgatgagctgctaaagatcagcatagccgtgggactacctcaggagttcgtaaaggagtggtttgaacagagaaaggtttaccagtatagtaatagccggtctccttctctcgaaagatccagcaaaccactcgctcccaactctaatccccctacaaaggatagcttacttcctagatccccagtgaaacctatggactccatcacctctccatccatagcggagctgcacaactcagtgaccaattgcgacccacccctcaggctcacaaagccgtctcatttcactaacataaagccggtagagaagcttgatcattcccgctcaaatacgccctcccccctgaatctgtcatcaacgtcaagtaagaatagccattcctcctcttacacacctaactccttttccagcgaggaactccaagccgagcctttagaccttagccttcccaagcagatgaaggagcctaaatcaatcatagcgactaagaataagaccaaggcctcttcaatcagccttgaccataacagcgtgtcctcttcaagcgagaacagcgatgaaccgctgaatttgacattcattaaaaaagaattttcaaattcaaacaatctggataataaatcgaccaatcctgtgttctccatgaaccccttctccgccaaacctttgtataccgccctccctcctcaatctgcatttccacccgctacttttatgcctcctgtccaaacatctatccctgggcttagaccataccccggcctggaccagatgtctttcttaccccatatggcctatacttacccgactggcgccgccacatttgctgacatgcaacagagaagaaaataccagcgaaagcagggttttcagggagaactgctggacggcgcgcaagactacatgtctggattggatgatatgaccgactccgacagctgtctcagccggaagaaaatcaaaaagaccgaaagtggaatgtacgcctgcgatctgtgtgacaagactttccagaagtcgtctagcctgttgcggcacaaatacgagcacacgggaaagcgacctcatcagtgccaaatctgtaagaaagcttttaagcacaagcaccacttaattgagcactccagactacacagcggagaaaaaccataccagtgcgacaaatgcggcaaaagattcagccattcggggtcctattcccaacacatgaaccatcggtatagctactgtaagcgcgaggccgaagagcgtgaagccgctgaaagagaagccagagaaaagggccacctggagcctaccgaactacttatgaatcgagcttacctgcagtctattacacctcagggctattcagacagtgaggagagagagtccatgccacgcgacggcgagtcagagaaagagcatgaaaaagagggagaggatggttacggtaaattgggcaggcaggatggcgatgaagaattcgaggaggaagaagaggagtccgaaaacaagtctatggatacagaccctgagaccatccgggacgaggaagaaaccggcgaccactccatggacgacagtagtgaagatggaaaaatggaaaccaaaagtgatcacgaagaagataacatggaggacggtatgtag

SEQ ID NO: 27133 - DNA, 2109 bp, Artificial Sequence
  Description of Artificial Sequence: Synthetic coding sequence
atgaagcagcccatcatggccgacggcccccggtgcaagcggcggaagcaggctaatcctaggaggaagaacgtggtcaattatgataatgtagtggacaccggatcagaaacagacgaggaagacaagctgcatatcgctgaagatgacgggatcgctaatccattggaccaggagactagccctgcctcagttccgaaccatgaatccagtccacacgtctcacaagccttgctacccagggaagaagaggaggacgagattcgagaggggggcgtagagcacccctggcataataacgagatactgcaggctagcgttgatggacccgaagaaatgaaggaagattacgacaccatgggtcctgaggccaccattcagacagcaattaataatggcactgtaaaaaatgccaattgtacgagcgatttcgaggaatatttcgccaagaggaaactggaagagcgcgacgggcatgccgtgtctatagaagaatatctgcagagaagcgatacagcaattatataccccgaggcccccgaggagctatctcgactggggacccccgaagcgaatggtcaggaagaaaacgacttgccaccaggaacgcctgatgctttcgctcagcttctcacctgcccttactgcgatagaggctataagagactgacatcgctaaaggaacacataaagtatcgacacgagaagaacgaggagaacttcagttgtcccttgtgctcatacacgtttgcctatcggacgcaattggaacgtcacatggtgacccacaagccaggaacggatcagcatcaaatgctgacccagggggcagggaataggaaattcaaatgtacagaatgcggtaaggcatttaagtacaagcaccacctcaaggaacacttaaggattcattcaggggaaaagccctatgagtgcccaaactgcaagaagcgcttctcacacagtgggtcatatagcagtcatatctccagcaagaaatgcatcggcctcattagcgtgaacggacgaatgcgaaataatattaaaaccggcagcagtcccaactcggtgtcatcctccccaaccaactccgccattacacagctaagaaataaattagagaatggaaagccgttgagtatgtcagaacagactgggctgctgaagataaaaactgagccactggacttcaatgattacaaggtgttaatggctacgcacggttttagcggcacctcaccttttatgaacgggggattgggagcaacctctccgttaggtgttcatcccagcgcccagtctccaatgcaacatctgggcgtggggatggaggctccccttctgggctttccaacgatgaattcaaacttatccgaagtccagaaggtgttacagatcgtggataacaccgtgtcccggcagaagatggattgtaaggcagaagagatatccaagctcaaaggttaccatatgaaagatccgtgttctcagccagaagagcagggcgtgacttcccccaacatcccccccgttggcctccctgtggtctctcacaatggagccaccaaaagtatcatcgactacacgcttgaaaaggtgaacgaagctaaggcttgcctccagtctctaacaactgatagccggagacagatctcgaacatcaagaaggagaagttaaggactttaattgatctcgtcaccgacgacaaaatgatcgagaatcacaatataagcactcctttctcctgtcagttctgtaaagagagctttcccggtccgatcccgctacatcaacatgaaagatacctgtgcaagatgaacgaagagatcaaagccgtattgcagccgcatgaaaacatagtccctaataaagctggcgtattcgtcgacaacaaggcactgctgctatcttctgtgttaagtgagaagggaatgacctctcctataaacccctacaaggaccatatgtctgtcctgaaagcctattacgccatgaatatggagccaaattccgacgaattgttgaaaatttcaatcgcggtgggcctaccccaagaattcgtaaaggagtggttcgagcagaggaaagtttaccagtactccaactag

SEQ ID NO: 27134 - DNA, 276 bp, Artificial Sequence
  Description of Artificial Sequence: Synthetic coding sequence
atgaagcagcccatcatggccgacggcccccggtgcaagcggcggaaacaggccaatccacgtaggaagaacgtggtgaattacgataatgttgtggataccggaagcgaaaccgatgaagaggacaagctacatattgccgaggatgacggcatcgctaatccactggatcaagaaacaagcccagcatcagtgcccaaccacgagagcagcccacacgtcagccaggccctcctcccccgggaggaagaagaggacgagataagggaggggtag

SEQ ID NO: 27135 - DNA, 192 bp, Artificial Sequence
  Description of Artificial Sequence: Synthetic coding sequence
atgaagcagcccatcatggccgacggcccccggtgcaagcggcggaaacaggctaaccccagacgaaagaacgttgtgaattatgacaacgtcgtcgacaccggatctgaaaccgacgaggaagacaagctacacatagccgaagacgacggcatcgcgaatccccttgatcaggaaaccagcccagcttag

SEQ ID NO: 27136 - DNA, 3573 bp, Artificial Sequence
  Description of Artificial Sequence: Synthetic coding sequence
atgaagcagcccatcatggccgacggcccccggtgcaagcggcggaaacaggcgaatcctcgacggaagaacgtagtcaattacgacaatgtggttgataccggttccgaaacagatgaggaggacaaactacacatcgccgaggacgacggaatcgctaatcctcttgatcaggaaaccagtcctgctagcgtcccaaaccatgaatcctctccacatgtttcgcaggccttgctgccccgagaggaggaggaggacgagatcagggaggggggagtagagcacccatggcacaataatgagatcctccaagcttccgtggatggccctgtgaagaacgccaactgtaccagcgattttgaagagtattttgccaaacggaagttggaggaaagggatggccacgccgtctcaattgaggagtatctgcagcgctctgacacagcgatcatatacccagaggcaccggaagaactctcacgtctcggcactcccgaggcaaacggccaagaggagaatgacctgcctcctgggacaccagatgcattcgctcaactccttacatgtccatattgcgaccgcggctataagcgcttgacttcgttgaaagaacatattaaatatagacatgagaagaacgaggaaaacttttcctgcccactttgctcttatactttcgcatatcgaacccagctggagcgccacatggtcacccataagccagggacagatcagcaccaaatgctgacacaaggagcgggaaaccgaaagttcaagtgtacggaatgcggtaaggcctttaaatacaagcatcatttaaaggaacacctgcgaatacattcaggagagaaaccttatgaatgcccgaactgtaagaagcgatttagtcacagcgggtcttattcaagccacatatccagcaaaaaatgtataggactgatctccgtgaacggcagaatgcggaataatatcaaaaccggctcatccccaaactccgtgagttcctcaccaaccaattcagcaataacacagttgagaaataaactggagaatggtaagccactgtctatgagcgagcaaaccggcctgcttaaaattaaaacagagcctctcgactttaatgattataaagtgcttatggctacacatggatttagcggaacaagcccctttatgaatggaggactcggggcaacctctcctctgggtgtacacccctctgcgcagtctccaatgcagcatctgggggtcggaatggaggcgcccctgctcggctttcctaccatgaatagcaatctctctgaggtacagaaagtgcttcagatcgtcgacaataccgtctctcggcagaaaatggactgcaaggctgaagagatctccaagctgaaggggtaccacatgaaagacccttgctctcagcctgaggagcagggagtgacctcccccaatatcccacccgtagggcttcccgtcgtgtcccataacggagccaccaagagcattattgactataccctggagaaagttaatgaggccaaagcctgcctgcaatcactcactactgacagtaggcgtcaaatttcaaatatcaagaaggaaaagctgcggacccttattgacctggtaacagatgataagatgattgagaaccataacattagcacgcccttttcttgccagttctgcaaggagtcctttcccggtcctatccctctgcaccagcacgagaggtacttatgtaagatgaatgaagagattaaggccgtcctgcaacctcatgaaaacatagtacccaataaagcgggcgtgttcgtggataacaaggcactgttactttctagtgtcctgagcgaaaaaggaatgactagtcctatcaacccatataaagatcatatgagcgtcctgaaagcctactacgcaatgaatatggagccaaatagcgacgagctgttaaaaatatccatcgcggtcggcctgccccaagagttcgtaaaagagtggtttgaacagcgtaaagtgtatcagtactccaattcaagatcaccttccttggagaggtcctcaaaaccactagcccctaacagcaatcccccgacaaaggattccctgctgccacgcagtccagttaaaccaatggattctatcacgagtccctcaattgccgaattgcacaactcagtgactaactgtgatccccctctgcgcctcactaagccgagtcatttcactaatatcaagccggtggaaaagctggatcacagcagaagtaacacgccatcaccactgaacctgagctctacatcgagtaaaaatagccacagcagttcatacaccccaaattccttcagtagcgaggaactccaagctgaacctttagatttgtctttgcccaagcagatgaaggagcccaaatcaataatcgcgactaagaataagacaaaggcctcctccatatctttagatcacaattctgtctctagtagcagcgaaaactccgacgaaccactcaacctgacctttatcaaaaaagaattctcaaactcaaataacctggataacaagagcaccaacccagtattctcaatgaatcctttctctgcgaagccactctataccgctctgcctccccagtctgccttcccgcccgccactttcatgcctcccgtgcagacaagtatcccaggcctgcggccatacccaggcttggaccagatgagttttctgccacatatggcatacacctacccaacaggggccgctacatttgctgatatgcagcagagaagaaaataccagagaaaacagggcttccaaggggagctgttggacggcgcccaggactacatgagcggcctggatgacatgaccgattctgacagctgtcttagcagaaaaaaaataaagaaaacagagagcggcatgtatgcctgcgacctgtgcgacaaaactttccagaaatcatctagcttgcttcggcataaatacgagcacacaggtaaacggccacaccagtgccagatctgtaaaaaagcctttaaacacaaacaccacctgatcgagcattcccgactgcattctggcgaaaaaccgtaccagtgtgataagtgtgggaaaaggttcagtcacagcggctcttactcacagcatatgaaccacagatactcttactgtaagagggaggctgaggagcgcgaagccgctgaacgggaggcccgcgagaagggccacctggaacccaccgaattgctcatgaaccgggcttatttacaaagcatcacaccccagggctactccgactctgaggaacgcgagagcatgccacgcgacggggagagcgagaaggaacatgaaaaggagggggaggacggatacggcaagttgggaaggcaggatggcgacgaggagttcgaagaagaggaggaagagtcagagaacaaaagtatggataccgatcctgaaaccataagggatgaagaggagacaggcgaccattctatggatgatagtagcgaggatggcaagatggagactaagagcgaccatgaagaggacaatatggaagacggtatgtag

SEQ ID NO: 27137 - DNA, 3645 bp, Artificial Sequence
  Description of Artificial Sequence: Synthetic coding sequence
atgaagcagcccatcatggccgacggcccccggtgcaagcggcggaaacaagccaatcctagacggaagaatgtagtgaattatgacaatgtggtcgatacaggttccgaaacagatgaggaagacaagttacatatagcagaagacgatggcattgccaacccccttgatcaggagacaagtccagctagtgtgcccaatcatgagtcaagcccgcatgtgtctcaggccctgctgcctcgggaggaggaagaggacgaaatacgggagggtggcgtggagcacccgtggcacaacaacgaaatcttgcaggcaagtgtagacgggcccgaagagatgaaagaagactatgatactatgggccctgaggctaccatccagacagcaatcaataacggcaccgtgaagaatgctaactgcacaagcgatttcgaggagtacttcgccaagcgcaagcttgaggagagagacggtcatgcggtgtctattgaggagtatttacagagatcagacaccgcaattatttaccctgaagctcccgaggaactgagccgcctcggtacacctgaggctaatggccaggaggagaatgacctccctcccgggacacccgacgcttttgctcagctgttaacatgcccctattgcgatcgaggatataaaagattgaccagcttgaaggagcacatcaagtaccggcacgagaagaacgaggaaaactttagctgccccctctgtagctacaccttcgcctatcgaactcaactagaacggcatatggtcactcacaagccaggcaccgaccagcaccagatgttaacacagggtgccggcaatagaaagttcaagtgcacggaatgcggtaaggcatttaaatataagcatcatctgaaggagcaccttagaatccactctggggaaaaaccatacgagtgccctaactgtaagaagaggtttagccatagcggctcatacagtagccacattagctccaagaagtgcatcggactgattagcgtgaatggtcgaatgaggaacaacattaagacaggctccagccccaactctgtttcctctagccccacaaatagcgccatcacccagttaaggaataagctcgagaatggcaaaccattaagtatgtccgagcaaacaggcttgctgaaaataaagactgaacctctcgattttaacgactacaaggtgcttatggccacccatgggtttagcggtacaagcccgttcatgaatggcggcctgggggccactagccctctgggagtgcacccaagcgcccagtcaccaatgcagcatttgggcgtgggcatggaagcccctctcctgggttttcctacaatgaactctaacctaagcgaggttcagaaggtgctgcagattgtcgataataccgtgtcccggcagaagatggactgcaaggccgaggagatcagcaaactaaaaggctatcacatgaaggatccttgctcccagcctgaggagcagggcgtgacatctccaaacatcccaccggttggactgcctgtcgtgtctcataatggtgcaacgaagagcattatagattacactttagaaaaggtgaatgaagctaaagcttgcctgcagtcattgacgaccgactcaaggagacagattagcaatattaagaaagagaaactccggactctcatcgacctcgtcaccgatgataagatgatcgaaaaccataatatctccacccccttttcctgtcaattctgcaaggaatcttttccaggtccaatcccccttcatcaacacgaaagatatttatgtaagatgaacgaggagatcaaggcagtgctgcaaccgcacgaaaacatcgtgccaaacaaggcaggtgtgtttgtggacaacaaagcactgctgctctccagtgtcctgagcgagaagggaatgactagcccgattaacccttacaaggatcacatgtcagtattaaaggcctactacgccatgaatatggaaccaaactcagatgaactcctcaagatctctattgccgtggggctgccgcaggagttcgtcaaagagtggtttgaacagcgcaaggtttaccaatactctaattccaggagcccctctttggagcgcagctctaagccacttgcacctaacagcaatccccccactaaagatagcttactcccccgtagtcccgtcaagcccatggacagcatcacaagccctagtatcgccgagctgcataatagcgtgaccaattgtgaccctcctcttagattaacaaagccctcgcattttactaatatcaagcctgtggagaaactcgaccatagcaggagcaatactcctagtcccctcaacctgtcttcaacctccagcaaaaactcacattcgtcaagctatacccccaactcgttctctagcgaggagctccaggctgaaccactagacctgtcgctgccaaagcagatgaaggaaccaaaatcaattatcgccactaaaaacaaaacgaaggcatcatccataagcttagaccacaactccgtcagctcctcctccgagaatagtgacgagccactgaatctgaccttcattaagaaggagttctcgaacagcaacaatctcgacaacaagtcaacaaatcctgtgttctcaatgaaccccttcagcgcgaagcctctctataccgccctgcccccacagtcagcttttccacccgcgacttttatgccacccgttcaaacgtcaatccccgggttgaggccctaccccgggttagaccaaatgagctttctcccgcacatggcttacacatatccaacaggcgcagctacctttgccgatatgcagcaacgccgcaaatatcagcgaaaacagggcttccagggcgagctcctggatggagcacaggattacatgtcagggcttgacgacatgaccgatagcgacagctgcctgtcacggaagaagatcaaaaagactgaatccggaatgtacgcctgcgatctctgtgataaaaccttccaaaagtccagctcgctcctcaggcataaatacgaacataccgggaagaggccacatcagtgccagatttgtaagaaagcattcaagcataagcatcacctgattgagcacagtaggcttcactccggggagaaaccctatcagtgtgacaaatgcgggaaacgattttctcattccgggtcttactctcaacatatgaaccaccgctatagctattgtaagcgagaggccgaagagagggaggcagctgaacgagaggcacgagaaaaaggccacctcgaacctaccgaacttttgatgaatagagcctacctgcagtctatcacccctcagggctacagtgattctgaggaacgggaatcaatgccccgggacggtgaatctgaaaaagagcacgagaaggaaggcgaggacggatacggcaagctagggaggcaggacggcgatgaggaatttgaggaggaggaggaagaatctgaaaacaagagtatggacacagaccctgaaactatccgggacgaggaggagacaggagaccacagcatggatgactcatccgaggatgggaaaatggaaaccaagtccgatcatgaagaggataacatggaagacgggatgtag

SEQ ID NO: 27138 - DNA, 1893 bp, Artificial Sequence
  Description of Artificial Sequence: Synthetic coding sequence
atgagcatcagcgccctgggcggccggaccaagggcaagcccctgcctcccggcgaggaggagagaaacaacgtgttaaaacaaatgaaggtgagaactacccttaaaggagacaagagctggatcaccaagcaggacgaaagtgaaggcaggaccattgaactcccctctggtaggtccagagctacttcttttagcagtgctggggaagttccaaagcctagacctccgtctacgcgcgcccccacagggtatattatccggggagtcttcaccaagcccatagatagctccagccaaccacagcagcaattccctaaggctaatggcactcctaagagcgcagccagtctggtgcgcacagcaaacgcaggtcccccccggccctcctcgagcggctacaaaatgaccaccgaagactataagaagcttgcaccctataatatccgcagaagtagtacttctggtgataccgaggaagaagaggaagaagaggtggtgcccttttcgtcagacgaacagaaaagacggtcagaggctgccagtggcgtgctccgcaggaccgcccccagggagcatagctacgttcttagcgctgcaaagaagagtaccggacccacccaagagacccaggctccttttatcgccaaacgggtggaagtggtggaagaagacggtccctcagagaagtcccaagatcccccagcattggccagaagtacgcctgggtccaaccgatcgtcaccaggcaataaagataaagaagcaccgtgcagccgggaactgcagcgcgatctagcgggggaggaggcattccgcgcgccgaacaccgacgccgcccgtagctcagctcagctgtccgacgggaacgtagggtccggcgctaccggatcacggccggaggggctagccgccgtagatattggatctgagcgtggtagctcctcagccacttccgtgtccgccgtccccgcagatcggaagagcaatagcacggccgctcaggaggatgctaaggcagatcccaaaggggcattagccgactatgaggggaaagacgtagcaacaagggtgggggaggcgtggcaggagcggcctggtgcccctagaggcgggcaaggcgaccccgcagttccagcccaacagcccgccgacccatccacacctgagcggcagagtagccccagtggatctgagcagctggttagaagagagtcatgtggaagttcagtgcttaccgattttgagggcaaagacgtcgccaccaaggtaggggaagcttggcaggaccgtccaggggcgccccgagggggtcagggcgaccccgctgtgcctacccaacagcctgccgatcccagcacccctgagcagcaaaacagcccatctgggtctgagcagttcgtaagacgcgagagctgcaccagtagggttcgaagtccatcctcctgcatggtgactgttactgtgactgccacctctgagcagccacacatctatataccagctcctgcatccgagttggatagctcaagcaccactaagggtatcctgtttgtgaaagagtacgtaaatgcctcagaggtgtcatccggcaagcctgtgtcagcccgctactctaacgtgagctccatcgaagactcttttgccatggagaagaagccaccatgtggttccaccccttatagtgagagaaccactggcgggatctgcacatactgcaacagggagatccgcgattgcccaaaaatcacactggagcatctgggtatttgctgtcacgagtactgctttaagtgtggaatttgttccaaaccaatgggagacctgctagatcagatattcatccatagagacactattcactgcgggaagtgctatgaaaagttattttag

SEQ ID NO: 27139 - DNA, 1407 bp, Artificial Sequence
  Description of Artificial Sequence: Synthetic coding sequence
atgaccaccgaggactacaagaagctggccccctacaacatccggcggagcagcacaagtggcgataccgaggaagaggaagaagaagaggttgtgcccttttccagcgacgaacagaaacgaagcagtcccacccaagaaacccaggctcctttcattgccaaacgcgtcgaagtcgtggaagaggatggtccaagcgaaaaaagtcaagacccacccgctctggcccgcagcacacccggcagtaatagatcatcacctgggaacaaggataaggaggccccttgtagccgtgagttacagagggaccttgcgggcgaagaggcttttcgggcccccaacacagacgctgctaggtcatcagctcagttatccgacggcaacgtcggatccggggccacaggcagtcgaccagaaggactcgccgctgtcgatatcggaagcgaaagagggtccagctccgccacttcagtctcagcggtacctgctgaccggaagtctaacagcactgctgcccaggaggatgccaaggcagacccgaaaggagccctggccgattacgagggcaaagacgtggcaactagagttggtgaagcgtggcaagagaggccaggagccccccgcggcggtcagggggaccctgccgttcctgctcagcaacctgccgatccttcaacaccagaacgccagtcttcgccctctgggagtgagcagctggtgcggagggaatcttgtggtagctcggtccttaccgacttcgaagggaaggatgtcgctacaaaagtgggtgaggcctggcaggaccgacctggcgccccaagagggggccagggcgatccagcggtgcccacacagcagcctgccgatccgagtacaccagaacagcaaaactcccccagcgggtctgagcagtttgtcagaagagaaagttgtaccagcagagtgcgctcaccctcgtcctgtatggtaacggtcactgtgacagcgacctccgagcagccccatatctacattcctgcacctgccagcgagcttgattcctcgagcacaaccaaggggatcctgtttgtgaaagaatatgtcaacgcgagtgaagtaagcagtgggaagccagtgtctgccagatactcaaacgtctcctcgattgaagattcttttgccatggaaaagaaaccaccttgtggaagcactccctactctgagaggacaaccggcgggatttgcacttattgcaaccgcgaaatcagggattgtcctaaaattacacttgagcacttggggatttgttgccatgagtactgctttaaatgcggcatttgctcaaagcctatgggggatcttcttgatcagatctttatccatagagatactattcactgtggcaagtgctatgaaaaactgttctag

SEQ ID NO: 27140 - DNA, 1374 bp, Artificial Sequence
  Description of Artificial Sequence: Synthetic coding sequence
atgaccaccgaggactacaagaagctggccccctacaacatccggcgcagcagtactagcggcgacaccgaagaagaagaagaggaggaagttgtgcctttcagtagtgacgagcagaaacggcgctccgaggccgcgagcggcgtgctacgtcgtacagctccacgggagcactcctatgtgctcagcgccgcgaagaaaagtaccgggagccctacccaggaaacgcaggcaccgtttatcgccaagcgcgtggaagtggtggaagaagacggtccctccgagaagtctcaggacccacctgccctagcgcggtctacaccgggtagcaatagctcacggggagaagagatcgtgagattacaaatattaactccacgcgccggacttagactcgtcgccccagacgttgaaggaatgtctagctcggcaacttctgtatctgcggtgcccgcagaccgcaagagtaatagcactgccgcccaggaagacgccaaagccgacccaaagggagccctggcagattacgaggggaaagatgttgcaaccagggtgggagaagcttggcaagagcgacccggtgcccccagagggggccagggcgacccagctgtcccagctcagcagccagccgacccctcaaccccggagcggcaatctagcccttccggcagcgagcagctggtacgccgtgaatcatgtggatcctccgtgctaactgactttgaagggaaagatgtggccacgaaagtgggagaagcctggcaggacagaccaggcgccccacgaggcgggcagggcgacccagccgttccaacccaacaacccgcggatccttccacaccagaacagcagaattctcctagcgggagcgagcagtttgtgcggcgcgagagctgcacaagccgggttcgtagcccatccagctgtatggtcactgttaccgtcaccgccacctccgagcagccccatatctacatccctgccccagcctctgagctggacagctcaagcacaaccaaaggcatcctgttcgtgaaggaatacgtcaacgcctcggaagtcagctcaggcaagcctgtgagtgcccggtacagtaacgtgagctcaattgaagattcctttgccatggagaagaaaccaccgtgcggatccaccccctacagtgaacgcacgaccggcggcatctgcacttactgcaacagggagatcagagattgcccgaagatcaccctcgaacatctgggaatctgttgtcatgagtattgctttaaatgtggtatttgttcaaaacctatgggagacctgttagatcaaatattcatacacagagatacaatccactgtggcaagtgttacgagaagttgttctag

SEQ ID NO: 27141 - DNA, 2070 bp, Artificial Sequence
  Description of Artificial Sequence: Synthetic coding sequence
atgagcatcagcgccctgggcggccggaccaagggcaagcccctgcctccaggagaggaagaacggaacaatgtgctgaaacagatgaaggtccgcaccaccctgaaaggtgataagtcttggatcaccaagcaggatgagagcgagggcagaacaatcgagcttccttcggggcgatccagagccaccagtttctcatcagccggcgaagtgcccaagcccaggcctccttctaccagagctcccaccgggtacattatccggggggtcttcactaaacccatcgactcaagtagccaaccccaacagcagttccctaaggcaaatgggacgcctaagagcgccgcctcgctagtgcgcacagccaacgcaggacctcccagaccatcctcatccgggtacaagatgaccactgaagattataaaaagttggccccttacaatatccgacgaagttctacctccggtgacacagaggaagaagaggaggaagaagtagtgccattcagcagtgacgagcaaaagagacgttccgaagctgcttcaggggtactccggagaacagctcctagagagcactcttatgtgctgagcgcggccaagaagtctaccggccctactcaagaaacacaggcacccttcatcgctaaacgtgtggaggtcgtggaggaggatggaccgtcagaaaaatctcaggacccaccagcactggcacgaagtacccctgggtctaatagcgctgacggaggccgcactaaggcaagcagggcgatttggattgagtgcctccctagtatgccatctccagctggttctcaggagctttccagcaggggtgaagagatcgtgaggttacaaattctcaccccacgggccggactccgcctggtggctcctgacgtggaagggatgagatccagccccggcaataaggacaaggaggccccttgctcccgagagctccaaagggatctcgcaggcgaggaagcttttcgcgcacccaatactgatgcggctaggagctcagcacagctgtccgacggaaacgtgggaagtggcgcaactggcagccggcccgaagggctggctgcagtcgacatcggaagtgaaagaggctcctcatctgccactagcgtgagcgctgtccccgcagaccgcaaaagcaacagcacggcagcccaggaagatgccaaagcggatcccaaaggggcgctggctgattatgaaggaaaagacgtagccacaagagtgggggaagcttggcaggagcggccaggcgctccccggggaggacagggggatccagccgtgccagcccagcagcctgccgacccttctacccccgaacggcaatcttcccccagtggctctgaacagctggttcgccgggagtcttgtggaagcagtgtgttgacggattttgaaggaaaagacgttgcgacaaaggtaggagaggcttggcaggatcgacccggggctccacgaggcgggcagggggaccccgcagtccccactcagcaaccagcagacccttcaactcctgagcaacagaatagtccctcagggagcgaacagtttgtgcgcagagaaagttgcacttccagggttcgctccccaagcagttgtatggtgacagtcacagttaccgctacatccgagcaacctcatatctacattcccgctcctgctagtgaactggactcatcgagcacgacaaaaggcatcctgtttgtgaaggaatatgttaacgctagcgaagtcagtagcggcaagcccgtgtccgcccgctattcgaatgtgtcatcaatagaagactcgtttgccatggagaagaagccaccatgtggttcaaccccatactcagaacgcacaaccggcggcatttgcacctattgcaatcgggaaatcagggattgtcccaagattaccttagaacacctcggaatttgttgccacgagtattgcttcaaatgcggcatttgctctaaacccatgggcgatctactggatcagatatttatccatcgtgatacaattcactgtggcaaatgttatgagaaactgttctag

SEQ ID NO: 27142 - DNA, 1359 bp, Artificial Sequence
  Description of Artificial Sequence: Synthetic coding sequence
atgcagcggcaggccccctacaacatccggcggagcagcaccagcggagacaccgaggaagaagaggaagaggaagttgtgccattttcatcagacgagcaaaaaagaaggtctgaagctgcgtcaggagtactacgccgcacagccccccgggagcactcttacgttttatctgccgctaagaaatcgacaggctcccctacccaggaaacccaggccccatttattgccaagagagtcgaagttgtcgaagaggacggaccatctgagaaatcccaagacccccctgccctagcgagatccacgccaggctccaatagctcccggggggaggagatcgtcagattgcagatcctgacccctcgggctgggcttcggctggtagctccagacgtggagggcatgagcagtagcgccacctccgtgagtgctgttcctgcggaccggaagtcaaacagcaccgctgcccaggaagacgctaaggccgacccaaaaggcgcgctcgccgactatgagggcaaggacgttgccaccagagtaggcgaggcgtggcaggagaggcccggcgctcctagggggggacagggcgatccagccgttcccgctcaacagccagcggacccttccacacctgagaggcaatcttcacccagcggtagcgagcagctcgtacggcgggagagttgtggctcttcggtactcactgactttgaaggtaaagatgtggctactaaagtcggtgaagcctggcaggataggcccggggcccctagaggtggtcagggcgatccagcggtccccacacagcagcccgctgatccctcaacaccagaacagcagaatagcccctccggctcggagcaatttgtgcgaagagagtcttgtactagtcgcgtgagaagcccctctagttgtatggtcactgtaacagtgaccgctacatccgaacagccccacatttatatccctgcaccggcatccgaactggacagctctagcactacaaaaggtatcctgttcgtcaaagagtacgtgaacgctagcgaggtcagctctggcaaacccgtatctgcacggtactccaacgtgtcatcaatcgaggacagttttgccatggaaaagaaaccaccctgcggaagcaccccttattccgaacgcactacaggcggtatttgtacatattgcaaccgggagatcagggactgccccaagatcaccctggagcacctcggcatttgctgccacgaatattgttttaagtgtggcatttgttccaaacctatgggtgatttgttggaccaaatttttatccatcgggatacaatacactgcggcaagtgctacgagaagctgttttag

SEQ ID NO: 27143 - DNA, 1428 bp, Artificial Sequence
  Description of Artificial Sequence: Synthetic coding sequence
tgacggagcagcaccagcggcgacaccgaggaggaggaggaggaggaggtcgtgccattctcttctgacgaacagaagagatccttgcgcaggaccgcacccagggaacattcgtacgttctgtcggcagccaagaagagcaccggtagtcccacacaggaaacccaggcaccgtttatcgccaagagggtcgaggtcgtcgaggaggatggccccagcgaaaaatcccaggatccaccagcactcgctagatccacacctgggagcaatcgctcctctccaggcaacaaggataaggaagctccatgttccagggaacttcaaagagacctggccggtgaggaagcatttagagcacccaatactgacgcagccagaagcagcgcccaactgagcgacggcaatgtgggaagtggtgccaccggaagccgaccagaaggtctggccgctgtggatattggctctgagcgtggttcttcaagtgccacaagtgtgtctgccgtcccggccgaccgcaagtctaacagcaccgcagcacaggaggatgccaaggccgatcctaagggcgccttagccgactatgaggggaaggatgtggcaacaagggtcggagaggcctggcaggagcgtcctggcgcgccacgtgggggccagggcgatcctgccgtgcctgcgcaacagcccgcagatcctagcaccccagaaaggcagtcttcccccagtggatcagaacaactggtgagaagggaatcatgtggctccagcgtcttgaccgacttcgaaggaaaggatgtagccaccaaggtaggcgaagcatggcaagatcggcccggcgccccgaggggcggacagggcgatccggcggttcctactcaacaacccgccgatccctctactccagaacagcagaacagcccgtcgggcagtgagcagttcgtgcggagagagagctgcacctctcgagttcgctccccatctagctgcatggtgaccgttaccgtcaccgctacaagtgaacagccccacatttacattcccgctcccgccagtgaattagacagttccagcaccacaaagggcatattgttcgtgaaggagtacgtcaatgccagcgaggtatcctccggtaagcccgtgagtgcccgctacagcaatgtgtcctctattgaagattcctttgctatggagaaaaaacctccatgcgggtcaacaccatactccgagaggactactgggggaatttgtacatactgcaatcgggagatccgagattgcccaaaaatcaccctggagcaccttggcatctgctgccatgaatactgctttaagtgtggaatctgtagcaagcccatgggagacctgcttgaccagatattcattcatcgcgacacaattcactgcgggaagtgttatgagaagctgttttag

SEQ ID NO: 27144 - DNA, 1146 bp, Artificial Sequence
  Description of Artificial Sequence: Synthetic coding sequence
atgaccaccgaggactacaagaagctggccccctacaacatccggcggtcatccacctcaggggacacggaggaggaagaagaagaagaagtcgtacctttcagctccgacgaacagaaacgacgttcagaagccgccagcggtgtccttagaaggacagccccccgcgagcattcttatgtactcagcgcggcaaaaaagagcacaggcagcccgacccaagaaacccaggccccttttatcgccaagcgcgtagaggttgtcgaagaggacggcccgtctgagaaatcgcaggatcctccggccttggcccgaagcactccagggtcaaatagcgcagatggggggaggacaaaggccagcagggcaatctggattgaatgtctgccctcaatgccttcccccgctggatcccaagaactgagtagccgtggcgaggagattgtccgtctccagatcctgacccccagagcaggcttacggttagttgcgccggacgtggagggtatgaggagttcacctggtaacaaagacaaagaagcgccatgcagccgggaactgcagcgagacctcgccggagaggaagcctttagggcacctaacactgacgccgccagatcctcagcccagctttctgacgggaacgtcggaagcggcgctacgggctctcgacccgagggactcgcggctgttgacatcggttccgagcgaggctcctcatccgctacatccgttagcgccgtgcccgccgatcgcaagtcaaattcaacggcggcacaggaagacgcgaaggctgacccgaagggggccctggcagactacgagggcaaggatgtggcgactagggttggcgaggcctggcaagaaaggcccggggccccaagagggggccagggcgaccccgccgtgcccgcccagcagccagctgatccctctacacctgaacggcagagctcgccaagtggaagtgagcagttggtgcggcgggaaagttgcggcagtagcgtcttaaccgacttcgagggaaaagacgtggccaccaaggtgggtgaggcttggcaggatcggcccggccctagctgcacacattctgcgacctgcagaagccagtacccccgcactgccgaacagccacaacggatctag

SEQ ID NO: 27145 - DNA, 636 bp, Artificial Sequence
  Description of Artificial Sequence: Synthetic coding sequence
gaggaggccttccgggcccccaacaccgacgccgcccggagcagcgcacagctgagtgacggcaacgtgggttccggcgcgaccgggtctcgacctgaagggcttgctgcggtggacataggaagtgagaggggcagattatgtgcagctgcaagtttcgcctccttcctggaggaccaggacggccactcagctaattcccaatcatgcaaaccaagaccagcagcaatctccagctccgctacctcagtgagcgcagtccctgcggaccgcaaatccaattcaactgcggctcaggaagatgcgaaagcggaccctaagggagcccttgccgactacgagggcaaagacgtggctactcgagttggcgaagcctggcaggagagacccggggccccccggggaggccaaggcgacccagctgtgccagctcagcagccggctgatccctcaactccagagcggcagtcctccccctctggctctgagcagctggtacgcagagaaagttgtgggtcttctgtgttaacagatttcgagggaaaagacgtggcgaccaaggtcggggaggcctggcaagataggcccggagcaccaaggggcgggcaaggtgatccagctgtccccactcagtag

SEQ ID NO: 27146 - DNA, 666 bp, Artificial Sequence
  Description of Artificial Sequence: Synthetic coding sequence
tgactgcggcggaccgccccccgggagcacagctacgtgctgagcgccgccaagaaatctaccggcagtcccacccaggaaacgcaggccccttttatcgccaagagagtggaggtcgtggaagaggacgggccctctgagaagtcacaggacccccccgcgttagccaggagcactccaggctccaactcagctgatggaggcaggacaaaggcttctcgggccatctggattgagtgcctcccctccatgccttcccctgccggatcccaagagctctcctctagaggtgaggaaatcgtgaggcttcaaatcctgaccccaagagctgggttgagactcgttgctccagatgtcgaaggaatgcggtcatcacctggcaacaaggacaaagaagcaccttgctccagagaactgcagagggatttagccggagaggaggcctttcgggcaccaaatacagatgcagcccggtctagtgcacagctctccgacggaaacgtaggctctggggctaccggttcccgccctgagggactggctgccgttgatattggaagcgagcgggggtcctcatcggccacctctgttagcgctgtgcccgcagacaggaagtcgaattccacagcagcgcaggaagatgccaaggctgatcccaagggctag

SEQ ID NO: 27147 - DNA, 414 bp, Artificial Sequence
  Description of Artificial Sequence: Synthetic coding sequence
tgagtgctgccccggcggcaccggcaccggctgagccggcggggctggcggtggtggaagagaactggcctgcttcgccgggcaaggactcatcttctctggcaggatccactgttggcgcagactgtccggatggaggcgggccccaagcggcttggtcagttcggaagttcggcttgtcaggtctgcttggcaccgttaggggcccgctccagtggtttaccacaggctaccaagacacgcaggcccccggcacctgagagtagccggggcacatggcttgtgcgaagattaagcggtccccctacccagatgctgcaggcccccgtgcccctgcagagcttattatccctgttaatcgggagggccactgcgcagcaacctcgcaggatgcagcgccagactcagaggtag

SEQ ID NO: 27148 - DNA, 2073 bp, Artificial Sequence
  Description of Artificial Sequence: Synthetic coding sequence
atgagcatcagcgccctgggcggccggaccaagggcaagcccctgccgcctggggaagaggagcggaacaacgtgctgaaacagatgaaagtaagaactactctgaaaggcgataaatcttggattacaaagcaggacgaaagtgaggggcggaccatcgaattgcccagcggtcgaagcagggcgacgtctttctctagcgctggagaggtgcctaaacctcggcctccctcaacgagagcacctacaggatacatcatccgaggggtatttactaagccaatcgactctagctcccagccccagcaacaattcccgaaggccaacggaaccccaaaatctgccgcctctctggtgcgtaccgcaaatgccgggccgccccgaccatcatcctctggatataagatgacaactgaggactacaagaaactcgcgccctataatatccggaggtcctcaacgagcggcgacacggaggaagaggaggaggaggaggttgtacccttttcatctgatgagcaaaagagacggagcgaagccgcgtctggcgtgctccgaaggactgcgcctcgagagcactcttacgtgctgagcgctgctaagaagagcacggggtcccccacacaggaaacgcaggctccgttcatcgccaagcgcgtggaggtggtggaggaggacggaccctcagagaagtcacaggatccgccagcccttgcgcggtctacacctggctctaatagtgccgacggaggcagaacaaaagcatcacgcgcaatctggattgaatgcctgccctcaatgccatctccggctgggagtcaggagctgtcctctaggggtgaggagatcgtacgtctacagatactgacccctcgcgcaggtctgcggctagtagcccctgacgtggaggggatgaggagttctccagggaataaggacaaagaagcaccctgttctagggagctacagagagatttagccggcgaggaggcttttcgagcccccaacaccgacgccgccaggagctctgcgcagctctctgatggcaacgtgggttctggagccaccggctccagaccagagggactggcagctgttgatatcgggtccgaaaggggatcatcctctgcaaccagcgtgagcgccgtccctgctgacagaaaatccaacagcacggccgctcaggaagacgccaaggctgatccgaaaggggcccttgctgactacgaagggaaagatgtggccacacgggtgggcgaggcatggcaggagaggcccggagcaccccgaggaggacagggggatcccgccgtgcccgcccagcagcctgctgaccctagcactcccgaacggcaaagctcaccctccggaagcgagcagctggtgcgccgagaaagttgcggctccagtgtgcttaccgactttgagggcaaagacgtcgcaaccaaggtgggcgaagcttggcaggatcggccaggcgcaccaagaggtggacagggggaccccgccgtgcccacccagcagccagctgatccttcaacccctgaacagcagaactcgccttccgggtccgagcagttcgtgcgccgagagagttgtacctctcgcgttagatccccttcctcctgtatggtcactgtgactgtcactgcaacaagtgagcagcctcatatctacatccccgcccctgcatccgagctggacagttcgtccacgacaaagggtatcttatttgtgaaagagtatgtcaacgcttcagaggtcagctccggcaagcccgtgagcgccagatatagcaacgtcagttccatagaagactccttcgccatggagaaaaagccaccctgcgggtcaacaccttacagcgagcgaaccacaggcggtatctgtacttactgcaaccgagaaattcgggactgcccaaagatcaccctggaacatttgggcatttgctgccatgagtattgcttcaagtgtgggatctgttctaagccgatgggagacctgttggaccaaatttttattcacagagacaccatccactgtggcaaatgttacgagaagctgttctag

SEQ ID NO: 27149 - DNA, 993 bp, Artificial Sequence
  Description of Artificial Sequence: Synthetic coding sequence
tgaagcgagatggccgcccgggacgagctgggcctgggcggcgactctcttgaagctatgccggtccccgccgccagaggcaggcctcgcatcactaacggccccgaagaattagcagctccctccccggctgccctagcagattacgaagggaaggatgtcgctaccagggtaggagaggcttggcaagagaggccgggtgccccgagaggtggacaaggagatcctgcagttcccgcccaacaaccagccgatccctccacgccagagcgacagtcatcgccctccgggtcagagcagcttgttaggcgggaaagctgcggttcaagtgtactgactgatttcgagggtaaggacgtggccaccaaggtgggggaggcttggcaggatagacctggcgctcccagggggggccagggggatcccgctgtccctacacaacagccagcagatccctccaccccagagcaacagaactctcctagcggctctgagcagtttgtcagacgcgaatcttgtactagtagagtaaggtcccctagcagttgcatggtgacagttactgtgacggcgaccagtgagcagccacacatttacatccccgcccccgctagcgagctggacagctccagtaccaccaaaggcatcctgtttgtgaaagagtacgtgaacgcaagtgaagtatcgtccggaaaacctgttagtgctaggtactctaatgtcagctcaattgaggattcctttgcaatggaaaaaaagccgccgtgtggaagtaccccatatagtgagcgaacaacgggcgggatctgtacatactgcaaccgagagatcagagattgccccaagatcaccctcgagcatctcggcatctgttgccacgagtactgcttcaaatgcggcatttgttcaaagcctatgggcgacctcttagaccagatttttattcaccgcgacacgattcactgcgggaagtgttatgagaagctgttctag

SEQ ID NO: 27150 - DNA, 1575 bp, Artificial Sequence
  Description of Artificial Sequence: Synthetic coding sequence
atgaccaccgaggactacaagaagctggccccctacaacatccggagatcttccactagcggagatactgaggaagaggaagaagaggaggttgtgccatttagctcagatgaacagaaaaggcggtccgaggccgcatctggagtcctcaggcgcactgcccctagggagcactcttatgtgcttagcgctgctaagaagtcaacaggccccacgcaagagacacaggccccctttatagctaaacgagtcgaagtcgtggaggaggacggcccatccgaaaagtcccaggacccacctgcactggcacgtagcacgcctggcagcaactcgtcacggggcgaagaaattgtgagactgcagatcctgactcccagagccggactgaggttagtggcccctgacgtcgaaggtatgaggtcttcccccggaaataaggacaaggaggcgccctgttctcgcgagctgcagcgcgacctcgcgggagaggaagctttcagggcaccgaataccgatgccgctcggtcttcagcccagctgagcgatggcaacgtgggctctggcgctacaggaagtcgcccagagggtctggcggcggtcgatatcgggtccgagcgaggctcgtctagcgccacttctgtatctgccgtgccagccgaccggaagtcaaatagcacagcggctcaggaagatgcaaaagcagatcccaaaggggccctggccgactacgaggggaaagacgtggccactagagtgggcgaagcatggcaggaacgcccaggcgctccaaggggaggccagggcgatcctgctgtccctgcacagcagccagcagacccaagcacacccgaacggcagagtagtccctctggcagtgagcagctggtacgccgtgagagttgtgggagcagcgttctgacagatttcgagggaaaggacgtggctaccaaggttggcgaagcttggcaggaccgacccggggcacccagaggcggccaaggggacccagctgtgcccacccaacagccagccgacccgtcaacccccgagcagcagaactccccttccggttcagaacagtttgtacgaagagagagttgcaccagtcgggtccgttcgccttccagctgcatggtcacagtcacagtgactgcaacatccgaacagccccatatttatataccggcccccgcaagcgaattagattccagcagtactactaaggggatcttgtttgtgaaggaatacgttaatgcatccgaggtgagctccggtaagcccgtgtctgccaggtatagtaacgtgagctcaatcgaagacagcttcgctatggagaaaaagcctccctgcggctctaccccatatagtgaacgaaccaccggcggaatctgtacttactgtaatagggagatacgtgactgccctaagatcacactcgagcacctgggcatctgctgtcatgagtattgcttcaaatgtggcatctgttctaaacccatgggtgaccttttggatcagattttcatccacagggacaccatccactgtggtaaatgttacgaaaagctcttctag

SEQ ID NO: 27151 - DNA, 2166 bp, Artificial Sequence
  Description of Artificial Sequence: Synthetic coding sequence
atgagcatcagcgccctgggcggccggaccaagggcaagcccctgcctcctggcgaggaagagaggaacaatgtcttgaagcagatgaaagtccggaccaccctaaagggggacaaatcgtggatcacaaagcaggacgagtcagaaggacggacaattgagctgccctccgggagaagcagggcaacaagcttctcctccgctggcgaggtgccaaaaccaaggcctccctccactagagccccaactggctatatcattcggggagttttcaccaagcccattgatagcagctcccagcctcaacaacagttcccgaaagctaatggaacccccaagagtgctgctagtctggttcgaaccgccaacgcaggtcctccaagaccatccagttccggctacaagatgaccaccgaagactacaaaaaattagcaccctataatatccggcgcagcagtacgagtggtgacaccgaggaagaggaagaagaggaggtagtacctttttcctcagatgaacagaagcgacgtagtgaagcagcctcaggagtgttaaggcgcaccgctcccagggagcattcctacgtgctcagtgccgctaaaaagagtactgggcccacccaagagacgcaagcgccgttcatagcaaagagagttgaagtggtggaagaagacggtccaagtgaaaagagccaggacccgcccgccttggctcgttccacccctggatctaattcagcagacgggggtcgcaccaaagcgtcgcgagccatttggattgaatgcctcccatctatgcccagccccgcaggctcgcaggagctgagctcacgaggagaagaaattgtgaggctccaaatcttaacgccgcgtgccggcctgagactggtagcgcctgacgttgaggggatgagatcatcccctggaaataaagataaggaagctccctgttctcgggagctgcaacgggaccttgctggtgaggaggcattccgagcccctaatacggatgccgcccgctccagtgcccagctgtccgacggcaatgtcgggagcggagcgactggctcccgacctgagggtctcgcagcagtggacattggttccgagcggggacggctttgcgccgccgcgagttttgcatcctttcttgaggatcaggacggtcactcagccaatagtcagagttgtaaaccgcggccagccgccattagttcctccgcaacaagcgtctctgctgtccctgctgatcggaaatcaaacagcactgcggcacaggaggacgcaaaagccgaccctaagggggccctcgcggactacgaaggaaaggatgtggccaccagagtgggcgaggcctggcaagaacgtccaggcgccccccgcgggggtcaaggggatcccgccgtgcctgctcagcaacctgctgatccctctacccccgagcgccagagtagcccctccggatctgaacagctggtccgccgggaatcatgcgggagctccgtgttgacagacttcgaaggcaaagatgtggctacaaaagtgggagaagcctggcaggatcgccctggagcgcctcggggggggcagggggacccagcagtgcctactcagcagccagcggacccatcaacaccagagcagcagaacagcccttccggtagcgagcagttcgtccgccgggaatcatgcacatctcgtgttcgtagcccctccagttgcatggtgactgtcactgtaactgctacaagtgaacagcctcatatttacattcccgctccagcgagtgaactcgactcaagtagcaccactaagggcatcctgttcgtgaaggaatacgtgaatgcttcagaggtgtccagtgggaaaccagtgtcagctcggtactcgaacgtcagtagtatcgaagattcttttgccatggagaagaagcccccatgcggctccaccccttactcagagcggacaaccggtggcatctgcacatattgcaaccgtgagatacgggactgtcctaaaataactctggagcacctggggatttgctgtcatgaatactgctttaagtgcggcatctgctcaaagccgatgggcgacctcctcgaccagatattcatacatagagacaccatacattgcggtaagtgctatgaaaagctcttctag

SEQ ID NO: 27152 - DNA, 2079 bp, Artificial Sequence
  Description of Artificial Sequence: Synthetic coding sequence
atgagcatcagcgccctgggcggccggaccaagggcaagcccctgccccctggggaagaagagagaaataatgtcctcaaacagatgaaggtccgcacaactctaaagggagacaagagctggatcaccaagcaggatgaaagcgagggaaggacaatagaactgcccagtgggcgcagccgtgctactagttttagctcagcaggcgaggtcccaaagccccggcccccatccacaagagcaccgactgggtacatcatacggggcgtgttcactaagccaatcgattcatctagccagccgcagcagcagttccccaaagctaacggaacgcccaaatcggccgccagcttggttaggaccgcaaacgcaggccccccgcggcctagctcaagcgggtacaagatgaccactgaggattataagaaattggccccctacaatattcgcaggtcgtctacaagtggggacaccgaggaagaggaggaggaggaggtagtaccttttagttctgacgaacagaaacggagatccgaggccgcttcaggggtactccgaagaaccgctccccgagaacatagttacgtgctctcagccgcaaagaagtccaccgggccaacacaggagactcaggcaccctttatagctaaaagggtcgaagtcgtggaggaggacgggccatccgagaagtctcaagatccgcccgcactggctagatctactcccgggtctaattccgctgacggtggacggacaaaggcctccagggccatttggatcgagtgcctgccctctatgccctcacccgcaggatctcaggaactgcgctctagcccgggcaataaagataaagaggctccttgttcaagagagctgcaaagggatctagcaggagaagaagcgtttagagccccaaataccgatgccgctcggtctagcgcccaactgtcggatggaaatgtgggtagtggcgcaactggatctagacctgaggggctagccgctgtggacataggcagcgagcggggcagactgtgtgctgctgcctcttttgctagtttccttgaagatcaagacggccacagtgcaaacagccaaagctgcaaaccacggccagccgccatttcatcctcggcaacctccgtttcagctgtgcccgccgaccggaaatcaaattctactgctgctcaagaggatgccaaggctgaccccaagggtgctctggcagactacgaaggcaaagacgtcgcgactagggtaggagaagcatggcaagaacggccaggagcaccaaggggcggccagggcgacccggccgtgcctgctcagcagcctgctgacccaagtacacccgaaagacagtcctctccctctggatccgagcaactggtgaggcgcgaatcctgtgggtcttccgtgcttactgattttgaaggaaaggacgtggccactaaggtgggagaggcttggcaggatcgcccaggcgcaccccgtggcgggcaaggagatccagccgtgcccacgcagcaaccagctgatcccagcacccctgaacagcagaattctccatcagggagtgagcagtttgttcgacgtgagagttgcacatcccgggtccgctccccttccagttgcatggtaacagtcacagttacggccacctccgagcaacctcacatctatatccctgcgcccgcatccgagctggattctagcagtactacgaagggcatactctttgtcaaggagtacgtcaatgcctccgaggtatcatcaggaaaacctgtttctgcgcgctattctaacgtatcttccatcgaggactcttttgccatggagaagaagccgccttgcggctccacgccgtacagtgagaggaccactggcggcatctgtacgtattgcaatcgggagatcagagattgtcctaagattactcttgaacatctcgggatttgctgccatgagtactgtttcaaatgtggcatttgtagcaagcctatgggcgatttattggatcaaatctttatacaccgagacaccatccattgtggcaagtgctacgaaaagctgttctag

SEQ ID NO: 27153 - DNA, 1899 bp, Artificial Sequence
  Description of Artificial Sequence: Synthetic coding sequence
atgcagcgggaggagggcttcaacaccaagatggccgacggccccgacgagtacgataccgaggcggggtgcgtgccactgctccatcctgaggagattaaaccccagtcccactataaccacggatacggagagccactgggccgtaagacacacatcgacgactactccacctgggatatcgttaaagccacccaatacgggatctatgaacgatgccgtgaactcgtggaggccggctacgatgtccgccagccagataaagaaaatgtaacactgctgcattgggcagccatcaacaaccgcatagacctggtcaagtattacatttctaagggtgctatcgtggaccagctgggcggtgatctcaatagcacgcccttgcattgggccacaagacaaggccacctgagcatggtagtgcagcttatgaagtatggtgccgacccatcattgattgatggagagggatgttcttgtattcatctcgccgcacagttcggccatacttctattgtggcctacctcatagctaagggccaagacgtggacatgatggaccaaaatgggatgacacctctcatgtgggcagcttacagaactcactcagttgacccaacaagattactcctgacgttcaacgtgtctgtgaatcttggtgataaatatcataagaataccgcattgcactgggccgtacttgctggcaacaccacggtcatttcccttctgttagaggccggagcaaatgtcgatgcccagaatatcaagggtgagtcagccctggatctggctaaacagcgcaagaacgtatggatgattaaccatcttcaggaggcgagacaggctaaagggtatgataatccctctttcctacggaaactgaaggctgacaaagaatttcggcagaaggtaatgcttggcactccctttctcgtcatctggttagtgggttttatcgcagacctaaacatcgattcctggctgattaagggcctcatgtacgggggagtttgggcaactgtccagtttctgagcaaatcatttttcgaccattccatgcactccgcccttcctcttggtatctaccttgccacaaagttctggatgtacgtcacttggtttttttggttctggaacgacttgaatttcctattcatccatctcccattcctggccaatagcgtggccctgttctataattttgggaaatcgtggaagtccgacccaggaattatcaaggccaccgaggaacagaagaaaaagactattgtggaactagcagagactggctccttggacctgtccatcttctgttcgacttgtctgatccgaaagcctgtgaggagcaagcattgtggagtttgcaaccgatgtatcgccaagtttgatcaccactgcccttgggtaggcaattgtgtgggagccgggaatcataggtactttatgggttacctgttctttctgctttttatgatttgttggatgatctacggctgcattagctattgggggctccactgtgagacaacatacaccaaggacgggttttggacttatatcacacaaattgccacatgttcgccgtggatgttctggatgtttctgaattctgttttccatttcatgtgggtggccgttctattaatgtgtcagatgtaccagatctcgtgtctgggcatcacgacaaacgaacgcatgaacgcgcgacggtacaagcactttaaggttaccactacatcaattgaatctcccttcaaccatggctgcgtgcgcaacatcattgatttctttgaattcaggtgttgtggattgttccgacctgtgatcgtcgattggactcgtcagtacactattgaatatgaccagatctcaggatctggctaccaattagtctag

SEQ ID NO: 27154 - DNA, 651 bp, Artificial Sequence
  Description of Artificial Sequence: Synthetic coding sequence
atgagcaccatccccaagcgggccgtgtgccccttcagcacccagagatacggaatttacgaaaggtgtcgagagttagtcgaagccggctatgatgtgcgccagccggataaggagaatgtaacattacttcattgggccgccattaataaccggatcgacttagtaaagtactatatttccaaaggtgccattgtagatcaactgggcggggatctcaattcaactcctctgcactgggcaactcggcaaggtcatctgagcatggttgttcagctgatgaagtatggcgccgaccccagcctgattgatggagagggatgctcctgcatacacttggccgctcagtttgggcacacctctatcgtcgcctacttgatcgccaagggtcaagacgtggacatgatggaccagaatggtatgacaccactgatgtgggccgcttaccgtacacattcagttgatcccacaagacttctgctgaccttcaacgttagtgtcaatctcggcgataagtaccataaaaacacggcactccactgggctgtcttggctgggaacaccacagtgatttccttacttctagaagctggagccaacgtggatgcccagaatatcaaggcaatcctgaggtgtcacatggctctgtag

SEQ ID NO: 27155 - DNA, 1899 bp, Artificial Sequence
  Description of Artificial Sequence: Synthetic coding sequence
atgcagcgggaggagggcttcaacaccaagatggccgacggccccgatgaatatgacactgaagccgggtgtgtcccactgctgcaccccgaggaaatcaagcctcagtcccactataaccatgggtatggcgagcctctcggtcgcaagacccacatagacgactacagtacgtgggatatcgtaaaggctacccagtacgggatatatgaacggtgtcgagaacttgtcgaggctggatacgacgtgcggcaaccagacaaggaaaacgtaacactcctacactgggctgccattaacaacaggattgacctggtgaaatattatatatccaagggcgcgatcgttgaccagctggggggggacctgaacagcaccccactgcactgggcgaccagacaggggcatctgagtatggtagtgcaacttatgaagtacggggccgatccatccttgattgatggggaagggtgcagctgcattcacctcgccgcccagttcggccacaccagtatcgttgcgtacctgattgccaagggacaagacgtggatatgatggaccagaacggtatgacccccctgatgtgggccgcgtatcgcacacattccgtggaccctactaggctccttctaacctttaacgtgagcgtgaatctgggagacaaataccataaaaataccgcattacactgggctgtgctggccggaaatacaactgtgatctctctgctactggaagccggggcaaacgtggacgctcagaatatcaagggagagagcgccctggacctggcaaagcagaggaagaacgtgtggatgattaatcatcttcaggaggccaggcaagctaagggttacgataacccttcattcttgcgaaagctaaaggcagataaagagtttcggcagaaagtgatgctcggtacaccattcttagtgatatggctagtcgggttcatcgccgaccttaacattgatagctggttaataaagggactaatgtatgggggcgtttgggccacggtgcagtttttgtctaaatcattcttcgaccactccatgcactccgccctgccactgggaatctacctagcgacgaagttttggatgtacgtgacgtggtttttctggttctggaacgaccttaatttcctttttattcatctaccctttcttgccaattctgtggcactcttttataatttcgggaaaagttggaagtccgatcccgggatcatcaaagccacagaagagcagaaaaaaaaaactatcgtcgaactcgccgagaccggttccctcgacctttccatattctgttcaacctgtttgataagaaagcctgtgcgcagcaaacactgcggagtttgcaatcgatgcatagcaaaatttgaccaccattgtccctgggttggtaactgtgtgggtgctgggaaccaccgctacttcatgggctatctctttttcctcctattcatgatttgttggatgatttacggctgtatttcctactggggtctccattgcgaaactacatataccaaggatggcttttggacatatataacacagattgccacctgcagcccttggatgttctggatgttcctgaacagtgttttccacttcatgtgggtggccgtgctgctgatgtgtcagatgtatcagatttcctgccttggcatcacaacaaacgaaaggatgaacgctagacggtataagcactttaaagttaccactacctccatagaaagcccttttaatcacggatgtgtacgcaacatcatcgatttttttgagttccgctgttgcggactgttccgtccagtaattgtcgattggacacgccagtacaccatcgagtatgatcagatatccgggtccggctaccagctggtatag

SEQ ID NO: 27156 - DNA, 2667 bp, Artificial Sequence
  Description of Artificial Sequence: Synthetic coding sequence
atgctgagtcggctgtttcggatgcatggactttttgtagccagtcatccttgggaagtcatcgtgggaaccgttacattgaccatttgtatgatgagcatgaacatgttcaccggaaacaacaaaatctgtggatggaactacgagtgcccaaaatttgaagaggatgttcttagctccgacatcattatcctgactatcacacgctgtatagccattctctacatctattttcaatttcagaacttaagacagcttggcagcaagtatattctggggattgctggcttgttcaccattttttcctcctttgtgtttagtaccgtcgtaatccatttcctggataaggagttaaccggtctaaacgaagccctgccattcttcctcctgctcattgatctcagtcgggcttccacactggctaagtttgccctgagctccaattcacaggatgaggttcgggaaaacattgccagggggatggccatcctgggcccaacttttactctggatgccctagtggagtgcctggttataggggtcgggactatgtcaggagtccgccagttggaaatcatgtgctgtttcggctgcatgtccgtgttggctaattacttcgtgttcatgacttttttccctgcctgcgtctccctggtgctggaattgtcaagagagtctagggagggaaggcccatatggcagttgtcacactttgcacgcgtcctggaggaagaggaaaacaagcccaatccagtgacccagcgagtgaagatgattatgagtttgggactcgtattagtgcacgcgcatagcagatggatcgccgacccaagcccacaaaactcgacagctgatacgtcaaaagtctctctgggtctcgacgaaaatgtgtctaagagaatcgagccctccgttagtctttggcagttctacctctccaagatgatatcaatggacattgagcaggtgatcacactctcactagccctactcctggcagtgaaatacattttttttgagcagaccgaaaccgaatcaacgttgtcacttaaaaacccaatcacctcccctgttgtcacccagaagaaggtgccagacaactgctgccgccgagagcccatgctggtgagaaacaaccagaaatgtgattcagtagaggaggagacggggatcaatagggagaggaaagtagaggtaataaagcccctagtcgcagagactgatactccaaatcgggcaacattcgtggtcggaaactcatccctccttgatacatcttctgtgcttgtcacgcaggagcccgaaatcgagctgccgcgagagcctagacctaatgaggaatgcctgcagattctgggtaatgctgagaaaggagctaaatttctaagtgatgccgaaattattcaactcgtcaatgccaaacacattccagcgtacaaactggagacactgatggaaacacatgagaggggcgtgagcattcgacgccaattgctctcaaaaaagctttctgagcctagctctctgcagtatttaccttatagggactacaattattcactcgtgatgggtgcttgttgtgaaaacgtgatagggtacatgcccatccccgtaggcgtcgctggaccactgtgcctggatgagaaggagttccaggtaccaatggccacaacggaggggtgccttgtagcatcaaccaatagaggttgtagagcaatcgggcttgggggtggggctagcagccgcgtattggcagatggtatgacaagggggccagtggtgagactcccacgggcttgtgactccgccgaggtgaaagcctggctggaaacctctgagggattcgctgtgatcaaggaagcctttgattccacgtctagatttgctaggctgcagaagctgcatacatccatcgcagggcgaaatctgtatattcggttccagtcacggagcggcgacgccatggggatgaacatgatttcaaagggaacggagaaggccctatcaaaattgcatgagtactttcctgaaatgcagattcttgccgtgagcggaaactactgtacggacaagaagcccgctgcaatcaactggatcgagggcaggggcaagagcgtcgtgtgcgaagctgtgattcccgctaaagtagtccgcgaggttctgaaaactaccaccgaggctatgattgaagtgaatatcaacaagaatctggtgggctctgccatggctggaagcatcggaggctacaatgcacatgcagcaaatatagtaactgccatatatattgcatgcggtcaagacgccgcacagaatgtgggtagctctaactgtatcacactaatggaggcgtcaggtcctacaaatgaggatctctacatttcatgcaccatgccatctattgagatcgggactgttgggggtggtacgaacctgcttccacagcaggcctgtctgcaaatgctgggggttcagggagcctgtaaagataaccccggtgagaacgcgagacagctcgcacgcatcgtttgtggcacagtaatggcaggagagctgagtctcatggcagcgttagctgcaggtcatctggtgaaaagtcacatgattcataatagatcaaagatcaacttgcaagatctacagggtgcctgcacgaagaaaacggcctag

SEQ ID NO: 27157 - DNA, 2508 bp, Artificial Sequence
  Description of Artificial Sequence: Synthetic coding sequence
atgctgtctagactgttcagaatgcatggcctgtttgttgcctcccacccctgggaagtgattgtcggtacggttaccttaaccatctgcatgatgtccatgaacatgttcacaggcaacaataaaatctgtggctggaattatgagtgtccaaagtttgaggaagatgtcctgtccagcgatataatcattctgactattaccaggtgcatcgcaatcctgtatatttattttcagtttcagaatctgaggcagctggggtccaagtacattttagggattgccggtttgttcactatttttagcagctttgtgtttagtacagtcgtgatccacttcttggataaggagctcactggcctgaacgaggctctgcccttctttctcctcctgatcgacctgtcccgggcatccacattggccaaattcgcgcttagctccaattcccaggacgaggttcgcgaaaatattgccagaggaatggccatcctgggcccaacctttaccctggacgcccttgttgaatgcctggtgattggcgtcggcacaatgtcaggagttcggcagttagagatcatgtgttgcttcggctgcatgagtgtcctggcgaactacttcgttttcatgactttttttcccgcatgtgtcagtcttgtgctcgaactgtcccgggagagtcgcgagggcagacccatctggcagttaagtcacttcgccagagtcctcgaggaagaggaaaacaagcctaatcctgtcactcaaagggtcaagatgatcatgagtctgggactggtgctcgtgcacgcccactcaaggtggatcgcagatccctcacctcagaattctactgctgatacttctaaagtgtctcttggccttgatgaaaatgtgtccaaacgaatcgagccttccgtaagcctctggcagttctatctgtccaagatgatcagcatggacattgagcaggtcatcactctgagcctggcgctgttgctggccgttaaatacatctttttcgaacagacggagactgagagcacactgtcattaaaaaaccctatcacttccccagtggtgacacagaaaaaggtacctgataactgttgcagaagagagcccatgctggtccggaacaatcagaaatgtgattcggtggaggaggaaacaggcattaatcgcgagaggaaggtggaggttatcaagcctttggttgccgaaactgatactcctaatcgagcaactttcgtggtcggtaactcgtccctgctggacactagttcagtcctcgttacacaggagcccgaaattgagctcccacgagaacccaggcctaacgaagaatgtctccagatccttggaaacgccgagaagggcgctaaatttctgtcggacgctgaaatcattcagctggtaaacgccaagcatatccccgcatacaaactggagactcttatggaaacccacgagcgcggagtgagcattagaagacagttactgagtaaaaagttatccgaacccagctctctacagtacctcccctatagagactataattattcgctactcgggggtggggcatcttcacgcgttctggccgatggaatgactcggggacccgtggtgcggctgccacgcgcttgtgacagcgccgaagtgaaggcttggttggagacgtccgagggctttgcagttataaaagaggctttcgactccacctctaggtttgcccgattgcaaaaattgcacaccagcatagcaggacggaatctgtacatccgatttcagtcacgttcaggcgacgctatgggcatgaacatgatctccaagggaactgagaaggccctctccaagctccacgagtactttcccgagatgcaaatcctggctgtatccggcaattattgcaccgataagaaacccgctgcaatcaattggattgagggccgtggaaagtcagtggtctgcgaagcggtgattcccgcaaaggtagtgcgggaggttctcaaaaccacaaccgaggccatgattgaagtgaacatcaacaagaacctggttgggagcgccatggccggaagtattggaggctacaatgctcatgctgccaacatcgtgacagccatctacatcgcctgcgggcaagatgccgctcagaacgttgggagcagcaactgtattacgctgatggaagcctctggtccaaccaacgaggacctatacatatcatgcaccatgccctctatagagattggcacagtgggcggaggcaccaaccttttgccgcaacaggcctgcttgcaaatgctgggggtgcagggtgcctgcaaggacaatcccggtgagaacgcgcgacagctggctcgtattgtgtgtgggaccgtgatggcgggagaactgtctctaatggcagcactggccgcaggccacctagtgaaatcccatatgattcataatagatcgaagattaatcttcaggatctgcagggtgcatgtacgaagaagacagcttag

SEQ ID NO: 27158 - DNA, 798 bp, Artificial Sequence
  Description of Artificial Sequence: Synthetic coding sequence
atgctcagtagactcttccggatgcacggcttgtttgtcgcctcacacccctgggaggtcatagttggcaccgttacattgaccatatgtatgatgagtatgaacatgttcacagagggaacagagaaagccttgagcaaattacatgagtatttccctgagatgcagatcctcgccgttagtggaaactactgcaccgataagaaacccgcagcaataaattggatcgagggcagaggtaagtctgttgtatgtgaagcagtcatccctgctaaagtggtgcgagaggtgctgaaaacaactaccgaagccatgattgaggtgaatatcaacaaaaacctcgttggttcagcaatggctggttctatcggcggatacaacgcacatgcagcaaacatcgtcacagccatatacattgcctgcggccaggacgccgcacaaaatgtaggaagtagcaactgcatcactctcatggaggcgtcggggcctaccaacgaggacctctatatttcctgcaccatgccgtcaattgagatcggaacagtcggcggtggaacaaatctgctcccccagcaggcctgcctacaaatgctaggcgtgcagggcgcatgcaaagataatccaggagaaaatgcacgtcagttggctaggatcgtgtgtggcacagtaatggcgggagagctgagtctgatggcagccttggcggcagggcacctcgttaagtctcacatgattcataaccgtagcaagataaacctccaggatcttcagggtgcctgtacaaagaagacagcctag

SEQ ID NO: 27159 - DNA, 57 bp, Artificial Sequence
  Description of Artificial Sequence: Synthetic coding sequence
atgctgagcagactgtttcgtatgcacgggttattcgtggcctctcacccctggtag

SEQ ID NO: 27160 - DNA, 336 bp, Artificial Sequence
  Description of Artificial Sequence: Synthetic coding sequence
atgctgagtcggttgttcaggatgcatggactgtttgtcgcatctcacccgtgggaggttatcgtcgggacagttactctcacgatctgcatgatgagcatgaacatgttcaccgggaacaacaagatctgcggatggaactatgaatgcccaaaatttgaggaagatgtgctgagctccgacattatcatacttactataacgagatgcatcgcgattctttacatttattttcagttccagaatctccgtcaattgggctctaaatacatcctaggcattgcgggactgttcacgatcttttctagcttcgtatttagcacagtggtgatctag

SEQ ID NO: 27161 - DNA, 2667 bp, Artificial Sequence
  Description of Artificial Sequence: Synthetic coding sequence
atgctgagcagactcttccgtatgcacggcctattcgtagcgtcgcatccgtgggaggtgatcgtggggaccgttacgctgacaatctgcatgatgtctatgaacatgttcactgggaataacaagatctgcggatggaactatgaatgtccgaagttcgaagaagatgtgcttagttcagatataattatcctcactataacgagatgcatcgcgattctgtatatttattttcagttccagaatcttagacaactaggcagtaagtatatccttggaatcgcaggattatttactatcttttcctctttcgttttctctacagtggttattcacttcttggacaaggaattaacggggttgaatgaggccctcccattcttcctcttgctgattgacctaagtagagctagcaccctcgcgaagtttgccctcagttctaactcccaggacgaggtgagggaaaacatagcccgaggtatggctatcctgggacctacatttaccctggatgctctggtcgaatgtttggtgatcggagtcgggacgatgtccggagtcagacagttggaaatcatgtgctgtttcggctgcatgtctgtgcttgctaattactttgtgtttatgacattttttccagcctgcgtgtcgctagtgctggaactgtctagggagagcagggagggaagacccatttggcagctgtcccactttgcccgtgtgttggaagaggaggagaacaagcccaatcccgtaacgcagcgagttaagatgatcatgtcattagggctagtgctggtccacgcccatagcaggtggatcgcagatccctcaccccagaacagtactgctgacactagcaaggtcagtcttggactggacgagaacgtttctaagaggatcgagcccagcgtttcattgtggcaattttatctgagtaagatgatcagcatggatattgagcaagtcattaccctgagcctggctctactattggctgtcaagtacattttctttgaacaaaccgaaactgagagcacgttaagcctcaagaatccaattacaagtccggtagtgactcagaaaaaagtgcccgataactgttgccgcagagaaccaatgttagtacgtaataatcagaaatgcgacagcgttgaggaagaaacgggaatcaacagggaacgaaaagtggaagtcatcaaacccctggtagcagagacagacacacctaacagagcgacgttcgtcgtggggaacagttccctcttggacacctcatcggtactggttacccaagaacccgagatagaactaccaagagagcccaggccgaatgaagaatgcttgcagatcctggggaatgccgagaagggcgcaaaattcttgtccgacgccgaaatcatccagctcgtgaatgccaaacatattccggcatataagcttgagacccttatggaaacgcacgagagaggcgtaagcataagaaggcagctactgagcaagaagctgtccgaaccaagttccctacagtacctgccttatcgggattataattattcactggtaatgggcgcatgctgtgaaaacgtgatcggatatatgccaatcccggtgggggtggcgggtcctctgtgcttggacgagaaggaatttcaggtgccgatggccactactgagggatgcctggttgccagtaccaataggggatgtcgtgcaattggtctgggaggtggggcttcaagtagggtactggcggatgggatgacacgcggtcctgtggtgagactacccagagcatgtgattccgcggaagtgaaggcctggttggagacctctgagggctttgctgtgatcaaggaggctttcgatagtacctcccgcttcgccaggctccaaaaactgcacaccagtatagccggtcgcaatctgtacatcagattccaatccaggagcggcgacgccatggggatgaacatgattagcaagggtactgagaaggccctcagtaagctgcatgaatattttcccgagatgcagattctagcggttagcgggaattattgtaccgataagaaacccgctgctattaattggattgagggccgaggaaagagcgtggtatgtgaagccgtgataccagcaaaggtggtgcgggaggtcctgaaaacgactaccgaggccatgatcgaggttaacattaacaaaaatctggtgggctcggccatggcaggcagcatcggcggatacaacgctcatgccgcaaacatcgtgacagctatttatattgcctgtggccaagacgccgctcagaatgtggggagctccaattgcattacactgatggaggcctccggccctaccaatgaggacctgtatatctcttgtactatgcctagcatcgagatcggcacagtcggaggcggaacaaacctcctgccgcagcaggcgtgcttacagatgttgggcgttcaaggagcatgcaaggacaatcctggagagaacgccaggcaactggccaggatagtttgcggaactgtcatggccggagaattgtcactcatggccgcactggccgcaggtcacttggtaaagtcacacatgattcataacaggtcaaaaattaacctccaggacctacagggcgcatgcacaaagaaaacagcctag

SEQ ID NO: 27162 - DNA, 2460 bp, Artificial Sequence
  Description of Artificial Sequence: Synthetic coding sequence
atgcattcccaccctgtgtatttgcttcccgtgccagagtttaccagcacgtggattaaaatttacttcggctactgctggccatttcacaatttcctgaagttctgtatccagtattcctgtcattccctgctcaggcagcgcatagataggctggaagaggcactcccctttttcttacttctcatagaccttagtagggcatccactctcgctaaatttgcattgagttctaattcgcaggatgaggtccgagagaacattgcgaggggaatggcgattctgggaccaacttttactctcgacgccctcgtagaatgcctggtgatcggcgtaggcaccatgagcggtgttcgccagttggagataatgtgttgctttggatgcatgtccgtcctcgctaattattttgtgttcatgacattttttccggcttgcgtttcactggtgttagagctcagcagggagagcagagaggggcgacctatatggcaactctcccacttcgccagggtgctcgaggaagaagagaataaacccaatcctgtcacccaacgcgtcaagatgatcatgtctcttggcctggtcctcgtgcacgcccactcaaggtggatagccgacccatcgccacaaaattcaacagccgataccagtaaggtatctttgggacttgatgagaatgtgagcaagcgcatcgaaccctctgtgtctctttggcagttctacttaagcaagatgatctccatggatatcgagcaggttattacactctcactcgcattgctgttagcagtgaagtacattttctttgagcagactgaaactgagtctactttgagcctgaagaaccccattactagcccagtggtcacccaaaaaaaggtgcccgataactgttgccgtcgggagccaatgttagtccgtaataaccagaagtgcgacagtgtggaagaagagactggcattaacagagagcgaaaagtggaagttatcaaacctctcgttgccgagaccgatacacccaatagagctacatttgttgtgggaaacagctcccttttagatactagctcagtgttagtgacacaggagccagagatcgagctccctagagagcctaggccaaacgaagagtgcctccaaatactgggtaacgcggagaaaggcgctaagtttttatcagatgcagaaataatccagctcgtgaatgccaagcatatcccagcttataagctggagacacttatggagacccacgaacgaggcgtgtccatcagacgtcaacttctgagcaagaagttgagcgagccttcctccctccagtatctgccctaccgagactataattatagccttgtgatgggcgcttgttgcgagaacgtgatcgggtacatgcctattcctgttggtgttgccggaccgctttgcctggacgagaaggagtttcaggtaccaatggcaacaaccgaagggtgcctggtggcttcaacaaatagaggttgcagagccatcggactcggtggaggtgcctcctcaagggtgctggcagatgggatgactaggggtccagtggtcagactccctcgagcatgcgatagcgccgaggtgaaagcatggttggagacatctgaaggcttcgcagtcatcaaagaagccttcgattctacttccaggtttgcaagactgcaaaagctccacacgtccatcgcagggaggaatttgtacattcgctttcagtcccgaagtggcgacgccatgggaatgaacatgatttctaaaggtacagaaaaagctttgagcaaactgcacgagtatttcccggagatgcaaatactagccgtcagtggcaactactgcacagataagaagcctgcggctattaactggatcgaagggagggggaaatctgtcgtctgtgaggctgtgatccccgcaaaggtggtgagagaagtgctgaaaacaactaccgaggctatgatcgaggtgaatattaataaaaacttagtgggctcagcaatggccggtagcatagggggttacaatgcacatgctgcaaatatcgtcactgcaatttatatcgcctgtggccaagatgcagcccaaaatgtgggtagctctaactgtatcacactgatggaggcatcaggcccaacaaacgaggacctatatatttcctgcactatgccctctatcgaaatcggcacagttggtggtggcacgaatctactaccacagcaggcttgtttgcaaatgttaggtgtgcagggcgcatgcaaagacaacccgggagagaacgcccgacagctggccaggattgtatgcggcaccgtgatggccggtgaactgtccctgatggccgcactggctgccggacacctagttaagtctcacatgattcacaacaggtcaaaaattaatcttcaggatctgcagggagcctgcaccaagaaaacagcttag

SEQ ID NO: 27163 - DNA, 1671 bp, Artificial Sequence
  Description of Artificial Sequence: Synthetic coding sequence
atggccaggaccacttcacagctttacgacgccgtgccaattcagtcgtccgtggtcctatgcagctgtccctcgccatctatggtgcgaactcagactgagtcctcaactccaccaggcatcccgggaggttcacgacaggggccagccatggatgggacggccgctgagcccaggcccggtgcaggcagcttacagcatgcacaaccaccacctcagccacgaaaaaagagacctgaagatttcaagttcggtaaaatcctgggagagggttcattctcgacagtggttctcgcgagagaactggcaacctccagagaatatgcgatcaagatactcgaaaagcggcacattattaaggaaaataaagtgccctacgtcacgagagagcgagacgtgatgtctcggttggatcatccgttcttcgtgaagttgtacttcacctttcaggacgatgaaaagctctacttcggcttgtcctacgccaagaatggcgagctgctgaaatacatccggaagataggcagcttcgatgaaacatgcactaggttctacacggctgaaattgtcagcgcgttggaatatctccacggcaagggaatcatccaccgcgacctcaagccagaaaatatcctgcttaatgaggacatgcatatacaaatcacggattttggcacggctaaggtattaagccccgagtctaagcaggcgagggcaaattcattcgtcggcacggcccagtatgtatcccctgagttgcttacggagaaaagtgcttgtaagtcttcagatttgtgggctttaggctgcatcatctaccaactagttgctggactgccaccattcagagccggaaacgaatacttgatttttcaaaaaatcatcaagctggagtacgacttccccgaaaaattcttccctaaagcaagggatctggtggaaaaacttcttgtgttggatgcaacgaagagactgggttgtgaagaaatggaggggtatgggccactcaaagctcaccctttctttgagtcggtgacgtgggagaatctgcatcagcagacaccgccaaagctaactgcatacctacctgctatgtccgaggatgacgaggattgctatggaaattacgacaacttgctctcccagttcggatgtatgcaggtgagtagcagcagctcttcccactcactctccgcttctgatactgggctgccacaacgctctgggagcaatattgaacaatacattcatgacctggactcaaatagtttcgagctggatctgcaattttcggaggacgagaagcgtttgcttctggagaaacaggccggtggcaacccttggcatcagtttgtggagaataatctgattttaaagatggggccagtggacaaacgaaagggactatttgcaagacgaagacagctcctgctaaccgaggggcctcacctgtactacgtcgaccctgtgaacaaggtcctgaagggggaaattccatggtcccaagagctgcggccagaagctaaaaatttcaaaacattcttcgtgcatacacctaatcgcacttattatttgatggacccttccgggaacgcccacaaatggtgccgaaaaatccaagaagtgtggcgacagcggtatcaatcgcaccccgacgcggctgtgcagtag

SEQ ID NO: 27164 - DNA, 1599 bp, Artificial Sequence
  Description of Artificial Sequence: Synthetic coding sequence
atggcacggaccacgtcccagctatacgacgccgtccctattcagtcaagcgtggtgctgtgttcttgcccgtcccccagtatggttagaactcagacagaatcctcaacccctccaggtataccaggcggttcacgccagggtccggcaatggacggcacggcggcagaaccacggcctggagctggaagcttgcaacacgcgcaacctcccccacagccgcgaaagaaacgtccggaggactttaagttcggcaaaatattaggcgagggcagcttttctaccgttgttctcgcgagggaactcgccacaagcagagaatacgccatcaaaattttagagaagcgtcacataattaaggagaacaaagtgccttatgtaaccagagaaagggacgttatgtcaagactggatcatcccttcttcgtgaaactttactttacttttcaagacgacgaaaagctgtacttcgggctgagctacgcaaagaatggagaactgctcaaatatattcggaagattgggtctttcgatgaaacttgtacaaggttctataccgcagagatcgtctcggctctcgaatacctccatggcaaggggattatccaccgcgatctgaagcccgaaaatatcctcctcaacgaagacatgcatatccagatcaccgacttcggcacggctaaggtcttatcacccgaaagcaagcagggggtctctgacctctgggccttgggttgtatcatttatcagctcgtcgctggcctccccccatttcgtgcgggtaacgagtatctcatcttccagaaaatcattaagctcgagtatgacttccccgaaaagttttttcccaaagccagggacctcgtcgaaaagctgttggtcctagatgctactaagaggctgggatgtgaagagatggaggggtacggcccactaaaagcccacccattcttcgaaagtgtaacctgggaaaatctgcaccagcagacaccacctaagttaaccgcgtacctaccagccatgtccgaggacgacgaggactgctatggcaattacgacaacctcctgtcccaatttgggtgcatgcaggtaagtagctccagctcttcgcacagcctgtccgccagcgacactggtttgccgcaaagaagcgggagtaacatcgagcagtatatccatgacctggacagcaactcttttgaattagatctgcagttcagcgaagatgaaaaacggctgctgttagagaagcaggcagggggtaacccatggcatcaatttgtggagaacaacctcattcttaaaatgggccctgtggataagcgaaagggcctgttcgcacggagacgccagcttctgctgactgagggaccacatctttactacgtggaccctgtgaacaaggtgttaaagggtgaaataccctggtctcaggagctacggcctgaggctaagaactttaaaacattttttgtgcacacaccaaatagaacctactacttaatggatcctagcgggaatgcccataaatggtgtaggaaaatacaggaagtttggaggcagaggtaccagagccacccagatgcagcagtgcagtag

SEQ ID NO: 27165 - DNA, 1479 bp, Artificial Sequence
  Description of Artificial Sequence: Synthetic coding sequence
cgcgctcaggacgagggtgggcactgttggggctccgcctccggacggaggacattacggaggcgaagggcagctcagagatgtggtggcggtgcacgagccgatgctggaccaatggctcggacaactagccagttgtatgatgcggtccccatacagtcctcagtcgtgctgtgcagttgtccctccccaagcatggtgagaacccagactgaatcatctactcctcctggcattccaggaggtagtcgacaggggccagcaatggacggtacagctgccgagcccagacccggagccggttccttacagcacgctcagcctcctcctcagcctcgcaagaaaagacccgaggatttcaaattcggaaagatccttggggaggggtcctttagcaccgtcgtgctagccagagaacttgccacatctagagaatatgcaatcaaaattctagagaaacgccatatcataaaggagaataaggtaccctacgtcacaagggagagggatgtaatgtcgcggttggatcaccccttttttgtcaaactttacttcacttttcaggatgatgagaagttatactttggcctgagttacgcgaagaatggggagctgcttaagtacatccggaagattgggagcttcgacgagacgtgcacgcgtttttacacagccgagattgtcagcgcattggagtatctgcacgggaagggaatcatccatcgcgatttgaaaccagagaatatcttgcttaacgaggacatgcacatccagatcactgattttggcacggcgaaagtgctgagtcccgaatccaagcaggcacgggctaattcattcgtggggactgctcaatatgtgtctcctgaactcctcacagagaagagcgcttgtaaaagttctgatctgtgggcactgggctgcatcatctaccaattggtggctggcttacctccttttcgagctggtaatgaataccttatctttcagaaaatcatcaagttggaatatgatttccccgaaaagtttttccctaaagccagagacctggtcgaaaagttactggtgctggacgctactaaacggcttggctgcgaagagatggaagggtatggtcctttgaaagcacatccctttttcgaatctgtgacttgggaaaacctccaccaacagactcccccaaaacttacggcttacctgcctgccatgagcgaggatgacgaagattgttacggaaactatgacaacctcctgtcacagttcggttgcatgcaggtgtcctcctcatccagctcccactccctgtccgcctccgacacaggacttcctcagcgaagtgggtccaatatcgaacagtacatccatgacctggatagtaattcatttgaattagacttacagttttctgaggacgagaaacgcttgctcctggaaaaacaggcaggaggaaacccttgcttgacgggtcggataatatag

SEQ ID NO: 27166 - DNA, 1290 bp, Artificial Sequence
  Description of Artificial Sequence: Synthetic coding sequence
atggcacgaactaccagccagctctacgacgcagtccccatccagagcagcgttgtcctttgtagttgccccagcccgtcaatggtgcgtacgcagactgaaagttcaacccctcctggcattcccggaggctccagacaaggacctgccatggacggaactgccgcagaaccacgaccaggcgcaggctccctccagcatgcgcagcctccgcctcagcccagaaaaaaaaggcctgaagacttcaagtttgggaaaatcctcggggagggctcattctctacagttgtgctggcacgtgaactagctacgtccagggagtacgcaaccagggccaattccttcgtggggaccgcccagtacgtctctcctgagctgctcactgaaaagagtgcatgtaagagttccgatttgtgggccttagggtgtatcatctaccagctcgtcgcaggacttcccccatttcgtgccggtaacgaataccttatcttccagaagatcatcaaactggagtatgatttccctgaaaagtttttccccaaagctcgggatttagtagaaaagctgcttgtgctagacgcaaccaaaaggcttggctgcgaggagatggagggatatggcccactgaaagcacaccctttttttgagtctgtgacctgggagaatctgcaccagcaaacacctccaaagttaaccgcttacttaccagccatgagtgaggatgatgaagattgctacggaaattatgacaacctgctgtctcagttcggctgtatgcaggtttctagcagctcctcgtcacattctctgagtgcctccgacaccgggttgccccagcggagcgggagtaacatcgagcagtatatccacgaccttgatagcaactccttcgaattggacctgcagtttagtgaggacgaaaaacgattacttctcgagaagcaggcaggtggaaatccttggcaccagttcgtcgaaaacaacctgattctaaagatggggccagtggacaagcggaagggcttgttcgcgagaagaagacaactgctgctgactgagggccctcatctctactatgttgaccccgtgaataaggtgcttaagggggagataccctggtctcaggaactgcgacccgaagcgaagaactttaagacctttttcgttcatacacccaacaggacctactacctgatggaccccagcgggaacgcgcataagtggtgtagaaaaattcaagaggtctggcgccagcgttaccagtcacatccagacgccgctgtacagtag

SEQ ID NO: 27167 - DNA, 5121 bp, Artificial Sequence
  Description of Artificial Sequence: Synthetic coding sequence
atgggagttcccaaattctacaggtggatttctgagcgatatccgtgcctgtcagaagttgtgaaagagcaccaaatccccgagtttgataatttgtatcttgacatgaatggaatcatacaccaatgttcgcatcccaatgacgatgacgtgcacttccggatctctgacgataagattttcactgacattttccattacctcgaagtcttgttcagaatcataaaaccacgcaaggtctttttcatggctgtggatggcgtggcgccaagagctaagatgaaccagcagcgcggacgaagatttcggtccgccaaggaagccgaggacaaaattaaaaaggccattgagaaaggggagacactgccaacagaagcaaggtttgattctaactgcataaccccgggaactgaattcatggctcggcttcacgagcatctcaaatacttcgtgaatatgaagatttccacagacaaatcctggcagggcgtgaccatctacttcagcggacatgaaacacctggggagggtgaacataaaataatggagttcatccgtagtgagaaggcgaagccggatcacgatcccaacacacggcattgtctctatggactcgacgcagatctgatcatgctgggcctgacatcccacgaggcgcacttctcactcctcagggaggaggttagatttggagggaaaaagacccagagggtctgcgcaccagaagagactacatttcatcttctgcatcttagtctaatgcgcgaatatatcgattatgaatttagcgtgctcaaggaaaagatcactttcaagtatgacatcgaacgcattatcgacgattggatccttatgggttttttagtcgggaacgattttattcctcacctgccacatctacatatcaaccacgacgcactaccactgctttacggtacctacgtaaccattctacccgagctgggagggtacatcaatgagtctggacacctcaaccttccaaggtttgaaaagtaccttgtaaaactttcagattttgaccgggaacatttctctgaagtgttcgtggatctaaagtggttcgagagcaaggtgggtaataaatatctcaacgaagcagcaggcgtggcagccgaagaggccagaaactataaggagaagaaaaaattgaaaggacaagaaaactccctttgctggaccgcccttgataagaacgagggggaaatgatcacaagtaaggacaatttggaggacgagacggaggatgacgatctgtttgaaaccgagttcagacagtataagcggacctattacatgactaaaatgggtgtagacgttgtttcagacgactttctggctgatcaggctgcttgttacgttcaggcaatccagtggatactgcattactactatcacggggtgcagagctggtcatggtattatccgtaccactacgcccctttcctctcagatatccacaatatcagcaccctgaagatccacttcgagctcggcaaacccttcaagccatttgaacaattgctggcggtgctccccgctgcttcaaaaaatctcttacccgcttgctaccaacatcttatgacaaacgaagacagtcctataatcgagtattaccccccagactttaagacggatctcaacggaaaacaacaagaatgggaagccgtggtgttgattcctttcatcgacgagaaacggttattagaggctatggagacatgtaatcattcactgaagaaagaggaacgcaagaggaatcagcacagcgagtgccttatgtgttggtacgatcgggacaccgaatttatttaccctagcccctggccggagaaattcccggcaatagaacgttgctgcaccaggtacaaaattatcagtctcgatgcttggcgagtcgacattaacaagaacaaaataaccaggattgaccagaaagccctctacttctgcggcttcccaactctgaaacatattcggcataaattcttcctgaaaaagagcggggtccaggtgtttcagcagagctcccggggagaaaacatgatgctggagatcctcgtggatgcagagtctgatgaattgacagttgagaatgtggcaagttcagtgcttggaaagtcagtctttgttaactggccgcacctggaagaagctcgcgtcgtagctgtgtccgacggcgagactaagttttatctggaggaacctcctggtacacaaaaactgtattcagggagaacagctccgccttcgaaagtggtgcatctcggtgacaaggaacagtccaattgggcaaaggaggttcagggcatcagtgaacattatcttcgccgaaaaggaataattattaacgaaaccagcgcggtcgtctatgcccagttactgaccggtcggaagtatcagataaatcagaatggagaagttcgactggagaaacagtggagtaaacaggttgtcccatttgtctaccaaaccatcgtgaaagatatccgagctttcgattcacgcttcagcaacataaaaaccttggacgacttattccccctcagatcaatggtcttcatgctcggaactccgtattacgggtgtactggggaggtacaggactctggcgacgtcataactgaaggacgtatcagggtcatttttagcatcccctgtgaaccgaacttagacgctcttattcagaatcagcacaagtatagcatcaagtataacccagggtatgtgctggcctctagactgggtgtgagcggttaccttgtcagcagatttaccgggtccatatttatcggacggggttcaaggcgcaatccgcacggagaccacaaagccaacgtgggattgaacctcaagtttaacaagaaaaatgaagaagtccccggttacaccaagaaggtcggtagtgagtggatgtactcctcagcagccgaacagctgctggcagaatatctggaaagagccccagagctatttagctacatcgccaagaatagccaggaagatgtcttttacgaagatgatatctggccgggagaaaatgaaaatggcgcagaaaaagtgcaggaaattattacgtggctgaaaggccacccggtgagcacactgtccaggagtagctgcgatctgcagattctagacgctgcaattgtggaaaaaatagaagaggaggttgaaaaatgcaaacagaggaagaataacaagaaagttcgtgtgacagtgaaaccccatttgctgtatagaccgctggaacagcagcacggtgttatcccagatcgcgatgcggagttctgtttatttgaccgagtggtcaatgtaagggagaacttctcagtgcctgttggactgagaggtacgataatcggcatcaaaggcgctaatcgcgaagctgatgtcctctttgaagtgctgtttgacgaggagtttcctggtggtctaaccataagatgttcccctggaaggggctatcgactcccgacgagtgccctggtcaatctgagccacggctcacgatccgagacagggaaccaaaagctgactgcaatcgtgaagccccagcctgccgtccaccagcattcttcctcctctagcgtgtcctctggccatctcggtgccctgaatcacagcccacagagcctcttcgttccaacacaggtcccgaccaaggatgacgacgaattctgcaatatttggcagagcctccagggttccgggaagatgcaatattttcaacccacaattcaggaaaagggggcagtactgccccaagaaatcagccaggttaaccagcaccataagagcggctttaacgataactctgtcaagtaccagcagcgtaagcacgacccccataggaagttcaaagaggagtgcaaatccccgaaggccgagtgctggtcacagaaaatgtctaacaaacagcctaacagcggaattgagaacttcctggcctcactgaatatctctaaagaaaatgaggttcagagctctcatcacggggagcccccatctgaagaacacctctcaccacaatctttcgctatgggaacgcgaatgcttaaggagatactgaaaattgatggtagcaacaccgtcgaccacaaaaacgagatcaaacaaattgccaatgagattccagtgtctagcaatcgcagggacgaatacggcttgccaagtcagcccaaacagaataagaagcttgcttcctatatgaataagccacacagcgccaacgaatatcacaatgtgcagtccatggacaatatgtgctggcctgcacccagtcagataccacctgttagtacaccggtgacagaactgtctcggatctgctccttagttgggatgccccagcccgacttttcttttttaagaatgccacagaccatgactgtgtgtcaggtgaaattgtccaacggactccttgtccatggacctcaatgtcactctgagaatgaagcaaaggaaaaggccgctttgttcgcactgcaacagctgggaagcttgggcatgaatttcccattaccttcccaggtctttgctaattatccatcagccgtaccacccggtacaatccccccagcctttcctccccctacagggtgggaccactatggtagtaactatgccttaggggcagccaacattatgccatcgagctcccacctcttcgggagcatgccgtggggtccttctgtgcctgtgcctggaaaacctttccaccacaccttgtacagtgggaccatgcctatggcaggcggaatccccggaggggtgcacaaccagtttataccactgcaggtgaccaaaaagcgggtggcaaacaaaaagaattttgaaaacaaagaagcacagagctctcaggctacgccagtgcagacaagccaacccgatagttccaatattgtgaaggtcagccctcgggaatcttcttctgcttctctcaaaagttccccaatcgctcagccagctagctcctttcaggtcgagactgcttcccaaggccacagcattagccatcacaagtccactcccatctctagctcaagacgcaaatctcgcaagctcgccgtcaattttggcgttagcaaaccgtctgagtac

SEQ ID NO: 27168 - DNA, 5085 bp, Artificial Sequence
  Description of Artificial Sequence: Synthetic coding sequence
atgggggtccctaaattctacaggtggatctccgagcgctacccttgtctcagtgaagtcgtgaaggaacaccagattcctgagtttgacaacctctacctggacatgaacgggattattcaccagtgctcccaccccaatgatgacgacgtgcacttccgaatctcagacgataagatcttcacagacatcttccactacctagaggtgctgtttcggatcatcaagcccaggaaagttttctttatggctgttgacggggtggctcctcgggctaagatgaaccagcaaagaggcagacggttcagatccgccaaagaagcagaggataaaatcaaaaaggccatcgagaaaggagagacactgcccacggaggcgaggttcgactcaaactgtatcacacctgggaccgagttcatggcacgcctgcacgagcatctgaaatattttgtgaacatgaagatctctaccgataagtcatggcaaggggtaaccatctacttttccggtcacgagacccccggagagggcgagcacaagatcatggagttcataaggtccgaaaaagcaaagcctgaccacgaccccaacacaagacactgcctttatgggctggacgctgacttgatcatgctgggcctgacatcacacgaagcccacttttcccttttacgagaggaagttcgcttcgggggaaaaaaaacacagagggtgtgcgccccagaggaaaccacctttcatctgctgcacctctcactcatgcgagaatatatcgactatgagttcagcgtactgaaggaaaagataacatttaaatatgatattgaacgcatcattgatgattggatcctaatgggattccttgtcggtaatgattttatcccccaccttccacacctacacatcaaccatgatgccctccccctactgtacggaacctatgtaacaatcttgccagaattgggaggttacatcaacgaatcaggacacctgaatctccctcgcttcgagaagtatctcgttaaattaagtgactttgatagggagcacttcagtgaagtgttcgtggacctcaagtggttcgaatcgaaggtgggcaataaatacctgaatgaagcggcaggcgtagctgctgaggaggctcggaactataaggagaaaaaaaagcttaagggacaggagaattccctgtgctggactgcgctcgataagaacgagggggagatgatcaccagcaaagacaatctggaagacgaaacagaggacgacgacctgtttgagaccgaattcagacaatacaaacggacttattacatgacgaaaatgggcgtggacgtagtgtctgatgatttccttgcggaccaggccgcttgttacgtgcaggctattcaatggattttgcactattactatcatggtgtacagtcctggtcctggtactatccttaccactatgcacctttcttgtccgatattcataatatttcaacactgaaaatccattttgagttgggtaagccttttaaaccattcgagcagctgctcgccgtgcttcccgctgcatcgaaaaacctcctgccagcctgctatcagcatcttatgacaaacgaggattcacccataatcgagtattacccccctgatttcaaaaccgatcttaatgggaagcagcaggaatgggaggcagtggtgctgataccatttattgacgagaaacggcttctggaggctatggaaacctgtaatcactcactgaagaaagaggaacgcaaacgtaatcagcacagcgaatgtttaatgtgctggtatgaccgcgataccgaatttatttatccctcaccgtggcccgaaaagttcccagcaatcgaacgctgctgcacccgatacaaaataatttcactggatgcatggagggtggacatcaataaaaataaaatcactcgcattgatcagaaagccctgtacttttgcggattccccaccctgaagcatatccggcataaattctttctcaagaagagcggcgttcaggtgttccagcagagctcgcggggagaaaacatgatgctagaaattctagttgatgcggaaagcgatgagttgacagtagagaacgttgcctcttccgtgctgggaaaaagcgtattcgttaactggccacatcttgaggaggctcgcgtggtcgcagtgtctgacggcgaaaccaaattttatcttgaagaaccaccaggtacccaaaagctttattcgggacgaaccgccccaccatcaaaagtggttcatctgggcgacaaagagcagtcaaattgggctaaagaagtccagggaatcagcgagcactacctgcgaagaaagggtatcattattaacgaaacgtccgccgttgtctacgcccaacttcttactggaaggaagtaccagatcaatcagaacggtgaagtgagactggagaagcaatggtctaagcaagtggtgcccttcgtgtaccagactatcgtgaaggatattcgagctttcgacagtcgattttccaatatcaaaaccctggacgatctgttcccattaagatccatggtgtttatgctcggcactccttactacggctgtacgggcgaagtgcaagatagcggtgatgtgatcaccgaggggaggatcagggttatcttctcgattccttgcgagcctaacctggacgcgttaattcagaatcagcacaaatactctattaagtacaatccagggtacgtccttgctagtcgcctcggggtgtcaggctacctggtctcaaggttcactggctctattttcatcggtagagggagtcggaggaatccacatggggaccataaggccaacgtgggattaaatctcaagttcaacaagaaaaatgaggaagttcccggttacacgaagaaagtcggcagtgaatggatgtattcctctgccgctgagcaactactggcagaatacttagagcgggcacccgagcttttctcatacattgcaaagaatagtcaagaagatgtgttctatgaggacgatatttggccaggtgaaaacgagaatggcgctgagaaggtccaagagataatcacatggctgaaggggcaccccgtctctaccctaagtcgcagttcgtgcgatttgcagattttagacgcagccattgttgagaagattgaagaagaagtggaaaagtgcaaacaaagaaaaaataacaaaaaggttcgagttaccgtgaaacctcacctgctgtatcgcccactggagcagcagcacggcgttatacccgatagagatgccgaattttgtctgtttgatcgggtagttaacgttcgcgagaatttttcagtgcccgtggggttacgcggaacgattattggaattaaaggcgctaatagagaggctgacgtgttgttcgaggtgctgtttgacgaggaatttcctggcggtctaacaattagatgttcccctggcaggggttaccgcttgcctacatccgcacttgtgaatttatcacacggatctcggtccgaaaccggaaatcagaaactcacggcgattgtgaagcctcagcccgctgtacaccaacattcttcctcttcaagcgtgtcatctggccacctgggcgcactgaaccacagccctcagagcctttttgtgcccacccaagtccctacaaaagatgatgatgaattttgcaacatttggcagtctctccaagggtcagggaaaatgcaatacttccaaccaaccattcaggaaaagggcgcagtgctgcctcaggagatttcccaggtgaatcaacaccataaatccggttttaatgacaacagcgttaaataccagcaaagaaaacatgatccccaccggaaattcaaagaggagtgcaagtctccaaaggctgagtgctggtcccagaagatgagcaataagcagccaaacagtggcatagagaattttctggcatcgctgaatataagcaaagaaaacgaagttcagtcgtcacaccatggcgaaccgccaagcgaagagcatctgagcccgcagagtttcgccatgaaaggtactagaatgctgaaagaaattttgaaaatcgacgggtccaataccgttgaccataagaatgaaatcaagcagattgctaacgagatacctgtgagttccaataggagagacgaatacgggctgccttcccagccaaaacagaataaaaagctcgcgtcatatatgaataaaccccactctgccaacgagtaccataacgtccagtctatggataatatgtgttggcctgccccatcacaaatcccgccagtgtctactcccgttacggagctatcaaggatttgcagcttggtgggaatgccacagcccgattttagctttctgaggatgccccaaactatgacagtttgtcaagtgaagttgtcaaatgggttacttgtgcacggccctcagtgtcacagtgagaacgaggccaaggagaaggccgcactgttcgcgctccaacaactggggtccctgggaatgaatttcccgctaccatctcaggtatttgccaattacccttcagccgtgccccctggcactatcccgccagcctttccgccacctaccgccaatataatgccctcgtcctcacacctgtttgggagcatgccctggggaccaagcgtcccagttcccggtaaaccgtttcaccatacattgtacagcggcaccatgccaatggcagggggaatacccggtggtgtccacaatcagttcatccctttgcaagtgacgaaaaagagagtagccaacaaaaaaaacttcgagaataaggaggcccagtcttctcaagctacacctgtgcagaccagtcaacctgattcctccaacattgtcaaagtgtctcccagggagtcaagctctgcgtccctgaagtcctcgcctatcgcccagcctgccagttcattccaggtcgagacagcctctcagggacattctatctcccaccacaagagtactcctatctcttcctcccgccgtaagtcccgcaagctggccgtgaatttcggggtttcgaagccctctgaatag

SEQ ID NO: 27169 - DNA, 1380 bp, Artificial Sequence
  Description of Artificial Sequence: Synthetic coding sequence
atgggggttccaaagttctaccgttggatctctgaaagatatccatgtcttagtgaggtggtgaaggagcaccagattcccgagtttgacaatctctacctagacatgaacggtatcattcatcagtgcagtcatcccaatgacgatgacgtgcacttcaggatttccgacgataaaatctttaccgacatcttccattacctagaggtgcttttccgcatcattaagcctcgaaaggtgttttttatggccgtggacggcgtggctcctcgggctaagatgaaccagcagcgaggcaggcggtttagaagtgccaaagaggccgaagataagatcaaaaaggctattgaaaagggggagaccctgcctactgaagccaggttcgacagtaactgcatcacaccaggaaccgaatttatggcgaggctccacgaacacttgaaatattttgttaatatgaaaatcagtacagacaagtcctggcagggggttaccatctacttttctgggcacgagactccaggcgaaggcgagcataaaatcatggagttcattagatcagaaaaagctaagcctgatcacgacccaaacacaagacactgcctctacggcctcgacgcagatcttattatgttgggattgacctcacacgaagcacacttcagtctccttcgggaggaagtacgcttcggaggaaagaagacacagagggtttgtgccccagaagaaacgacgtttcacctcctacacttaagcctcatgagagaatacatcgattatgaattctccgtgctaaaggaaaagattacttttaagtacgacattgaacggatcattgacgactggatcctgatgggctttctcgtgggtaatgatttcatccctcacctaccccatctccacatcaaccacgacgctcttccactgctgtatgggacgtacgttacaatactcccagaactgggaggttatattaatgaatccgggcaccttaatctgcctcgttttgagaagtacttagtgaaattatctgactttgacagagagcatttttcagaggtgttcgtagacttgaagtggttcgaaagcaaagtaggcaacaagtaccttaatgaggcagccggagtcgctgcggaggaagccaggaattataaagagaagaagaaactcaaaggtcaagagaatagtctgtgttggacagctctggacaagaacgaaggtgaaatgattacaagcaaggataacctggaggacgaaacagaagatgatgacctgttcgaaactgagtttcgtcagtacaaaaggacttattacatgacaaagatgggcgtggacgtcgtgtcagaatacgtcttcgcaaatgctttcattcttaagtag

SEQ ID NO: 27170 - DNA, 750 bp, Artificial Sequence
  Description of Artificial Sequence: Synthetic coding sequence
atgttagggctaacaagtcatgaggcacactttagcctgttgcgggaagaggtccggtttgggggaaaaaagacacagcgtgtctgtgcgccagaagaaacaacatttcacctcctgcatctctctctgatgcgggagtacatcgactatgagttctccgtgctgaaagaaaaaatcacctttaaatacgacattgagagaatcattgacgattggattttgatggggtttctggtgggcaatgatttcatcccccatctcccacatctacacatcaatcatgacgcgctccctcttctgtatggaacctacgttacaatcttaccggaactggggggttacattaacgagtctggccatcttaatttgccaagattcgaaaaatacctggtgaagttgagcgactttgaccgagagcacttcagtgaggtgttcgttgatttgaaatggttcgaatcaaaagtgggcaataagtacctgaacgaagccgcaggggtggccgctgaagaagcaaggaattataaggaaaagaagaaactcaaaggccaggagaattctctatgctggaccgctctcgacaagaacgagggtgaaatgatcacctccaaagacaacttagaggacgaaacggaggacgacgatctgttcgagacagagttccggcagtataaaaggacctactatatgacaaagatgggcgtagacgtcgtgtccgagtacgtcttcgcgaatgcgttcatcttaaaatag

SEQ ID NO: 27171 - DNA, 3483 bp, Artificial Sequence
  Description of Artificial Sequence: Synthetic coding sequence
taaaccaatgaagacagtcccattatagagtattaccctcccgactttaagaccgaccttaacgggaagcagcaggagtgggaagcagtggtgctcatcccctttatagacgagcggctgctggaggccatggagacctgcaaccacagtttgaaaaaagaagagagaaaaagaaaccaacactccgagtgtttaatgtgctggtatgatagagatacggaattcatttatccaagtccatggcctgagaagttccctgccatcgaacgctgttgcactcgctataaaatcatttctcttgacgcctggagagtggacattaacaagaacaaaatcactcggattgaccaaaaggcattatacttttgcggttttcctaccctgaagcacatcaggcacaagttcttcttgaaaaaaagtggggtccaagtctttcagcagtcctcaaggggcgaaaatatgatgctggaaattctggtggacgcggagtctgatgaactgaccgttgaaaatgttgccagctcagttttagggaaatccgtctttgtgaattggcctcacctcgaggaggctagagtcgtggcagtctccgacggtgagacaaagttttaccttgaagaaccgccaggcactcagaaactctattccggccgaaccgcccctccatccaaagttgttcacctgggcgacaaggagcagtctaactgggccaaagaagttcaagggattagcgaacactacttgcgcaggaaaggaattataatcaatgaaacatccgcagtggtgtacgcccagctgctgacggggcgtaaataccaaattaaccagaatggcgaggtacgactagagaaacaatggagtaagcaagttgtgcccttcgtgtaccagaccatagtcaaggatattagagcattcgatagtcgcttcagcaacatcaaaactctagacgatcttttccctctgagatctatggtgttcatgctgggcacaccttattatggttgcactggtgaggtccaggattctggggatgtgatcaccgaagggagaattcgcgtaatcttctcaatcccgtgtgagcctaatctggacgccctgatccagaaccaacacaagtacagtatcaaatacaaccctggatacgtactcgcctctcggctaggagtgtcagggtacctggtctctcggttcactggaagcatcttcattggcagggggtctcggagaaatcctcacggcgaccacaaggccaatgtgggcctaaatctcaagtttaacaaaaaaaacgaggaagtcccgggttataccaaaaaggtcggctccgagtggatgtactccagcgctgccgaacagctgctagctgaatacctcgagagagcacccgagctcttttcctacattgccaagaattcacaagaagacgtgttttatgaagacgacatttggccaggcgagaatgagaacggagctgagaaggtgcaggaaatcataacttggctcaagggccaccctgtctcaaccctctctcggtcaagctgtgacctccaaattctcgatgccgctattgtggaaaaaatagaagaagaagtggagaaatgtaagcaaagaaaaaacaacaaaaaagtgcgtgtcaccgtcaaacctcatctactctacaggcccctcgagcagcagcatggtgtgatcccagacagagacgccgagttttgtctgtttgatcgggtggtcaatgtgagggaaaatttcagcgtgcccgtcggcctacgaggaaccatcatcggaatcaagggagctaatagggaggccgatgttctgtttgaagtcctgtttgatgaagaatttcccggagggctgacaattaggtgcagcccaggaagaggttatcgcctcccaacttctgccctggtgaacctgtcgcatggctcgcggtcagaaactggaaaccaaaagttgaccgctatcgtgaagccccagcccgcagtgcatcagcatagctcctcctcttcagtttcatctggtcacctgggagccttgaatcactccccccagagcctgtttgtacccacacaagttcctaccaaagatgatgacgagttttgcaatatctggcagtccctgcagggttctgggaagatgcagtattttcaaccaacgatccaggagaagggtgcagtgctgcctcaggagatcagccaagtaaatcagcaccacaaaagcgggtttaacgataatagtgtcaagtaccagcagcggaagcacgatcctcatcggaagttcaaggaggaatgtaagagcccaaaagcagaatgttggtctcagaaaatgagtaataagcagccaaattccggtattgagaatttcctggcatccctgaatatttcaaaggagaacgaggtgcagagctctcaccatggggagcccccatcagaagagcacctgtccccccagtctttcgccatgaaggggacaaggatgctaaaggagatactgaaaattgacggctccaacaccgtcgaccataagaatgaaatcaaacagattgctaatgagatccctgtgagctcaaataggcgggacgagtatggtctgccatcgcagcctaagcagaacaagaagctggcctcttatatgaacaaaccacattctgccaatgaatatcacaatgtgcagagcatggacaatatgtgttggccagcaccatcacagattccacccgtctcgaccccagtgactgagctctcacgcatttgctccttggtgggaatgccacagcccgatttttccttcctgaggatgccccagaccatgactgtgtgccaggtgaagctgagtaacggcctgctcgtccatggaccacagtgccattccgaaaatgaggccaaggaaaaggctgccttatttgccttgcagcaattaggcagtctcgggatgaacttccccctgcccagccaggtgtttgcgaactatccctctgcggtgcccccaggaaccatccctccagcattccctcctcccacagccaatatcatgccctcgtcctcccacttattcgggtcgatgccatggggacccagcgtgcctgtcccaggcaaaccgttccaccacaccttgtattcgggtacaatgccgatggctgggggtatccccggtggtgtacacaatcagttcattcccctgcaggtcacaaaaaagagagtggccaacaaaaagaactttgagaacaaagaggcacagtcctcgcaggcaactcctgttcagacaagccagcccgactcttctaacatcgtcaaagtgagtcccagagagtcttcttctgcctctctgaaaagctcccccatcgcgcagcccgcttcaagttttcaagtcgaaaccgcttcccaggggcactccatttcccatcataagagcacacctatttctagctcacggagaaagagccgcaagctggctgtgaacttcggcgtgtctaaaccgtccgagtag

SEQ ID NO: 27172 - DNA, 1233 bp, Artificial Sequence
  Description of Artificial Sequence: Synthetic coding sequence
atgcctgctcgggctctcctacccaggaggatggggcatcgaaccctggcctcaactcccgcactgtgggccagtataccttgtccccgttcggaactcaggcttgacctggtcctgccgagcggacagtcattcagatggagggaacaatcacccgcacattggagcggggttctggccgaccaggtctggacactgacccagacagaggaacagctccactgtaccgtgtacaggggcgacaaatcacaggcttctagacccacacccgatgaactagaggccgttcgcaagtactttcaactagacgtgaccctagcacagctgtaccaccattggggttctgtggactcacacttccaggaagttgcccagaagtttcagggtgttcgtctgttacgccaggaccctattgaatgcctgtttagctttatttgcagcagtaataataatatcgctagaattactggtatggtggaaaggctatgccaggcttttgggcctcgattgatacaactagacgacgtcacataccatggcttccccagcttgcaggccctcgccggtcccgaagtagaggcccatctgcggaaattaggactaggctatcgcgctcgatacgtttcagcctccgcgagagctatcctggaggagcaggggggactggcatggctgcagcagctcagggagagctcctacgaggaggcacataaagcactctgtatcctgcccggagtcggtaccaaagtcgctgattgcatttgcctgatggcattggataaacctcaggccgtgcccgtagacgtgcatatgtggcacattgcccagcgcgactatagctggcatcctactactagccaggcaaagggaccctcccctcagacaaataaggaactggggaatttcttcaggtctttgtggggcccttatgcaggctgggcgcaagctacaccccctagttacagatgctgctctgttcccacatgcgctaaccctgccatgctgcgatcccaccagcagtccgcagaacgcgtccccaagggtagaaaagcgaggtggggaaccttagacaaagaaatccctcaggctcccagtccgcctttccccacttctttatcaccctcacccccttccctgatgctggggagagggcttccagtcactacctccaaggcccgacacccccagatcaagcagtcggtttgtaccacacgctggggtggtggatattag

SEQ ID NO: 27173 - DNA, 1071 bp, Artificial Sequence
  Description of Artificial Sequence: Synthetic coding sequence
atgcccgcaagagcattattgccccgtaggatgggccatagaacattggcatctaccccggctctgtgggccagcattccatgccctagatcagagctccgtctagacttggtgctacctagtggccaatcattccggtggcgggagcaatcgccagcacactggtccggcgtgctagctgatcaagtgtggacactgactcagactgaggaacagctccactgcacagtgtacaggggggacaagtcccaggcatcgcgacccacacccgacgagctggaagcagttcgcaaatatttccagctcgatgtgaccttagcacagctgtaccaccactggggaagcgttgactcccattttcaggaggttgcccaaaagtttcagggagtgcgactgctgagacaggatccaattgagtgtctgttttccttcatatgctcatccaacaataacatcgcacgaataacaggcatggtggaacggctctgccaggctttcggtccgcgtctcattcagctggacgatgtcacatatcatggctttccttctttacaggcgcttgccggacccgaggtcgaggcccatctgaggaaattgggcctaggatatagagccagatatgttagtgcaagtgccagagccattttagaggagcaagggggattggcttggcttcagcagctgcgcgagtctagttatgaggaggcccacaaagccttgtgcattttacccggagtaggaacgaaggtcgccgattgcatatgcctgatggccctagacaagccccaggccgtgccggtggatgtccacatgtggcatatcgcgcaacgggactactcctggcacccaactacaagtcaagcaaaaggtccttctccccagaccaacaaagagctcggtaatttttttcgctcactgtgggggccatatgcgggttgggctcaagccctgtgtcaagttattaccaccttcatgaccttccttggaccgcacagattggatcaaatgccccctgaagagctccagacgtccagtagtagactaggcggtcccccatggcagtgcatatag

SEQ ID NO: 27174 - DNA, 1275 bp, Artificial Sequence
  Description of Artificial Sequence: Synthetic coding sequence
atgcccgctcgcgctctgcttccgcgaagaatgggacataggaccctcgccagtacacccgcactgtgggcttcaatcccttgccctaggtctgagctcaggctggacctggtactgccaagcggacagtctttcaggtggagggagcagagtcctgcccactggtccggagttttagctgatcaggtgtggacactgactcagacggaagagcagttgcactgcaccgtgtatagaggggataaatcccaagccagtaggccgactccggatgagctggaagctgtgcgaaagtacttccaactagacgtaacgctcgcccagctctatcatcattgggggagcgtggacagccatttccaagaggtggcccaaaaattccagggcgtccgccttctgcgtcaggatcctattgagtgcctcttttcctttatctgtagcagcaataacaatattgccagaattaccggtatggtcgagcgcctctgccaggccttcggccctcgtctaatacaacttgacgatgtgacataccatggttttccatcactccaagctttagcaggacccgaggtagaagcccacctgcgcaaacttggcttgggctatcgcgctcgatacgtgtcagccagtgctagagccattctggaggagcaaggtggcctggcctggcttcagcagctgagagaaagctcttacgaggaagcgcataaagctttatgcatactccctggcgttggcactaaggtggctgactgtatctgtctcatggctcttgataaaccacaggctgtaccagtggatgttcacatgtggcatattgctcaacgagactactcctggcacccaacaaccagccaggccaaaggaccctcaccccagacgaacaaggaacttgggaattttttcagatccctttgggggccatacgccggatgggcacaggccggtttattgggcaacgcctttgacggccatcagttgttgcgcccattgatcttttgccaggatcacctgcgagaaggcccaccaattggccgtggagattcgcaaggagaagagctcgagcctcagcttccctctagcctatcatccattccgtatggcttctgcgaccactgttggaccaaggacgttgatgacccaccattggtaacccatccaagtcccggaagccgagacgggcatatgactcaggcatggcctgtgaaggtggtgagcccattagcaaccgtgatcggtcacgtgatgcaggcatctttgcttgctctctag

SEQ ID NO: 27175 - DNA, 975 bp, Artificial Sequence
  Description of Artificial Sequence: Synthetic coding sequence
atgccagccagagctctgctgcctagaaggatggggcatagaactttggcctccaccccagctctgtgggcctccatcccttgtcctcggtccgagctgaggcttgatctagtactcccgagcggacagtctttccgttggcgcgagcagtcccctgcccactggtctggggtgctggcagaccaggtgtggactttgacacaaacggaagagcagctccattgcacggtgtaccgcggagacaagagccaggcttcccgccctacaccggacgaactcgaagctgtgcggaagtattttcagctggatgttacgctggctcagctttatcatcactggggcagcgtggattctcatttccaggaagtggcccagaaatttcagggtgtgaggctcctacgccaggatccaattgaatgtttgttttctttcatttgttcttctaacaacaacattgcaaggatcacagggatggttgaacggttgtgccaggcctttggccctcggctgatacagttggatgatgtgacgtatcacggcttcccatccctacaggcacttgccggacctgaagtcgaagcacacctgagaaaactgggcctgggctatcgcgcacggtatgtgtcggcttcggctcgggctattctggaggagcagggaggactggcatggcttcagcagctgcgcgaatcttcctacgaggaggctcataaggcactgtgcatactgcccggtgtcggcacaaaagtagcagattgtatttgccttatggccttggacaagccccaggcagtaccggtcgacgtgcatatgtggcacatcgcccaacgcgattattcttggcaccccaccacgtctcaggccaaaggacctagccctcagacgaataaggagctgggtaacttcttccgctccttatggggcccatacgcagggtgggctcaagctgtgtcagtgcctcggtgtcctccatag

SEQ ID NO: 27176 - DNA, 594 bp, Artificial Sequence
  Description of Artificial Sequence: Synthetic coding sequence
atggtggaacgtctgtgtcaggcgtttggccctcgtctgatccagcttgacgatgtgacgtaccacggctttccctcgttgcaagctttggcgggacccgaagtggaggcccatctccgtaagctgggactaggatatagagctcgctatgtctccgcctctgcacgcgcaatcctcgaggaacaggggggactggcatggctccagcagctccgcgaaagctcatatgaagaggcacataaggctctttgtatactccctggtgtggggacaaaagaaaccttcagtggggcttgtggagatctcatgctcgcgggaccaaaaaggtgctgtagtgtgccaacctgcgccaaccccgctatgctgcgctctcatcagcagtcggctgaacgtgtgcccaaaggtcggaaagctcgctggggcacacttgataaggagatcccccaagcccctagccctccatttcccacatctctgtcgccttcgccccctagtcttatgttgggcagaggtttgcccgtgactacctctaaagctcggcatccccagattaagcaaagcgtgtgcacaacacggtggggcggaggatactag

SEQ ID NO: 27177 - DNA, 1038 bp, Artificial Sequence
  Description of Artificial Sequence: Synthetic coding sequence
atgcccgctagggctttactgcctcggaggatgggccatcgtaccctcgcatccactccagccctgtgggcgtcaatcccgtgtccaaggtcagagctccgcttagacctcgtgttaccctctggacagtccttccgatggcgcgagcagtctcctgcccactggagcggtgtgctcgctgatcaggtatggactttaacacagacagaggagcagctgcactgcaccgtttatagaggagacaaatctcaggcgagccgcccaacacccgacgaactcgaagcagtacggaagtatttccagctggatgtgacactcgcccagctgtaccatcattggggctcagttgactcacacttccaggaggtcgcccagaagtttcagggggttcgtctgctgcgccaggatcctatcgaatgcttattctcatttatttgttcgagtaacaataacattgcgagaataacagggatggtggaaaggctgtgtcaggcttttggcccacggctgatccagctcgatgacgtcacatatcatgggttcccttctctacaggctctagccggacctgaggtggaagcccatctgcgtaagctaggattgggataccgcgcacgatacgtttctgcctctgctcgtgcaattctggaggagcagggcggacttgcctggctgcagcagctgagagagtcttcctatgaggaagctcataaagcattgtgcatacttccaggggtcggcacaaaggtggccgattgtatctgtctgatggctctcgacaaaccccaggccgtgcctgtagacgtgcatatgtggcacatcgcccagagagactatagctggcaccccacaacttcgcaggccaagggacccagtcctcagacaaataaagagcttgggaatttctttagaagcctttggggcccatacgcaggctgggcacaggcagtcctgttcagcgcggacttacgtcagagtagacatgctcaggaacccccagcaaagcgtcggaagggctccaaaggccctgaaggctag

SEQ ID NO: 27178 - DNA, 1074 bp, Artificial Sequence
  Description of Artificial Sequence: Synthetic coding sequence
atgccagcgagagctctcctgcctcgaagaatgggacacaggactttagcatcaacacctgccctgtgggcgagtatcccgtgccctagaagcgagctccgtttagatctcgtcctccctagtggtcagagtttcaggtggagagagcagagtcccgctcattggtcaggcgttttagctgatcaagtatggaccctgacccaaacagaagagcaactacattgcaccgtgtataggggagacaaatcccaggcctctcggcctactccggacgaactggaggccgtacgtaaatattttcagttggacgtgaccctggcccagctttaccaccactggggatctgtagatagtcactttcaggaagtggctcagaagtttcaaggagtccgcctgttgcgacaggatcctatcgaatgtctgtttagctttatctgttcctcaaacaacaacatagcacggattaccggaatggttgagagactatgtcaggccttcgggccaaggcttattcagctcgacgatgtgacttatcacggcttcccgagccttcaagctcttgccggtccagaggtggaagcccatctgcgaaagctgggtctaggctatcgcgcaagatatgtctccgccagcgcacgggcaatattagaggaacaagggggactagcatggctccaacagctgcgagaaagttcctacgaagaggcgcacaaagccctgtgtatactgccaggcgtggggacgaaggggctcctgggcaacgctttcgatggccaccagcttcttcggcctctgatcttctgccaggaccatctgcgagaaggccctccaattgggaggggggactctcagggcgaagaacttgagccccaacttccttcgagcttgagctcaataccctacggattctgtgatcattgctggactaaggatgtcgacgacccccctctggtgacccacccctctccaggttctagagatggtcacatgacacaggcgtggccagtaaaggtggtcagtcccttagctacagtgatcggacacgtcatgcaagccagcttgctcgccttatag

SEQ ID NO: 27179 - DNA, 588 bp, Artificial Sequence
  Description of Artificial Sequence: Synthetic coding sequence
atgcccgcacgggctttgctgccccgaagaatggggcaccgaacgctcgcgtctacaccggcactgtgggcaagtattccttgtccacggtccgaacttaggctcgacctcgtgctgccaagcggacagtctttccggtggagggagcagtcaccagctcactggtcaggcgtcctagccgatcaagtctggaccctcacgcaaaccgaagaacagttgcactgcaccgtgtacaggggggacaagagccaggcctcaaggcctacccccgacgagctggaggccgtgaggaagtactttcagctcgatgtcactctggctcaactctaccatcattggggatcagtggactctcacttccaggaagtggcccagaagtttcaaggtgtgagactactgaggcaggatccgattgaatgcttattctcatttatttgttcctccaacaacaatatcgcacggatcactggaatggtagagagactctgccaagctttcggccctaggctgatccaattggatgacgtgacttaccacggcttcccaagcctgcaggctttggctggacccccttggcaatgcatatag

SEQ ID NO: 27180 - DNA, 969 bp, Artificial Sequence
  Description of Artificial Sequence: Synthetic coding sequence
atgccggcaagagcactactgccacggcgaatgggtcaccggactctggcaagcacgcccgcactgtgggcttccataccttgtcccaggtccgaactccggctggacttggttctgccctccggacagtccttcaggtggcgcgagcagtccccagctcattggtcgggcgtgctagccgaccaggtgtggactcttacgcagaccgaagaacagctccattgtaccgtttacaggggtgacaaaagccaggccagtcggcctacaccggacgaactagaagcggttcgcaaatattttcaacttgatgttacgctggcacagttatatcatcactgggggagtgtagattcccattttcaggaggttgcccaaaagtttcagggtgtgcggttgctaaggcaagatccaattgagtgcttgttctcctttatttgctcctctaataataatattgctcgtatcaccgggatggtagagcgtctttgccaggccttcggccctcgcctgatccaactggacgatgtgacataccatggatttccttcactgcaagccctggctggacccgaggttgaggctcatctgcgcaaactcggcttgggctaccgcgctaggtatgtctcagcctctgccagagccatcctggaggagcaaggcggtcttgcttggctgcaacagctgcgcgaatctagctacgaggaggctcataaggctttatgtattttacctggagtgggcaccaaggtagcagactgcatttgcctgatggcactggataaaccccaagctgtgcctgtggacgtgcacatgtggcacatagcccagagggactacagctggcatccaaccacatcccaggccaagggtcctagcccccagaccaataaggaactggggaatttcttccggtcactgtggggtccttacgccggttgggcacaagctgccggatcagacgcgtcttag

SEQ ID NO: 27181 - DNA, 6806 bp, Artificial Sequence
  Description of Artificial Sequence: Synthetic coding sequence
atgagtgggttgcacctggtaaaacagggacgcgacaggaaaaagatagatagccaaagagattttacagttgcctctcctgcagagttcgtgactcgctttgggggtaacaaagtgattgagaaagtgctcattgctaacaatggcatagccgctgttaagtgcatgcgctcaatcaggagatggagttatgagatgttcagaaacgagagggcaatccgcttcgtcgttatggtgacgcccgaagacctgaaagccaacgccgagtacatcaaaatggctgatcactacgttcccgtgcctggcggacccaataataacaattacgctaacgtcgagctcatactcgatatcgccaaacggatccccgtgcaagccgtctgggccggttggggccacgcgtccgaaaatcccaagttgccggaactcctgctcaaaaacggcatcgccttcatggggcctccttctcaggccatgtgggccctgggagacaagatcgcatcctccatcgtcgcccaaactgcaggcattcctaccctcccttggagcgggtctgggctccgagtggattggcaagaaaatgacttcagcaagagaatcttgaatgtacctcaggaattgtacgagaagggatatgtgaaggatgtggatgatggtctgcaagctgcagaggaagtcggctatccagtgatgatcaaagctagcgaggggggaggagggaaaggcatacggaaggttaataacgccgacgacttccccaacctctttagacaggtccaggcggaagtgcctggtagccctatattcgtgatgagactggctaaacagagccgacatctggaggtccagatcctggcggaccagtatggcaacgccatcagtctgttcggacgggactgctccgtccagcggagacaccagaagattattgaggaggctcccgcaaccattgctacacccgctgtatttgaacacatggaacaatgcgctgtgaaactcgctaagatggtgggctacgtgtctgccggtacggtggagtacctgtactcgcaggatggatctttttattttcttgagctgaaccccaggctgcaggtcgaacacccctgtaccgagatggtggccgacgtgaacctccccgcagcccagctccagatagctatgggcattcccctgtaccggattaaggacatcagaatgatgtacggagtgtctccatggggtgattcccccattgattttgaggactctgcccacgtgccttgcccgagaggccatgttatcgccgcaaggatcaccagcgagaatcctgatgagggtttcaagccgtcttcaggtaccgtacaggaattaaatttcaggtccaacaaaaacgtgtgggggtatttctctgtggccgctgcaggcggattgcatgaatttgctgatagtcagttcggacattgcttctcatggggcgagaatcgggaggaggccatttccaatatggtggtggcgttaaaggaattgagtatccgaggggacttcaggacaaccgtggaatatttaatcaagttgttggagacagaatcctttcagatgaatagaattgatactggttggttagataggctgattgccgagaaagtgcaagctgagcgaccagacaccatgctcggtgtcgtctgcggagcactgcatgttgccgatgtgagtctgaggaatagtgtgagcaatttcctgcacagcctggagcggggtcaagtacttcctgcgcatactctgctgaacaccgtggatgttgagctaatctacgaaggcgtgaaatacgtgctcaaagtgaccaggcagagccccaactcatacgtcgtgattatgaacggcagttgcgtggaggttgacgttcacagactgtccgacggcggtcttttgctctcctatgatggcagtagctatacgacatacatgaaggaggaggtcgacaggtaccgtataacaattggcaacaaaacatgtgtttttgagaaggagaatgaccccagtgtgatgcggtccccgagtgccggaaaactcattcagtacatagtcgaagacggaggacacgtgttcgctgggcaatgttatgccgaaatagaagtgatgaagatggtgatgaccttgaccgctgtcgaaagtgggtgcatacattatgtgaagagaccaggtgcagcccttgatcctggatgtgtgctggctaagatgcagctcgacaacccaagtaaagtgcaacaagcagaacttcacactggttccctgcccagaatccagagcaccgcactccgcggagaaaaactgcatcgcgtctttcactatgtactggacaacctggtgaatgtaatgaatgggtattgcctgcctgatccttttttctcttctaaggtgaaggactgggtcgagagattgatgaagacactgcgagatccctctctgcccttactggaacttcaagacattatgacctcagtgtcaggccgaattcctccaaatgtggaaaaaagcatcaagaaagagatggcccagtatgcatccaatataaccagcgtactctgtcagtttcctagccaacagatagcaaacattctggactctcacgctgccaccctgaatcgcaagtctgaaagggaagtgttcttcatgaatacgcagtcgatcgttcagctcgtacagaggtaccgaagtggaatcagaggacacatgaaagccgtggtgatggatcttctaaggcagtacctcagggttgagacacaatttcagaatggacactacgataaatgcgtgttcgctctgcgggaggagaacaagtcagacatgaacacagtcctcaattatattttcagccacgcccaggtgacaaagaagaatcttctcgtcaccatgttgattgaccagctgtgcggcagagatccaacactgacagatgagctcctgaacattctcacggaattgacacagctgtcaaaaactaccaatgccaaggtagcccttagagccaggcaggtcctgattgccagtcatcttccctcttacgagctccgtcacaaccaggtggaaagtatctttctgtctgcaattgatatgtacgggcatcaattttgcatcgagaacctccagaagctgattctaagtgagactagcatttttgatgtgcttcccaactttttctatcacagcaaccaggtagtccgcatggctgcgttggaagtgtatgtccggcgagcatacatcgcctacgaattgaattcagtccagcacaggcagctgaaggacaacacttgtgttgtggagttccagtttatgttacctacgagtcatcctaatcggggtaacatcccgacgctgaaccgtatgtctttttcctcgaatctcaaccactacgggatgacccatgtcgccagcgtaagcgatgtgctgctagataactcatttacacctccctgtcagcgaatgggaggaatggtgtctttccgtacattcgaggacttcgtgagaatcttcgacgaggtaatggggtgcttttccgacagtccgcctcagagcccaacctttcccgaagcaggtcatactagcctctacgatgaggataaagtgcccagagacgaacccatccatatcctaaatgttgccattaaaaccgactgtgacatcgaggacgatagattggctgcaatgttccgggagttcacccagcagaataaagccacattggtggaccatggtatcagacggctcacatttctagtcgctcagaaggattttcggaaacaagtgaactatgaggtggaccgaaggttccatcgagagttccctaaattctttaccttccgggctagggacaagtttgaggaggacagaatttacagacatctggagcccgcactggcctttcagttggaacttaatcgtatgagaaatttcgacctgactgccatcccttgtgccaatcacaaaatgcacctctacctgggcgctgctaaagttgaagtgggtacagaagtgactgactatagatttttcgttcgcgcaataattagacactctgacctcgtgacaaaagaggctagtttcgagtacttacaaaatgagggggagaggctgttgcttgaggcaatggacgaactcgaagtggccttcaataacaccaatgtacggactgactgcaatcacatcttcctaaatttcgtccctaccgtaatcatggacccctccaaaattgaggagtcagtccggtcgatggtcatgaggtatggctcacggctgtggaagctcagagtgcttcaggccgagctgaaaatcaacattagactgacaccaacaggcaaggctattcctattcggctgttcttgaccaacgagtccggctactatctagacatatccctttacaaagaggtgactgactctcggactgctcagatcatgttccaggcatacggggacaagcaggggcctctgcatgggatgttgattaacactccttatgtcaccaaggacctgcttcagtctaaaagatttcaggcccagtccctaggcacaacctatatatacgacatccctgagatgtttaggcagtcccttattaaactttgggagagtatgagcacacaggccttcttgccatccccgcctttaccaagcgacatgctcacatatactgagctggtcctggacgatcagggccagttagtgcatatgaacagactacccggaggcaacgaaattggaatggtcgcctggaagatgacattcaaatctccagagtatccagagggcagggacatcattgtgataggtaatgatatcacctaccgcattggatcctttgggcctcaagaagacttactgttcctccgcgcatctgaactggcacgcgctgaggggatcccaaggatatacgtcagtgctaattctggtgccaggatcggcctggctgaggagatcaggcacatgtttcacgtcgcttgggtggaccccgaggacccctataagggataccgatatttatacctcacaccacaggactataaaagagtttctgcactaaactctgttcactgtgagcacgtcgaggacgagggagagtctcgatataaaatcacagacattatcggaaaggaggagggaataggacccgaaaacctcaggggctccggcatgatagcaggcgagtccagtctagcttataatgaaatcatcacaatttctcttgtgacatgcagagctatcggcattggggcatacctggtgcggctgggacaaagaactatccaagtggagaactctcaccttatcctgaccggggcaggagccctgaataaggtgctgggcagggaggtatataccagcaataaccagctcgggggaatccagattatgcacaacaacggagtcacacactgtacggtgtgtgatgattttgaaggggtgttcacagtgctccattggctgtcctatatgcccaaatccgtgcactcgagcgttccgctgctgaactcgaaggacccaattgatcggattatcgaatttgtgcccactaaaactccgtatgaccccagatggatgctcgcaggcagaccccaccctacccagaaggggcagtggttatctggcttcttcgactacggttccttctccgaaatcatgcagccctgggcccagaccgtggtggtcggacgggcaaggttgggcggaatccctgttggcgtcgtggccgtggagactcggactgtcgaattgtccatcccagcagatcccgctaatctggactccgaggctaagatcatacagcaggctgggcaggtgtggtttccggattcagcctttaaaacctatcaggccatcaaagactttaatagagagggccttccactaatggtctttgccaactggcggggtttcagtggtggcatgaaggacatgtacgaccaggtcctcaaatttggggcttacattgtcgatgggctgcgggagtgctgtcagcccgtcctcgtttacatacctccacaagcggagttaagggggggtagttgggtcgtcatcgactcatcaattaatcctagacatatggaaatgtatgccgacagggaatctcggggatcagtcctggagccagaaggcacagtagaaatcaaattccggaggaaggacttggttaagacaatgcggagagtggaccctgtctatatacatttggccgaaaggctggggacacctgaactgtccaccgccgaacggaaggaattggagaataagctgaaggagcgcgaagagttcctcattcctatatatcaccaagtcgctgtgcaattcgcagatctccacgatacccccggacgaatgcaggaaaagggcgtcatctctgacattctagactggaaaacatctcgcacattcttttactggaggcttcgcaggttgctgctcgaagacttggtgaagaagaaaatccacaatgcaaatcccgagctaacagatggacagatccaagccatgctacgccgttggtttgtggaagtggaagggaccgtaaaggcatacgtgtgggacaataataaagacttagccgaatggctggaaaagcagctgaccgaagaggacggcgtccattccgtgattgaggaaaacatcaagtgtatttctagagactatgttctcaaacagatcaggtccttggtccaagctaatcctgaagtggctatggacagtatcatccacatgacacagcatatctcgccaacgcagagagctgaggtgattagaatcctctccactatggattctcctagtactta

SEQ ID NO: 27182 - DNA, 7151 bp, Artificial Sequence
  Description of Artificial Sequence: Synthetic coding sequence
atgtggtggtccaccctgatgagcattctgcgagccagatctttctggaagtggatcagcacccagaccgtaagaatcatccgcgcagttcgggcacatttcggcggaatcatggacgagccatccccactggcccagccactggagctcaaccagcattccagatttattataggatcggttagtgaagacaatagcgaggatgagatatctaatctggtaaaattggatctcttggaagagaaagaaggatctctgagcccggctagcgtcggctctgatacgctctcggacctcggcatatcaagtttacaggatggcctggccttacatatcagatcctctatgagcggcctgcacctcgtcaagcagggcagggacaggaaaaagattgattcccagagagatttcacagtggcttctcccgcagaattcgtaactagatttgggggaaacaaggtaatcgagaaggtcctgattgctaataatggcatagcagcggttaaatgtatgcgaagtataagaagatggagctacgagatgttccggaacgaacgggcaattcggttcgtggtgatggtgactcccgaagacttaaaggcaaacgccgaatatatcaagatggcagaccactacgtgccggttcctgggggacctaataacaacaactatgccaacgtcgagttgatccttgacatcgccaagaggatcccggttcaagctgtgtgggccggatggggtcatgcgtccgaaaacccaaaactgcccgaacttctgctgaaaaacgggattgcatttatgggacctccatctcaagccatgtgggccctcggagacaaaattgccagctccattgtagctcaaacggcgggtatccctacgctgccgtggagtgggtctggacttcgtgtggactggcaagagaatgacttctcaaaaagaattcttaatgtaccacaggaactgtatgaaaaaggatacgtgaaggacgttgatgatggcctacaagctgcagaggaagtgggctaccccgtcatgatcaaggcaagcgagggcggtgggggaaagggcataaggaaggttaataatgcggacgactttcccaacttatttagacaagtgcaggcagaggtgccaggctcccccatttttgtcatgcggctcgcaaagcaatcccgccacctggaggtccagatcctcgcagaccagtacggcaacgcgatctctctcttcggtagggactgctcagttcaacgaaggcaccagaaaatcatagaggaggccccagccacaatagctacacccgctgtgttcgaacacatggagcagtgcgccgtcaaactagcaaaaatggtgggatacgtttcagccggaaccgtcgagtatttatattcccaagacggcagcttctactttctggaactgaatcccagactgcaggtcgagcatccctgcacagaaatggttgccgacgtcaaccttcccgctgctcaactgcagatcgccatgggcatccctctgtaccgcataaaagacattcgaatgatgtacggggtctccccttggggagattccccgattgattttgaggacagtgctcatgttccatgcccaagggggcatgtgattgcagctaggatcacatctgagaatcccgatgaggggttcaaaccatctagcggcaccgtacaggaactgaattttcgctccaacaaaaacgtgtggggctatttctcggtagccgcagcgggtggcctccacgagttcgctgacagccaattcggacactgcttctcatggggtgagaacagggaagaggccattagcaatatggttgtggccttgaaggaactgagcatcagaggcgatttcaggaccactgtagaatacctgatcaaactgctcgaaacggaatcttttcagatgaatcgtatagacacgggctggctcgaccgcctgatcgccgaaaaggtacaggcagagaggccggacacaatgcttggcgtggtgtgtggcgcactccatgtcgcagatgtgtcattacgaaattcggtcagtaatttcctgcacagtctagaacggggacaggttctgccagctcatacgttgttaaatacggtagatgtcgagttaatctatgagggagtcaagtatgtgctcaaagtcacacggcaaagtcctaattcctatgtagtcattatgaatggcagctgcgttgaggtggacgtacataggcttagtgatggaggtctgctgctcagttatgatggaagctcctataccacttatatgaaggaagaggtggataggtatcggataaccattggcaacaaaacgtgcgttttcgagaaagaaaatgatcccagcgtcatgcggtctccaagcgctggcaaacttatccagtacatcgtcgaggacgggggacacgtcttcgcgggacagtgctatgcagagatcgaagtgatgaagatggtcatgaccctcactgccgtggagagcggttgtatacactacgtgaagcgaccgggagctgcactggaccccggatgcgtcctggcaaagatgcagctggacaacccaagcaaagtgcagcaggccgagctgcacactggatcattaccaaggatccaaagcacagcactgagaggcgaaaaactgcatagagtattccactatgtcctagacaacctggtgaacgtcatgaatgggtattgtttgccagacccattcttcagctccaaggtgaaggattgggttgagcggctaatgaaaacactcagggatccgagtctgcccctcttagaattgcaggacatcatgacaagtgtgtccgggagaattccgccaaatgtcgagaagtctataaagaaggagatggcacagtatgcaagcaacattactagtgtgctgtgccaatttccttcacagcagatcgcgaatatactcgattctcatgcggcaaccctgaacagaaagtccgaacgagaggtgttttttatgaacacccagtctatcgtgcagctggtgcagagatatcggtctggcatccgtggacacatgaaagccgtcgttatggacttacttcgccagtacctgagagtggagacacaatttcagaacggtcattacgataaatgtgtgttcgctcttagggaggagaacaagtccgatatgaacacagtcctgaattatatattttcacacgcacaggtgactaagaagaatctgctggttacaatgctcatcgaccaattgtgcggcagggatccaacccttaccgatgagctgctcaacatcctaactgagctgacccagttgtcaaagaccactaatgccaaagtggctctcagggctaggcaggtgctgattgcgtcccatctgccaagctacgaactgagacacaaccaggtggagtctatttttctttccgcgatagacatgtatggccatcagttctgcattgagaacttgcagaagttgatcctgtctgaaacaagtattttcgatgtgcttccaaatttcttttaccactccaaccaggtcgttagaatggcagccctggaggtctatgtgagacgggcatatattgcttacgagctgaattcagtccagcatagacagttgaaggacaatacctgtgtagtagaatttcagttcatgctgcctacttctcaccccaatcgcggaaacattccaacgctgaaccggatgtctttttcctcaaatttaaaccattatgggatgacccacgtggcctccgtctccgacgtgctgctcgataatagctttacccctccctgtcagaggatgggcggtatggtgtccttccggacatttgaggactttgtccggatcttcgacgaagtgatggggtgcttttctgattcaccaccccaatctcccacctttcctgaagctgggcacacctcattatatgacgaagacaaggtccctagagacgagcctatccacatcctcaatgtcgccattaagacagattgtgatatcgaagatgaccggttggcagccatgtttcgggagttcacacagcaaaataaggccactcttgttgaccacggcattcggagactcacctttttggtggctcagaaagattttagaaaacaagtgaactacgaagttgatcggaggtttcaccgcgaatttccaaagttttttaccttcagggctagagataagttcgaagaagatcgcatataccgccacctggaaccggcactggcttttcagttggaacttaacaggatgcggaattttgatctgaccgcaatcccatgtgccaatcacaagatgcatttgtatttaggggctgcgaaggttgaggtgggaaccgaggtgactgattaccgcttctttgtgcgagctatcatccggcattctgacctggttaccaaggaagcatcctttgaatatctgcaaaatgaaggcgagcggctcctgctcgaggccatggatgaactggaggtggcttttaacaatacaaatgtccggaccgactgcaatcacatcttcctgaactttgtcccaacagttatcatggacccttccaagatcgaagagtccgtgcggtccatggtgatgcgttacgggtcacgactttggaagcttcgagtactgcaggcagaactgaaaatcaatatacgtctgaccccgacggggaaagcaatccctatacggctgttcttgacgaatgagagcggatactacctggacatcagtctctacaaggaggtgaccgacagccgcactgctcagattatgttccaggcttatggcgataagcagggccctctgcacggtatgctcatcaacacaccatatgtcactaaagaccttctgcagtccaagaggtttcaggcccagagcctgggcactacctatatctatgacattcccgaaatgttccggcagtcattgatcaagttgtgggagtctatgtccacacaggcctttttaccaagccctcctttgccaagtgatatgcttacatataccgagctggtccttgatgatcagggccagctagtgcacatgaacagactcccagggggaaacgagatcgggatggtggcgtggaagatgactttcaagtccccagagtacccagagggacgcgacattattgtcatcggcaacgacatcacttatcgaatcggcagtttcggaccacaggaagacctgttatttctccgtgcttctgagctcgcacgtgctgaaggaatccctcgcatatatgtgagcgctaatagtggagccagaatcgggttggccgaggaaattcgacacatgttccatgtcgcctgggtggatcctgaggatccgtacaagggctaccggtacctctacttgaccccccaggattacaaacgcgtgagcgccttaaattccgtccactgtgaacatgtggaggatgagggtgaaagtagatacaagattacagatataatcggaaaggaagagggtataggcccagaaaacctccgcggtagcggaatgattgctggggagagcagcctggcctataatgagatcatcacaatctcactagtaacctgccgtgccataggcataggagcctacctcgtccgtctgggacagcgcaccatccaggtggagaattcacacctgatcctcacaggggcaggggcacttaataaggtgctgggccgagaagtgtatacctcaaacaaccagctcggaggcatacagatcatgcataacaacggagtgacccactgcacggtttgcgacgattttgaaggggttttcacagtcctccactggctctcatacatgcctaaaagcgtccactcctcggttcccctgttaaactccaaggatcccatcgaccgaatcatcgaatttgtgcccaccaagacaccgtatgaccctaggtggatgttggcagggagaccgcaccccacacagaagggacagtggctcagcggattttttgattacgggagtttcagcgagatcatgcaaccatgggcgcagactgtcgttgtgggccgagcaagactgggcggtataccagttggagtggtggccgttgagacccggaccgtggaactgtccattccagccgacccagcgaatctggattctgaggctaagattatccagcaagcagggcaagtgtggtttcccgatagcgcgttcaagacctaccaggctataaaagactttaaccgggaaggccttccacttatggtttttgcaaactggaggggattctcagggggaatgaaagatatgtacgatcaggtccttaagtttggagcttatatcgtagatggtttgcgggagtgctgccaacccgtgttagtgtatatcccaccacaggccgagcttcggggagggagttgggtggtcatcgactcttctatcaaccctcgtcacatggaaatgtatgcggacagggagagtcggggttctgtgctcgaacctgaggggacggtagagattaaattcagaaggaaggaccttgtgaaaactatgagaagggttgatccggtgtacattcacctcgcagaacgactggggactcccgagctctccacagcagagagaaaagagctagagaacaaactgaaggaacgcgaagaatttctgattccaatctaccaccaggttgctgtccagtttgccgatctacatgacacacccggacgtatgcaagaaaaaggcgtgataagcgatattctggattggaagacctcccggacattcttttattggcggttacggcgactgctgctggaggacctggtgaagaaaaagattcataacgccaaccccgagctcacagatggacagattcaggctatgctcagacggtggttcgtggaagtagaggggaccgtcaaagcgtacgtctgggacaacaacaaagatctggcagagtggcttgagaagcaacttacggaggaagacggtgtccactctgtaattgaagaaaatatcaagtgtatttcccgggattatgtgctgaaacaaattcggagtctggtacaggcaaatcctgaagttgctatggattccataatccacatgacacaacacatcagccctacccagcgggcagaggttatacgcatactatcgacgatggactccccaagtactta

SEQ ID NO: 27183 - DNA, 6866 bp, Artificial Sequence
  Description of Artificial Sequence: Synthetic coding sequence
atggaggggtccccagaggagaacaaggagatgagatattatatgcttcagaggagctctatgtctggcctgcatctggtaaagcaggggcgagatcggaagaagattgactctcagagagatttcaccgtggccagcccagcagaattcgtgaccaggtttggcggtaacaaggtgattgagaaagtgctgattgcgaataatggtatcgcagcggtcaagtgcatgcgatctattagacgctggtcttatgagatgttccggaatgagcgcgctatacgattcgtggttatggtgacacctgaggatctgaaagcgaacgccgagtatattaagatggcagatcactacgtccctgttcctggaggtcccaataataacaactatgccaacgtagaattgatcctcgacatcgccaagagaattcccgtgcaagccgtttgggctggatggggtcacgcgtccgaaaatcctaaattgccagaactgcttctgaagaacggcattgccttcatgggaccaccatcccaggcaatgtgggctctgggagacaaaatcgccagcagtattgtggcccagaccgcgggaattcccaccctaccctggagcggatccggcttgagagtggattggcaggagaacgattttagcaaaagaatcctgaatgtgccgcaggaactttatgagaagggctacgtgaaggacgtcgatgacggtctgcaagcggctgaggaagtcggctatccagttatgattaaggcgtctgaaggtgggggagggaaggggatacgcaaggtcaacaacgcagacgactttcctaatttatttcggcaagtacaggctgaggtccccggaagccccatcttcgttatgcggttggctaagcagagccgtcacctcgaggtgcagatccttgcagatcaatatggcaacgctatcagcctgtttggaagggattgttccgtccaacgacgacatcaaaagattatcgaggaagctcctgcgaccattgcaaccccggcagtgttcgaacacatggaacagtgtgctgttaagctcgctaagatggtaggctacgtttcagctgggaccgtggaatatctgtactcacaggacgggagtttctatttccttgaacttaaccctcggctgcaggtggaacatccctgtactgagatggtggctgatgtcaatctgccggctgctcagctgcagatcgccatgggaattccactgtatcggataaaggatatccggatgatgtatggagtttcaccctggggggacagcccaatagatttcgaggactccgcccacgtcccctgtccgaggggccatgtcatcgccgctagaattactagcgagaacccagacgagggctttaaaccctcttcagggaccgtgcaggaactaaattttcgctctaacaaaaatgtctggggctatttttccgtggccgctgctggcggtcttcatgagtttgcagacagtcagtttggtcattgcttctcgtggggggagaacagagaagaggcaatttcaaacatggtggtggcgcttaaagaactcagcatcaggggtgactttcgaactaccgtcgaatacctaatcaagttgcttgaaacagagagtttccagatgaataggatcgacacgggatggctcgaccgcttgattgccgaaaaagtgcaggctgaacgacccgacacaatgctgggcgtggtgtgtggagccttacatgtcgcggacgtgtctttgagaaacagtgtgagcaactttttacacagcttggaaagggggcaggtcctgccagcccataccctgctgaacaccgtcgacgtggagctgatttatgagggcgtaaagtatgtcttaaaggtgacacggcagagccctaactcctatgtagtgatcatgaatggaagttgcgtggaggtcgatgtacatcgattgagcgacggcggactcctgctgtcctatgatggttcttcctacaccacatatatgaaggaagaagtcgaccgatatcggattactattggaaacaagacatgcgtgtttgagaaagaaaatgacccctccgtaatgagaagcccaagcgccggaaaattgattcagtatatagtcgaggacggcggacatgtgtttgcagggcagtgctatgcagagattgaggtaatgaaaatggtcatgactctcaccgcagtcgaatccggctgtattcactacgtgaaaaggccaggagctgctttagaccctggctgtgtactcgccaagatgcagctggataacccctctaaggtccaacaagctgaattgcacactggttccttgcctagaatacagagcaccgcgctacgaggggagaaactgcacagggtctttcactatgtcttggataatctagtgaacgtgatgaatggctattgtctgccagatccttttttctcctctaaagtaaaagattgggtggagagacttatgaagacactccgagatcctagcttacccttgctggagctgcaagatatcatgacttcagtgtctgggaggatacccccaaatgtggaaaaatctattaaaaaagagatggcacagtatgcatctaatattacatccgtactctgtcagttccccagtcagcagattgcaaatattctcgactcacacgccgcaaccttgaatcggaagtcagaacgcgaggtgttcttcatgaacacacaatccatcgtgcagcttgtgcagagatacagaagcgggattcgcggacacatgaaggccgtggttatggacctgctccggcagtaccttcgggtggaaacgcagttccaaaacggtcactatgataagtgtgtatttgcacttagagaggaaaataaatccgatatgaataccgtgctgaattatatcttctcccacgctcaggtcacaaagaaaaacctgcttgttaccatgctgatcgaccaattatgtggccgagatcctaccctcactgatgagctcctgaacatcctcacagagctgacacagttgagtaaaacaacgaacgcaaaagtagcattgcgagccaggcaggtcctaattgcatcgcatttgcccagctatgaactgcgccataatcaggtcgaaagtattttcctcagcgccatagacatgtacggacatcagttctgcatcgagaatctccagaaactgattttgtcagagacctctatctttgacgttctgccaaacttcttttaccactccaaccaggtagtgaggatggccgctcttgaggtgtacgtccgaagggcatatattgcatacgagttgaacagtgtgcaacaccggcagctcaaagataatacatgcgtcgtcgaatttcagttcatgctcccgactagccatccaaacagaggcaacatcccgactctcaatcgaatgagtttttcaagcaaccttaatcactacggaatgacacatgtggcaagcgtctccgacgtcttgctggacaattctttcaccccaccttgtcaacgaatgggcggaatggtgtctttccgcactttcgaagacttcgttcgcatctttgacgaggtcatggggtgtttctcagatagccccccacaaagcccgacgtttccggaagccggacatacctcactatacgacgaggacaaagtgcctagggacgaaccaattcacatcttgaacgtggctatcaaaaccgactgtgatatcgaggacgatcgtctcgcagccatgtttcgcgaatttacacaacagaataaggcgaccctcgtcgaccacgggatccggaggctgacctttctggtggcacagaaagatttcaggaagcaagtcaactatgaagtggaccgtaggtttcaccgggaatttccgaaattttttacatttcgagcaagggacaagtttgaagaagacaggatttaccgccaccttgaaccagctctcgcttttcaactggagctcaatagaatgcgcaattttgacctcacagctatcccctgtgctaatcacaagatgcacctttatctgggagccgctaaagtggaggtggggacagaagtcaccgattaccggttctttgtgcgggctatcattaggcactctgacctggtgaccaaggaagcctcttttgaatatctgcagaacgaaggagagaggctgctgctcgaggcaatggatgaactggaggtagctttcaataacaccaatgttcgcactgactgtaaccacatttttttgaacttcgtgcccactgtaatcatggaccctagcaaaattgaagaatctgtacgctcgatggtaatgcgctacgggagcaggctttggaagctgcgagtcctgcaggccgagttaaagattaatattcgcctcacaccaacaggtaaagcgatacctatccgactgtttctcacaaatgagtcaggatactacttggacatctccctttataaagaagtcactgacagccggaccgcccagataatgtttcaagcatacggcgacaagcaaggacctctccatggtatgcttatcaacaccccctacgtcactaaggatcttctgcagtctaagcgttttcaagctcagtctctagggacaacctacatttacgatatacctgaaatgtttaggcagagcctcatcaagctttgggaaagtatgtctactcaagccttcctgccctcccccccactgccttccgacatgcttacttacacagagctggtgctggatgaccaagggcagttggtgcacatgaaccgcttaccagggggtaatgaaatcggaatggtagcatggaagatgacattcaagagccctgaatacccggaggggagagacattatcgtcatcggcaacgacataacttatcggatagggtcttttggtccccaggaggacctgttattcctgcgcgcttctgaattggctcgtgcagaaggcattcccaggatttatgtgtccgccaattccggtgccaggatcggcttagcagaggagattcgccatatgttccatgtggcttgggtggaccccgaggatccctacaagggatatcgctatctgtacttaacacctcaggattataaacgggtgtcagcccttaactcggtacactgcgaacacgtcgaagacgagggtgagagccggtacaagattaccgacattatcggcaaggaagagggaatagggccagaaaacctccggggatccgggatgattgccggagagagttccctggcgtacaacgagataatcaccatcagtttggtgacatgtcgggcaattgggataggtgcgtacttagtgaggttaggccagagaactatccaggttgagaactctcacctaatcttgactggagctggcgctctgaataaagtgctgggtagggaggtttacacatccaacaatcaacttggaggtattcagatcatgcacaataacggagtgactcactgcacagtttgtgatgactttgaaggcgtttttactgtgcttcactggctgtcctacatgcccaaatccgtgcactcatctgtccctctacttaactccaaggatcctatcgaccgcattatagagtttgttccaactaaaaccccctacgaccctaggtggatgctggctggacggcctcaccctactcaaaaggggcagtggctgtcaggctttttcgattacgggagtttcagtgaaattatgcagccttgggcccagaccgtcgtcgtgggcagagcgaggttggggggtataccagtcggcgtggtggccgtggagacaaggactgtggagctctccatacccgcagatccagccaacctagactccgaagctaagattatccaacaagctggacaggtctggtttcctgactcggctttcaagacatatcaggcgattaaagattttaaccgagaagggctccccctgatggtctttgccaactggagggggttctcaggcggaatgaaggacatgtacgatcaagtgttgaaattcggggcttacattgtggacggcctgagggagtgctgtcagcccgtgttggtttatattccacctcaggccgaactccggggagggagctgggtggtcattgattcatctatcaaccccagacacatggagatgtacgcagatagagagagccgcggatcagtgctagaaccagaggggactgtcgagatcaagttcaggagaaaagacctggtcaaaactatgagacgcgttgaccccgtttatatccacttggccgaaagactggggacccccgaactgagcacggctgaacgtaaggagctggagaataagctgaaggagcgcgaggagtttctcattccaatctatcaccaggtcgccgtccagttcgcagatctgcacgacactcctggacgcatgcaggaaaagggggttattagtgatatcttggattggaaaacgagcagaaccttcttttattggcggctgcggcgactgctgttggaggacctcgtcaagaaaaagattcacaatgctaaccctgagctaaccgatgggcagattcaggccatgctgcgtcgctggttcgttgaggtagagggaactgtcaaggcttatgtctgggacaacaacaaggacctggcagaatggttggagaagcaactcacagaggaggatggagttcactcagtaatagaggaaaacatcaaatgtatctcaagagattacgtgttgaagcagatcaggtctttagtgcaggctaaccctgaggtcgccatggatagtatcatccatatgacacagcacatcagtcccacacagagagcagaggtcatcaggatactgtctacgatggattccccttccaccta

SEQ ID NO: 27184 - DNA, 1419 bp, Artificial Sequence
  Description of Artificial Sequence: Synthetic coding sequence
atgcacaataacggtgtgactcactgtaccgtgtgtgatgatttcgagggggtgttcaccgtcctccactggctgtcttatatgcccaaatcggtgcactccagcgtgcctctcctgaatagcaaggaccctattgatcgtataatcgagttcgtgcccacaaaaaccccatatgaccccaggtggatgttagctggtcgcccacaccccacccagaaaggtcagtggctcagcgggtttttcgattacggatcctttagtgaaataatgcagccctgggctcaaacagtggttgtaggacgggcaaggttaggcggaattccggtgggtgtcgttgcagtcgaaacaagaacagttgaactgagcattccagccgatccagcgaatctggatagcgaggccaagatcattcagcaggccggtcaggtctggtttcccgatagtgcttttaaaacatatcaggccataaaggacttcaatagagaaggtctcccactgatggttttcgcaaattggcggggatttagcgggggaatgaaggacatgtatgatcaggtgctcaagttcggcgcttacatcgtggacggtctcagagagtgttgtcagcctgtgttggtttacataccacctcaggccgaactgaggggcggtagctgggttgtgattgattcttcaatcaatcccaggcacatggaaatgtacgccgatcgcgagtcccgaggatctgtgctggagccagagggtaccgttgaaattaaatttcgtcgtaaggacttagtcaaaaccatgcggagagtggacccagtgtatatccatttagcagagcgcctgggaacacctgagctcagtaccgctgagcgaaaggaactggagaacaaactcaaagaacgagaggaatttctcattccaatctatcaccaagtggcagtccagtttgcggatctgcatgacactcccggtcggatgcaagaaaaaggcgtgatctctgacatccttgactggaagacaagccggacttttttttactggcggctccgcaggctgttgttagaagacctggttaaaaagaagatccataacgcgaatcctgagctgactgatgggcagatccaagccatgctccggcgatggtttgttgaagtggaaggaacagtcaaagcctacgtgtgggataataacaaagacctagctgagtggctggaaaaacaactgaccgaggaggatggggtgcattctgtgatcgaggaaaatattaagtgcatctccagggattatgttttaaagcaaatcaggtcgctggtgcaagcgaaccctgaagtggcaatggattccattatacacatgacacaacacattagcccaactcagagagctgaggtgattcggatcttaagcactatggattccccatccacctag

SEQ ID NO: 27185 - DNA, 129 bp, Artificial Sequence
  Description of Artificial Sequence: Synthetic coding sequence
atgtccggtctgcacctcgtgaagcagggtagagaccggaagaagatagacagtcagcgcgacttcacagtggcttcccctgccgagttcgtgactagatttggcggaaataaggttattgaaaaatag

SEQ ID NO: 27186 - DNA, 7040 bp, Artificial Sequence
  Description of Artificial Sequence: Synthetic coding sequence
atggatgaaccctccccacttgcccaaccgcttgaactcaaccagcacagtcgatttattataggaagcgtcagtgaggacaactcagaggacgagatcagcaacctggtcaagctggatttattagaggaaaaggaggggtcactttcgcctgcaagcgtgggtagcgatacattgtctgacctggggattagctctctccaggatgggcttgccctacatatccggagctccatgagtggcctccatctcgtgaaacagggcagagataggaagaagattgacagtcagcgagactttaccgtggcgtcacccgctgagttcgtgacccgatttgggggtaataaagttatcgagaaggtgctgattgcaaataatggcattgccgctgtcaagtgtatgcgctcaatccgtcgctggtcttacgaaatgttccggaatgaacgagcgatacgttttgtggttatggtgactcccgaggacctgaaagccaacgcagagtacattaagatggctgaccactacgtcccagtgccaggcggtcctaacaacaataattatgccaatgtggagctcattctggatattgctaagagaatcccggttcaggcggtatgggccggatgggggcacgctagcgagaatccgaaactccctgagctgttactaaaaaacggcatcgcctttatgggcccaccaagccaagctatgtgggccctgggagataagatcgccagctctatcgtcgcccagaccgccggaatccctaccctgccttggtctggaagcggcctgagggttgattggcaagagaacgacttttcaaagcggatactcaatgtaccacaggagctatacgaaaagggatacgtaaaggacgtcgacgacggactccaagccgctgaggaagtcggataccctgtgatgattaaagccagcgaaggaggcggtggcaaggggataaggaaggtgaataatgccgatgactttccaaatctctttaggcaggtgcaggctgaggttcctgggtccccaatctttgttatgagattagccaagcaatcgcggcaccttgaagtacaaatcctcgctgaccaatatggaaatgccataagcctgtttggaagagattgttctgtccaacggaggcatcagaagattatcgaggaggctcccgctacaatcgcgactccagcagtgttcgaacacatggagcagtgtgccgtgaagctagccaagatggtgggatatgtatcggccggtaccgtggagtatttgtattctcaggacggaagtttttactttctggagctgaatcctaggttgcaagtagagcatccatgcaccgagatggtggctgatgtgaacttgcccgcagcgcagttgcagatcgctatgggtatccccctttacagaatcaaagatattagaatgatgtatggtgttagtccgtggggagactcacctatcgattttgaagatagcgctcacgttccctgtcccaggggacacgttatcgccgcacgcattacctccgaaaatcctgacgaagggttcaagccttcttccggcaccgttcaggaactgaatttcagatctaacaagaatgtgtggggatacttcagcgttgcggcagccggtggcctacacgagtttgctgatagccagttcggccactgctttagttggggggagaatagggaggaggccatttcgaatatggtcgtggcactgaaggaactgagtatcagaggcgattttcggaccaccgtggaatacttgatcaaactgctcgagaccgagagtttccaaatgaatcgcatcgatacaggatggctagaccgtcttattgccgagaaagttcaagccgaacggcctgataccatgctgggagttgtgtgcggcgctctgcatgttgccgacgtaagtctgcgcaacagtgtctccaacttcctgcacagcctggagaggggacaggtactgcctgcacatacactgcttaataccgttgatgtcgagttgatctatgagggtgttaaatatgtcttgaaagtgactcggcaaagcccaaatagctatgttgtgataatgaacggctcatgcgtggaagtggacgttcacaggctttctgatggaggtttgctgctcagttacgacggctcctcatacacaacatacatgaaagaagaagtggatcgttataggatcacgatcggaaacaagacatgcgtctttgagaaagaaaatgatccaagcgtcatgagaagccccagtgccggaaagctcatccaatatattgtggaagatggagggcacgtgtttgcagggcagtgctatgcagagatagaggtcatgaaaatggtgatgaccctcaccgccgtagagtccggctgcattcactacgtgaaacgaccaggcgctgctctcgatccagggtgcgtgttagctaagatgcagcttgacaacccgagcaaggtgcagcaggccgagctgcacacggggtccctgcctaggatacaatctacagccctgcgtggcgagaaactccacagagtgtttcactatgtgttggataacctggtgaacgtgatgaacgggtactgtcttcccgatccattcttctcttctaaggtgaaagactgggtagagcggctcatgaagactctccgcgatccaagccttccactgcttgaactgcaggacatcatgacttccgtctccggccgaattcctcctaatgtggaaaagtctatcaagaaagagatggcacagtatgcaagtaatattacctctgtcctctgtcagttcccgtcccagcagattgcaaacatcctcgacagtcatgccgcaactctgaatcggaaaagcgaaagagaggttttttttatgaacacacagagtatagtccagctggtacagcgttaccgatctggaattcgtggacacatgaaagctgtggtgatggacttgctcagacagtatctgcgcgtcgagacccagttccagaatggccactacgacaaatgcgtcttcgccctgcgcgaggaaaacaagtcagacatgaacacagtattgaactacatcttctctcacgcacaggtcactaagaagaatctcctagtgacaatgttgatcgatcagctgtgtggaagagaccccaccctcactgacgagctcctgaatattctgaccgagctgacccagctctcaaagaccaccaacgctaaggtcgcccttcgcgcaagacaggtcttgatcgcttctcatctaccttcgtatgagctgagacataaccaggtggaatctatattcctgagtgcgatcgatatgtatggtcatcagttttgtatcgagaaccttcaaaaactgattctgagcgagacttcaatcttcgatgtgctgcctaacttcttttaccattccaaccaggtggtccggatggctgcactcgaggtgtacgtccgacgcgcttacattgcctacgaactcaacagcgttcagcaccgtcaacttaaggataatacttgcgttgttgaatttcagttcatgctgccaaccagtcaccctaatcgcggaaatataccaaccctgaatcgcatgagtttctcctcgaatttaaatcattatggtatgacacatgtggcctccgtttccgacgtccttcttgataactcctttaccccgccttgccagcgtatgggtggcatggtgtcctttagaaccttcgaagactttgtcaggatcttcgacgaagtcatgggctgtttttccgattcacccccacaaagtcctacttttcccgaagccggtcacacgtcattgtatgatgaggataaggtgccccgagatgaacccatccacatcctgaacgttgccatcaagaccgattgcgacatcgaggacgatcgactggctgcaatgtttcgcgagttcactcaacagaacaaggcaacactcgtcgaccatgggatcaggaggctgacctttcttgtggctcagaaagatttcagaaaacaggttaattatgaggtggaccgaagattccacagagagttccccaagttttttaccttccgcgctcgggataagtttgaagaggatcgaatatacagacacctggaacccgcacttgcctttcaattggagctgaatcgaatgagaaatttcgatcttacagccatcccgtgcgccaaccataagatgcacctctacctgggtgctgcaaaggtagaggtgggtacagaagtgacagattatcgctttttcgtgagagctatcataaggcactcagacctggtgactaaagaagcttccttcgagtatctgcagaatgagggagagcgattactgctggaggctatggatgagctggaggtcgccttcaacaacaccaatgtcagaaccgattgcaatcatatttttcttaattttgtaccaactgttatcatggacccttccaaaatagaagagtctgtgagatccatggtaatgagatacgggtccaggctgtggaaattgcgtgtgttgcaagctgagctcaaaatcaatattcggctgacaccaactggcaaggcgatccctatcagactttttttgaccaacgaatcagggtactacctcgacatctcattgtacaaggaggtaacagactctcgtactgcacagataatgttccaggcttacggtgataagcaaggaccactccacggcatgctgataaataccccctacgtgaccaaagacctgcttcagtcaaaacggttccaagcccagagtctaggaactacctacatctacgatattcctgaaatgtttagacagtctttgattaaactctgggaatctatgagcactcaggcgtttcttccctcccctccactgccctcagacatgttgacttacactgaactggtgctggatgatcagggtcagcttgtgcacatgaatcggcttcccggtggcaacgagatcggtatggtagcatggaagatgaccttcaagtctcccgaatacccggaaggaagggatatcatagtaatcggtaatgatatcacgtatagaatcggctcctttgggccacaagaggatctactgttcttgcgtgcttccgagctggcgagagcagaagggattccgaggatttatgtcagtgccaacagtggtgcccgaatcggcctcgccgaggagatcagacacatgttccacgtcgcatgggtggatcccgaagatccttataaaggttataggtatttgtatttgaccccccaagactacaagcgagtgagtgcacttaactccgtccattgcgagcacgttgaggatgaaggcgagtcccgatataagatcactgatatcattggaaaagaggagggcattggcccagagaacctacgaggttctggcatgattgccggagagagcagccttgcatataacgaaattataaccataagtctggttacttgcagagcaatcggaattggtgcctatctggttcgcctggggcagcgaactatacaggtcgaaaactctcatctcatcctaaccggcgctggtgccctgaacaaagttttggggagagaggtctacacaagcaacaaccaattggggggtattcagattatgcacaacaacggcgttactcattgcacggtctgtgacgacttcgaaggggtctttactgttctgcactggctaagttatatgcccaagagcgtccatagttctgtgccgctgctcaattcaaaggaccccatcgataggattatagaatttgtccccacaaagacgccctacgacccgagatggatgcttgccggtcgaccccaccctacgcaaaagggccaatggttgagcggcttcttcgattacggcagtttttctgaaataatgcagccttgggctcagacagtggtggtaggccgagcccgtctgggcggaatacccgtgggcgtcgtggcagtggaaaccaggaccgtcgaactctccatcccagcggatccagctaacctggactcggaggcgaagattattcagcaggcgggacaggtgtggttccccgatagcgcgttcaagacctaccaggccatcaaagattttaaccgcgagggtttgcccctgatggtgtttgcgaactggcggggattttcgggcggaatgaaggatatgtacgaccaggtcctcaagtttggagcttacattgttgacggactgagagagtgttgccagccagtgcttgtgtacatcccgcctcaagccgaactgcgcggagggtcttgggtggtgattgatagctctatcaatcccaggcacatggagatgtatgcagatagggaatccagagggtccgtgttggagcctgaagggactgtagaaataaaattccggagaaaggacttagttaagacgatgcgcagggtggaccctgtctatatacaccttgccgagcggctcggaacacctgagcttagtacagcagaaagaaaggagttggaaaacaaacttaaagaacgggaggagttccttatccctatataccaccaggtggccgtgcagtttgctgacttgcatgacacacccggtcgcatgcaggaaaagggggtgatatccgacattctcgattggaagacatcacgaaccttcttctattggcggctacgccgtctacttctggaggatctcgtgaaaaagaaaattcataatgcaaatcctgaactgaccgacggacagattcaggctatgctgcggaggtggtttgtcgaggtggaaggcacagtcaaggcctatgtctgggataacaacaaggatctggccgagtggttagaaaagcaattaacagaggaagatggcgtgcattccgtaatcgaagaaaatataaaatgcatatcccgggattacgtgctgaagcaaatcaggagcctggtgcaggccaacccagaggttgccatggactctatcatccacatgacccagcacatttcacccacccaaagggccgaagtgatccggatactgtctacaatggacagcccaagcacata

SEQ ID NO: 27187 - DNA, 129 bp, Artificial Sequence
  Description of Artificial Sequence: Synthetic coding sequence
atgagtgggctccatctagtcaagcagggcagagacagaaagaagatcgacagccagcgagactttacagtggcttcacctgcagaatttgttacccggttcgggggtaacaaggtcatagaaaaatag

SEQ ID NO: 27188 - DNA, 234 bp, Artificial Sequence
  Description of Artificial Sequence: Synthetic coding sequence
atggatgagcctagtcctctggctcagccacttgagctgaaccaacactctagatttattattgggagtgtgtctgaggacaacagcgaggatgagatctccaatctggttaaactcgacctgctggaagagaaagagggaagcctgtccccagcgtctgtgggctccgatactttgtcggacctcggtatcagcagtcttcaggatgggctggcactgcacatcagactctag

SEQ ID NO: 27189 - DNA, 3138 bp, Artificial Sequence
  Description of Artificial Sequence: Synthetic coding sequence
atgggctgttttagcgacagtccaccacagtctcccacattccccgaggcgggacacacgagtctgtatgacgaggacaaagtccccagggacgaaccaatccatattttaaatgtagctattaagaccgattgtgatattgaagatgatcgactggccgcaatgttccgcgaattcacccaacagaacaaggcaaccctcgttgatcatggaatccggagactgacctttcttgttgctcagaaggatttcagaaaacaagtcaactacgaggtcgatcggagattccatagggagttcccgaaattctttactttccgggctcgcgacaagtttgaagaggacaggatctatcggcatctggagcctgcccttgctttccagctggagctgaacaggatgaggaattttgatctgaccgccataccatgtgcaaaccataaaatgcacctatatctcggtgcggcaaaagtcgaagttggaactgaggtgacagattatagattttttgttcgggcaattatcagacattcagatctggtgactaaagaggcgagctttgaatatttgcagaatgagggggagcgattacttcttgaggcaatggatgagctggaggtggctttcaataatactaatgttcggactgactgcaatcacatctttctcaactttgtgcccacggtgatcatggatccatcaaaaatcgaggagtctgtaagatctatggtgatgcggtatggatcacgtttgtggaaattgcgtgtcctccaggctgagctgaagatcaatattcggctcacccctaccgggaaggctataccaatacggcttttcttgacgaacgagtccggctactatctcgacatcagtctatacaaagaagttacagacagccgcacagctcagattatgtttcaggcttacggagataagcaaggacccttgcacggcatgctcattaatactccttacgttactaaggatcttctacagtccaagcgttttcaggcccagagccttggcactacttatatttacgacatacctgagatgtttaggcagattggaatggtggcctggaagatgaccttcaagtccccagagtacccggaaggaagagatataatagtcataggtaacgatataacatacagaatagggtcatttggccctcaggaggacctcctctttctgcgggctagtgaattggctagagccgaagggatacctcgcatctacgtcagcgcaaatagtggcgcaaggatcggccttgccgaggaaataaggcatatgttccatgtagcttgggtcgatcccgaagacccatataaaggatataggtatctatacctgactccccaagactacaagcgggtctccgctctgaatagtgtccattgcgagcacgtggaggatgaaggcgaaagtaggtacaagattacagatatcattggtaaagaagagggaatcggccctgagaaccttcgtggcagtggaatgattgccggagagtcatcattggcatacaatgagatcattactatttcattagtaacctgtcgcgcaatcggcatcggagcctatctggtgagattggggcagcgaacaatacaggtcgaaaactcgcatctgattctgactggggcaggcgctctaaacaaagttctgggcagagaggtgtacacttcaaacaaccaactaggaggaatacagataatgcacaataacggtgtcacccattgcaccgtctgcgacgatttcgaaggcgttttcaccgtgcttcattggctgagttacatgcccaagtctgtgcattctagcgtgccccttctgaattcaaaagaccccattgaccggattattgagtttgtcccaaccaagaccccgtacgatccaaggtggatgttggctggcagaccgcaccccacccagaaggggcagtggctcagcggattttttgactatgggagcttcagtgaaatcatgcagccatgggctcagactgtggtagttggacgcgctaggttggggggtatccccgttggggtggtggccgtggaaacgaggactgtggagctgtccattcctgcagaccctgccaacctcgattcagaagctaaaatcattcaacaggcaggtcaagtgtggtttcctgactcagcttttaaaacctatcaggcaattaaggatttcaatagggagggacttccgctgatggtgtttgcaaattggcgcggttttagtggcggaatgaaggacatgtacgaccaggtgttaaagtttggggcatacattgtggatggcctcagggagtgttgccagcccgtgttggtctacatccccccacaagccgagctgagaggtggctcatgggtcgtcattgacagtagtatcaatccacgccatatggagatgtatgccgatcgtgagtctcggggatccgtcctagagcccgaggggacagtagaaatcaaatttcgcagaaaagacctggtcaagacaatgcgcagagtcgaccccgtctacatccatctggctgaaagactcgggacccccgagcttagcacggctgagagaaaagaactggagaacaagctgaaggagagagaggagttcctgattcctatataccaccaggtagccgtgcagtttgctgacctgcatgatacacccggaagaatgcaggaaaaaggagtcataagcgacatactagattggaagacttccagaacctttttctactggagactccggagactgttgctggaagatctcgtgaaaaagaagattcacaatgctaatcccgagttgacagacggtcaaatccaggcgatgctgagacgatggttcgtcgaagttgaaggcacagtcaaagcttatgtctgggacaacaacaaagacctggccgaatggctggagaaacagcttacagaagaggacggggtgcattctgtgatcgaagagaacataaagtgcatatcgcgcgactacgtactgaaacagatcaggtcactggtccaggccaaccccgaggtcgcgatggatagcataattcacatgacacaacacatttcccctacccagcgtgctgaagtcatccgcattctctcaacaatggactcccctagtacctag

SEQ ID NO: 27190 - DNA, 363 bp, Artificial Sequence
  Description of Artificial Sequence: Synthetic coding sequence
atggatgagcccagccctctcgctcagcccttggagttaaaccagcattccagatttatcattggatccgtgtctgaggacaattctgaggatgagatttccaacctggttaagctggatctactcgaagaaaaggaagggagcctgagccccgctagcgtcggaagcgacaccctgagcgatctcggaatcagttctttacaggacggcctggcacttcacatcaggtccagcatgtccggattacacctggtgaagcaggggcgagatagaaagaagatagacagccagcgagattttacagtcgcatctcctgcagaatttgttactagattcggaggtaacaaagtgattgagaaatag

SEQ ID NO: 27191 - DNA, 7112 bp, Artificial Sequence
  Description of Artificial Sequence: Synthetic coding sequence
tccttttggaaatggatctccacccagacagtgcgtattattagggctgtcagggcccacttcggtggcatcatggatgagccctcacccctggcccaacccctggagctcaaccaacacagcaggttcataatcgggtcagtgagtgaggacaattctgaagacgagatctcaaatctggttaagctggacctcttagaagagaaggagggcagtcttagccctgccagtgtaggctctgataccctcagcgacttgggaatcagcagtctgcaggacggcctggcccttcacatcaggtccagcatgagcgggctacacctggtgaaacaagggagggaccgcaagaaaattgacagccaacgagattttacggtggcgagtcccgctgagtttgtgactcggtttggcggaaataaggtgatagagaaagtcctgatcgctaacaacgggatcgctgcagtgaagtgtatgcgcagcataagacgctggtcgtacgagatgttccggaatgagcgcgctatccggttcgtggtgatggttacccctgaggacctaaaggcaaacgcggagtatatcaagatggcagaccactacgtcccagtgcccggagggcctaacaacaataattatgccaatgtcgagctcatccttgacattgcaaagcggatccctgtgcaggccgtatgggccggttggggccatgcttctgaaaatccaaaattgcccgagctgctcctgaaaaacggcattgccttcatgggccctcccagtcaggcaatgtgggcattaggtgacaaaatcgcgagttctatcgtcgcccagaccgctggcattcctactttgccatggtccgggagcggcttgagggttgattggcaggagaatgacttcagcaagcgaattctaaacgtgccgcaggaactgtatgaaaagggttacgtgaaagacgtggacgacggactgcaggctgcagaggaggtgggatacccagtaatgattaaggcatctgaggggggaggcggaaaaggaataaggaaggtaaacaacgccgacgacttccctaacttgttccgccaggtccaggcagaagtccctggcagtccgatcttcgtgatgaggctcgcaaaacagtctcggcacctcgaggtccagattttggccgaccagtacggcaacgcaatctccctgtttggcagagattgctctgtgcagcgacgacatcaaaagatcatagaggaagccccagctactatagccacccccgcagtgtttgaacacatggagcagtgtgccgttaaactcgctaagatggtggggtacgtgtccgccggtaccgtcgaatacctttactcccaggacggctcattttattttctggagctcaacccgaggctccaggtagaacacccttgtacagaaatggtggccgatgttaatttgcccgctgcccagttgcagatcgccatggggatccccctatatcgtattaaagatatcaggatgatgtatggggtgtcgccctggggggattcaccaattgactttgaggattctgcccatgtgccatgtcccagaggccacgtcatcgcagctcgcatcacttccgaaaaccccgatgaaggcttcaagcctagttccggaacagtgcaagaactgaacttccgtagcaacaagaatgtctggggctatttctcagttgccgctgcaggaggcttgcacgaattcgctgatagtcaatttggccattgcttcagctggggcgagaacagggaggaagctatcagcaacatggtggtggcgctgaaagaactctccatcagaggggacttccggaccactgttgagtatctgattaaacttttggagacagaaagcttccaaatgaaccgaatcgacaccgggtggctggaccgcttgatagcggaaaaggttcaggcagagcgccctgatactatgctgggtgtcgtgtgcggagccctgcacgttgcggacgtttccctgcggaactctgtgtccaacttcctccactccctcgaacgtggacaagtattgccagcccacactctgctcaacaccgtggacgtcgaactcatttacgagggagttaagtacgtcttgaaagtgacccgacagagtcccaattcttacgtagtaatcatgaacgggtcttgcgtcgaggttgatgtccacaggctgtctgatgggggactgctgctgtcttatgatggtagtagctataccacatacatgaaagaagaggtagatcgttatcgcatcacaataggcaacaaaacctgcgtcttcgagaaagagaacgatccttccgtaatgagatccccgtccgccggaaaattaatacagtatatcgtcgaagatggtggacacgtgttcgccggtcagtgttacgccgagatagaggtcatgaagatggttatgaccttaacagccgtcgaatcggggtgcattcactatgtcaagcgccctggagccgctctcgatcccggatgcgtcctggccaagatgcagctggataatcccagtaaggtgcagcaggcagaactgcataccggctctttgcccaggatccaaagcacagccctgaggggcgagaaactccacagagtattccactatgtgctggacaacctggttaacgtcatgaacggctactgtctgccggatccttttttttcctctaaggtgaaagactgggtagagagactgatgaaaacccttcgcgatccctctctccccctgctggagctgcaggacatcatgacgtccgtgagtggacgcatccccccaaacgtcgagaaaagtatcaaaaaggagatggcccagtacgcctcgaatattacctctgttctctgtcagtttcctagtcaacaaatagccaacatcttggatagccacgccgcaacgctgaaccggaagtcagagagggaagtattttttatgaatacccaatcaatcgttcaactggtgcagagatacaggtctggcatccgaggccacatgaaggctgtggtgatggatctcctgagacaatatctgcgagttgaaacacagttccagaatggacattacgataaatgcgtgttcgctctgcgagaggagaataagagtgatatgaacaccgtcctgaattacatcttttcacacgcgcaggtgacgaagaagaatttgctggtgaccatgttgatcgaccagttatgtggccgagatcctaccctcacggatgagctcctgaatattctgacagagttgactcagttgtcgaagactaccaatgcaaaggtggcattgcgggctcgccaggttttgatcgcctcccatctgccctcatatgagctgcggcataatcaagtggagagcatcttcctttctgctattgacatgtacggccatcagttctgtatagaaaacctccagaagctgatcctgtccgagactagcatctttgatgtcctgcccaactttttctaccactctaaccaggtggtcaggatggcagcattggaagtgtacgtgcgaagagcatatatagcctacgaactgaatagcgtgcagcataggcagctcaaggataacacctgcgtcgtggagttccagtttatgctgcccacctcacacccgaacagggggaacatccctacgctgaatcggatgtctttctcgagtaacctaaatcattatgggatgacgcatgttgccagtgtcagtgacgtcctcctggacaacagctttacgccaccatgtcaaagaatggggggaatggtctcgtttagaacctttgaggactttgtgcggatcttcgacgaggtgatgggctgcttctccgactcaccccctcagtctcctacattccccgaagctggccacaccagtctctacgatgaggacaaggtaccaagagatgagcctatccatatcctgaacgtcgccatcaagaccgattgcgacattgaggacgaccggctcgccgcaatgtttagagagtttacacagcagaataaggccaccctagttgatcatggtatccggaggctgacattcctggtcgcccagaaggatttccggaaacaggtcaactacgaagtggatcgacgattccaccgcgagttccctaaattctttacctttcgggctcgcgataaatttgaagaggatcgaatctacagacacctggaacccgcattggccttccagctggaactgaatcggatgagaaattttgatttgacggctataccctgtgccaatcacaaaatgcacctttacctcggcgcagcaaaggttgaagtgggcaccgaggtcactgactaccggttctttgttcgggctataatcagacattcagatctggtgacaaaagaggcttcgtttgaatatctgcagaatgagggggagcgcttactgctcgaggctatggacgaattagaagtcgccttcaataatacgaacgttagaacggactgcaatcacatctttttgaacttcgtgccaactgtaattatggacccgtctaagattgaggagtccgtacgatcaatggtgatgaggtatggtagccgcctgtggaaactccgggttctccaggcggaactgaagatcaacatacgccttactccgaccggtaaggcaatccccattaggctgtttttgactaacgagagcggctactatttggatattagcctgtataaagaagtgacagatagtcgcacggcccagatcatgttccaggcttacggcgacaaacaaggacccttgcatggtatgctgatcaatacaccttacgtaacgaaggacttgcttcaatctaagagattccaggcccagagtctgggcacaacctacatctatgatattcccgagatgttccgccagtctttgatcaagctctgggagagtatgtctacccaggctttcctcccctctccaccattgcctagcgacatgctgacctacacggagctggttctggacgatcaggggcaattggttcatatgaatagactaccaggtgggaacgaaataggcatggtggcctggaagatgacatttaaaagtcccgagtaccccgaaggcagggatataatcgtgataggcaacgatatcacctacagaattggctcatttggaccacaggaggatctcctgttcctaagggcatcagagctggctcgcgcagaaggaattccaagaatttatgtgagtgcaaatagcggggcacgtatcggtttggctgaagagatcaggcatatgtttcacgttgcctgggtggaccccgaggatccatataagggctaccggtacttgtacctcacacctcaggattataaacgcgtttctgcccttaattccgtccactgcgagcatgttgaggacgaaggagaaagtagatacaagattacggacattattggcaaggaagaaggtattggcccagaaaacctgcggggatctggcatgatcgccggagaaagctcacttgcctacaatgagatcatcacaatctcattggtaacctgtagggccatcgggatcggagcgtatcttgtccgacttggtcaacgcacaatccaggtggagaactcccacttgatcctgacgggggcaggcgctcttaacaaggtacttggacgggaggtgtacacctctaacaatcagctaggaggcattcaaataatgcacaacaatggcgttacccactgcaccgtatgcgatgactttgagggcgtcttcaccgtgctgcattggctgagttatatgcccaagtcagtgcattcttccgtgccacttctgaatagtaaggatcctatcgatcgcatcattgagttcgtacccaccaagacaccctacgatcccagatggatgctggcaggcagaccccaccccacgcagaaaggccagtggctttcaggttttttcgactatgggagcttctctgagatcatgcaaccatgggcacaaactgttgtggtaggaagagccagacttggcggaatcccagtcggtgtcgtggcggtggaaaccaggaccgtggaactgtccatccccgcagaccctgcgaacttagattccgaggctaagataatccagcaagccggtcaggtctggtttccggattcggctttcaaaacctatcaggctattaaagacttcaatagggagggactgcccctgatggtgttcgctaattggcggggatttagcggtggtatgaaggatatgtacgatcaggttcttaagtttggagcgtatattgttgatggcctgcgggaatgttgtcagccggttttggtgtatattcctccacaagcagagttgcgcggaggcagttgggtcgtgattgacagtagcatcaacccccgacacatggaaatgtacgccgatcgagagagtaggggttccgttctggagcccgaaggaacagtggaaatcaaattccggaggaaggacctcgttaaaacgatgcgcagagtagacccagtctacatacacttagcagaacgcttgggcactcctgaactgtccacggctgaacgaaaggagcttgagaacaagctaaaagaacgcgaagagtttctcatccctatctatcaccaggtggccgtgcagtttgcagacctccatgatacacctggcaggatgcaagagaaaggcgtaatttctgatatccttgattggaaaacaagcaggacatttttctactggaggctgcggagactgctgctcgaagaccttgtgaaaaaaaaaatacacaacgctaatcctgagctgaccgacggacaaatccaggccatgctgcgcaggtggtttgtggaagtagaaggaactgtaaaagcctacgtgtgggataataataaggacctggcggaatggctcgaaaagcagttgacagaggaggatggagtgcactcagtgatcgaggagaacattaaatgcatttcgcgggattatgttctgaagcaaatccgctccctcgtgcaggccaatcccgaggtggccatggactcgataatacatatgactcagcatatttcacccactcaacgggcagaagtaattcgcatcttatctacaatggacagtccttccaccta

SEQ ID NO: 27192 - DNA, 777 bp, Artificial Sequence
  Description of Artificial Sequence: Synthetic coding sequence
atgtctggtcttcaccttgtgaagcagggtagggatcgtaaaaaaatcgattctcaaagggacttcacagtggcatcccctgctgagttcgtcacacgttttggcggaaacaaggtcattgagaaggtgttgatcgcaaacaacggcatcgctgccgttaagtgtatgaggagcattagaagatggagctatgagatgtttcgaaatgagcgcgcaatcaggtttgtagtgatggtgacccctgaggatctcaaagccaatgccgaatacattaagatggcagaccattacgtgcctgtgcctggtggcccaaataacaacaattacgccaatgttgagcttatactcgatatcgccaagcggatcccagtgcaagccgtgtgggccggttgggggcacgcctcagaaaatcccaagttgccagagttactgctcaagaatggaattgccttcatgggtcccccatcacaggccatgtgggcgttgggcgataagattgcttcttcaatagtcgctcaaactgctggcattcccaccttgccgtggagtggaagtggactgagggtcgactggcaggaaaacgatttctccaagcgcatattgaacgttcctcaggagttatatgagaaaggttacgtgaaagacgtagacgacggtttgcaagccgcagaagaggtgggttaccctgtaatgattaaagcctcagaaggaggtggaggtaaagggatccgcaaagtaaacaacgccgatgatttccccaacctgttcaggcagtag

SEQ ID NO: 27193 - DNA, 144 bp, Artificial Sequence
  Description of Artificial Sequence: Synthetic coding sequence
atggatgagccttcccccctcgctcagccgctggagctcaatcagcactccagatttatcataggttcggtgtccgaagacaactctgaagatgaaatttcaaatctagtgaagctagatctgcttgaagaaaaggagggctag

SEQ ID NO: 27194 - DNA, 2679 bp, Artificial Sequence
  Description of Artificial Sequence: Synthetic coding sequence
atggatcactacgattcacagcagacgaacgactatatgcaaccagaagaagactgggatagggatctgcttctggacccagcttgggagaagcagcagcgtaagaccttcactgcttggtgtaacagtcatctccggaaagcaggtacccagatagaaaacattgaagaagacttcagagatggtctgaagctgatgctgctcctggaggtgatcagcggggagaggctggcaaagcctgagaggggcaagatgcgcgtgcataaaataagtaacgtaaataaggctctggacttcatcgcaagtaagggagtgaaattagtatcgatcggggctgaggaaattgtggatggtaatgtaaagatgacactcgggatgatctggaccatcatccttcggtttgccattcaagatattagcgtggaggaaacgtccgcaaaagagggactgctgctctggtgccaaagaaaaaccgcaccatataaaaatgtcaatatccagaattttcacatctcatggaaggacggattgggattctgtgctctgatccaccgccatcgcccagaactgatcgactatggcaagttaaggaaagacgatcctctcacgaatttgaataccgctttcgatgttgcagaaaagtacttggacatcccaaagatgttagatgctgaagacattgtggggaccgctaggccagacgaaaaagcgatcatgacttacgtatcgtctttttaccatgcattttcaggcgctcagaaagcggagacggctgctaaccggatttgcaaggtgttggcggtaaaccaagagaatgagcagctcatggaggattacgagaagctggcttctgaccttcttgagtggatacggcgaacgatcccctggcttgagaatcgggtacctgagaatactatgcatgccatgcagcaaaagttggaagacttccgcgactacaggcgcctgcacaagccaccaaaagtgcaggagaagtgtcaactcgaaattaattttaacacattacagacaaaattacgtctgtctaatcgacccgctttcatgccttccgaaggacgaatggtaagtgacatcaataatgcttggggatgtctcgagcaagttgagaagggatacgaggaatggctgctgaacgagattagacggttggagagactggaccatctggcagagaagtttaggcagaaggctagtatccacgaagcatggactgacggaaaagaagccatgttgcgccagaaggactacgaaacggcaacactgtctgaaattaaggcgcttctgaagaaacacgaagcttttgagtcggacttagctgcacaccaagaccgggtcgagcaaatcgccgcaattgcacaagagctgaacgaattagattactacgatagtccttcagttaatgctcgctgccagaagatctgtgaccagtgggacaatcttggcgcactaacacagaagcgaagagaagccctcgaaaggacagagaagctattagagactatcgaccagctttacctggagtacgcaaaacgagcagccccatttaacaattggatggagggcgctatggaggatttgcaggatacattcatcgttcacactattgaggaaatacaggggcttactacagcacacgagcagtttaaggccactctcccagatgctgataaggagcggttggctattctggggattcataacgaggtctccaaaatcgttcagacatatcacgtgaacatggccggtaccaacccttacactacaattaccccccaagaaattaacggtaagtgggaccatgttcgtcaactggtgcccagacgggaccaggcactgacagaggagcatgctaggcagcagcacaatgaaagactcaggaaacagtttggtgcccaagcaaatgtcatcggtccttggatccaaactaaaatggaagagattgggaggatctcgatagagatgcacggcacactcgaggatcagttgtcccacctccgccaatatgaaaaaagcattgtgaactataaacccaaaattgaccagctggagggagaccaccaactgattcaggaagccctgatattcgataacaaacacacaaattacacaatggaacacatcagggtcggctgggaacagttattgactaccatagccagaacgatcaatgaggtggagaatcagattctgaccagggatgctaagggcataagtcaggagcagatgaacgagttcagagcttctttcaatcattttgatagagaccacagcggcacactggggccagaagagttcaaggcttgcctgatttctttgggatatgacatcggcaacgacccccagggcgaggctgaatttgccaggattatgagtatcgtagacccgaaccgcctgggggtggtgaccttccaggcgttcatagatttcatgtcccgggagacagcagacacagatacagctgaccaagtcatggcatctttcaagattctcgctggcgacaagaactacatcacgatggatgaacttcgtcgtgagctccccccagatcaggccgagtactgtatcgctcgtatggccccttacaccggcccagactcagtccctggagccctagattatatgagtttctccacagctctttatggggagtctgacctgtag

SEQ ID NO: 27195 - DNA, 2745 bp, Artificial Sequence
  Description of Artificial Sequence: Synthetic coding sequence
atggatcattacgattcccaacagacgaatgactacatgcagcctgaggaagattgggacagggatctgcttctcgatcctgcttgggagaaacagcagaggaaaacctttacagcctggtgtaattcccacctgcgcaaagcaggcacccaaattgaaaacatagaggaagacttccgggacggactcaagttgatgctcctgctcgaggttatttctggggaacggttggccaaacctgaacgcggaaagatgagagttcataagatttccaatgtcaataaagctcttgattttattgcttccaagggagtaaaactggttagtattggcgctgaagagatcgttgatgggaacgtgaagatgaccctgggcatgatatggacaatcattctacgtttcgccatccaggacatttccgtagaagagaccagcgccaaggaaggcctgcttctgtggtgccagcggaagacagccccatacaaaaacgttaatattcagaactttcacatcagttggaaagacggcctcggcttctgcgccctgatccaccggcaccgccctgagctgatcgactatggtaagctccggaaagacgacccactcaccaatctcaacacagcattcgatgtggctgaaaaatacttggatattccaaaaatgctggacgcagaagacattgtgggcaccgcccgaccagatgaaaaagccattatgacgtacgtgtcatctttctatcatgccttctccggcgctcagaaagcagagaccgcagcaaatagaatttgcaaggtgctggctgtaaaccaggagaatgaacagctgatggaagactacgagaagctggcctcagacctgctagagtggatccgtcggacaatcccctggttggagaatagggtgcccgagaacacaatgcacgccatgcagcagaaactcgaggactttcgggactatcgaaggttgcacaaaccgcctaaagtccaagaaaaatgtcagctggagatcaactttaatactctgcagaccaaattgcgcctctccaaccgacctgctttcatgccgagcgagggaagaatggtgagcgatatcaataatgcatggggctgcttagaacaggtcgaaaagggctacgaagagtggttactcaacgaaattaggcgtctggagcgccttgaccacctcgccgaaaaattcagacaaaaggcctccatacacgaggcttggacggatggcaaagaagctatgctccggcagaaagactacgagaccgcaaccctgagcgagatcaaagcgctcctcaaaaaacacgaggcctttgaatccgaccttgccgctcaccaggaccgggtggagcagattgccgctattgcgcaggagctgaatgaactagactattacgactctccatccgtcaatgcacgctgtcagaaaatatgcgaccaatgggacaatcttggcgcacttacccaaaagcgccgtgaggcccttgagcggaccgaaaaactgctcgaaacgattgatcagctgtacttggagtatgccaaaagggccgcacccttcaataactggatggagggggctatggaagatctccaggataccttcatcgtccacacgatcgaagaaatccagggacttacgaccgcccacgaacagttcaaagcgactctgcctgatgcagacaaggaacgtttggccattctgggtatccacaacgaagttagcaagattgtccaaacctaccatgttaatatggctggaactaatccttataccactataacgccccaggaaattaacggcaagtgggatcatgtccggcagctggtgccccgtcgagaccaggctctgaccgaagagcatgccagacagcaacataacgagcgtctgagaaaacaattcggtgctcaagcaaacgtgatcggcccatggatacagactaagatggaagaaataggtagaatctctatagagatgcacggaaccctcgaggaccagctcagtcatctgcgccagtatgagaagtctatcgtcaattataaacctaaaattgaccagcttgaaggagaccaccagctgatccaggaggcgctgatttttgacaacaaacacaccaattacaccatggagcacattagggtgggatgggagcagcttctcactactatcgccaggaccatcaatgaagtagagaaccagatcctgacgcgagacgctaaaggcataagccaggagcaaatgaatgaattccgtgcctcctttaatcatttcgatagagatcatagcggaaccctaggtcctgaggagttcaaggcctgtctcatttccttaggctacgacattggcaatgacccccaaaagaagactggcatgatggatactgatgactttagagcatgtctcatctccatggggtataacatgggcgaagcagaatttgccagaatcatgtctatcgttgatcccaacaggctgggcgttgtcacatttcaggccttcatcgacttcatgagcagggagaccgcagacactgacaccgccgatcaggtgatggcctcttttaaaatccttgcaggagacaagaactacatcactatggatgagctgcggagagaactccctcctgatcaggccgagtactgcatcgccagaatggctccctacaccggacctgactccgtcccgggagctcttgattatatgtctttctccacagccctgtacggggagtctgatctttag

SEQ ID NO: 27196 - DNA, 2664 bp, Artificial Sequence
  Description of Artificial Sequence: Synthetic coding sequence
atggatcactacgactcacagcaaaccaatgattatatgcagcccgaggaggactgggacagggatctacttctagaccctgcttgggagaagcagcagcgcaaaacatttaccgcatggtgtaatagtcacctacgtaaggctgggacccagattgagaatatcgaggaagatttccgtgacgggctgaaactgatgttgctcctggaggtaatcagcggggagaggctagctaaaccggaacgcggtaagatgcgagtgcacaagatttcaaatgtgaacaaggctcttgatttcatcgccagcaagggtgtcaagcttgtgtcaatcggggctgaggagattgtggacggcaacgtgaagatgacgctggggatgatctggacaatcatactgcgtttcgctattcaggacattagcgtggaagagaccagtgctaaggaggggcttcttctctggtgccagaggaagaccgccccttacaaaaatgtgaacatacagaatttccatatatcatggaaggacgggctgggattctgcgctcttatacatagacatcgccctgaactcatcgattacgggaagctccgaaaggatgacccactcacgaaccttaatactgcctttgacgtcgctgaaaagtatctggatattccaaagatgctggacgcggaggatattgtcggaaccgcccgtcctgatgaaaaggcgataatgacatacgtttcttcattttaccacgccttttcaggtgcccagaaagctgaaaccgcagccaacagaatctgcaaagtgctggctgtgaatcaagaaaatgaacaattaatggaggactatgaaaagctcgcgtccgaccttctagagtggatccgacgaactatcccttggctcgagaatcgggtgcccgagaacacgatgcacgctatgcagcagaagctcgaggactttagagattacagacgattacataagccaccaaaggtgcaggagaagtgtcagctcgagatcaactttaatacgctgcagactaagttgaggctcagtaatagacctgcattcatgccctcagaaggtaggatggtctccgacattaacaacgcctgggggtgcctggagcaggtggagaaaggctacgaggaatggctgctaaacgagatccgtcggttggaacgtctagaccatcttgcggagaagttccgacagaaagcgtccattcacgaagcatggacagacgggaaggaggccatgctcaggcagaaggactatgagacagccacactgagtgagataaaggcccttttgaagaaacatgaggcctttgagtccgatctggccgctcatcaggatcgggttgagcagatcgccgctattgcgcaggaattgaatgaactggactattatgactcaccctctgtgaacgccaggtgccagaaaatttgcgaccagtgggacaacttgggcgctttaacccaaaaacgtcgagaagccctggagcggaccgaaaaactcctggaaacaatcgatcaactctacctcgaatatgccaaacgtgctgctccttttaacaactggatggaaggcgctatggaggaccttcaggatacttttatcgtgcatactatagaggagatccagggtctgacgactgcccacgaacagttcaaagcgacactccccgacgctgacaaggaacggcttgccatactgggtatacacaatgaggtgtctaaaatcgtccagacctaccacgtgaacatggccggtaccaacccttatacaacaataaccccccaggaaattaatggtaaatgggaccacgtgagacaattagttccaaggcgcgaccaggccctcacggaggagcatgcgagacagcagcacaacgagagactgcgaaaacaatttggtgcacaggcgaacgttattgggccatggattcagactaaaatggaagaaatcggtagaatttcaattgaaatgcatgggacgctcgaagaccagctgagccatctgagacagtacgaaaagtcaatagtaaactataaacccaaaatcgaccagctggaaggggatcatcagctgatccaggaagcattaatttttgacaacaagcatacaaattatacgatggaacacatccgagtagggtgggagcagctgctgaccactattgcacggacaattaatgaagtggaaaaccagatcctgactcgggatgccaagggtatcagtcaagaacagatgaatgaattccgggcatccttcaatcactttgatcgcaagaagaccggaatgatggacactgatgacttccgcgcatgcctcatctccatgggctacaacatgggcgaggccgagttcgccaggattatgtccatagtggatcctaaccgactgggggtggtgacattccaggctttcatcgactttatgtcacgcgaaacagcggacacagatacagctgaccaagtgatggcctcctttaagattctcgccggagataaaaactacattaccatggacgagctgaggagggaactcccccctgatcaggctgaatattgcatagcaaggatggctccttacaccggacccgactcagtgcctggggctctagattatatgtccttttcaacggcactgtatggggagagcgatctctag

SEQ ID NO: 27197 - DNA, 2736 bp, Artificial Sequence
  Description of Artificial Sequence: Synthetic coding sequence
atggtggactatcatgctgccaaccaaagctaccagtacggaccaagctcagccggaaatggtgcaggaggaggagggtccatgggcgactacatggctcaagaggatgattgggaccgggatctgctcctagatcctgcctgggaaaaacagcagcgcaagacctttaccgcctggtgcaatagccatttgagaaaagccggaacccaaatcgaaaatatcgatgaggattttcgcgacggactgaagctgatgttgctcctggaagtgatatcaggagaacgcctaccaaaaccagaaagaggaaaaatgcgcgttcataaaattaataatgtcaacaaggctctcgacttcatcgctagcaagggtgtgaaactggtttctatcggagcggaagaaatcgtggacggcaacgccaaaatgacacttggaatgatctggaccataatactccggttcgccattcaagacatttccgtcgaagagacaagcgccaaagaggggctcctcttgtggtgtcagcgcaagacggccccttacaaaaatgttaacgtgcagaactttcatataagttggaaagacggcttggcattcaacgcactcatccacaggcatagacccgagctcattgaatacgacaaactgcgaaaggacgaccctgtcacgaacctaaacaatgcttttgaggtggccgagaaatatctggacatcccaaagatgttagatgcagaagacatcgtgaatacggccagacctgatgagaaggccatcatgacttacgtctcatccttctatcacgcgttctcaggagcccagaaggctgagactgctgcaaaccgcatctgcaaggtgctggctgtgaaccaggaaaatgagcacctgatggaggattacgagaagctagccagtgatctcctggaatggattcgacgtacaataccatggctcgaggacagggtcccgcagaagactatccaggagatgcagcagaagctggaagattttcgcgactatcgcagggtccacaaacctccgaaagtacaggaaaagtgccagctggaaatcaacttcaacacactgcagacgaaacttcgcctgtccaatagacctgcattcatgccatcggagggaaagatggtctccgatattaacaatggttggcagcatttggagcaagccgagaaaggatatgaggagtggctgctaaatgagatccggcgactggaaagactggaccatctggcagagaaattccggcaaaaagcatccatacacgaggcatggaccgacggtaaagaggccatgctcaaacatcgagattatgaaacagcgaccttgtctgacataaaggcattgatccgtaagcatgaagcctttgaatccgatctcgcagcacaccaggatagggttgaacagatagccgcaatcgctcaggagttgaacgaacttgactattacgacagccacaacgtgaataccagatgccagaagatttgtgatcagtgggatgctctcggttctctgacccatagtaggcgcgaagccctggaaaagaccgagaagcagctggaagctatagatcagctgcacctggagtacgctaaaagagccgctcctttcaataactggatggaaagcgccatggaagacctgcaggacatgttcattgtgcacactattgaggagatcgaaggcctgatttctgcgcacgatcagtttaagtcgaccctacctgatgccgacagggaacgggaagctatcctggccattcataaagaggcccaacggatcgctgagagcaaccacatcaagctgagcggttccaacccctatacaaccgtaacgccccagattataaacagtaagtgggaaaaggtgcagcaactggtgcccaaaagagatcacgctctcctagaggagcaatctaaacaacagtctaacgaacatctcaggcgccagttcgccagtcaggctaatgtcgtgggtccctggatccagacaaagatggaagagattggacgaatcagcattgaaatgaacggcaccttggaggatcagctttcccacctcaaacagtacgagagaagtatcgtggattacaagccaaacctcgacctcctcgagcagcagcatcagttgatacaggaagccctgatttttgacaacaagcacacaaactacaccatggagcacatacgtgtaggttgggagcagctgctgactaccatcgctaggaccattaatgaggtggagaatcagatcctcacaagagatgcaaaaggtatcagccaggagcagatgcaggagtttagagcttcatttaatcatttcgacaaagaccatggcggagctctcggcccagaggagtttaaagcttgtttgatttcccttgggtacgatgttgaaaatgatagacagggagaggccgaattcaacaggataatgtctctcgtggaccctaaccactcaggattggttaccttccaagcttttatcgacttcatgtctcgagaaactactgacacagacacagccgaccaagtgatagcctcctttaaggtgttggcaggcgataaaaatttcattacagctgaggagcttcgcagggaattgccaccggatcaggccgaatactgtattgccaggatggcaccttaccagggcccagacgctgtgcctggcgcactggactataagtctttttcaacggcactctatggtgaaagtgatctctag

SEQ ID NO: 27198 - DNA, 2079 bp, Artificial Sequence
  Description of Artificial Sequence: Synthetic coding sequence
atggtcgattaccacgcagcgaaccagtcgtatcagtatggccctagctcggctggcaatggtgcaggcggtggaggctctatgggcgactatatggcacaggaagatgactgggaccgcgacctccttttagacccggcttgggagaagcagcagcgcaaggcagagaccgctgctaatcggatctgcaaagtgctagccgtcaatcaggagaatgaacacctcatggaagattacgagaagctcgcctccgacctgttggagtggatccgccgaaccatcccctggcttgaggaccgggtgcctcagaagactatccaagaaatgcagcaaaagctggaggatttccgggactacaggagggtgcacaagcctcctaaggtgcaggagaagtgccagctagagatcaatttcaatactttgcaaacaaagcttcgtctttcgaataggcctgcatttatgccgtctgaaggaaagatggtatccgatattaataatggatggcagcatctagaacaagcagagaaggggtatgaagagtggttgctcaatgagatcaggcgccttgagcgactcgaccatctggccgaaaagtttcgacagaaagcatctattcatgaggcttggacggacggcaaggaggcgatgctgaagcatcgggactacgagacagcaactctgtccgacataaaggccctgatccggaagcacgaggcattcgagagcgacctcgcagctcaccaggacagagtggagcagattgctgcaattgcccaggagctgaacgaactcgattactacgacagccataatgtcaacacccgctgtcagaagatatgcgatcaatgggacgcactgggatctctgactcacagtcgcagagaggccctggaaaagactgagaagcaactcgaagcgattgatcagcttcatctcgaatacgccaagagggccgcacctttcaataattggatggaatccgctatggaagaccttcaggacatgtttattgtgcacactatagaggagatagaggggctcatctccgcacacgatcagtttaaatctacattacccgatgccgatcgggaacgggaagccattctggctatacacaaagaggcgcagcggattgccgagagtaaccatatcaagttatctgggtccaacccatataccacagtgacccctcagattatcaattcaaagtgggagaaagtgcagcagctagtgccaaaacgcgatcatgccctgttagaggagcaatcaaagcagcagagcaacgagcacctccggcgacagttcgcctctcaagcaaacgtcgtggggccttggatacagaccaagatggaagaaatagggaggatttccattgaaatgaatgggacactcgaggaccagttgagtcacttgaagcagtacgaacgctccatagtcgactacaagccgaatctggacctgctggagcagcagcatcagctgatccaggaggcccttatcttcgacaacaagcacacaaattacacaatggagcacattcgcgtgggctgggagcagctgctgaccacaatcgcacgtaccatcaatgaggtggaaaatcaaatcttgacaagagatgcaaagggaataagccaagagcaaatgcaggagtttagggcatcctttaaccactttgacaaggaccatggcggagccctgggtcccgaggagttcaaagcatgcctcatctcgctgggttatgatgtggagaacgacaggcagggtgaggccgaattcaaccggattatgagccttgtagaccccaatcattccggcttggtgacgtttcaggcatttatcgactttatgagcagagagaccacggataccgataccgcagatcaggttatcgcatcattcaaggtgctagcaggagataaaaatttcatcaccgctgaggaactcaggcgagaactgccgccagaccaggccgaatattgtatcgccaggatggccccttaccaaggccctgacgcagtgcccggtgcccttgactacaaatccttctccaccgccctgtatggggagagcgatttgtag

SEQ ID NO: 27199 - DNA, 1566 bp, Artificial Sequence
  Description of Artificial Sequence: Synthetic coding sequence
atggtcgactatcacgccgcaaaccaatcctaccagtacggaccatccagcgccggtaatggggcaggtggcggtgggagtatgggtgactatatggctcaagaggacgactgggaccgcgacttgcttcttgatcctgcctgggaaaagcaacagcgtaaaacctttaccgcctggtgcaactcgcacctgagaaaggccggtactcagattgaaaatattgatgaagacttcagagatggtctgaagctgatgctgcttctcgaggtgcatgaattggactattatgactcacacaacgtgaacacccgctgtcagaagatctgcgatcagtgggacgctctgggaagcttgacacacagccgccgagaggcccttgagaaaacggagaagcagctcgaagccatcgatcaactccatttggagtacgccaagcgggctgcccctttcaacaactggatggaatcggctatggaagatctgcaagatatgttcattgttcacacaatcgaagagatcgagggcttgatctcagcacacgaccagttcaaatccactcttccagacgcagatcgcgagcgtgaagccatcctagccattcacaaggaagcacagcgcatagccgagtccaaccatatcaagctgagcggaagcaatccttataccaccgtgaccccccagatcatcaatagcaagtgggaaaaggttcagcagctggttcccaagcgggatcacgctttgctggaagagcaatcaaagcaacagagcaatgagcacctcagacggcaatttgcctcacaagcaaatgtggtcgggccatggattcaaaccaagatggaggagatcggtaggatctcaattgaaatgaacgggaccttggaggaccagttatcacatctcaaacaatacgagcgaagcatcgttgattacaagccaaatctggacctgcttgaacagcagcatcagcttattcaggaggctttgatcttcgacaataagcacactaactacaccatggagcatatacgcgtgggatgggagcagctactgactaccattgcgcgaaccatcaacgaagtcgagaatcagatcctcacccgcgatgctaagggaatatcgcaggaacagatgcaagagtttagggcttcgttcaatcatttcgataaagatcacggcggtgcactggggccagaggagttcaaggcttgtctgatttcgctaggctatgacgtggagaacgacagacagggggaggctgagtttaatagaattatgtcgctagtagaccctaatcacagtgggcttgtcacctttcaggcgttcattgacttcatgagccgagagactacagatacggatacagcggaccaggttatcgcaagcttcaaggttttagccggagataagaacttcatcacggccgaggaactgagaagagagcttccacccgatcaggcggagtattgtatcgctcgcatggctccataccaggggcctgatgcagttcctggagccctcgactacaagagcttctccaccgcgctgtacggagaaagcgatctgtag

SEQ ID NO: 27200 - DNA, 1689 bp, Artificial Sequence
  Description of Artificial Sequence: Synthetic coding sequence
atggtcgactaccacgcggcaaatcagtcctaccagtatggtcccagctctgcaggcaacggtgctggtggaggtggatcaatgggggactatatggctcaggaagacgactgggatcgggacctgttgctagacccagcctgggagaagcagcagcggaaaacatttactgcctggtgcaacagtcaccttcgaaaagccggtactcagatcgagaacatcgacgaggactttagggatggtttaaagcttatgttacttctggaggtaatatctggcgaaaggttacctaagccggagcggggaaaaatgcgagttcacaaaatcaataatgtgaataaagccctggactttatcgcttccaaaggagtgaaactcgtatccataggcgctgaagagatcgtggacggcaacgccaagatgacacttgggatgatttggactattatacttcgatttgccatacaggatattagcgtggaggagacctcagcaaaagagggactactactctggtgccagcgcaagactgcaccttacaagaacgtgaacgtgcaaaacttccatatcagctggaaagacggcctggccttcaacgccctgattcatcgccaccgccctgagctgatagaatatgacaaactgaggaaagacgatcctgtgacaaacctcaacaatgcctttgaagtggctgaaaaatacttggacatccccaagatgctcgatgccgaagatatcgtgaatacagctcggcctgatgagaaggccatcatgacatatgtcagctctttttaccacgcattttctggagctcagaaggctgaaaccgccgcaaataggatctgtaaggtcctggccgtcaatcaggagaacgagcacctgatggaagactatgagaaactggcctctgatctcttagagtggataagacggaccataccctggctggaggatcgcgttccccagaaaaccatccaagagatgcagcagaagctggaggattttcgcgactaccgtagggtgcataaaccaccaaaggtgcaggaaaagtgccaactagagatcaactttaatacgcttcagactaaactgagactgtcaaacaggcctgcgttcatgccgtctgagggcaagatggtctccgacatcaacaacggctggcagcatctggaacaagccgaaaaggggtacgaggagtggctgctgaatgaaattagaaggctggaaagactggatcacctcgccgagaaattccggcagaaggcctcaatccacgaagcgtggacagatggcaaggaggccatgttgaagcaccgggactacgaaacagccacattgagcgacatcaaagccctgatcagaaagcatgaggcatttgagtccgatctcgcagcccaccaagatagagttgaacagattgcggctatcgcgcaagagctcaacgaattagactattatgattcccacaatgtcaacaccccagatggtctccaagaaggccctggtcaaccccactctcccatacctcccctgtgtatttacgctaaacatagcttgcagtcttctggggtcggaggatgggcgggacggggatggggaaggctgagcccgctgtcactgtgcggactggctcgcaggtttcccaggcccggatggggtgacttgggccctgctctcctcgtgtggtag

SEQ ID NO: 27201 - DNA, 1518 bp, Artificial Sequence
  Description of Artificial Sequence: Synthetic coding sequence
atgaaatttaagttgcacgtcaactccgcccgacaatataaagatttgtggaacatgtctgatgacaaacctttcctctgtaccgcccctggatgcggacagaggtttacaaatgaagatcacctggcagtgcataagcacaagcatgagatgacgctcaagtttggccctgcgaggaacgatagtgtaatagtcgcagaccaaacacctacccccacaagatttctaaagaactgtgaagaagtcggcctcttcaacgaattggcttcccctttcgaaaacgagtttaaaaaggccagtgaagatgacattaagaaaatgcccctggacttgtccccacttgctactccaattattagatctaagatcgaggagccctctgtcgtggaaaccacccaccaggattcacctttgccccaccccgaatctaccacgtctgatgaaaaggaggtgccactcgctcagactgcccaacccacctctgctattgtgcggccagccagtttgcaagtaccgaatgttttactgacgtcgagcgattcttccgtcatcattcaacaggccgttccttctcctactagcagtaccgtcattacacaggcgccaagctccaacagaccaatagtcccagtgcccggtccatttccgcttctgttgcatctgcctaatggtcaaacaatgccagtggcaatcccagcttcaattacctcgtcgaacgttcatgtgccagcggctgtgcctttggtacggcctgtcaccatggtccctagcgtgccgggaattcccggaccctcctcaccccagcccgttcagtcagaggccaaaatgagacttaaggccgcactgacccagcaacaccctcctgtcaccaatggtgacacagttaagggtcatgggagtggcctggtccggacgcagagcgaggagtctaggcctcagagcctgcaacagcccgcaacctctactactgagactcccgctagtcctgcacacactactcctcagacccagtccacatcggggcgtagaaggcgcgctgcaaatgaggacccagatgagaaacggaggaaatttttggagcgcaatagagcagccgcatctcggtgtaggcagaagcgtaaggtatgggtgcagtccctcgaaaagaaagcagaggatctttccagtctgaatggtcaactgcaatcagaggttaccctcctgaggaacgaggtggctcagctcaagcaacttttgttggctcataaggattgccctgtcacagccatgcagaaaaagtctggctaccacaccgccgacaaggatgatagttccgaggacatcagcgtcccctcatcaccacacaccgaagccatccagcatagttcagtgtccactagtaacggagtcagcagtacgagcaaagccgaggcagtcgcgacgtccgtccttacgcagatggccgaccagtctacagaaccagctttaagtcaaatcgttatggccccttcttcacagtcccagccttcaggatcgtag

SEQ ID NO: 27202 - DNA, 1344 bp, Artificial Sequence
  Description of Artificial Sequence: Synthetic coding sequence
atgtattgcgcgtggatgtggcccgaccagacacccactccaacacgctttctcaaaaattgtgaagaggtagggctttttaatgagctggcgtcaccatttgaaaacgaattcaaaaaagcttcggaagacgacattaagaagatgccattggatcttagcccactggccacgccaattattagaagcaagatcgaagagccatccgtggtcgagacaacgcatcaagatagccctcttccccatcctgagtccaccacatctgacgagaaagaggtacctctggcgcagacggcccagcctacctctgcaatcgtgagacctgccagcttgcaggtgcccaatgtcctgttgacctctagcgactctagcgtgattattcagcaggctgtcccaagcccaacgtcttcaaccgtgataactcaagcaccctcttcgaataggcccattgtgccagtgccaggcccattcccactgctccttcaccttcctaatggccagaccatgcctgtggcgattccagcctctattacctctagtaacgttcacgtccccgcagcagtgcctctcgtccgacccgtcacaatggtaccctctgtccctggtatacccggtccgtcctcaccccagccagtccagtccgaggctaagatgcgtcttaaagccgctctcacccagcagcaccccccagtcacgaatggcgatacggtgaaagggcatggaagcggcctggtgcgcacccagagcgaggagagtaggccacaaagcctgcagcagcctgctactagcacaaccgagactcccgcttctccagcacacactactccgcagacccaaagcacgtctgggaggagaagacgggctgcaaacgaggacccagatgaaaagagacggaagttcctggagcggaacagggccgctgccagtcggtgtaggcagaaacggaaagtttgggtgcaatcgcttgagaagaaggcagaggatctgagctcgctgaatgggcagctccaaagtgaggtcactttactccgcaatgaggtggctcagttaaaacagctcttgctcgcccacaaggactgccccgttactgcaatgcagaaaaagtctgggtatcatacggccgataaagacgactccagtgaagacatctctgtgccaagcagcccacataccgaggcgatccagcacagttccgtcagtacaagcaatggcgtttcatcgactagtaaagccgaggcagtggcgacaagcgtactcacccaaatggctgatcagtctacagagcccgctttgagtcagatcgtgatggcgccttcctctcaaagccagcctagtggaagttag

SEQ ID NO: 27203 - DNA, 381 bp, Artificial Sequence
  Description of Artificial Sequence: Synthetic coding sequence
atgagtgatgataagcccttcttatgcaccgctccaggctgcgggcagagtgaggtcactctcctgcgaaacgaggttgctcaactcaaacaattgcttctcgcccataaggattgtccagtgaccgcgatgcagaagaagtccggctaccacacagcggataaagatgatagctccgaggatattagcgtgcctagctccccccacacagaagctatccagcactcaagtgtatctacatcgaacggggtctcgagcacgagtaaggccgaggccgtagccacctcagtcctgacccagatggctgaccaatcgacggagcctgcccttagccaaattgtgatggccccttcctcccagtcgcagccaagtggttcttag

SEQ ID NO: 27204 - DNA, 1518 bp, Artificial Sequence
  Description of Artificial Sequence: Synthetic coding sequence
atgaagttcaaattacatgtgaattccgcacgccagtacaaagatctgtggaacatgtcagacgataagcccttcctgtgtacagcgccagggtgtggccaaaggttcacaaacgaagatcatctggccgtgcataagcacaaacacgaaatgacattaaagttcggtcccgctaggaacgactctgtaatcgtggccgaccaaactccaaccccaaccagattcctcaagaactgtgaggaggtaggattatttaacgaactcgcatccccctttgagaacgagttcaagaaagcatcagaggatgatataaaaaaaatgcccctcgacctcagcccactggccaccccaatcatcagaagcaagatagaggaaccgtccgtcgtggaaacgactcaccaggattccccactgccccatcctgaatctaccactagcgatgagaaggaggttcccttagcccagacagctcagccaacatcagctatcgttcgcccagcgtcattacaggttcccaatgtgctcctgacatcttctgattcatctgtcatcattcaacaggcagtgccatccccaacctcaagcactgtgattacacaagccccatcatctaataggcctatcgtccctgtccccggacccttccctcttcttctgcacctccctaacggacagaccatgcctgtcgctatacccgcaagtattacatcgagcaacgtccatgtcccagcagcggtccctctagtgcgacccgttaccatggtgcccagtgtcccaggtattcccggtccctcttcaccccagcctgtgcagagtgaagctaaaatgcgactgaaagccgcactgactcaacagcatccacctgtaacgaatggggataccgtgaaaggccatgggagtggcctggtacggacacagtcagaggagtctcgacctcagtcattgcagcaaccagccaccagtaccaccgaaaccccggcatccccggcacacacgaccccccagacacagtccacctcagggaggagacgacgggctgctaacgaagaccctgatgaaaaacggaggaagttcttggagcgaaaccgcgcagcggcatctcggtgtcgacagaagagaaaggtgtgggtacagagtcttgaaaagaaggccgaagatctgtcttctctgaatggccagctccagagtgaagtgacgttactgaggaacgaggttgcacaattaaagcagcttctcttagcccacaaggattgtcccgtgacagccatgcaaaagaaatccggctatcacaccgccgacaaggacgattcatctgaggacatttctgtgccttcatcgccgcacacagaggctatccagcactcatcagtgtcaacatctaacggcgtgtcctccactagtaaagccgaagccgtcgcaacatcagtgctaacccagatggcagaccagagtactgaacccgctctgtcgcagatcgtaatggctccttcctcgcagtcccaacccagtggttcttag

SEQ ID NO: 27205 - DNA, 1344 bp, Artificial Sequence
  Description of Artificial Sequence: Synthetic coding sequence
atgtattgtgcgtggatgtggccagatcagaccccaactcctacaaggtttctgaagaattgtgaggaggtgggcctttttaatgagctggcctcccccttcgaaaatgagttcaagaaggcaagtgaggatgatattaaaaaaatgcccttggatctcagtcctctcgcaacccccattatccggtcaaaaatcgaggagccatccgtggtagagaccacacatcaagacagcccccttccacatcctgagtcaacaacatcagacgaaaaagaggtacctctggctcagactgctcaaccgacttcagcaatcgtacggccagcaagcctccaagtgcccaatgtgctacttacttccagcgattcttccgttatcattcagcaagctgtgccgtcgcccacctcttccacagtcatcactcaggccccaagttctaataggccaattgtccccgtccccggtccttttcccctgctgttacacctgcccaacgggcagactatgcccgtagcaattccagcttcaattacgagcagtaacgtgcatgtgccggctgccgtgccactggtcagacctgtgaccatggtgcctagcgttcccggaatccccggtccgtcgtctccccaaccggttcagtctgaagccaagatgagactcaaagccgctctcacacagcagcaccccccagtgacaaacggagacacggttaagggccatggctctggactagtccggacccagagcgaggagtctaggccgcagagcttgcagcagcccgcaacatcaaccacagagactcccgctagcccagcccataccaccccgcaaactcagagtacgagtgggagacggcgtcgtgccgcaaacgaggaccccgacgagaagaggaggaagttcttagagagaaatagagcagccgcaagtcgctgcagacagaagcggaaggtctgggtgcagtccctcgagaagaaagcagaggacctgtcctccctgaacggacagttgcaaagtgaggtgaccttactccgtaatgaggttgcccagcttaaacaattgttactggcccacaaagattgtccagtaacagctatgcagaaaaaatcaggctaccacaccgccgataaagatgattcctccgaggatatctccgttccttcttccccccatacggaagcaattcagcactcatccgtgagcacttccaatggcgttagctctaccagtaaagccgaggcagtggctacttccgtgctcacccagatggcagaccagagtacagagcccgctctatcccagatcgtgatggccccttcctctcaatcccaaccatcgggcagctag

SEQ ID NO: 27206 - DNA, 630 bp, Artificial Sequence
  Description of Artificial Sequence: Synthetic coding sequence
atgaaatttaaactgcacgtcaattcagctcgacagtacaaagacctctggaacatgagtgatgataagccatttctttgcaccgccccaggctgcgggcagaggtttacgaacgaagatcacctcgcagtacataaacacaaacatgaaatgaccttgaaatttggaccggctcgcaacgactctgtgattgtcgcagatcaaacacctacccctacccggtttcttaaaaattgtgaagaggtaggcctgttcaatgaattggctagtccttttgagaatgagtttaagaaggccagcgaagatgacatcaaaaaaatgcctttagatctatcacctctcgctaccccaatcatccggtccaaaattgaggagcctagtgtcgtagagacaactcaccaggactccccactgccccaccccgagagtactaccagtgacgaaaaggaagtccctctggcacagacagcccaacctacgtcagcaatcgtccggcctgcttccctgcaggtgccaaatgtgctgttgacctcctcagattccagcgtcattatccagcaagcagtcccttccccaacatcctctacagtcattacacaggcgcctagttccaataggccaatcgtatag

SEQ ID NO: 27207 - DNA, 1188 bp, Artificial Sequence
  Description of Artificial Sequence: Synthetic coding sequence
atgaagtttaaattacatgtaaattccgctcggcaatataaggacctctggaatatgagcgacgataagccttttttgtgtaccgcacccggttgtggccaacgttttactaacgaggatcatctggctgtccacaaacacaagcacgagatgacactgaagttcgggcctgcgcgtaatgactccgtaatagtggccgaccagactcctacccctacccgattcctgaaaaactgtgaagaagtggggctctttaacgagctcgcctcaccctttgagaatgaatttaagaaggcctcagaggacgacatcaaaaagatgccgctggatctgtctccactggccacccccataattcggtccaaaatcgaggagccttcagtggtagaaacaacccaccaagacagccccctgccccatcccgaatctaccactagcgacgaaaaagaggtgccactagcgcagactgcacaacctacttctgccatcgtgaggccggctagcctacaggtccctaacgtgctgttaacttcttcagacagctccgtgattattcaacaggccgtcccttctcctacaagctctaccgtgatcacccaagccccttcttccaaccggccaatcgtccctgtacccggaccctttccactccttctacacctccctaacggacagacaatgcctgttgcaataccggctagcattacatcctccaacgtccatgtgcccgcagccgtgccgctggtgagaccagtcacgatggttccaagtgtccctgggataccagggccttcgtcaccgcagcccgtgcagtccgaagccaagatgagactgaaggcggcacttacccagcagcaccctccagtcacaaatggcgatacagtcaaaggtcatgggtcaggcctggtgagaactcaatcggaggagtctagaccgcagtcgctgcagcaacccgcaacttccaccaccgagacccccgcatcccctgctcacactacccctcagacacagagcaccagcggtagaagacgcagagccgcaaacgaagatccggacgaaaaaaggcgaaaatttttggaacgaaacagggccgctgcttctcgctgtcgtcagaaacgcaaagtttgggttcagtcgctggagaagaaggctgaggacttgtcctctttgaatggacaactccagtag

SEQ ID NO: 27208 - DNA, 714 bp, Artificial Sequence
  Description of Artificial Sequence: Synthetic coding sequence
atgaagttcaagttgcacgtgaattccgcccgacagtataaggacctgtggaacatgtccgatgataaaccattcctgtgcaccgcccctggctgtggacagaggttcacaaatgaagaccacctggccgtacacaagcacaagcatgaaatgaccctaaaatttggaccagccagaaatgactctgtgatcgttgcggaccaaacccccactcccacaaggtttttgaagaactgtgaggaggttggacttttcaatgaactggcatctccctttgaaaacgagtttaaaaaggcatcggaggatgacattaagaagatgccacttgacctaagccccctggcaacacctatcattcggtctaagattgaggaaccgagtgtggtggaaaccacacatcaggactccccactcccacatcccgaatctacgacctccgatgagaaagaggtaccgcttgctcagaccgcacagcccactagtgcaatcgttcgcccagcaagcttgcaggtgcccaacgttctcctcacctcgtccgacagttcagtgatcatccagcaagcagtcccatcccccacaagctcaacagtcatcacacaggcaccaagctctaacaggccaatcgtttcctttgaccagagtccctggtgcctggtcttccaggagagccaggtgttgccgttacctaatcagtactcccagaagcagaaatag

SEQ ID NO: 27209 - DNA, 1464 bp, Artificial Sequence
  Description of Artificial Sequence: Synthetic coding sequence
atgtctgacgacaaaccgtttctctgcacagcgcctggatgcggccagagatttacaaacgaagaccacctagcagtacataagcacaagcacgagatgaccctgaagttcggtccagctcgcaacgactcagtgattgtggctgaccaaacccctacccctacccggttcttgaagaattgtgaagaggtgggactgtttaatgagttagctagcccattcgaaaacgaattcaaaaaagctagcgaggatgatatcaagaagatgccgctcgacctgagccctctagcaacaccgattatcaggtccaaaatcgaggagcctagcgttgtggagaccacccatcaggatagtccactcccccaccccgagagtactacctctgacgagaaggaggtacctctggctcaaacagcccagccaacctcagctattgtgcgcccagctagcttgcaagtccctaatgtgctgctaaccagctccgattcaagcgtgatcatccagcaggccgtgccctccccgacgtcctctacagtgattactcaggcacctagttccaaccgaccaatcgtgcccgttccaggtcctttcccattgctgctgcacctgcccaacgggcagacaatgccagtcgcaattcctgccagcatcactagctctaacgtacacgtgcctgcggcagttcccctggtgcggcctgtcactatggtgcccagcgtaccaggcattcctggccctagcagtccacaacctgtgcaatccgaggctaaaatgcggttgaaggcagccctaactcagcagcatccaccagtgaccaatggagatacggttaaaggacacgggagtggcctggtgagaacacagagcgaggaatcccgcccacaatctctccagcaaccagcaacatctacaacggagacccctgcttcacctgctcataccaccccgcaaacacagtccacatctgggaggcggagacgcgcagcgaatgaggaccctgacgagaagaggaggaaatttttagagcgcaaccgggctgctgctagtcgctgccgccagaagcgtaaagtttgggttcagtctctggagaagaaagcggaggaccttagctcgctgaacgggcagctgcagtccgaagtcaccctcttgagaaacgaagtcgcccagttgaagcagctcctactggcccacaaggactgtccagtgacggctatgcagaagaagagtgggtaccacactgccgacaaagatgatagcagcgaagatatctcagtcccatcctccccccatacagaggccatccagcattccagcgtgtctacatccaacggagtcagttcaacaagcaaggcagaagctgtggcaacgtcagtcctcactcagatggcagatcagtccaccgaaccggctttaagccagatcgtgatggcaccatcctcacagagccaacccagcggctcctag

SEQ ID NO: 27210 - DNA, 1188 bp, Artificial Sequence
  Description of Artificial Sequence: Synthetic coding sequence
atgaagttcaagctccacgtgaactcagccagacagtacaaggacctctggaacatgagtgatgataaaccgttcctgtgcacagctccagggtgtggtcaacgctttacaaatgaagaccatcttgcggtgcacaaacacaaacacgagatgaccttaaagttcggaccagccagaaacgattccgtcatagtggctgatcaaacgcctacaccaacgcgctttcttaagaattgtgaggaggttgggctattcaacgaactcgcgtctccttttgagaacgagttcaaaaaagcctccgaggatgacataaagaagatgcccctcgatcttagtccgctggctacccctatcattcggagtaaaattgaggaaccgtccgttgttgagaccacccaccaggacagtcccctaccacatcctgaaagcacaaccagtgacgagaaggaggtacccctggctcagactgctcagccaacatctgctatagtccgcccagcgagtctgcaggttcctaacgttctcctcacatccagtgatagtagtgtgatcattcagcaggccgtcccaagccctacaagcagtactgtgatcacccaagccccatcctccaataggcctattgtgccggtccctgggccttttccacttcttctgcacttgccgaatggccaaactatgccagtggcaattcctgccagtattacttctagtaacgtgcatgtgcccgcagcagttccccttgttagacctgtcacaatggttccctccgtacctggtattccaggcccaagctctccacagcctgtccagtctgaagccaaaatgaggttgaaagcagccctcacacaacagcatcctcctgtaactaatggggatactgtcaagggccacgggtccggccttgtgcgcacccagtccgaagaatctcggcctcaaagtttgcagcagccagcaacaagcactacagagacgcctgctagcccggctcatacgactccccaaacccaatctaccagtggacgccgaagaagagctgccaacgaggaccccgacgagaaaagaagaaagttcctggagaggaatagagcagccgctagtcgttgccgccaaaagaggaaagtctgggtgcagtcgttagagaaaaaagctgaggatctgtcctccttgaacggccagctccagtag

SEQ ID NO: 27211 - DNA, 1188 bp, Artificial Sequence
  Description of Artificial Sequence: Synthetic coding sequence
atgaaatttaagctgcacgtaaacagtgctcgacagtataaggacctttggaatatgtccgacgacaagccattcctttgcactgcaccagggtgcggacagcggttcacaaacgaagatcacctggccgtgcacaaacacaaacacgaaatgaccttaaagtttgggcctgcgaggaatgactccgtgattgtggccgaccagacaccgactcccacacgattcctgaaaaattgcgaggaagttggcttgtttaatgagctggcttcacctttcgaaaacgagtttaaaaaggcatccgaggacgacatcaaaaaaatgcctctagatttgagtcctctcgctacaccaattattagaagtaaaatcgaagaaccatcagtcgtggagacaacgcaccaggacagtccccttccccatccagagagcaccacgtccgatgaaaaagaggtcccactcgcccagaccgcccagccaacctcagctatagtaagaccagccagcctccaggtgcccaacgtgcttctgacatccagtgactcttcagttatcatccagcaggccgtgccaagcccaaccagcagtaccgtcatcacccaggctccttccagcaatcgacccatcgtgcctgtgccaggcccatttcccttgcttctgcacctgcctaatggccagaccatgccagtggccataccggcatcgatcacaagctccaacgttcacgtgcccgctgctgtgccactggtgcgccctgtgaccatggtaccttcagtgccaggcattcccggaccaagctcgccccagccagtgcagtctgaggccaaaatgagacttaaagctgctcttacccaacaacaccctccggtgaccaacggggatactgttaaagggcatggctcgggattggtcaggactcagagtgaagagagccgaccccagtcattgcagcagcctgcaacaagcaccactgaaactcccgcaagccctgcccacacaaccccccagacccaatccacatccggaaggagaagacgggcagccaatgaagatcccgatgagaagcggcgaaaattccttgagagaaatcgagccgcagcctcacgatgtcgacagaagaggaaggtgtgggtccaatccctggaaaaaaaggccgaagatctttcgagtctgaatggccaactgcaatag

SEQ ID NO: 27212 - DNA, 660 bp, Artificial Sequence
  Description of Artificial Sequence: Synthetic coding sequence
atgagtgatgataaaccttttctctgtaccgccccaggatgcgggcagcgatttactaacgaggaccatctggcagtacacaaacacaagcacgagatgaccctgaagtttggaccagccaggaacgacagcgttatcgtcgcagaccagacgccaacccctacaagattcttgaaaaattgcgaagaggtgggcttgtttaacgagttggcctcacccttcgagaacgagtttaaaaaagcttcagaggatgacataaagaaaatgcccttagatttaagcccgctggccacccctattattcgatccaaaattgaggagcctagcgtggtggaaacgacacatcaggattcgcccttgcctcatcctgagtctactaccagcgatgagaaagaagtccccttagcacagaccgcgcaacccacctcggcaatcgtgcgcccagccagtctgcaggttcccaacgtactcctgacttcatctgactcgagcgtgattatccagcaagcggtgcccagccccacgagcagcactgtaataacccaggctccctcctctaacaggccaattgtctcgttcgatcagtctccttggtgtctcgtgttccaagagtctcaggtgctgccgctgcccaatcagtattctcagaagcagaagtag

SEQ ID NO: 27213 - DNA, 1134 bp, Artificial Sequence
  Description of Artificial Sequence: Synthetic coding sequence
atgagcgacgacaaacccttcctctgtaccgctcccggatgtggccagcgcttcacgaacgaagatcatctggcagtacacaagcataagcatgaaatgactctgaaatttggcccagccaggaacgacagcgtgatcgtagcagatcagactccaaccccgacacggtttttaaagaattgtgaggaagttgggctcttcaacgagctggcctctccatttgaaaatgagtttaaaaaagccagcgaagatgacattaaaaagatgccgctggatctcagtcctctggcgacgcctattatcagaagtaaaatagaagagccttcagtggtagaaaccacacaccaggattctcccttgcctcaccccgagagtaccacttcagacgaaaaagaagtgcctctggcacaaaccgcgcagccaacttcagccatcgtccgacctgcctcactccaggtgcctaatgtactgctgacttctagcgactcctcagttatcatccagcaggccgtaccaagtccgaccagttccacagtgattactcaggcccctagctccaaccgccctatcgtgcctgtgccaggcccattccctctcctgctacacctgccgaatggtcagaccatgccagtggctatccccgcatcaattacctcctctaacgtgcacgtgcccgctgcggtcccactggtcagaccggtgacaatggtgcctagtgtccctggcatccctggcccatcctcacctcaaccagtccagagtgaggccaagatgaggttgaaggccgctctgacacaacagcatcctccagtaactaatggcgatacagtcaagggacatggctcgggattggttcgcacacagagcgaggagtcaaggccacaaagcctgcagcagcccgctaccagcaccacagaaacacctgcctcccctgcccataccactccccagacccagtccacaagtgggagaagacgcagagctgctaatgaggatccagacgaaaagaggagaaagtttctggaacgcaacagagccgctgcgagccgctgtaggcagaagcgaaaagtgtgggtgcagtccctggaaaagaaggccgaagatctgagcagcttgaatggccagctgcagtag

SEQ ID NO: 27214 - DNA, 1449 bp, Artificial Sequence
  Description of Artificial Sequence: Synthetic coding sequence
atgaagttcaagctgcatgtgaactcagcccgacagtataaagacctttggaatatgtccgatgacaagccatttctttgcaccgcaccgggttgtggtcagcggttcactaatgaagaccaccttgccgaccagactcctactcctactcgtttcctcaagaattgtgaggaggttggtttgttcaatgagttggcctcccccttcgagaacgaattcaagaaagcgagcgaagacgacataaaaaagatgccgcttgatttatccccacttgccactccgatcatccgctcgaagattgaagagcctagcgtggttgagaccacgcatcaagacagccctctccctcaccctgagagtacaacgtccgacgaaaaagaagtaccgctagctcagaccgcacagccgacgtccgccatcgttcggcctgctagcctgcaggtgccaaacgttctgctcacatcatccgactcttccgtcatcatccagcaggctgtgcccagccccacatctagtactgtcataacacaagccccttcatcaaatagaccaatagtgcctgtcccaggcccatttccgttacttctgcatctgcctaacggccaaacaatgcccgtcgccatccccgcttccatcacatcctctaatgtgcatgtgccagcggctgtacctttggtgcggccagttacaatggtcccgtccgtcccaggcatcccaggaccctcctccccccagcccgtgcagagtgaagccaaaatgagacttaaagctgccctcacacagcagcacccgccagtgactaacggtgacaccgttaagggacacgggagcggcttggtgcgtacccaatctgaggaatctcggccacagagccttcagcagcccgctacatcaaccactgagactccagcctctcccgcacatacaacacctcaaactcagtcaacctcagggagaagaagaagggccgcaaatgaggaccccgatgagaaacgcagaaagtttctcgagcgcaatcgcgcagccgcttcaaggtgtagacaaaagcggaaagtgtgggtgcagtcacttgagaagaaagctgaggacctgagcagcctgaacggccagttgcagagcgaggtcacactgttgcgcaacgaggtcgcacagcttaagcaattattacttgcgcataaggattgtcctgtgaccgctatgcagaagaagtctggctaccacaccgcggacaaggacgactctagtgaagatatatccgttccatcatcaccccacaccgaagcaattcaacattcctccgtgagtacatcaaacggagtgtcaagtaccagtaaagccgaggctgtggctacgtctgtcctgacccagatggcggatcagtcaacggagccagctctgagccagattgttatggcaccaagctctcagagtcagcctagtggcagctag

SEQ ID NO: 27215 - DNA, 2136 bp, Artificial Sequence
  Description of Artificial Sequence: Synthetic coding sequence
atgaagttgaaactcaacgtgctcacaatcatcctcctgccggtgcatctgctcattactatatattctgctctcatttttattccctggtactttctgaccaacgccaaaaaaaaaaacgctatggctaagcggatcaaagccaaacccacttctgataagccaggttccccctatagatctgtaacccatttcgatagcctcgcagttatagatatccccggtgcagatacactggataagctcttcgatcatgccgtttcgaaatttgggaagaaggattccctcggaactcgggagatcctcagtgaggagaatgaaatgcagcccaacggaaaggtgttcaaaaaactgatcctcggcaattataagtggatgaactacctggaagtgaaccggagagttaataattttggaagcggcctgactgcactgggtctcaagccgaagaacaccattgccatcttttgtgagacgagagctgaatggatgattgctgcacagacctgtttcaagtacaacttcccactggtcacactatacgccacactcggcaaggaggcggtggttcatggcctcaatgagtcagaggcatcctatttgatcacctccgtggaactgctggaatctaagctgaagacggcccttttagacatatcctgcgttaaacacattatctatgtggataacaaggctattaataaggctgagtacccggaaggttttgagatccactcaatgcagagtgtggaagaattggggtccaatccagagaacctggggattcccccatccaggccaactccaagtgacatggctatagtcatgtatacatctggatccaccggccgtccaaaaggtgtgatgatgcatcatagtaacttgatcgctggtatgacggggcagtgcgagagaataccaggactagggcctaaagacacatatatcgggtacctgccactggcacatgtccttgagctgaccgccgaaatatcctgttttacctacggttgtcgtattggctactctagccccttgacactgagtgatcaatccagcaaaatcaagaagggcagtaaaggagattgcactgtgctgaagcctacactgatggcagccgtgcctgaaattatggacagaatctacaagaacgtcatgagcaaggtccaggaaatgaactacatccagaaaacactcttcaagatcggatacgactacaagcttgagcaaatcaaaaagggctatgatgcccctttatgtaatctcttgttgtttaagaaggtaaaagccctgctggggggtaacgtgagaatgatgctgtcggggggagcccctctgagcccacagacacaccgattcatgaacgtctgcttttgctgtcctatcggccaaggctacggactgacagaaagctgtggcgctggcaccgtgacagaggtaaccgattacacgactgggagagtaggtgctcccttaatctgctgtgaaatcaaattgaaagattggcaggaaggcggatacaccattaatgacaagccgaaccctcgcggagagattgtcatcggcggtcaaaatatttccatgggatattttaaaaatgaggaaaaaactgcagaagattactccgtggacgaaaacggccagcgctggttctgcaccggggatatcggcgagtttcatccagatgggtgtctccagattatagaccgaaagaaagatttggtgaagcttcaggccggagagtacgtgtcattgggaaaggtcgaggccgctctgaagaattgtcctcttatcgataacatttgtgcatttgccaagagtgatcagtcctatgtaatctcatttgtggtgccaaatcagaagagactgaccctactcgctcagcagaagggagtggaaggtacctgggtagacatttgcaacaaccctgccatggaggccgagattctgaaagagattagggaagctgccaacgccatgaaactggagcggtttgagataccaatcaaggtgcggcttagcccggaaccttggacacctgaaacgggcctcgtgactgatgcatttaaactaaagagaaaggagttgcgtaaccactatctcaaggatatcgagaggatgtatggcggtaaatag

SEQ ID NO: 27216 - DNA, 2013 bp, Artificial Sequence
  Description of Artificial Sequence: Synthetic coding sequence
atggccaagcgcataaaggccaagccaactagtgataagcctggatctccttaccggagtgtgacacatttcgattctctggccgtgatcgatattccaggcgcagataccctcgataaactcttcgaccatgcggtgagtaaatttggcaagaaggacagtctcggcacaagagagattttatcagaggaaaacgaaatgcagcctaacggaaaggtgttcaagaagttgatcctggggaactataaatggatgaactacctcgaggttaatcgcagggtgaataattttggcagcgggctaactgcgttgggccttaaaccaaaaaatacaatagctatcttctgcgaaacccgcgcagaatggatgatcgcggctcagacatgctttaagtataatttcccactggtcaccctgtacgcaaccctgggcaaggaggctgtagtccacggtctgaacgagagcgaagctagttacttgatcacctcagtggagcttcttgaatctaagctcaaaaccgccttattagatattagctgtgtgaaacatatcatctatgtagacaataaagccattaataaagcagagtatcctgaagggttcgagatccattcaatgcagtcagtggaagaactagggagcaacccggagaatctaggcattcccccaagccgcccaaccccatctgacatggccatcgtcatgtacacgtctggttcaactggcagaccaaagggggtgatgatgcaccacagcaatcttattgccggtatgacgggccagtgcgagcgaatcccaggactcggtcccaaggatacctatattggatatctaccgttagcacacgtactggaattgacagcggagattagctgctttacctatggctgtcggattggttactcctccccacttacattgtcagaccagagttccaaaatcaaaaagggctccaaaggggactgcactgtcctgaagcccactcttatggccgcagtgccagagatcatggatcgtatttataaaaatgtaatgtcaaaggtgcaggaaatgaattacatccagaagacactgttcaagattggatacgactacaagttggagcagataaagaagggatatgacgctccattgtgtaacttgcttctgttcaaaaaggtcaaagccctgcttggcggaaacgtgaggatgatgctatccggtggagcacccctttcccctcagacacatcggttcatgaatgtgtgtttttgctgtcctataggtcagggctacgggttaacagaaagctgcggggcagggacggtgactgaggtgactgattatacaaccgggagagttggcgcaccactgatctgctgcgaaattaagttgaaagattggcaagaagggggttataccatcaacgacaaaccaaacccacggggagagatcgtgataggaggccagaatatttctatgggttatttcaaaaatgaggaaaaaacagcagaggactactctgtagacgaaaatggacagagatggttttgtacaggggatatcggtgagttccaccccgatggatgcctgcagatcatagatcggaaaaaggatcttgttaagctccaggccggagagtatgtgagtcttggaaaggtggaagccgcactaaagaactgcccactcatagataatatctgtgcttttgccaaatctgatcagtcctacgttatctccttcgtggtgcctaaccagaagaggctaaccctgttggcccagcagaaaggcgtggagggcacctgggtagacatctgtaataaccctgccatggaggcggaaatccttaaagaaatacgggaggccgcaaacgcgatgaagctagagcgttttgagatccccattaaagtgcggctcagtcctgaaccatggacccctgagaccgggttagtgaccgatgcctttaagttgaaacgcaaagagctgaggaatcactatctaaaggatattgagcgcatgtacggcggaaaatag

SEQ ID NO: 27217 - DNA, 2136 bp, Artificial Sequence
  Description of Artificial Sequence: Synthetic coding sequence
atgaaactaaaactgaatgtgttaacaatcatactgctgccagtccacctccttatcacaatttacagcgcactgatttttattccatggtattttttaactaacgccaaaaagaaaaatgcaatggccaagagaatcaaggcgaagcctaccagtgataagccaggatccccttatagatcagttacccattttgattccctcgcagtcatagatatcccaggggctgacacattagacaagctgttcgatcatgccgtaagcaaattcgggaaaaaggatagtttgggaacaagggagattctgagtgaagagaacgaaatgcaaccaaatgggaaagtgttcaaaaagttaattttaggcaactacaagtggatgaattacctggaagtcaatcgcagggtgaataatttcggtagcgggctcaccgccttgggtctaaaacccaagaacaccatcgctatcttctgcgaaacacgggcagaatggatgatcgctgcccagacatgctttaaatataatttccctcttgttacgctctatgctacattgggcaaggaggccgtagttcatggcctcaacgagtccgaggcttcttatcttattaccagtgtagaactgctggagagcaagctcaagactgctctgctggacattagttgtgtgaagcacatcatctacgtggacaacaaggccatcaataaggccgagtatcctgaagggttcgagatccacagcatgcagtctgtcgaggagctcggatcgaaccccgaaaatttaggcattcccccatcaagaccgacacccagcgatatggccatcgtcatgtatacttctgggagcaccggaaggccaaaaggggtgatgatgcaccacagcaacctcattgccggaatgactgggcagtgtgagaggatcccaggactggggcctaaagacacgtacattggctacctgcctctggctcatgtcctagagttgacggcggaaattagctgttttacttatggctgccggattggctatagttctcctttaacactcagcgaccaatcaagtaagatcaagaaagggagtaagggtgattgtactgttctaaagcccactcttatggccgcagtgcctgaaattatggatagaatttacaagaatgtgatgtccaaggtgcaggagatgaactatatccagaaaacactgttcaaaattggttatgattacaagctagaacaaattaaaaagggttatgacgcaccattatgcaatttgcttctctttaagaaggtgaaggcacttctgggcggaaacgtacgaatgatgttatctggaggggcaccactaagccctcagacacaccgtttcatgaacgtctgcttctgctgccctatcggacaaggttacggcttgaccgaaagctgtggagcgggaactgtgactgaggtgaccgattataccacgggtagagtcggcgctccacttatttgctgcgaaatcaagcttaaggactggcaagaggggggatacactattaatgataagcctaatcccaggggagagattgtcatagggggtcagaacatttccatgggctacttcaagaacgaagaaaaaaccgccgaggattattcagtcgacgagaatggccagcggtggttctgcaccggcgatatcggtgaattccaccctgacggctgtctccagatcatcgaccgaaagaaggacctggtgaaattgcaagcaggggagtacgtgagtttgggaaaggtcgaagctgctctaaaaaattgccccttgatagacaacatttgcgcctttgcaaaatccgatcagagctacgtgatcagcttcgtggtcccaaatcagaagaggctcactctgctggcgcagcaaaagggagtggaaggcacctgggtcgacatctgcaataatcctgctatggaggccgagatccttaaggagatccgagaggccgctaatgcgatgaaattagagagatttgaaatccccatcaaggtgcgtctgagtcccgagccctggacccctgaaacagggcttgtaactgacgccttcaagttgaagaggaaagagcttagaaatcactacctgaaggatatcgagagaatgtacggaggaaagtag

SEQ ID NO: 27218 - DNA, 165 bp, Artificial Sequence
  Description of Artificial Sequence: Synthetic coding sequence
atgaagctcaagctcaatgttctgactatcatccttctccctgttcacctcttgataaccatttattcggcattgatattcattccatggtacttcttgactaacgctaaaaagaagaacgccatggctaagcgaatcaaagccaagccaacatccgacaagtag

SEQ ID NO: 27219 - DNA, 438 bp, Artificial Sequence
  Description of Artificial Sequence: Synthetic coding sequence
atgaaactgaagcttaacgtgctaacaataatcctcctccctgtgcatctcctgatcacaatatattccgccctcatttttattccttggtacttcttgactaacgctaagaagaaaaatgctatggcaaaacgcataaaggcaaagccgacgagcgataagccaggttccccgtaccgttccgtgacccacttcgactcactggctgtgatcgatatccccggtgctgacaccctggacaagctgtttgatcacgccgtaagtaagttcggaaaaaaggatagcctgggaacgcgggaaatactaagtgaggagaacgaaatgcaacccaatggcaaggtatttaagaagttaatcttgggcaattataaatggatgaattacctcgaggtcaatcggagagttaataattttggcagcgggttgaccgctctctag

SEQ ID NO: 27220 - DNA, 381 bp, Artificial Sequence
  Description of Artificial Sequence: Synthetic coding sequence
atgaaactcaaactcaatgtactgactatcatacttctgccggtccatctccttatcaccatctactccgcgctgatctttatcccctggtatttcctgaccaacgcaaaaaaaaagaatgcaatggcgaaacgaataaaggctaaaccaacttccgataaacctggctctccctaccgttccgtcacccattttgacagccttgccgttatagatattcccggagctgacaccttggacaaactgttcgaccacgctgtgagtaaatttgggaagaaggacagtctcggaacccgtgaaattctttcagaggagaacgaaatgcagcctaatggcaaggtgtttaaaaagctgattctgggaaattacaaatggatgtag

SEQ ID NO: 27221 - DNA, 465 bp, Artificial Sequence
  Description of Artificial Sequence: Synthetic coding sequence
atggcgaagcgaatcaaggctaaaccaacctctgataaacccggttcaccttatagatctgtcacacacttcgattctctcgcagtgatagacatacccggtgcagatacacttgataaactctttgaccatgccgtctcaaagtttgggaagaaagactcacttggaacacgggaaatccttagtgaagaaaatgagatgcagcccaatggaaaagtgtttaaaaaactgatattaggcaactacaagtggatgaattatttggaggtgaaccgtcgtgtgaacaatttcggaagtggccttaccgctctcgggcttaagcccaaaaacactatcgcgatattctgcgagacacgtgccgagtggatgattgccgcacaaacctgttttaaatacaatttccctctggtgacgctttacgccacattgggcaaagaggcggttgtgcacggactgaatgagtag

SEQ ID NO: 27222 - DNA, 387 bp, Artificial Sequence
  Description of Artificial Sequence: Synthetic coding sequence
atgaaactcaaacttaatgtactgactatcatcctgctgcctgttcacttgctgattactatctacagtgctttgatattcatcccctggtacttcctgaccaatgccaagaagaagaatgctatggcgaagcgaattaaagcaaaacccacctcggacaaaccaggaagcccttatcgctccgtcactcatttcgactccctggctgtcatcgatattcctggagcagataccctggacaaactcttcgaccacgcagtgagtaaatttggcaagaaagacagcctcggcacgcgcgaaatcctgtcggaggagaacgaaatgcagcctaatggcaaagtgttcaagaagttgatccttggcaattacaaatggatgaattattag

SEQ ID NO: 27223 - DNA, 2475 bp, Artificial Sequence
  Description of Artificial Sequence: Synthetic coding sequence
atgcgtcagagcttactctttctcacttcagtcgtccctttcgtgctggccccacgccctcccgacgacccaggctttggacctcaccagaggttggaaaaactggacagtttgctgtccgactacgacattctctccctatctaatatccagcaacactccgtgcggaagagagatctgcagactagcacacacgtcgagacactcttaaccttcagtgcactaaagcgtcacttcaagctttacctcacatcatctacggaaaggttctctcagaattttaaagtggtggttgtagatggcaaaaacgagtccgagtatacggttaagtggcaggacttttttaccggacacgtcgttggcgaacctgactcacgcgtactggcccatatccgggatgatgacgtgataatcaggatcaatacggatggagccgagtataacatcgagccactctggaggttcgtgaacgatactaaagataagcgcatgctggtgtataagtctgaggatatcaaaaacgtgtcgcgtctgcagtcacctaaagtctgcggctatctcaaagttgacaacgaggaactgctcccaaaagggctcgtcgatcgggagcccccagaggagcttgtccaccgtgtgaagaggagggcagacccagaccctatgaaaaacacctgtaagctattggtcgtggcagatcataggttctatcgctacatgggtcgcggagaggagtcaaccaccactaattacctgatcgagctgatcgatcgcgtcgacgatatttacaggaacacaagctgggacaacgccggattcaagggttatggaattcagatcgagcagatccgaattctcaaatccccacaggaagtgaaacccggagaaaagcactataacatggccaagtcgtacccgaacgaggagaaagacgcctgggatgtcaagatgttgctcgagcagtttagctttgatatcgccgaggaggcaagcaaggtatgcctggcccatctcttcacataccaagacttcgatatgggcacccttggactcgcctacgtaggctcgccaagagcgaattcccatgggggagtctgtcctaaagcctattactcaccggtagggaagaaaaacatttacctcaactcgggactgacctccacaaagaattacggtaagaccatactgacaaaagaggcagacttggtgaccacacacgagttaggtcacaacttcggtgcggaacacgatccggacggtctggctgaatgtgcgcctaatgaggatcagggtggcaaatatgtcatgtatcccattgctgtcagcggcgaccatgaaaataacaagatgttctccaattgtagtaagcaatccatctataaaactattgaaagtaaggcccaggagtgcttccaagagaggtcgaataaagtatgcgggaattccagggtggacgaaggtgaggaatgtgacccagggatcatgtatttgaacaacgatacctgctgtaattccgattgtactcttaaagagggggtgcagtgctccgatcggaacagcccatgctgcaagaattgccagttcgagaccgcccagaagaagtgccaggaggccatcaacgccacctgcaaaggagtgtcatactgcacagggaattcatccgaatgccccccacccggaaatgctgaagacgataccgtatgcctcgacctcgggaagtgcaaggacgggaagtgtattcccttctgcgaacgggagcaacagcttgagagctgcgcctgcaacgagacagacaacagctgcaaggtgtgttgtcgcgacctcagcggacggtgtgtcccatatgtcgacgcagagcagaaaaaccttttcttacgtaaaggaaaaccttgcactgtcggattttgtgacatgaacggcaaatgtgagaaacgggtacaagatgtcattgagagattctgggactttatagatcagctttctatcaacacttttggtaagttcctggcagacaacatcgttggttccgttctggtattctcccttatcttctggatcccgttctccattctcgtgcactgtgtggataagaaactggacaagcagtatgagtcactgtcgttattccatccctcaaatgtggaaatgctcagttcgatggattcagcttctgtgcgaattattaaaccctttccagcacctcaaacccccggacgcctgcaacccgctcccgtgatccctagcgcacccgcagctccaaaactggaccaccagagaatggatacaattcaggaagatccgagtacagacagccacatggacgaagatggattcgaaaaagatccgtttcctaattcttccacagcagccaagtcattcgaagatttgactgatcatccagtgactcggtccgagaaggccgcttcttttaagttacagaggcagaatcgggttgactccaaagagacggagtgctag

SEQ ID NO: 27224 - DNA, 777 bp, Artificial Sequence
  Description of Artificial Sequence: Synthetic coding sequence
atgagacagtctctgttatttttgacatccgtagtccctttcgtcctggctccaaggcccccagatgaccccggattcgggcctcaccagcgtcttgaaaagctagattccctactctcagattacgatattctaagccttagtaacatccagcagcattctgtaagaaagagggacctccaaacatcaactcatgtggaaaccctactcacattttcagccctgaagaggcactttaagctgtacctgacctcatccacggagagattttctcaaaatttcaaagtcgtcgttgttgacggcaagaacgaatcagaatacactgttaaatggcaggattttttcacgggtcacgtcgtgggcgagccagacagcagggttttggcccacataagggatgacgatgtgattattcgaatcaacaccgatggcgctgagtataatattgagcccctttggcggtttgtgaatgacaccaaggataaaaggatgctggtttacaaatctgaagatatcaagaacgttagccgtcttcagagtcctaaagtctgcggctatttaaaagttgataacgaggagttgctgccaaaagggctggtggatcgggagcccccagaggagctcgtgcatcgggtgaagcggagggcggaccccgaccctatgaagaacacctgcaaactgctggtcgtggccgaccatcgcttttatcggtacatgggtcgcggagaggagtctactaccaccaactatttgatccatacagatagggccaactag

SEQ ID NO: 27225 - DNA, 2499 bp, Artificial Sequence
  Description of Artificial Sequence: Synthetic coding sequence
atgaagccccctggcagctcctcaaggcagcctccattggctggttgctcattagcaggcgcttcatgcggcccacaaagagggcctgcaggctccgtgcctgcttccgcgccagcaagaacgcccccatgccgacttctgctggttctgttgctattgccaccactggccgcaagctcacgaccacgtgcgtggggcgctgctgcaccaagcgcaccacactggaatgagacagccgaaaaaaatttgggagtattagcggacgaggacaataccttacaacaaaatagcagttctaacatctcctactccaacgccatgcagaaagaaattacgttacccagccggctcatctactacatcaatcaggactcagaatctccatatcacgtgctggacacaaaagcgagacaccaacagaagcacaacaaagcagtccatctggcccaagcttctttccagatagaggcattcggatccaaattcattctcgatttaatcctgaataatggcctcctctcatctgactatgtcgagatccactacgagaacggaaaacctcaatatagcaagggcggagaacactgttattatcacgggtcaatcaggggtgtgaaggactcaaaagtggccctttcaacctgcaatggcttacatggcatgtttgaggatgatacattcgtctacatgattgaaccactggagctagtccacgatgagaagagtaccggacggccacatatcatccagaaaacactggcgggtcagtattctaagcaaatgaagaacctgaccatggaaagaggagaccaatggccatttctgagcgagctgcaatggcttaaacgtaggaagcgggctgtgaatcccagcaggggtatttttgaagagatgaagtacctggaattgatgatcgtcaatgaccacaaaacctacaaaaagcaccgctcttcacatgctcatacaaataacttcgcaaaaagcgtggtcaacctggtggacagtatctataaagaacagctgaacacacgggttgtgctggttgccgttgagacctggacagaaaaagaccagatagatattactaccaacccagtgcagatgctccatgaattttcaaagtatagacaacgcataaaacagcacgccgacgccgtccacctgattagccgagtaaccttccactataaacggtcctcactgtcatactttggtggagtatgttcccgtactcgcggagtgggggtgaacgagtatggactccccatggcagtagcacaggttttatcccaatccctcgcacaaaatctgggcattcagtgggaaccgtcaagccgcaaacccaagtgcgattgcacagaatcatggggaggatgtattatggaggaaaccggggtaagccattcaaggaaatttagcaaatgctctattcttgaatatagggatttcctgcagaggggaggaggggcatgcctgttcaaccgacctactaaattgttcgagccaacggagtgcgggaacgggtacgtggaagctggtgaggagtgcgactgtggttttcacgtcgagtgctacggtctctgctgcaagaaatgcagtctaagcaatggtgcacactgtagcgatggcccatgttgtaacaacaccagctgtctgttccaacccagagggtacgagtgcagagatgcagtaaatgaatgtgacatcaccgagtactgtactggtgatagcggacagtgtccacctaacctccacaaacaggatgggtatgcctgcaatcaaaatcagggacgctgctataacggcgagtgtaagactcgggataaccaatgccagtatatctggggtacaaaggcggcagggagcgacaaattctgctacgagaagttgaatacggagggaacggaaaaggggaattgtgggaaggacggcgatcgatggatccaatgctccaagcacgatgtcttctgtggattcctgctttgtaccaacctgaccagggctcctaggattggccagctccaaggagaaataattccaacctctttctaccaccagggcagagtgatcgactgcagtggcgctcacgtcgtcctcgacgacgataccgatgttggctatgtggaggacggcactccttgtggaccaagtatgatgtgcctggacaggaaatgcctgcagattcaggctctgaacatgtctagctgtccacttgactccaaagggaaagtctgctccgggcacggcgtgtgcagtaacgaagctacttgtatatgcgacttcacttgggccggaactgattgctccatccgagatcctgtgcgaaacctccacccaccaaaggacgagggaccgaagggaccatcggcaacaaacttgatcattggcagtattgctggcgctattcttgtggccgctatagtccttggaggtaccgggtgggggttcaagaacgttaagaagagacgcttcgaccccacccagcagggcccaatttag

SEQ ID NO: 27226 - DNA, 2499 bp, Artificial Sequence
  Description of Artificial Sequence: Synthetic coding sequence
atgaagcccccaggatcttcgtctaggcagccaccgctggcgggatgttcacttgccggtgcgtcatgtggacctcaaaggggccctgccggatctgtccccgcatctgctccagctcgcacacctccgtgcaggcttctgctcgtcttgctgctgcttcctccactggccgctagttcgcgccctcgcgcttggggggcagctgccccttctgctccccactggaatgaaaccgcagagaagaacctgggggtcctcgccgacgaggataacacactgcagcagaatagctctagtaacatttcctatagtaacgctatgcagaaggaaatcaccttaccttccagacttatttactatattaatcaggacagcgagtcgccctatcatgtgttagatacgaaggctcgacatcagcaaaagcataacaaggctgtccatctcgcccaagcaagcttccagattgaagcatttggctcaaaatttattctggatctgatcctgaacaatggcttgctgagttcggactatgtagaaatccactacgagaatggcaagccccagtactccaaaggcggtgaacactgctattaccacggatcaattagaggagtcaaggattccaaggtggcactgtctacttgtaacggtctgcatgggatgtttgaggacgataccttcgtgtacatgatagagccactggaactagtccacgacgagaaaagcacagggcgtccacatatcattcaaaagacactagccggacagtattctaagcagatgaagaatcttacaatggagcggggtgaccagtggccctttttgagtgaattgcagtggcttaaacggagaaagagagccgtcaacccatctaggggcatattcgaagagatgaagtacctggagctcatgatcgtgaatgatcacaagacctataagaagcacagatcttcccatgcacatacaaacaacttcgcaaagagcgtggtgaacttggtggattcaatctacaaagagcagctaaacacgcgcgtcgttctggtggctgttgagacttggacagaaaaggaccagattgatattactacaaatcctgtgcagatgctacacgaattcagcaaatatagacagcgtatcaagcagcacgctgacgccgtgcacttgatcagccgggtgaccttccattacaaaagaagcagcctgtcttattttgggggtgtgtgtagtcgcacacgtggggtgggagtcaatgaatatggtcttccaatggcagtggcccaagtcttatcccaatctctcgctcagaatctgggcattcagtgggagccatcgagcaggaagcccaagtgcgactgcacagagagctggggcggttgtatcatggaggaaactggggtctcccactcaagaaagttttcaaagtgctccatcttagagtacagggactttctgcaaagagggggtggggcatgtctgttcaaccggcctacgaagctgttcgaaccaaccgaatgcgggaatggatacgtcgaggcaggtgaagaatgtgattgcggattccacgtcgaatgctacggtttgtgctgtaagaagtgtagcctttctaatggagcacattgctctgatggtccatgctgtaataatacctcgtgtctgtttcagcccaggggctatgagtgccgagatgctgtcaacgaatgcgacataaccgaatactgtactggagacagtggacagtgcccaccaaacctgcacaagcaagacggttacgcgtgcaaccagaatcaggggcgttgctataacggtgaatgcaagaccagagacaaccagtgtcagtacatctgggggaccaaggccgcagggtctgacaagttctgttacgagaaacttaacaccgagggcaccgagaagggaaattgtggaaaggatggggatcggtggatccagtgctctaagcacgatgtgttttgtggtttcctgctgtgtacaaaccttaccagggcgcctagaatcggccagttgcagggcgaaattattcccacgtcattctaccaccagggcagggtgatcgattgctctggagcccatgtcgtccttgacgacgacacagacgtgggatacgtcgaagacggaaccccatgtggcccaagcatgatgtgtctagatagaaagtgcctgcagattcaggcgctgaatatgtcctcatgcccactggacagcaaggggaaagtttgcagcgggcacggtgtgtgcagcaacgaggccacatgcatctgtgactttacatgggccggaacagattgctccataagagaccctgttcgcaatctgcatccccctaaagacgaaggcccaaaggtcaacatggcaacctccaggttgataggagccgtagccggtactattcttgctctcggggtgatattcggcggaacgggttggggcatcgagaatgtaaagaagcggagatttgatccaacccagcaggggcctatttag

SEQ ID NO: 27227 - DNA, 2499 bp, Artificial Sequence
  Description of Artificial Sequence: Synthetic coding sequence
atgaaacctcccggaagttcaagtcggcaaccccctttggcaggatgcagtctggccggagctagctgtggtccccagcgcggtcccgctggttccgtgccagcgtcagcgccagcacgtactccaccttgtaggttgcttctggtgctccttcttctgccaccccttgcggcaagctctaggcccagggcctggggcgctgccgcaccgagtgcccctcattggaatgaaaccgccgagaaaaaccttggggtattagctgacgaggacaacacactccaacaaaactcaagctctaacatctcatattccaacgctatgcagaaagagatcacccttccgtccaggctgatctactacatcaatcaggactccgaaagcccctaccatgtgctggatacgaaagctcgccaccagcaaaagcacaacaaagccgtacatctggctcaggcctcatttcagattgaagcatttggttctaagttcattcttgatctaatactgaacaacgggttactgtccagtgattatgtcgaaatccattatgagaacggtaagccccagtactctaaagggggtgaacactgctactatcacggttccatcagaggggtgaaagacagtaaggttgctttgtcaacatgcaatggcctgcacggaatgtttgaggatgacacattcgtgtatatgattgagcctctggagctggtacacgacgagaagtctactggcaggcctcacatcatacaaaagactctggctggtcagtactctaagcagatgaagaacttaactatggagcggggagatcagtggccctttctgtccgagctgcaatggctgaagagacgaaagcgagccgtcaacccttcccggggaatttttgaagaaatgaagtacctcgaattaatgatcgtgaatgaccataagacctataaaaagcaccggagctcccacgcacacacgaataattttgccaagtcagtggtcaatcttgtcgattcaatatataaggagcaattgaacacaagagttgtactggtagccgttgagacgtggaccgagaaagaccagatcgacatcactaccaaccccgttcagatgttgcacgaattcagtaagtaccgtcaaagaataaaacagcacgcagacgctgtgcacctgatttctcgcgtcacctttcactataagcggtcaagcctctcttatttcggtggcgtgtgctcaagaaccagaggggtcggagtcaacgaatatgggctaccaatggcagtcgctcaggtgctcagtcaatcactcgctcaaaacctaggcatccagtgggagccctcatcacgcaaacccaaatgcgattgtaccgagtcctggggtggctgcatcatggaggagacaggagtgagtcattcccgcaagttttccaaatgttcaatcctggaatacagggacttcctccagagaggcggtggggcttgtttatttaatcgaccgacaaaactgtttgaacccacagaatgcgggaatggatatgtggaggcaggcgaagagtgcgactgcggcttccacgtcgaatgctatgggctgtgttgtaaaaagtgctcactctctaatggcgctcactgtagcgacggaccctgttgcaacaacacatcttgtctcttccagcctaggggatatgaatgcagagacgcagtgaacgaatgcgacattaccgagtattgtaccggggatagcggccagtgtcccccaaaccttcataaacaggacggctacgcttgtaatcagaatcaggggagatgctacaacggtgagtgtaagacccgcgacaaccagtgtcagtatatatggggtactaaggcggcaggctctgacaagttctgttacgagaaactcaatactgaggggaccgaaaagggaaactgcggaaaagacggtgaccgctggattcagtgtagtaaacacgacgtgttctgcgggtttctgctctgcactaaccttacacgcgctccacggattggccagctgcagggagaaataatcccgactagcttttaccaccagggtcgggttattgattgtagtggagcccacgtcgttctggatgatgatacggatgttggctacgtagaggatggaactccttgtggccctagtatgatgtgcctcgacaggaaatgtctacagatacaggcactgaacatgagttcttgtcctttagactcgaagggtaaggtgtgctctggccatggcgtgtgttctaacgaagctacatgcatatgcgatttcacatgggccggaactgactgctccattcgggacccagtccgtaatctacatccgccaaaggacgaagggcctaaggagatgtcccggcgagaagggtccattctcttaagtaaagccccttctgagagcgccgcactggacggccacaggctagcactgctagacagcggatacgacatcctcgccgcagtgctgctggagctgttatccctgtag

SEQ ID NO: 27228 - DNA, 2100 bp, Artificial Sequence
  Description of Artificial Sequence: Synthetic coding sequence
atgcagaaggaaatcaccctgccatctcgactcatctattatatcaaccaggattccgagtctccatatcacgttctagacactaaggccaggcatcagcagaaacacaacaaagccgtgcacctagcccaggcttctttccaaattgaagcatttggatctaagttcattcttgacctcatcttaaacaacggtcttcttagctctgactacgtggaaattcattatgagaatggaaagccccagtattcaaaaggcggagagcattgctattaccacggatcaatccggggagtcaaggatagtaaagttgctctctctacatgcaatggccttcatggtatgttcgaagacgatacattcgtgtatatgatcgagcccctagagctagtccacgacgagaaatccaccggccgacctcacataattcaaaaaacgctggcgggacagtatagcaagcagatgaagaacctcacaatggagagaggggatcaatggccctttctttccgagctgcagtggctaaagagacggaagagggccgtcaatccttcccgaggcatctttgaagagatgaagtatctggagctgatgattgtgaatgatcataaaacttacaagaagcatcgttcaagtcacgcacacaccaataactttgcgaagtcggtagttaacctcgtggacagcatttacaaagagcagctaaacacaagggtggtcttggtggccgtagagacctggacagaaaaagatcaaatcgacatcacgactaaccctgtccaaatgctccacgagtttagtaaataccggcaacgcatcaagcagcacgccgacgctgtgcacctgatttccagagtcacatttcattacaagaggtcctcgttgagctactttggaggagtctgctctcgtacccgaggtgtgggggtaaatgagtatggactgcccatggccgtggcacaagtgctcagccagagtctcgcacagaacctgggcatccaatgggagccgtcctctagaaagccaaaatgcgactgcactgagagctggggaggttgtattatggaagaaactggtgtgtctcactccagaaagttttccaaatgtagcattttagaatatcgggactttctgcagcgcggtgggggtgcctgcctctttaatagacccaccaagctgttcgaacctacagagtgcggaaacggctacgtggaggctggtgaagagtgtgactgcggcttccacgtcgaatgctatggcttatgttgtaagaagtgctccctgtctaacggagcccactgttcagatgggccttgttgtaacaatacgtcgtgtctgttccagcccagagggtacgaatgtcgggatgcagttaatgaatgcgatatcactgagtattgtaccggcgattccggtcagtgtcccccaaacctgcataaacaggatggctacgcttgcaatcaaaaccagggcagatgttacaatggggaatgcaagacgcgcgacaatcagtgtcaatatatatggggcaccaaagccgctggctctgataaattctgctatgagaagctgaacaccgaaggcactgaaaagggtaactgcgggaaagatggcgaccgatggatccaatgcagcaaacacgatgttttctgtggttttttattgtgtactaacctgacccgggcaccaagaatcggccagctacagggggaaattatacccacatcattttaccaccagggccgtgtgattgactgttccggcgctcacgttgttctggatgacgacactgatgttggttatgttgaggacggcaccccgtgtggacccagcatgatgtgcctggacagaaaatgcctacagatccaggctctcaatatgtcttcgtgccctttagattcaaaggacgagggccctaaagcctgttttctaaagcgaactaagtgtaaatcttatcctaaacataggaagtgccaggaggaaaaggtcagatcttatagtgcacgccctcacctcaatcagttacggtggatggacacagctctgcattgttggatcttgggcatgacgtattcccagcagtgctattggaactattag

SEQ ID NO: 27229 - DNA, 324 bp, Artificial Sequence
  Description of Artificial Sequence: Synthetic coding sequence
taacagatccaggccctgaacatgtcctcctgcccactggacagtaagggaaaagtgtgctccggccatggcgtatgttctaatgaggccacatgcatttgcgattttacttgggccggaactgattgttccattcgggacccagtccgcaaccttcaccctcccaaggacgaggggcctaaggaaatgagcaggcgggagggatccattcttctttccaaagcgccttcagagagtgccgcactggacggacacagattagctctgttagatagtggatatgatattctggccgcagtgcttttggaactgctctctctgtag

SEQ ID NO: 27230 - DNA, 8532 bp, Artificial Sequence
  Description of Artificial Sequence: Synthetic coding sequence
atggctgcagcctcatatgatcagttgctgaagcaggtggaagcactgaagatggagaacagtaatttgcgccaagaactggaggataactcaaaccacttgaccaaactcgagacagaagccagtaacatgaaggaagtacttaaacaacttcagggttccatcgaggatgaggctatggccagtagcggccagatcgacctccttgaaaggctcaaggagctgaatctggattctagtaattttccaggggtaaagttaaggagcaaaatgagtctgagatcgtacgggagcagagagggctcggtttcatcgcgctcaggcgagtgttcaccagtgccaatgggatcttttccccgaagggggtttgtgaacggctctagagaatccaccggctacctcgaggaattagagaaagaaagatcactgctgctggcagacctagataaggaggaaaaggaaaaagactggtactacgcccagttgcagaatctcaccaaaagaatcgactctttgcctcttaccgagaatttcagcctacaaactgacatgaccaggaggcaacttgagtatgaagccaggcaaattagggttgcgatggaagagcagctgggtacttgccaggatatggagaagcgagcccagcgtaggatcgcaaggatacagcaaatagaaaaggacatccttcggatcaggcagcttttgcagtcgcaagcaacagaagcggaacgaagctcacagaacaagcacgagacaggcagccatgatgcggagcgacagaatgaaggccagggagtgggcgagataaacatggccacctcgggcaatggccagggtagcacaacaagaatggatcacgaaacagcgtcagtgttatcatcgagttccactcacagcgctcctcgtaggttaacctctcatctaggaacaaaagtcgaaatggtctacagtctacttagcatgctggggacacatgataaagacgacatgagcagaacgctattggcaatgagttcctcacaggatagctgcatttccatgagacagtccggttgtctccctttactgatccagttactgcacggcaatgataaggattccgtgttactaggtaacagtagaggatccaaagaggctagggcaagagcaagcgccgctcttcacaacataattcattcacagccggacgacaaaaggggcagaagggagatccgggtacttcatctactggagcagatacgggcttactgcgagacctgctgggagtggcaggaggcacatgaacctgggatggaccaggacaagaaccctatgcccgctcccgtagagcatcagatatgtccggcagtctgcgtgcttatgaagctgtcattcgatgaagagcaccggcatgctatgaatgagctgggcggtctccaggcaatagccgagttgttgcaggtggattgtgagatgtacggtctgaccaatgatcactatagcatcaccctgcgcagatatgccggaatggctttaacgaatctcaccttcggggacgttgcaaacaaagccaccctgtgctcgatgaaagggtgtatgcgagcgctggttgcccagctcaagtctgaatccgaagatctgcagcaggtcatagcttctgttctgaggaacctttcttggcgggctgatgtcaactcaaaaaagaccctgcgtgaggtgggtagcgtcaaagctcttatggagtgcgcgttagaggtcaagaaagagagtaccttgaagagcgtcctgtctgcgctgtggaacctcagcgctcactgtactgaaaataaggcagacatttgcgcagtagatggcgcactcgcgttccttgttggcaccctcacttataggagccagacaaacaccttggccattattgaatctggcggaggaatcctaaggaatgtgtcctccctgatcgccacaaacgaggatcacaggcagatcttgcgagagaataattgtctccaaactctcctgcaacatttaaaatcccactcgctcaccatagtgtccaatgcatgtggcacactgtggaatcttagcgctagaaatccaaaggaccaagaagcattatgggacatgggcgctgtcagtatgctcaaaaacttgattcactccaagcacaagatgattgctatgggctctgccgctgccctgagaaacttgatggcaaaccgtcccgctaagtacaaggacgcaaatattatgtcccccggaagctcactgccgtcacttcacgttaggaagcaaaaggcactcgaagccgagttggacgctcagcacctcagcgagacgttcgataacatcgacaacctgtcgcccaaggcttcccatagatcaaaacagcgccataaacagtccctgtacggagactatgtgttcgataccaatcgacacgatgataaccgcagcgataattttaacaccggtaacatgactgtcttgagtccgtatctcaacaccacagtactgccgtcctcttcatcgtctcggggatcccttgactcttcccgaagtgagaaggacagaagccttgagcgggagagggggattggtctgggcaattatcaccccgcaaccgaaaatccagggacaagtagtaagaggggcctgcagataagcacaactgctgcccaaatcgctaaggttatggaggaagtgtccgccattcatacttcgcaggaggatcgctccagcggtagtacaactgaattgcactgtgtcaccgacgagcgcaatgctctccgtaggtctagtgccgcacacactcactctaatacatataacttcaccaagtccgagaacagtaaccgaacgtgttctatgccttatgcaaaactagagtataagaggtcgtcgaacgattccttgaattctgtttctagcagtgacggctacggcaagcgtggacagatgaagccatccattgagagttacagcgaagacgacgaatcaaagttttgtagctatggccaataccctgccgacctggcccataagatccattcagccaatcacatggacgataatgatggcgagctcgatactcctattaactattccctcaagtatagtgatgagcagctcaacagcggtaggcaatccccttcccagaacgaacgatgggctagacccaaacacattatagaggacgagattaaacagagtgaacagcgccagtcccgcaaccagagcactacttatccagtctatacagagtcaaccgacgacaagcacctaaagttccagcctcactttggacaacaggagtgcgtgtccccctataggagccgaggtgccaacggctcagaaactaatagagtgggcagcaaccacgggatcaatcagaacgttagtcagagcctttgccaggaagatgattatgaggacgacaaacccactaactattccgagcggtattctgaagaggagcagcacgaggaggaggagcggccaaccaactactcaattaagtataacgaagagaagcgacatgtcgaccagccaatcgactacagtcttaaatacgccacagacattccaagtagccagaaacaaagttttagctttagcaagagcagctccggtcaatcgtcaaaaaccgaacatatgtcaagctcttcagagaatacgtccacccccagcagtaatgccaagagacagaaccaactgcatccttcgtctgctcagagccgttcaggacagcctcagaaagccgctacatgcaaagtttcatccatcaaccaagagactattcagacctattgcgtcgaggacacccccatttgtttcagccgctgtagctctctgagctcactgtcatctgccgaggacgaaataggatgtaaccagacgacccaggaggccgactcggccaatactttgcagatcgccgaaatcaaggaaaaaataggcacgcgctcggcagaggaccccgtgagcgaagttcccgcagtttctcaacatccaagaaccaagtcttcacgcctacaggggagttccctgtcatcagaatccgcacggcataaagccgtcgagttctctagtggtgcaaagtctcccagtaagtcaggggcacagactccaaagtcccctcccgaacattacgtgcaggagacgccactgatgttttctcgatgtacgtcagtgagcagcctggattcctttgagtccaggagcatcgccagcagtgtgcaaagcgagccctgtagcggaatggtgtccgggatcattagcccttcggaccttcccgactcgccagggcaaaccatgcctccttcccgctcgaaaacacctcctcctccacctcagaccgcacagaccaaacgcgaggttcctaaaaataaggctccgaccgcagagaagcgtgaaagcggccctaagcaggccgctgtaaacgctgctgtgcagcgtgtgcaagtgcttccggatgccgatacgctcttacatttcgctacagagagtacccccgatgggttctcttgcagctcgtctctgtccgccctctcactggatgagccgtttattcagaaagatgtggaactaaggatcatgccgcctgtgcaggagaacgacaacggcaatgagaccgaatcagaacagccaaaagagagtaatgaaaatcaggagaaagaagccgagaagacgattgatagtgagaaggacctgctggatgactcggacgatgatgacatagagatactggaagagtgcatcatcagcgctatgccaaccaaatcctctaggaaggccaaaaagccagcacagacagcatcgaaattgcccccacctgtggcacggaaaccaagccagctgccagtgtacaagttgcttccttcccagaacaggctccaaccacagaagcatgtgagcttcacgccaggagacgacatgccacgggtgtactgcgttgaaggcactccaattaatttttcaacagccacttctctctcggacctgactattgagtccccccctaatgaactggctgcaggcgagggcgtccgcggaggcgcacagtctggcgaatttgagaagcgtgatacaattcccacggaagggagatctaccgacgaggcgcagggcggaaagacaagttcagtgaccattcccgaactcgacgataataaggcagaggaaggagacatcctcgcagaatgcattaacagcgctatgcccaaggggaagagccacaaaccattccgagtaaagaaaatcatggaccaggtgcaacaagccagcgcctcctcctctgcccctaacaaaaaccagctcgacggaaagaaaaagaagcccacctccccagtcaagccaattccccagaacaccgaataccgaacacgcgttaggaagaacgccgacagtaaaaataatttgaatgccgagcgcgtgttctccgacaataaggattccaagaagcagaaccttaagaataacagcaaagtctttaatgataagctgccgaataatgaggacagagtgcggggtagcttcgcgttcgatagcccgcatcactacactcccatagaaggcacaccttactgtttctcacgtaatgattccctgtcttccttggattttgacgacgatgacgtggacctgtccagagagaaagccgagctgagaaaggccaaggaaaataaggagagcgaagccaaggtaacaagtcacacagagttgacatcgaatcaacaatccgcaaacaaaacccaggcaatcgctaagcaacccataaatagggggcagcctaaaccaattctgcaaaagcagagtactttcccccagtcctctaaagatatacccgaccgcggtgccgcaactgatgagaaacttcagaatttcgccattgagaacaccccagtctgtttctcccacaattcatccctatcaagcctcagtgatatcgaccaggagaataataataaagaaaatgagccaattaaggaaacggagccaccggatagtcagggcgaacccagtaaaccacaggccagtgggtacgcccctaaatcatttcacgtggaagataccccagtgtgttttagtaggaatagctccctctcatccctcagcatcgactcagaggacgacttgctgcaggaatgcatcagtagcgcaatgcccaagaagaagaagccatcaagattgaagggcgataacgagaaacatagtcccagaaacatgggcggaatactgggcgaagatctcaccctcgacctgaaggatatccaacgcccagacagtgagcatggacttagccccgattctgaaaattttgattggaaggccatccaagagggtgccaattcaattgtttcttcacttcaccaggctgcagcagctgcctgtctatcacgacaggcctcatcggacagcgactcgatcctgtcccttaagagcggcattagcttaggctcgccttttcacctcactccagatcaggaggaaaaacccttcacaagcaacaagggcccacgtattctaaaaccaggtgaaaagtccacattggaaaccaagaagatcgagtcagagagtaaggggattaaggggggaaaaaaggtttataagtccttgattactggcaaagttcgctcaaactcagaaatttcgggccagatgaagcagcctttacaggcaaacatgccatcaatttctcggggaagaacaatgatacacatcccgggtgtgcggaacagctcctctagcacctctccagtgagcaagaagggaccacctctgaagaccccggctagtaagtccccttctgaggggcagaccgccacaacctcaccaagaggggcaaagccctctgttaagtccgagctctcccccgtggccagacaaaccagccagattggcggttcctcaaaagctccctccaggagtggcagcagggacagcactccaagccggccagcgcaacagcctctcagccgccctatccaatcacccggaagaaactccatcagtcctgggagaaacgggatttctcctcctaacaagctctcacagctgcctaggaccagtagtccatcgaccgcttccacaaagtcctcgggcagtggcaaaatgagttataccagcccaggacgccaaatgtcacaacaaaatctgactaagcagaccgggcttagtaaaaatgcgagctcgatcccccgttccgaatccgcctccaaagggctcaatcagatgaacaacggcaacggggcaaataagaaggtggaactttcccggatgtcatctaccaagtcctctggcagcgaaagcgaccgatcagaacgtcctgtgcttgttcgccagtctacatttataaaagaggctccttctccgacgcttcgcagaaagcttgaggagtcagcctcatttgaatcgctgtctccgagttccaggccagccagccccactcgttctcaggctcagactcccgttctgagcccatccctgcccgatatgtcactaagtacccacagctccgtccaggccggtgggtggagaaaacttccacctaatttgtcccccacaatcgagtataacgatggcagacctgcaaaacgccacgatatcgcacggtcgcactccgagtcgcccagtcgcctgcccattaataggagcgggacttggaagcgcgagcacagcaagcactccagctccttaccgagggtgtccacgtggcggcgtaccggatcttcatcctctattctctccgccagctcagaatctagcgaaaaggcaaagtccgaggatgaaaagcacgtgaatagcatcagtggaactaagcagtccaaagagaaccaagtctcagctaaggggacttggcggaagattaaggaaaatgaattcagtcctacaaattccacctcacaaacagtgagctctggcgcaaccaacggcgctgaatccaaaacccttatctatcagatggcccctgccgtgtcgaagacagaggacgtgtgggtgagaatagaagattgccccataaacaatcctaggtccggacgcagcccaactgggaacactcctcctgtgattgacagtgtgagcgagaaggccaaccctaacataaaagacagtaaggataatcaggccaagcagaatgtaggtaacgggtctgtccccatgcgcaccgtaggactggagaatagactcaactcatttattcaggtggacgcccctgaccagaagggaactgagataaagcccggacagaacaatccagttccagtctctgaaacaaacgagagcagcatcgtggagcgaacgccatttagcagttcatccagtagcaaacactcttcaccttccggtactgtggccgctcgcgtgaccccattcaactacaatccatccccaaggaagtccagtgctgactcgacgtctgcaaggccctctcaaattcccacacccgtgaataacaacaccaaaaaaagggatagtaaaaccgactccacagagagttcaggcactcaaagcccaaagaggcacagcggttcatacttggtgacctcagtctaa

SEQ ID NO: 27231 - DNA, 8531 bp, Artificial Sequence
  Description of Artificial Sequence: Synthetic coding sequence
atggccgctgctagctatgatcagctgctgaagcaggtagaggcgttgaagatggagaatagtaacctacgccaagaacttgaagataattccaaccatctcaccaaactggagaccgaggctagtaacatgaaggaggttctaaagcagctacagggttcgatcgaggatgaagcaatggcctcttcagggcaaattgatcttctcgaacggctcaaggagttaaatcttgatagttctaactttcccggtgtgaagctgaggtcgaagatgtctctgcgatcatacggttccagggaaggatctgtctcctctcgctccggtgagtgcagcccggtgcccatgggctcatttccaaggaggggatttgttaacggtagccgggaatctactggctacctggaagagttggagaaagaaaggagtctgttactggccgacctagacaaggaggagaaggagaaagattggtattacgcgcagctccagaatctgacaaaacgcatcgactcactccccttaaccgagaatttcagtctgcagaccgatatgactcggaggcagctggaatatgaggcccgtcagatccgggtcgccatggaggagcagctggggacatgccaagacatggagaaacgagctcagcggcgaattgccaggattcaacagattgagaaggatatcctgcggatccgacagttgttgcagtcccaggccaccgaagcagagcggagctctcagaataaacacgagactggaagccatgatgcggagaggcagaatgaaggccaaggggttggggagatcaacatggccacatcagggaatggccagggaagcacaaccagaatggatcacgaaaccgccagcgtgttgtccagcagctctacacatagtgcacctcgaagattaacaagccacttgggaacaaaagtcgagatggtgtactcattactgagcatgctaggcacacatgacaaggatgatatgtcaaggacgctgttggcgatgtcttctagccaagactcatgcattagcatgcgacagtctggctgccttcctttactgatccaactgttgcatggcaacgacaaagattcagttctcttgggaaattctagggggagtaaggaagcaagagcacgtgcttccgctgcactgcataacatcatccacagtcagcccgacgacaagaggggcaggcgggaaattcgggtcttgcatctgcttgaacagataagggcttactgtgagacctgctgggagtggcaggaggctcatgaaccaggtatggaccaggacaagaatccaatgccagctcctgtggagcatcagatatgtccagctgtgtgcgtgctgatgaaactgtctttcgatgaagaacaccggcatgcaatgaatgagctgggcggactccaggctatcgcggaactgttacaggttgactgcgagatgtacggactgaccaatgaccactattccatcaccttacgacggtacgcgggaatggctctcacaaatctgacgttcggagacgtcgctaataaagccaccctgtgtagcatgaagggatgtatgcgcgctctggtggcccagctgaagtccgaaagcgaggatctccaacaggtcatcgcctcagtactccggaacttatcttggagggcagatgttaactccaagaagactctccgggaagtagggtctgtgaaggccctgatggaatgcgcactggaggtcaagaaggagtccactctcaagtcagttttgagcgcactatggaacctatcggcgcactgtactgagaacaaagctgatatttgcgcagtggacggtgccctcgcttttttggtgggcacgttgacctaccggagccaaaccaatacactggccatcatcgagtcagggggaggaatcctgaggaacgtgtccagcctaattgcaaccaacgaagaccaccggcagatcctgagggaaaacaattgtctacaaaccctcctccagcatctgaagtcacacagtctgacaattgtgtctaacgcgtgtgggactttgtggaacctgtctgccagaaatcccaaagaccaggaagcactgtgggacatgggagctgtgtcaatgctaaagaacctgatccacagcaagcacaagatgattgccatgggctccgctgccgctctgagaaacctgatggctaacaggcccgctaaatataaggacgcgaatataatgagtcccggttccagcctccctagcctgcatgtgagaaagcaaaaggccctggaggctgaactggacgcacaacatctgagcgaaacatttgacaacatagataacctctcccccaaagctagccatagatccaaacagcgacataagcagagcttatatggcgattatgtgttcgatacaaaccgacacgatgacaacaggagtgataattttaatactgggaacatgaccgtactttccccatatctcaatacaacagtgctgccctctagtagtagctcacgaggctcccttgacagttcccgctcagaaaaagataggtcactggagcgagagaggggaattgggctgggcaactatcaccccgctaccgaaaatccagggacatctagtaaacggggtttgcagatctctaccactgccgctcaaattgcaaaagtaatggaagaggtgtctgctattcatacctcacaggaggatcggtcttccggctccaccacggaactgcactgcgtcacggatgaacggaacgctctgagaaggtcttccgcggcacacacacacagtaacacatataatttcacaaagagcgagaattcaaacagaacttgttctatgccatatgcaaagctcgaatataaaagatcgtccaatgatagtcttaattctgtatcgtcatctgacgggtatggaaaacgcggacagatgaaaccttccatagagtcctattctgaggacgatgagtctaagttctgtagttacggccagtatcctgcagaccttgcccacaaaatccactcagctaatcatatggacgataacgacggggaactagacactcctatcaactattcactgaagtactctgacgaacagctcaattccggtcggcagagcccatcccagaacgagagatgggcgagaccaaaacacatcatcgaggacgaaatcaagcagtcagagcagcggcagagccggaatcagagcacgacataccccgtgtacactgaatctacagatgataaacaccttaaattccaaccacatttcggtcagcaggagtgtgtgtctccgtaccgatctcgcggtgcgaacgggtctgaaacgaatagggtgggctctaatcacggcatcaaccagaatgtctcacagagcctctgccaggaggacgactatgaagatgacaagccgacaaattatagtgagaggtacagcgaggaagaacagcacgaagaagaagaaagaccaaccaactatagtatcaagtataatgaagaaaagcgccacgtcgaccagcctatcgactattctctcaaatatgccaccgacattccgagctcccagaaacaaagttttagttttagtaaatccagttccgggcagagcagcaagactgagcacatgtcgtcgtcttccgaaaacacatctacacccagtagcaacgccaagagacaaaaccagttgcatccctccagcgcgcagtcgcgctcaggtcagccacaaaaagctgcgacttgcaaggtctcaagcatcaatcaggagaccatccaaacctactgtgtcgaggacactcctatttgtttctcaagatgttccagcctctccagcctctctagtgctgaggacgagatcggttgcaaccagaccacgcaggaagccgactctgcaaacaccttgcagatagcagagatcaaagagaagatcgggacacgctccgcggaggatcccgtgagcgaagtgccggcagttagtcagcatcctcgcactaaatcttcccgattgcagggttcttccctgtcctcagaatcagcacgccacaaagcggtcgagttttcctccggcgctaagagtccttctaagtctggggctcaaactccaaaaagcccgccagagcattacgtccaggagactccattaatgttttcccgctgtacaagcgtttctagcctagacagcttcgagtccaggtcaattgcttcttcggtccaatccgagccctgctccggaatggtctcaggaattatcagtccttccgacttaccagattcacccggacagaccatgcccccatcacgctctaagactcctccccctccccctcagacagcccagactaaacgcgaggtgcctaaaaacaaagcaccaactgcggagaagcgagagagtggacccaagcaagccgcagtgaacgctgccgtgcagagagtccaagttctgcccgacgccgacacgctgctgcactttgccacagagtcaacccctgacggattttcgtgctctagctccctgtccgcattatctttggatgaaccatttattcagaaggacgttgagttaaggataatgcctcctgtgcaggagaatgataatggcaacgagacagagagcgagcagccaaaagagtcaaatgagaatcaggaaaaggaggcagaaaaaacaattgatagtgagaaggacctgctggacgattccgacgatgacgatattgagatcttggaggagtgcataatatccgccatgcccactaaatcttccagaaaggcaaaaaagcccgctcaaaccgcctccaaactgccaccacctgtggcaagaaagcctagtcaattgccggtttataagctgctgccttcacagaatcgcttgcaaccgcagaagcatgtctcgtttacaccaggtgatgatatgcccagggtttattgtgtggagggtacgcccataaacttcagtacagccacttctctgagtgatctgaccattgaatctcctcctaatgagcttgcggctggggagggggtcaggggaggagcccagtccggtgaattcgagaaacgagatacaatcccaacggagggacgatcgactgatgaggcacagggcggaaagacttcatcagtaaccatcccggagctcgacgacaacaaggccgaggagggcgatatcttggcagaatgcatcaacagcgccatgccaaaaggtaagtctcacaagccctttcgggtgaagaaaatcatggatcaagtgcagcaagcttccgccagctcgtccgcgccaaataaaaaccaactggatggcaagaaaaaaaagccaacctcacccgtcaaaccgattccacagaatacagagtatcgtaccagagtacgcaagaatgccgactccaaaaataacttaaacgccgagagagttttttcagataacaaagattccaagaaacaaaatttgaagaacaacagtaaagtgtttaatgacaaactgcctaacaacgaagatcgagtccgcggatcattcgctttcgattcaccccaccactataccccaatagagggtacgccctattgcttcagtcgcaatgacagtttgagtagtttagatttcgatgatgacgacgtggacctgagcagagagaaggcagagcttcggaaagccaaggagaacaaggaatccgaagcaaaggttaccagtcacaccgaactgacatccaaccagcaatctgcaaacaagactcaggctatagccaagcagcccatcaaccgagggcagcctaagcccattctccagaagcagagtaccttcccacagtcgagtaaggatataccagaccggggtgctgcaaccgatgaaaagctgcagaatttcgcgatcgaaaatacgccagtctgtttctcccataatagttccctctcctccttatcggatatcgatcaggagaacaataacaaggaaaacgagcccatcaaggaaaccgagccccctgattctcagggcgaaccaagtaagccccaggccagcgggtatgcacccaagtccttccacgttgaggacacgcctgtttgcttctcgcgcaactcctcacttagctccctaagtattgacagtgaagatgacctactgcaggaatgtatttccagcgccatgcccaagaagaagaaaccttcccgtcttaagggtgacaatgagaagcactcccctagaaatatggggggaattttgggcgaggacttgactttggatttgaaagacattcagcgccctgactctgagcatgggctgagccctgactccgaaaacttcgattggaaagccattcaggaaggagctaactcaatcgtgagcagtctgcaccaggcggctgccgcagcatgtctgtcacgccaggcctccagcgatagcgactctatcctgagcctcaaatcagggatctcactcggttccccttttcatcttaccccggaccaggaggagaagcccttcacatccaataaaggcccacgaatcttgaaaccaggagagaaatcaactcttgagactaagaagattgaatcagaaagcaagggcataaaagggggtaagaaagtgtacaaaagtttaatcacaggcaaagtgcggtccaattcagagatctctggtcaaatgaagcagccattgcaggccaatatgccttcaatctctaggggcaggactatgattcatatcccaggagtgcgaaactcgagcagttctacttcgccagtgtcaaaaaaaggcccacctttgaaaactcctgcctctaagtctccttccgaaggacagaccgcaacaacctctccgagaggcgctaagccctccgtcaagtcagagctatctcctgtggctcgccagacctcccagatcggtgggagcagtaaggcaccatctcgcagcggcagccgagactcaaccccgtctaggcctgcgcagcagccccttagcaggccaattcagtcgcccggaagaaattcaatctcgccaggcagaaatgggatcagccctccaaataaactcagccaactgccaagaacatcatctccgagcaccgcctctactaagtccagcggtagtgggaagatgagctacacttctcccggaagacaaatgtcgcagcagaatttaaccaaacaaacaggactctcaaagaacgcttcctcaatccctcgaagcgagagcgcctctaagggcttgaaccagatgaataacggaaacggggctaataaaaaggtggagctgtctcggatgagttctacgaagtcaagcggaagtgaatctgacaggtctgagcggccagttttggttagacaatccacattcatcaaggaagcaccatcccccacactacgaaggaagctcgaggaatcagccagcttcgaaagcctgtccccttctagccgacctgcgagcccaacacggtcccaagcgcagacccccgttctgagtccttccctgcctgatatgtcactctccacccattcttcggtgcaagccggaggctggcggaagttgccacccaacttatcccctaccattgagtataacgacggtcggccagcaaagcgccatgacatagccaggtcccacagcgagtctcctagcagactccccatcaatcgaagtggaacctggaagcgtgagcactctaagcattctagtagtctcccaagagtttcaacgtggaggcgaactggcagcagcagctcaattctgagtgcctccagtgaaagctcagaaaaggcgaagtcagaggatgagaagcacgtgaactcaattagcggcaccaaacagtccaaggaaaaccaggtgtccgcgaagggtacttggcggaagattaaggagaacgagttcagtcctacaaatagcacctctcagacagtgtcaagtggagcaactaacggggcagagagcaagacgcttatatatcagatggcacctgctgtctcaaagactgaggatgtctgggtcagaattgaggactgtcccattaacaatcctcgctcagggcgatctcctaccggcaacacgcctcctgtgatcgattcagtgtctgaaaaggctaaccccaacatcaaagactccaaggacaatcaggccaaacagaacgtgggaaacggcagcgtccccatgcgcacagtcgggctggagaaccgtctgaacagttttatacaggtggacgcccctgatcagaagggcacagagatcaagccaggtcagaacaatcccgtcccagtgtcagagactaacgagtcgagtatcgtggaacgcacacctttttcatcgagctcaagctccaaacattcttctccctccggaactgtggctgccagagtaacgccttttaattataacccatctcctaggaagagtagcgctgattctacttcagctagacccagccagattccaactcccgtgaacaataacactaagaagcgggatagtaaaaccgattctacggagtccagcggcactcagagtcccaagcgacacagtggaagctacctagttaccagtgttta

SEQ ID NO: 27232 - DNA, 8531 bp, Artificial Sequence
  Description of Artificial Sequence: Synthetic coding sequence
atggccgctgcctcctacgaccagcttctcaagcaggtggaggctttaaaaatggaaaatagcaacttgaggcaggagctggaagacaacagcaatcacctaaccaagctggaaaccgaggcctcaaacatgaaagaggtgctaaaacagctccaaggctcaattgaggacgaggccatggctagttctggccaaatcgatctcctggagcgcttgaaagaactgaatctcgacagctcaaatttccctggcgttaagctgcggtcaaagatgtcattgcgcagctatgggagtcgggaaggcagcgtgagttctcgaagtggggaatgttcacctgtgcctatggggtcattcccgcgtcgcggattcgtcaatggcagccgtgagagtactggttatctagaggagttagagaaagagagatctctcctcctagccgacttggacaaggaggaaaaagagaaggactggtattacgcccagctccagaatttgaccaagcgcatagacagtctccctctgaccgaaaatttcagcctccagaccgacatgacaaggaggcagctggagtacgaagcgaggcagattcgggttgccatggaggaacagctgggcacgtgtcaggatatggaaaaacgcgcacaaaggagaatcgcaaggattcagcaaatcgaaaaggacattcttcgaatcagacagttgctacagagtcaggcaacagaggcggaacggtcctctcagaataagcacgaaactggcagccacgatgccgaacgtcagaacgaagggcagggagtcggcgagataaatatggccaccagcggaaatgggcaggggagcacaacgcgtatggatcatgagacagcctcagtcctgtctagcagctcaacacattcagcacctcggagacttacgagtcatcttggcacgaaggtggaaatggtgtacagtctactgtctatgctgggcacccatgacaaggatgacatgagcagaactctgttagcaatgagcagttctcaggacagctgtattagcatgaggcagtcgggctgtcttcccttgctcattcagctcttgcatggcaacgacaaagatagtgttttgttaggaaacagccggggatcgaaggaagccagggcccgtgcaagcgcagcgctgcataatatcattcactcacaaccagacgacaaacgaggtaggcgagaaattagagtccttcacctcctcgagcagatcagggcctactgcgaaacttgctgggagtggcaggaggctcacgagcctggcatggaccaggataaaaacccaatgcccgcacctgtggaacaccagatctgcccggcagtgtgtgtgctgatgaaactctcctttgacgaagaacatagacacgcaatgaatgagttaggaggactccaggcgatagctgagctcctgcaggtcgattgtgagatgtacgggctcaccaacgatcattacagtattacactgagaagatacgcgggtatggcactcacaaacctcaccttcggcgacgtggccaataaagcgaccctttgcagtatgaaggggtgcatgcgtgcactcgttgctcaattgaagagcgagtccgaagatctccagcaggtaatcgcatcagtgttaaggaatctttcctggcgtgctgatgtcaactccaagaagacgctgagggaagtgggttcagttaaagccttgatggaatgtgccctggaggtcaagaaggaaagtaccctgaaatccgtgttgagtgccctgtggaatctttctgctcactgcaccgaaaataaagcagacatttgcgcagtggatggggctctggctttcctggttggcacccttacatacagatctcagacaaatacactggccatcattgaaagtggcggtggcattctccgtaatgtgagctctctgatagccaccaacgaagatcataggcagatcttgagagagaataattgcctgcagacattgctccagcacctgaaatcacatagtctcactatcgtatccaatgcttgtggcacactttggaacttgtccgcccgtaaccccaaggatcaagaggcactctgggacatgggggcagtgtccatgctgaaaaatctgatccattccaagcataaaatgatcgcaatgggttcagccgctgcactgaggaatctgatggctaatcggccagctaaatacaaagatgctaatatcatgagcccgggatcttcgttaccatctttgcatgtccgaaaacagaaagccctggaggcagaactggacgctcagcacctgtctgagactttcgataacatcgacaacctgtccccgaaggcaagccaccggtccaagcagcgccacaaacaatccctttatggcgactacgtgtttgacaccaaccgtcatgacgacaatcgctctgataattttaacactggaaatatgacagtcctgtccccgtatctgaacactactgtcctccccagcagctcatcatcccgaggctcactcgatagctcaaggtcagagaaagaccgaagcctcgagcgagagaggggcatcggcctcggcaactaccatcccgctaccgaaaatccgggaaccagtagtaagagagggttacaaatctcaacaactgcggcacaaatagcaaaggtaatggaagaggtaagtgctattcacaccagccaggaggatcgctcaagcggatcaacaacagagctacactgcgtaacggacgagagaaacgccctgagacgctcaagcgcagctcacactcattccaatacatataattttaccaagagtgagaatagtaatcgtacttgcagcatgccctatgccaagctggagtataagcggtcaagtaatgacagcctgaattctgtgtcaagctctgatggatatggtaaacggggacagatgaaaccaagtattgaatcatattccgaggacgatgagtccaagttttgttcgtacgggcagtacccggctgatctggcccataaaattcattccgccaatcatatggatgataacgacggtgaactcgataccccaattaactactctttgaagtacagcgatgagcagctgaacagcggacgccaatcaccatctcagaacgagaggtgggcaagacccaagcatattatcgaagacgagattaagcagagcgagcagagacagagtagaaatcaaagcacaacctatcctgtctatacagagtccacagatgataagcatctgaagtttcaacctcattttggccaacaagagtgcgtgagtccctataggtctcggggagctaacggtagtgagaccaacagggtgggctctaaccacggcatcaaccaaaacgtcagccagtccctgtgtcaagaggatgattatgaggacgacaagcccaccaattatagcgagaggtattcggaggaggagcaacatgaggaagaagagcgtcctacaaattactctattaaatacaatgaagagaaaaggcatgttgatcagcccatcgactatagtttgaaatacgccacagacattccatcgagccaaaagcagtcattctccttctccaagtcatcgagcgggcagtcctcaaaaactgagcacatgtcgtccagcagtgagaatacatctaccccatcatctaacgccaaacgccagaaccaactgcatccaagctccgcacagtcccggtcaggtcagcctcagaaggcggcaacatgtaaagtctcatctattaaccaggagacaattcagacctattgcgttgaggacacccctatctgtttttctaggtgttcttctctgtcctccctctccagtgcagaggatgagatcggctgcaatcaaacaacacaggaagccgactctgccaacaccctgcaaatcgccgagataaaggagaagatcggaacgagatctgccgaggatccggtgtcagaagtgccagcagtctcccagcaccctaggaccaagtcgtcaaggctgcaagggtcatcactgtcttccgagtccgcccgacacaaagcagttgagttctcatccggggctaaatcaccctccaaatctggagcgcaaacaccaaaatcacctccagaacattacgtgcaggagactcccctaatgttttctcggtgtacctccgtgtctagcctggactctttcgaaagccggagtattgcgagctcagtgcagtccgagccctgtagcggcatggtatctgggatcataagcccctctgatctcccagattcacccggacagaccatgccgccttcaagatctaaaacaccacctcccccacctcagacagcacaaactaaacgcgaggtgcccaagaataaggcaccaacggctgaaaagagggagtccggcccaaagcaggccgcagtgaacgccgctgtgcagcgcgtgcaggttctgcccgacgcagatactctgctccacttcgccacagagagcacgcctgatggcttttcttgctcgtcctcgctgtctgccctttctctggacgagccttttatacaaaaagatgtcgagctacgaattatgccacctgttcaggagaacgacaacgggaacgagactgagagcgaacagcccaaggaatcaaatgaaaatcaagagaaggaggcggagaagacaatcgactccgagaaggacctcctggatgacagtgacgacgacgatattgaaatactcgaagaatgcatcatttccgccatgccaaccaagagctcgcggaaagcgaagaaacccgctcagacagcctctaagcttcctccccctgtggccagaaagccatctcagctaccagtctataaacttctgccgtcgcaaaaccggctacagccacaaaagcacgtgagcttcacccccggtgacgatatgcctcgggtttactgcgtggagggtacaccaatcaacttctctacagctacgtctctctccgatctcactatcgagtcaccgccaaacgagttggctgcaggtgagggtgtccgaggcggtgcacagtccggagaattcgaaaaaagagacacaatccctaccgaaggacggtccactgatgaagctcagggtggcaagaccagttcggttacaatccctgagctggacgacaataaagcagaggagggggatatcctcgctgaatgcataaattctgccatgcccaagggtaagagccataagcctttcagagtgaaaaagatcatggaccaggtgcaacaagcctcagcctcaagttcagcacctaacaaaaatcaattggacggtaaaaagaagaagccaacttcacctgtcaaaccgatcccgcagaatactgaatatcggactagagttcgcaagaacgcagacagcaaaaacaatctgaacgcagagcgagttttttccgacaacaaagattctaaaaaacagaacctcaagaacaatagcaaggtctttaatgacaagttgccgaacaacgaggatcgagttcgaggatcgttcgcattcgactcccctcaccattacacacctatcgaagggactccttactgctttagccgcaacgacagtctctcctccctggacttcgatgacgacgatgtcgacttgtcccgcgaaaaagccgagctgcgcaaagccaaggagaataaggagtctgaagcaaaggtgactagtcatacagaactgacatcaaatcaacagagcgctaacaagacacaggcaattgcaaagcagcccatcaatcgtggccagcccaaaccaatcctgcagaaacagagcacgtttccccagtccagtaaagacattccggaccggggagccgctaccgacgagaagctgcaaaacttcgctatagagaatacgcccgtgtgcttcagccacaattcctcactttcttccctcagtgatatcgaccaggagaataataacaaggagaacgagcccattaaggagactgaaccccctgattcgcaaggggaaccctctaaaccacaagcaagcgggtacgctccaaagtcatttcatgttgaagacacccccgtgtgcttcagcagaaactcatccctatcctctctcagcatcgacagcgaggacgacctacttcaagagtgcatctcctcggcaatgcccaagaagaaaaaaccatctcggctgaaaggagacaacgagaagcattctcctagaaatatggggggaattcttggtgaggacctgacgttggacttgaaagacattcagagacctgattcagaacacgggctaagtcctgattccgaaaacttcgactggaaggcaatccaggagggtgccaattctatcgtgagctctctacaccaggccgcagctgcagcctgtctgtcacgccaggccagttctgatagtgatagtattttgagtctgaagtctggtatctcattgggttctccttttcatctgactcccgatcaagaggagaagccgtttacctcaaacaaggggcctcggatcctcaagcccggtgaaaagagtaccctggaaacaaagaagatagagagcgagagcaagggcattaagggtgggaaaaaggtctataagagcttgataaccggtaaagtgcgaagtaactctgagatatctggccagatgaagcaaccactgcaggccaatatgcccagcatctcccgaggcaggacgatgatacatatacccggtgttcggaatagttccagcagtaccagccctgtctcgaagaaaggtcctccattgaagactcccgcatcgaaatccccatccgaggggcagacagctactactagtccacgcggagccaagccaagtgtgaaatcagagctgagtcctgtggcgagacaaacttcacagattgggggttcgagcaaggccccaagtaggtctggatctagagatagtacaccaagccgccctgcccagcagccattgagtcggccaattcagagccctgggcgtaactccatctcccctgggcgtaacgggatctcccccccaaataaattatcccagctgccaagaacctcatcccccagcacggccagtacgaagtcatccggaagtggcaagatgtcatatacaagccctggccgacagatgagccaacaaaatttgacaaagcagacgggactgagcaagaatgcatccagtatccccaggtccgagagtgcctccaagggtctgaaccagatgaacaacggcaacggagctaacaagaaagtggagctctcccgcatgagcagcacaaaatcatctggatctgaatctgatcgcagtgagcgtcccgtcctcgtccggcaaagcacatttattaaggaggctccctctcctaccctccgcaggaagctagaagagtcagcctcctttgaatccctgtccccatcaagccgcccagcaagccccacacgctctcaggcccagactccagttctcagtccctctctcccggacatgtcattgagcacacactctagcgttcaagctggtggttggcggaagttgcctcctaacctcagcccgacaatcgagtacaatgatgggcgacctgcaaagagacatgatatcgcgcgttcacactccgagtcaccatctcgcttgcctattaataggagtggcacatggaaacgagagcattcaaaacacagttcatcgctgcctcgcgtgagcacctggaggcgaacaggctccagctcctccattttgtctgcatccagtgaatcctctgagaaggcaaaaagcgaagatgagaagcatgtgaatagcatctcggggaccaaacagtccaaagagaaccaggtctcagccaaggggacatggcgaaagatcaaagagaatgaattcagccccacaaactcaacatcccaaacagtgagcagcggtgcgaccaacggtgccgaatcaaagacattgatttaccagatggcgcctgctgtatctaagaccgaggacgtatgggttaggatcgaagactgccctatcaataaccccagatcagggagaagccctaccggcaatacacctcctgtcattgatagtgtctccgaaaaggcgaatccaaacattaaggattctaaagataatcaggccaaacagaatgtcggcaacgggagtgttcctatgcgaacggttggcctggagaataggttgaatagcttcatccaggtggacgcgccagaccagaagggtactgagataaaacccggacagaataatcccgtgcctgtctccgagaccaatgagagctccattgtcgaacggacaccatttagctcctcaagttcctctaagcactccagcccttcaggaacagtcgcagccagggtgacgccttttaactataatccgtcaccaaggaaatctagcgctgatagcacatcggccaggccaagtcagattcccacacccgttaacaataacactaagaagagggatagcaaaaccgatagcacggagtccagtgggacacagagtcctaagcgccattcggggtcgtatctagttacatcggtgta

SEQ ID NO: 27233 - DNA, 864 bp, Artificial Sequence
  Description of Artificial Sequence: Synthetic coding sequence
atggccgcagcctcctatgatcagcttttgaaacaggtagaggctctcaaaatggagaattcgaacctgcgacaggagctggaagacaatagcaatcaccttacgaaacttgagactgaagcaagcaatatgaaggaggtgctgaaacagcttcaaggatcaatcgaggatgaggctatggcatcaagcggacagattgaccttcttgagcgactgaaagaattgaatttagactccagtaattttcccggagttaagttgagatctaaaatgagcctcaggtcttatggatcccgcgagggctcagtgagtagccgcagcggcgagtgcagccctgtgcccatgggctccttcccaagacgcggattcgtgaacggctcaagagaatcaaccggttacctggaagagttggagaaggagcggagccttctcctcgctgacctggacaaagaggagaaagaaaaggactggtattatgcgcaactccagaacctgacaaagagaatcgactctctgcctcttacagagaatttcagccttcagacggacatgacacgcaggcaactcgagtatgaagcaaggcagattcgtgtggccatggaggagcagctggggacgtgccaagacatggaaaaaagagcccagaggaggattgcacgaatccagcagattgagaaagatatcttaagaatccgccagctattgcagtctcaggctaccgaagctgagcggagtagccagaacaaacacgagaccggatcccatgacgcagagcgccagaacgaggggcagggcgtgggcgaaatcaacatggctacctccggaaacggacaaatagagaagatgcgcatgttcgaatgttag

SEQ ID NO: 27234 - DNA, 357 bp, Artificial Sequence
  Description of Artificial Sequence: Synthetic coding sequence
atggcagctgcttcctatgatcagctcttaaaacaagtcgaggcattaaaaatggagaattctaatcttcgccaggagctcgaggacaacagcaaccatctcacaaaactcgagaccgaagcctcaaacatgaaggaggtactgaagcagctgcaaggaagcatcgaggacgaggccatggcaagctctgggcaaatcgatctgctggagaggctcaaggaactcaatttagattccagcaacttccctggagtgaagttgcgttctaagatgtccctgaggtcttacggatctcgtgagggatctgtaagctcacggagtggcgaatgcagccccgtgcctatggggagcttctag

SEQ ID NO: 27235 - DNA, 3918 bp, Artificial Sequence
  Description of Artificial Sequence: Synthetic coding sequence
atggccgcagcttcttacgatcaacttctgaaacaagtcgaagcgctcaagatggaaaactctaacctcaggcaagagctagaagacaacagtaaccaccttactaaactggagaccgaagcttcaaacatgaaggaagttctcaagcagcttcaaggatccatcgaagacgaggccatggcctcctcgggccaaatcgacttactggaacgcttgaaagagctgaacctggactcatctaatttcccaggcgtgaaactgcggtccaaaatgagtctgcggagttacggatcccgcgaagggagcgtgtcttccaggtctggggagtgttccccagtccctatgggatctttcccaaggagagggttcgtgaacgggagccgcgagtccaccgggtacctcgaggaacttgaaaaggagaggagcctcctattggctgacctggacaaggaagaaaaggaaaaagattggtattatgcacaactgcaaaatctgaccaagagaatagactcactccccctgaccgaaaatttctctctccagactgatatgaccagacgccagctggagtacgaggctcggcagatcagagttgccatggaggagcagctggggacttgtcaggacatggagaagcgagcccaacgcaggatcgcaaggatccagcagatcgagaaagacatcctgcggattcgccagctgttacaatcccaagcaacagaagccgagagatcttcgcagaacaagcatgaaactggcagccatgacgctgagcgccagaacgagggacagggggtcggggagatcaatatggctacgtcagggaatggtcaggggtcgacaacgcggatggaccatgagaccgccagcgttctcagctcatctagcactcatagtgctccacggagacttacatcccacctcgggacaaaggttgagatggtgtattcactgctttccatgttgggcacccacgacaaagatgacatgagtagaactctgcttgccatgtcctcctcacaggacagctgtatctcaatgagacagtctgggtgcctacccttgctgatacaactgctgcatggcaacgataaggactcagtgttgcttggcaactccagaggtagtaaggaggcgagggcgcgagcatcagctgccctgcacaacattatccactctcagcccgacgataagagagggaggcgcgagatcagggtcctgcatctgctggaacagatccgcgcttactgcgaaacttgttgggagtggcaggaagcacatgagcccggaatggaccaggataaaaaccccatgcccgctcccgtcgagcatcagatctgccctgctgtgtgcgttttgatgaagctgagctttgatgaggaacaccggcatgctatgaacgaactgggtggtctgcaggcaattgcagagctactccaggtggattgtgagatgtatggtcttactaatgaccactattccatcacactaaggcgttatgctggaatggcacttaccaacctcacgtttggcgatgtggccaataaggccacgctatgcagtatgaaagggtgtatgcgggcacttgtcgcacagctcaagagtgagtctgaggatcttcagcaggtgatagcaagcgtgttgagaaatctgagctggagggccgatgtgaactcgaagaagaccctgcgcgaagtgggtagcgtcaaggcccttatggagtgtgcactggaggttaaaaaagagagtactctcaagtccgttctttcagctctctggaacctgtccgctcactgcacagaaaacaaagcggatatctgcgccgtggacggggcacttgccttcctggtgggaactctgacataccgttctcagactaatacactggccattatagagagtggaggagggattctgaggaacgtgagtagcctcatagcaacaaacgaagaccatcggcaaatcttgcgcgagaacaactgtctgcagaccctccttcagcacttgaaatctcactctttgacaatcgttagcaacgcatgtggaaccctctggaatttgtcagcccgaaacccaaaggaccaggaggccttgtgggacatgggcgctgtttctatgctcaagaacctgattcattcgaagcacaagatgatagctatgggaagtgctgcggctttgcgcaatctgatggcaaaccgccctgccaagtacaaagatgcaaacatcatgtcaccaggtagtagcctaccttccttacacgtgagaaagcagaaagcgctggaggctgagcttgatgcgcagcatctgagcgaaaccttcgacaatatcgataacctcagccccaaggcatcgcaccgctcgaaacaacgccataaacagagcttatacggcgactacgtttttgatacaaatcggcatgacgacaaccgctccgataacttcaacacaggtaacatgactgtgctgtccccatatttgaatacaaccgtactccctagtagcagctcgtcacgtggcagtctcgactcatctaggtctgagaaggatcgaagcctggaaagagaaaggggaattggactgggaaactatcaccctgccacagaaaacccagggacatctagcaagcgcggactgcagattagcactaccgccgcacaaattgccaaagtgatggaagaggttagcgccatccacacaagtcaggaagaccggtcctctggatctaccactgaactgcattgcgtcaccgatgagcggaatgcactgcggagaagctccgcggcacacacccatagcaacacctataacttcactaagtccgaaaactctaataggacctgtagtatgccatacgccaagctcgagtataaacggagttccaacgattccctgaattccgttagtagctctgacggatacggaaagagggggcaaatgaaacctagtatcgagagttactccgaagacgatgagtctaaattctgttcatacggccaatatccagcggacctggctcacaagattcacagcgccaatcatatggatgataacgacggggaactggacactcccattaactattcactcaaatattcagatgaacaacttaatagcggcagacagtccccttcacagaatgagcgctgggcacgaccaaagcacattattgaagatgaaattaagcagagtgaacagaggcagtcgcgtaaccagtcgacaacttaccctgtgtacacggagagtaccgacgacaaacacctgaaatttcaacctcacttcggccagcaagagtgtgtttcaccttacagatcaaggggtgccaacggttccgagacgaatcgggtgggcagtaatcacgggattaaccagaatgtttcgcagtccctgtgtcaagaagacgattatgaagatgacaagcccacgaactactcggaaagatatagtgaggaagagcagcatgaagaggaggagcgtccgactaattacagcattaaatataacgaagaaaaacgccacgtggaccagcctattgactactccctgaaatatgctacggatataccaagctctcagaagcagtctttctcatttagcaagagcagtagtgggcagagtagcaaaactgagcatatgagtagttcgagtgaaaacacctctactccgtcttcaaatgctaaaaggcagaaccagttgcatccaagtagcgctcagtctcgttccggacaaccacaaaaggccgctacgtgtaaagtgagttcaattaatcaagagaccattcagacatactgcgtcgaagatacccccatctgcttctccagatgtagctcactgtcctctctgtcaagcgctgaggacgaaatcggctgcaaccaaacaacgcaggaggcagactctgccaacacacttcaaatcgcctag

SEQ ID NO: 27236 - DNA, 2796 bp, Artificial Sequence
  Description of Artificial Sequence: Synthetic coding sequence
atggccgagatcaaggagaagatctgtgactacctgttcaatgtgtctgactcctctgctttgaatctcgcaaagaatatcggccttacaaaggcccgtgatatcaacgccgtgctgatcgatatggagcggcaaggtgatgtgtatcgacagggaacaacacctcctatttggcacctgactgacaagaaacgggaacggatgcagatcaagaggaacactaatagtgtgcccgaaacggcccctgcggctatcccggaaactaaacgaaacgctgagttcctgacctgcaacatccctacctccaacgcctccaataacatggtcactaccgaaaaggtagaaaatggtcaagaacctgtgatcaagctggagaatcgccaggaggcccgtccggaacccgcaagactcaagccccctgtgcactataacggaccctctaaagccggatacgtcgattttgagaacggacagtgggctacagatgatatcccggacgacctgaactccattagggctgcccctggggaattcagggccataatggagatgccatccttttattcacatggacttccacgctgtagcccgtacaagaagcttacggagtgtcagttgaagaaccccattagtggcctgctcgaatatgctcagttcgcaagccagacgtgtgaatttaacatgatcgaacaaagtggccctccccacgaacctagattcaagtttcaagtcgtgattaacggtcgagaattccctccagccgaggccggttctaagaaagtggcaaagcaggacgcagcaatgaaggccatgacaattctcctggaggaagctaaggcaaaggattctggcaagagcgaagagtcttctcactactccactgagaaggagtctgagaagaccgccgaatcacagacaccgactccgagtgctacctcattcttttcgggcaagtctcctgtgaccacacttcttgaatgcatgcataagctaggcaattcctgcgagttcaggttgctgagtaaagaaggccctgctcacgagccgaagttccagtactgcgttgctgtaggagcacagacttttcccagcgtgagtgccccaagtaaaaaggtggcaaagcagatggctgctgaggaagccatgaaagcgttacatggcgaagcgactaatagcatggcaagcgacaaccaaccggaaggcatgatcagcgagagcctcgataacctcgaaagtatgatgcctaacaaagtgagaaaaatcggcgagctcgttcgctacctcaataccaatccagtcgggggacttctcgagtacgcccgatcacacgggtttgccgctgagttcaagctggtcgatcagtcaggcccaccacacgaacccaagtttgtgtaccaagccaaggtcggagggagatggtttcccgctgtgtgcgcccactctaaaaagcaaggaaagcaggaggcagcggatgctgcattacgtgtacttatcggggagaacgaaaaagcagagcgcatgggcttcaccgaggtcacccctgtgacaggcgcttcgctgagaaggaccatgctcctgcttagcagaagtccggaagcccagcccaagacactccctctcacggggtccaccttccatgaccagatcgccatgctgtctcatcgttgctttaataccctaactaattcctttcaaccatccttactggggagaaagatcttagccgcaatcataatgaaaaaggactctgaagacatgggcgttgtggttagcttgggcacgggcaatagatgcgttaagggagattccctgagccttaagggcgagactgtcaacgattgccacgctgagataatcagccgtcggggatttattaggtttctttacagcgaactgatgaaatacaactcgcaaaccgctaaagatagtattttcgagccagccaaagggggtgaaaagctccagatcaagaaaaccgtgagcttccatctctatatttccacagcgccatgtggagatggcgctcttttcgacaaaagctgctcagacagagctatggagagcacagaaagcagacactaccctgtgtttgagaacccaaaacaagggaagctgcgcaccaaggtggagaacggtgaggggaccatacccgtggagagttccgacatagttcccacttgggacggcattagactgggggagcggttaaggaccatgagttgctcagacaaaatccttagatggaacgtgctgggcctacagggagcactactgacacatttcttgcagccaatttatctgaaatcagtgaccctgggttatctcttctcccaggggcatctgactcgagctatttgctgccgtgtgacacgagatggctcagcttttgaggacggcctgaggcatccgttcattgtgaaccatccaaaggtggggagggtctcaatatatgatagcaaacggcaaagtggcaaaacgaaggaaacatctgtcaactggtgcctagcagatggctatgacctcgagattttagatggtacacggggaacagtagacgggccaaggaatgaactgagcagagtgagcaagaagaatatctttctgctgttcaagaagttgtgttcattccggtataggcgcgatctgcttaggctctcctacggcgaggcgaagaaggccgcaagagactatgaaactgctaagaactatttcaagaaggggctaaaagatatgggttacggaaactggataagcaagccacaggaggaaaagaatttttacctctgccctgtatag

SEQ ID NO: 27237 - DNA, 3681 bp, Artificial Sequence
  Description of Artificial Sequence: Synthetic coding sequence
atgaacccacgccagggatactcgctgtcaggatattacacgcatcctttccagggatatgaacatcggcagttgcgttatcagcagcccggtccaggctctagcccctccagcttcctgctaaaacagatagaattcttaaaggggcagttacccgaggctcccgtgattggtaagcagactcccagcctgccccctagtctgcccggacttaggcctcgatttcccgtgctccttgcatccagcacccggggtcgacaggtggacatccgcggtgtcccgaggggcgtgcacttaagaagccagggcctgcagcggggatttcagcacccatcccctagaggcaggtctcttcctcagcgtggcgttgattgcctctcgtcgcatttccaagagctttccatctatcaggaccaggaacaacggatccttaaatttctggaggaactgggagaaggcaaggccactactgcccacgacctgagtggtaaactgggcaccccaaagaaggagattaatcgcgtcctgtactcgctggctaagaaggggaagcttcagaaggaggccggaactccccctctgtggaaaattgctgtgtcaacacaggcctggaaccagcactccggcgtagttagaccagacgggcacagtcaaggcgctccaaatagcgatccgtccctggaacctgaagaccggaactcgacctccgtctccgaggacctcctggagcctttcatagcggtctcagcacaggcatggaaccagcactccggagtcgtgcgtccagattcccactcacagggctctcctaatagtgacccgggtttggagcccgaggactcaaactctacctcagcactggaggaccctttggagtttttagacatggccgagattaaagagaagatctgcgattacctgtttaacgtgtccgattcttctgccctgaacctagcgaagaatattggcctgactaaggccagggatattaatgccgtactgatcgacatggagcgacagggggacgtgtatcgccagggaacgactccacccatttggcaccttacggacaaaaagagagaacgaatgcagattaagcgcaacaccaattcagtccccgagaccgctcccgctgcaattcccgagaccaagcgcaacgccgaattcctgacctgcaacattccgacgagcaacgcatcaaacaatatggtgacaactgagaaagttgaaaacgggcaggaacccgtgatcaaactagagaatcgtcaggaggcacggcctgagcccgctcgtttaaagcccccagtccactacaacggtccttctaaggcaggctacgtggattttgagaatggccagtgggccacagacgatattcccgatgaccttaactcaattagagctgcgccaggcgaattccgtgcgatcatggagatgccttccttttacagccatggtttgcctagatgttccccttacaagaagctgactgagtgccagcttaaaaaccctatctctggcttacttgaatatgcacaattcgcttcccagacttgtgagttcaatatgattgagcagtcagggccacctcatgaacccaggtttaaattccaggttgtcataaacgggagagaattcccccctgccgaggccggtagcaaaaaagtggccaaacaggacgcagctatgaaagcaatgacaattctgctggaagaggctaaagctaaggacagcggcaagagtgaggaaagcagccattatagcacagagaaagagagcgaaaagacagcagagagtcagacgcctacaccctcagccacttcgttcttttccggcaaatcgccagtgaccactctgctcgaatgcatgcacaaactgggcaactcctgcgagtttcggctcttgagcaaagaaggacccgctcacgagcccaaattccagtactgcgttgcagtgggcgctcagacattccctagtgtgtctgccccttccaagaaggtggcaaagcaaatggcagcggaggaagccatgaaggcactccacggcgaggctacaaacagcatggcctccgataatcagccagagggtatgatctcggagagcctggacaatctcgagtcaatgatgccaaacaaagttcgcaaaatcggtgagctggttaggtacctcaacaccaatcctgtgggcggactactggagtatgcaaggagtcatggattcgccgctgaattcaagttggttgatcagtctgggcctccccatgaacccaagttcgtgtatcaggcaaaggtgggcggtagatggttccctgccgtgtgtgctcatagtaagaaacagggcaaacaggaagccgcagacgcggctttgcgggtgttgattggggagaacgaaaaagcagaaagaatggggttcacagaagtcactcctgttaccggcgcatccctgaggagaaccatgttgttattgtctcggagcccagaggcccagccgaagacactgccactcactggctcaacgtttcacgaccaaatcgctatgctgtcccaccgctgttttaacaccttgactaactcctttcagccgtccttattgggcaggaagatcctggccgctatcataatgaaaaaagattctgaagacatgggtgtggtagtgtctctgggtactgggaatagatgtgtcaagggggactcgctctctctcaagggcgagaccgtaaatgactgccacgcagaaatcattagccgtcgaggttttattaggttcttatattcagaactgatgaagtacaatagccaaaccgccaaagacagtatctttgagccagcgaaggggggagaaaaactgcagataaagaagacggtctcatttcatttgtatatttctaccgcaccctgtggggacggggcattatttgacaagtcttgttcagaccgggcaatggagtcaactgaatctaggcactatcctgtgtttgagaatcccaaacagggaaagcttaggactaaagtggaaaacggtgaaggcactatccccgtagaaagttctgatatagttccaacctgggatgggattaggctcggagaacgcctgcggaccatgagttgctccgacaagatccttcggtggaatgttctaggattgcagggcgcattgctcactcacttcttgcaacctatatacttgaaatccgtaactttgggctacctattcagtcaaggccatttgaccagggccatctgttgtcgggtgactcgcgatggaagcgcgtttgaggacggcctcagacacccattcatcgtcaatcaccccaaggtgggacgcgttagtatttacgattctaaacgacagtctggcaagactaaagaaacctcagtcaattggtgcctcgccgatggatatgaccttgagatactggacggtacccggggaactgttgatggcccacgcaacgagttatcacgggtctctaaaaagaatatttttctgctttttaagaagctgtgctcgttcagataccgacgggatctgttgcgcctgagctacggagaggctaaaaaagccgcaagggattacgaaaccgctaagaactacttcaagaagggcctcaaagatatggggtacggaaactggataagcaagcctcaagaagagaagaatttttacctgtgccctgtttag

SEQ ID NO: 27238 - DNA, 3588 bp, Artificial Sequence
  Description of Artificial Sequence: Synthetic coding sequence
gggtactctctgtctgggtattatacccacccatttcaagggtacgagcatagacagcttcggtatcagcagcctgggcctgggtctagtcccagctctttcctgctgaagcagattgagtttttgaaaggtcagctgcctgaggccccagtcataggaaaacagacaccaagtctgcccccatcgctacccggacttcgcccacggtttccagtcctgcttgcaagctcaacccgcggtcgccaagtggatattagaggtgtaccccgtggggtccatctgcgcagccagggcctgcaaagagggttccaacacccaagccccaggggtcgcagtttgccacagcgcggtgtggattgcctatctagtcactttcaggagctttccatatatcaagatcaggagcagcggatcctgaagttcttagaggagctaggggagggtaaggcaaccaccgcccacgatttgtccggcaaactggggactccaaagaaggaaatcaatcgggtgctctatagtctggcaaaaaagggaaagctccagaaagaagcaggaacacctcccctgtggaagatcgccgtcagcacgcaagcgtggaaccagcactcaggcgtcgtgcggccagacggccacagccagggcgctccaaatagtgatcccagcctcgagccagaggaccgcaactcaacctccgtgtctgaagacttactcgagcctttcatagcggtcagcgcccaggcttggaaccagcattcgggggtcgtgcggccagacagccatagtcagggttctcccaactccgacccaggtctagaacccgaggactctaactcaacttctgctctggaggatcccctagagtttttagacatggccgaaatcaaagagaagatatgtgactatcttttcaatgtgtcagattccagcgctttaaatctcgcgaagaatataggtctgacgaaggctcgcgatatcaacgccgtcctgatcgacatggagaggcaaggtgacgtgtatagacagggaacgactccccctatctggcacctcaccgacaaaaagagggaacgcatgcagatcaagcggaatactaattctgtaccagagactgcccctgccgctatccccgaaactaagagaaacgccgagtttctcacatgcaacattccaacttcaaacgcatccaataatatggtgacaactgagaaggtggaaaatggacaagagcccgtcatcaaactggaaaacaggcaggaggccaggcctgagccagcacgcctgaagccaccggtgcattacaatgggcctagcaaggcaggctacgtggactttgaaaacggacaatgggctacggacgacattcccgacgaccttaattcaattcgggctgcccctggcgaattcagggctatcatggagatgccttctttctacagtcatggactcccccgttgctctccttacaagaaactcactgagtgccagctaaagaaccctatcagcggactcctcgaatatgcacagttcgcttctcagacttgtgagttcaatatgattgagcagagtggcccaccgcatgagcctcgcttcaagttccaagtggtgattaatggcagggaattccccccagccgaggccggaagcaagaaagtggcaaagcaggatgccgcaatgaaggccatgactatcctgttggaggaggccaaggccaaggactcgggtaaatccgaagagtcctcacattattcaactgaaaaggagagtgaaaagacagcagagagtcaaaccccaacccccagtgctacgtcgttctttagcggcaagtcccccgtcacgacgctgctcgagtgcatgcataaactgggaaattcctgtgaatttcgtttgctgtctaaggagggccctgcgcatgaacctaaatttcagtactgtgtcgcggtgggtgcccagaccttccctagcgtttccgcaccaagtaagaaggtcgcgaagcagatggctgccgaggaagcaatgaaggctttgcatggcgaagctacaaactccatggcaagtgataatcaacccgaaggcatgatatccgaaagcctcgacaacctcgagtctatgatgccaaacaaggtgaggaagatcggcgagctggtgaggtacctcaatacaaacccagtcgggggactgcttgagtatgctaggtcccacggatttgccgcagaatttaagctggtagatcagagcggtccgcctcacgaaccaaagttcgtatatcaggcaaaagtgggaggacgctggttcccggctgtgtgcgcacacagcaaaaaacaggggaagcaggaagccgctgacgctgccctgagggtgctgatcggagagaacgaaaaggccgaacgcatgggatttacagaactgcccctgactggatcgactttccacgatcagatcgcaatgctgtcacatcggtgcttcaatacactaaccaattctttccagccttcgctccttggcagaaagatactggccgctattattatgaaaaaggactcagaagacatgggcgtggtggtgagcctgggcactggaaacagatgcgttaagggcgacagcctcagtttaaagggtgaaaccgtgaatgactgtcacgcagagatcatctctagacgtggtttcataaggttcctgtattctgaactcatgaagtacaatagccagacagcaaaagattccattttcgagccagccaaagggggagagaagctccagattaagaaaaccgtctcatttcacctatatatcagcaccgctccatgtggtgacggtgcactgttcgataagtcatgttccgacagagctatggaaagtacagagagcaggcattatcccgtgttcgaaaaccctaagcagggtaagctcaggaccaaagtggagaacggggaaggaacaattccagtcgaaagctctgatatcgttccaacatgggacgggattcgactcggcgaacgcctacgcactatgtcatgtagcgacaagattctgcgctggaatgttctcggcctacagggcgcattactgacacacttcctgcagcctatctacctgaaatcagtgaccttgggctacctgttcagccaggggcacctgacgagggctatatgctgtcgcgtgacacgggatggcagcgctttcgaggacggacttaggcatccgttcatcgttaaccaccctaaggttggaagagtttccatttatgattcgaaacggcagagtggaaaaactaaggagactagcgtgaattggtgcctggctgacggttacgatctggagatcctggacggcacaaggggaaccgtggacggtccacgcaatgagctaagccgggtgtctaaaaaaaatatctttctgttatttaaaaaactgtgtagctttagataccggagagatctgctgagactgtcctacggggaggccaagaaagcagctagagattatgagaccgctaaaaactactttaaaaagggcctaaaagatatgggatacggtaactggataagtaagccacaggaagaaaaaaatttttatctgtgtccggtgtag

SEQ ID NO: 27239 - DNA, 528 bp, Artificial Sequence
  Description of Artificial Sequence: Synthetic coding sequence
atgggcaaagtgctgagcaaaatttttggtaataaggagatgcggatcctgatgttaggtctggacgccgctggcaagacaacgattttatacaaactcaaactcggccagagtgtgaccacaatccctacagtaggatttaacgtcgagaccgttacctataagaatgtgaaattcaacgtgtgggacgttggaggccaggataagatacgaccgctttggaggcactactatactggaacacaggggctcattttcgtcgtcgattgcgccgatcgtgacagaatagatgaggcgagacaggagctgcatagaattataaacgacagggaaatgagggacgcgattatcctcatcttcgccaacaagcaggacttgcctgacgcaatgaagccacacgagatacaggagaagctgggattaacccgaatccgagacaggaattggtacgtacagccatcatgcgccaccagcggtgatggtttgtatgagggactgacctggctgacctcaaactacaaatcctag

SEQ ID NO: 27240 - DNA, 1398 bp, Artificial Sequence
  Description of Artificial Sequence: Synthetic coding sequence
atgtttaggcaagagcagccactggcggagggctcttttgctccaatgggaagcctacaaccggacgccggtaacgcctcatggaacggcactgaagcccctgggggaggagcccgtgccaccccttacagtctacaggtgactctcacccttgtctgtctcgctggcctgctcatgttgctaacagtgtttggcaacgttttagtcataatcgccgtatttacctctcgggctcttaaagcgccacagaacttatttttggtatccctcgcctccgctgacattctagttgctacactggtaatcccttttagtctcgctaatgaggtgatgggatattggtactttggtaaggcttggtgtgagatctaccttgctctagatgtgctcttttgtacgtcatctatcgtacacctatgcgccatttcactagataggtattggtcaatcacacaggccattgagtacaacctgaagagaaccccccgtaggataaaggctataatcataacggtttgggttatctctgctgtcatcagttttccaccactcattagcatcgaaaagaagggtgggggtggcggaccccagcctgctgagcctcgttgcgaaatcaacgaccagaagtggtacgtgatctcatcctgtataggatccttcttcgccccatgcctgatcatgatcctggtctacgtgcggatctaccaaatcgctaaacggcgtacaagggtgccgcctagtcgcagaggaccagacgctgtggcggcacctccaggtggcacagagaggagacccaatggcctgggccctgaaagatcggccggacccggtggagccgaggcagaacccctgcccacccaactcaacggggctcctggagaacccgctcctgcaggccctcgtgatacagatgcccttgatctcgaagagtcctctagttccgaccacgccgaacggcctcctggaccacggaggcctgagcgaggccctcgagggaagggtaaagcacgggctagccaggtgaagccgggagactctctgccacgcagaggaccaggagcgaccggaattggaacacccgctgctggaccaggggaggagcgagtgggcgctgcaaaggctagtaggtggcgaggcaggcagaacagggaaaagcgattcacatttgtgttggccgtggtgattggtgtcttcgtcgtctgctggtttccttttttcttcacatacaccctcacagccgtcgggtgtagtgtaccccgtaccctttttaagttctttttctggtttggttactgtaacagcagcctgaatccagtgatctacaccattttcaatcacgattttagacgtgcctttaaaaagattctttgccggggagaccgcaagcgcattgtttag

SEQ ID NO: 27241 - DNA, 285 bp, Artificial Sequence
  Description of Artificial Sequence: Synthetic coding sequence
atggccccactgaagatgcttgctcttgtgacccttctcttgggagcaagtctacagcatattcatgcggctcggggtaccaacgttggcagggaatgctgtttggaatatttcaagggtgctattccactacgcaaattgaaaacttggtaccagactagcgaggattgttctcgagatgcaattgtctttgtgactgtccagggaagagccatatgctctgatcccaataacaaacgcgtaaaaaatgcagtgaaatatctgcagtcacttgaaagatcctag

SEQ ID NO: 27242 - DNA, 1635 bp, Artificial Sequence
  Description of Artificial Sequence: Synthetic coding sequence
atgccaggccgttgtcagtccgatgccgcaatgagggtaaacggtccagcaagccgggctccagcgggatggacttcggggagcttgcacacagggccaagggctgggagaccacgagcacaggcgaggggcgttcgaggcaggggcttactactgaggcctcggcctgccaaggaactccctctgccccgtaagggaggcgcttgggcacccgctggaaatccaggacctttacatcccctgggggttgcggtcggaatggcgggaagcggacggttagtgctgagaccctggatcagggaactgattctggggtccgagacaccatcttcacctcgtgctggccagctgctggaagtgcttcaggacgctgaggccgcagtcgcagggccatcacacgccccagataccagtgacgttggggctactctactggtgagtgacggcacccacagcgtgcggtgtctggtaaccagggaagctttggacacatcagactgggaagaaaaggagttcggctttagggggacagagggcaggctgctactccttcaggactgcggagttcatgtgcaggtcgcagaaggcggagcgcctgccgagttttacctgcaggtcgatcggttcagtctgcttccgaccgaacagcccaggcttcgggtgccaggctgtaaccaggatttggacgtgcagaaaaagctgtatgattgtctagaagagcacctctcagagtcaacatctagtaatgccggactgagcctgtcccagcttctcgatgaaatgcgtgaagatcaagagcatcaaggtgctctggtctgcctcgcggagagctgcctgaccctagaagggccttgtaccgcacctcccgtcacgcattgggcagcctctcggtgtaaagcgaccggtgaagctgtgtataccgtgccttcatccatgttatgcatctcggagaacgaccaactgatcctctcgagtctcgggccttgccagcgcacccaaggtccagaactcccacccccagaccctgccctccaggatcttagtctcaccctaattgcctcccccccttcttcccccagctcctccggaactcctgccttgccaggccatatgagtagtgaggaatcagggaccagtattagtttgctccccgcactcagcctggccgcaccggacccaggtcagaggagcagcagccagccctcccctgctatttgctccgcgccagctaccctcacaccaagatctccacacgcttctcgcacacccagttcccctctgcagtcatgtacaccttcactgtccccccgtagtcacgtccctagtccacatcaggcactggtcaccaggccccagaaaccctctttggaattcaaggagttcgtcggcctcccttgtaagaatcgacctccattcccaaggacaggtgccacccgtggagcacaagaaccgtgctcggtgtgggaaccaccaaaacggcacagagacggtagcgcctttcagtatgaatatgagcctccctgtacaagcctatgcgcgcgtgttcaagccgtgcgactgccaccccagttgatggcatgggcactgcacttcctgatggatgcccaacctggctccgagccaacccccatgtag

SEQ ID NO: 27243 - DNA, 558 bp, Artificial Sequence
  Description of Artificial Sequence: Synthetic coding sequence
atgaaactcgtgtctgtggccctgatgtatctaggttcactcgcttttttgggggctgatactgcacgcttggatgtcgcctctgaatttaggaagaagtggaataaatgggctctgagcagagggaaaagagagctcaggatgagctcaagctatccaactggactggccgatgtgaaagcgggacccgcacagaccctcatccgcccacaggatatgaagggagcgagccgttctccagaagacagctcaccagacgcagcccgaattagagtcaagagataccggcaatccatgaacaactttcagggactgcgctcctttggctgcagatttggaacctgcaccgtgcagaaacttgctcaccagatctaccagtttacggacaaggataaggataatgtggcgcctaggtctaagatctcacctcagggatacggccgacgtaggagacggagcctgcccgaggctggcccaggccgaaccctggtcagcagtaagccacaggctcacggcgctcctgcccctccttctgggagtgccccacatttcctgtag

SEQ ID NO: 27244 - DNA, 558 bp, Artificial Sequence
  Description of Artificial Sequence: Synthetic coding sequence
atgaagttggtgtcagtcgccttaatgtacctggggtctctggctttcttaggtgcagacacagcacgattggacgttgccagtgagttcagaaaaaaatggaacaaatgggctctgagcagggggaagagagaactgcgtatgtctagctcttaccctactggattagctgacgtcaaagccggacccgcacaaacccttattcgcccacaagacatgaagggggcatctagatccccagaggattctagtcccgacgccgcacggatccgggtcaaaagataccgacagtctatgaacaattttcagggattaaggtcgttcggttgccggtttggcacatgcaccgtccagaagctggcacaccagatatatcagttcactgacaaggacaaagacaacgtagctcctcggagtaagatctccccccaaggatatggtaggagaaggaggcgaagtctcccagaggcaggtcccggaagaacactggtttcttctaaacctcaggctcatggcgctcctgccccaccctctggctccgctcctcatttcctgtag

SEQ ID NO: 27245 - DNA, 558 bp, Artificial Sequence
  Description of Artificial Sequence: Synthetic coding sequence
atgaaactggtgtctgtggccctaatgtatctgggcagcctagccttcttgggggctgacaccgcaagattagacgtggctagtgagttccgcaaaaaatggaacaagtgggctctgtctaggggaaagagagaattacgaatgagttcatcctaccccaccggcctggcggatgtgaaggccggaccggcacagaccttgatccgacctcaagatatgaagggcgcaagtcggtcccctgaggactcatcccccgacgccgctcggatcagggtcaaacgctatcgccagtccatgaataattttcaggggttacgctcttttggctgccgttttggcacctgtacggttcagaaattagctcaccagatctaccagtttacagacaaagataaagacaatgttgccccacggtctaaaattagcccacaaggctatggacgaagaaggcggaggtctctgcccgaagccggtccaggcaggactctggtgtctagcaagccgcaggcacatggcgcaccagccccaccctctggtagcgcccctcactttttgtag

SEQ ID NO: 27246 - DNA, 702 bp, Artificial Sequence
  Description of Artificial Sequence: Synthetic coding sequence
atggccgcaggtactgcagtaggtgcctgggtgctggtgctgagcctgtggggggctgtcgtgggtgcccaaaatattactgcaaggataggcgagcctttggtgctgaagtgcaaaggtgcaccgaaaaaacctccacaacgcctcgagtggaagttgaatacgggtaggactgaggcctggaaggtcttgtctccgcaggggggaggcccatgggacagtgtcgccagggttttgccaaattcctccctgtttctaccggcagttggtatccaggatgagggcatcttccgatgtcaggcaatgaaccggaacggcaaagaaacaaagtccaactaccgcgtccgagtgtaccagataccaggaaaacccgagattgtcgatagcgcttctgagctcactgcgggagtcccaaacaaagtcgtggaggaatctcgacgaagccgaaagaggccttgtgagcaggaagtggggacctgtgtgtctgaggggagctatccagccggaacactgtcgtggcacctagatggtaagccgctagtgccgaacgagaagggcgttagcgtgaaagagcagactcgaagacatcctgagacaggccttttcaccctacagagcgaacttatggtgaccccagccagaggtggcgatccgagaccaactttttcttgctcttttagtccaggcctacctaggcattag

SEQ ID NO: 27247 - DNA, 1029 bp, Artificial Sequence
  Description of Artificial Sequence: Synthetic coding sequence
atggcggctggcaccgccgtgggagcgtgggtcctggtactttccttgtggggggcagtggtcggcgcacagaatattacggcgaggattggcgaacccctcgtcttgaaatgcaaaggcgctcccaaaaaaccccctcagcggctggagtggaaactcggcggtggaccctgggacagcgtggcccgtgttctgcctaactcttccctgtttctgcctgccgtcgggattcaagacgaaggtatatttaggtgtcaagccatgaacagaaacggtaaagagaccaaaagcaattaccgagtccgagtgtaccagatacccggtaagccagaaatcgtcgacagcgcttcggagttgacggctggagtgccaaataaggtggggacctgcgtgagcgagggctcataccctgctggaactctgagctggcaccttgacggcaaacctctggttcccaatgagaaaggtgttagcgtcaaggagcagacaagaagacatcccgagaccggactgtttactttacagagcgaactcatggttacaccggcaagagggggtgatcccagacctacatttagttgctccttctcccccggattgccccgtcacagagccctccgtaccgccccaatccagccaagagtctgggaaccagtacctcttgaggaagtccagcttgtcgtggaacccgaggggggagccgtggcgcctggagggaccgtaactcttacctgcgaggtacccgctcagcccagcccacagatccattggatgaaagacgtctcggatctggagaggggcgcaggccgaacacgcaggggtggcgcaaattgccgtctctgtggccgtatcagggcaggaaactccagtcccggtcccggagatcctggtaggcccggtgatagtaggccagcacactggggacatttggtggcaaaggcggctactcctagacgaggggaagaaggccctagaaaacccggaggccgagggggtgcttgtaggacggaaagcgtgggtggtacctag

SEQ ID NO: 27248 - DNA, 1044 bp, Artificial Sequence
  Description of Artificial Sequence: Synthetic coding sequence
atggccgcagggactgctgtcggagcctgggtgctggtcctgtcactgtggggggcagtcgtcggagcacaaaatatcacagccagaattggggaacctctggtgttaaaatgcaaaggggcaccgaagaaaccccctcagagactcgaatggaaactcaataccggcagaacggaggcatggaaggtcctgtccccccagggagggggaccctgggattccgttgcacgtgtgttgccaaacagcagcctctttctgcctgccgttggtatccaagacgagggtatcttcaggtgccaggccatgaaccgtaacggtaaggagaccaagagcaattatcgggttcgagtttatcagattccagggaaaccagaaattgtagactctgcatccgagctgactgctggcgttccaaataaggtgggcacctgtgtgtcagagggaagctatccagctggaacactctcatggcatcttgacggcaaacctctcgttccaaacgagaagggcgtttctgtcaaggaacagacgcgtcgccacccagaaaccggtttgttcacattacagtcggagctgatggtaactcccgctcgaggcggagacccgcgacccacctttagttgcagtttttccccgggtctgccacggcatagagccctgcgtacggccccaatccagccaagggtctgggagccagtccccctagaggaagttcaactcgtagtggagcccgagggcggagcagtcgctccgggaggtaccgtgactctgacctgtgaagttcctgcccaaccttctccccagatccactggatgaaggatggtgtgccattgcctctgccccctagccccgtcctgattctccctgaaatcggacctcaggaccagggtacttactcttgtgtggctactcattcctcccatggaccgcaagagtctagggctgtgtcaatttcaattatcgaaccaggagaggagggcccaactgcaggtgagggatttgacaaagtgcgagaggccgaggatagccctcagcatatgtag

SEQ ID NO: 27249 - DNA, 1215 bp, Artificial Sequence
  Description of Artificial Sequence: Synthetic coding sequence
atggcagctggaaccgcagtcggggcttgggtgctagtgctcagtctgtggggcgcagtcgttggggctcagaatattactgccaggatcggggagccgctggtcctgaagtgtaagggcgcaccgaaaaagccccctcagcggctcgaatggaagcttaacactggcagaaccgaagcatggaaggtactatccccacagggcggtgggccatgggattctgttgctcgcgtgctgcccaattcctccctgttcctccctgctgtgggcattcaagacgagggtatcttcaggtgccaagctatgaaccgtaacggtaaagagactaagtccaactatagggttcgcgtctaccagattccaggcaaacccgagatagtggactccgcttcggagttgaccgccggagttcccaataaggtgggaacatgcgtctcagaaggttcatatccagctggcaccctctcctggcacctagacggaaaaccactcgtccctaacgaaaaaggagtcagtgtaaaagaacaaacacgcaggcacccagaaacgggcctgttcacattgcaatcagagctgatggtgacgccggctcggggaggggaccctcgacccacattctcctgcagctttagccctgggctgccaagacaccgggcattgcggacagctccaatacagcccagggtgtgggagccagtccctttggaggaggtccaactggtagttgaaccggaaggcggtgcagtggcccctggcggtaccgtaaccctcacctgtgaggtccccgctcagccctctccacagatccattggatgaaggatggagtgcctttgcctctgccgccaagccccgtgctgatcttgccagaaatcggcccacaggaccaaggcacctatagctgtgtcgcgacacacagctcccacgggccacaagagtcccgcgctgtgagcatctcgatcattgagccaggcgaggagggcccaaccgctggaagcgtgggtggctcaggcctcgggaccctagctcttgcactggggattctaggagggctcggcactgctgccttgctcatcggcgttatactatggcagcgtcgccagaggaggggtgaagaaagaaaagcgcctgagaaccaggaggaagaggaggaacgagccgagctgaaccagagtgaggaacctgaagctggggagagctctacggggggaccctag

SEQ ID NO: 27250 - DNA, 705 bp, Artificial Sequence
  Description of Artificial Sequence: Synthetic coding sequence
atggcagccggtactgctgtgggcgcttgggtgctcgttctctccctgtggggggctgtagtgggtgcgcagaatattacagctcggattggggaaccgctggtcctgaagtgcaaaggcgcacctaaaaaaccacctcaaagactcgagtggaagctgaacaccggtcgcactgaggcttggaaagtgctgtcgccccagggaggtgggccttgggattccgtcgccagagtgctccccaatagcagcctgttcctaccagcagtggggatccaagacgagggtatctttagatgtcaggcaatgaaccggaatgggaaagaaacaaagtcaaattacaggagcctccgaacatttacaatcaccgcctcggattggatattccccccatctgaaatccctggaaaaccggaaattgtggactctgcgagcgaactcacagcgggtgtgcccaacaaggtggggacctgtgtgtccgagggtagctacccagcaggcacactgagctggcatctggacgggaagcccctggtgcctaacgaaaagggcgtttccgtgaaagaacagactcgcagacatcctgagacgggactgtttaccctccagtcagagcttatggtgactcctgcacgtggcggagaccccaggccaacctttagctgtagcttttctccaggcctcccacgccacagggcacttcgctag

SEQ ID NO: 27251 - DNA, 402 bp, Artificial Sequence
  Description of Artificial Sequence: Synthetic coding sequence
atgaaggacggcgtccctctgcccctgcccccatcacccgttctgatcctgccagagattgggccacaggaccaggggacctacagctgtgtcgcaacccacagctcacatggcccacaggagagtcgcgctgtctctatctccatcattgaacccggagaagaagggcctactgcaggcagcgtcggaggatctggccttgggactctggccctggccctcggcatcctgggcggacttggaactgccgcattgctcattggtgtcatactgtggcagcgcaggcagcgacgtggcgaagagcgcaaagcccctgagaatcaagaagaagaagaggagagggcagagctaaaccagagcgaagaacccgaggcgggtgaatcctctaccggcggtccctag

SEQ ID NO: 27252 - DNA, 1308 bp, Artificial Sequence
  Description of Artificial Sequence: Synthetic coding sequence
atgggagccggtgagagggttcaggcccctccgagagctgaggctacagccggacggggtgccgacagggctcgcaccctggaggggtcccgtatggctgcaggcactgccgtcggcgcatgggtactcgtgctgagtctgtggggggctgtggtgggagctcagaacattactgctcgaataggtgaaccgctggtattgaagtgcaaaggtgccccaaaaaaaccaccacagcggttggagtggaaacttaacacaggacggaccgaggcctggaaagtgctgtccccacagggaggtggtccatgggactcggtggctcgcgtgttgcccaacagtagtctgttcctgcccgcagttggcatccaggatgagggtatcttccggtgccaggccatgaaccgaaacggcaaggaaacaaagtctaattaccgagtgcgggtgtatcagatacccggaaagccggagattgtggacagcgcttccgaattgaccgccggagttccaaacaaagtcggcacgtgcgtctccgaggggtcataccccgctggtaccctgtcttggcacctggacggaaagccactcgtccccaatgagaaaggcgtcagtgtcaaagaacagacccgaagacatccagaaaccggactcttcacccttcagtccgagctgatggtaacccccgctagaggtggtgaccctcgccctaccttttcttgttcattcagtcctggcctgccacgccatagagcgctgcggaccgcacccattcagccaagggtttgggaaccagtgcccttggaggaggtgcagttagttgtcgaacccgagggtggcgcagtggcgcctggcggaaccgttacactgacatgcgaggtgcctgcgcagccttctcctcagattcattggatgaaagacggtgtccccctgcctctccctccaagcccagtcctgatcctcccagagatcggcccacaggatcaggggacctattcatgcgtggctactcactcatcgcatgggccacaagaaagccgagccgtctcaattagcatcatagagcccggtgaggaaggccctactgccggtagcgtgggcggatccggcctcggcactctggcactggcgctcgggattctgggaggtttaggaacagcagcactgctgatcggagtgatactgtggcagagacggcagagaagaggtgaggagagaaaagcaccggaaaatcaggaggaagaagaggagcgtgccgagctgaaccagagtgaggagcccgaggcaggggaatccagcaccggcggaccctag

SEQ ID NO: 27253 - DNA, 387 bp, Artificial Sequence
  Description of Artificial Sequence: Synthetic coding sequence
atggctgcgggaacagcagtgggtgcatgggtgttagtcctgagcctttggggtgcagtggttggggctcagaatattaccgcccgtatcggtgagccccttgtgctgaaatgcaaaggagcccctaagaagccacctcagaggctggagtggaaactgaacactggtaggaccgaggcatggaaagtactcagtcctcaggggggtgggccatgggactctgtagctagggttttgcccaatagtagcctgtttctgccggctgttgggattcaggacgaaggaatatttagatgtcaggccatgaaccggaacgggaaggaaacgaaaagcaattatcgtgttagggtatatcaatttgagaacctgcacaactatagcctttag

SEQ ID NO: 27254 - DNA, 462 bp, Artificial Sequence
  Description of Artificial Sequence: Synthetic coding sequence
atggcagctgggaccgcagtaggcgcatgggtgcttgtgctaagtctgtggggggcagtggtaggagcacagaatataacggccagaatcggggagccactagtgttgaagtgtaagggggctcctaaaaagcctccgcagagactcgaatggaagctgaataccggacgcacagaggcctggaaagttttgtctccccaggggggaggaccctgggactccgtggcacgggtcctgccaaactcctccctgttcttgcctgcggtcggtattcaggatgaaggtatcttgggtggcctcggcacagcagcactgcttatcggcgtgattctttggcagagaaggcagaggcggggtgaagagcggaaagcaccagagaaccaggaggaggaggaggaacgggctgaattgaatcagagcgaagagcccgaggcaggggaatccagcacgggagggccatag

SEQ ID NO: 27255 - DNA, 885 bp, Artificial Sequence
  Description of Artificial Sequence: Synthetic coding sequence
atgaacagaaacgggaaggaaacaaagagcaactatcgtgtgcgcgtttaccaaattcccggtaaacccgagatcgttgacagcgccagcgaacttactgctggcgttcctaacaaggtgggcacctgtgtaagtgagggcagctaccccgctggtacactctcctggcaccttgacggcaagccactcgtgcctaatgagaagggggtgtcagtgaaagagcagactagaagacatcccgagaccggcctatttactctccagagtgaactgatggtgacacccgcacgaggcggagacccccgaccaactttctcttgttcctttagtccgggactaccacgccacagagcccttcggaccgccccaatccagcccagagtctgggagccagtgcctctggaggaggtacagctggtcgtggaacccgaggggggtgcagtggcacctggcggaactgtgactctgacatgcgaggtgcctgcccagccctctccacaaatccactggatgaaggacggggtccccctgcccctcccaccctcacctgtgctcattctgcccgagattgggcctcaggaccagggcacctactcctgtgtggccactcatagctctcatggccctcaggagagccgggcagtttccattagcatcattggaagcgtggggggaagcgggttgggcactctggccctggcgttgggaatactggggggactagggactgccgctctgctgatcggcgtcattctctggcagcggagacagcggcgaggcgaagagcggaaagcccctgagaatcaggaagaggaggaggagcgggcagagctaaaccaaagcgaagaaccagaggccggagagtcctctactggcggaccgtag

SEQ ID NO: 27256 - DNA, 366 bp, Artificial Sequence
  Description of Artificial Sequence: Synthetic coding sequence
atggccgcaggcaccgcggtgggcgcttgggtcctcgtgctgagcttgtggggggcagttgtaggagctcagaatatcaccgccagaatcggcgaacctcttgtgttgaagtgtaaaggagctcccaagaaacctccccagcgactcgagtggaaattaaataccggtcggaccgaggcctggaaggtgctcagccctcagggcggtggcccatgggacagtgtagcacgggttttgcccaacagtagcttgttccttcctgccgtgggtatccaggacgagggcatcttccggtgtcaagcaatgaatcgtaacggcaaggaaacaaaatcaaattggtggtggtcacagaaggttgagcagtag

SEQ ID NO: 27257 - DNA, 1092 bp, Artificial Sequence
  Description of Artificial Sequence: Synthetic coding sequence
atggcagccggaaccgcagtgggagcatgggttttggtcctctcactctggggtgcagtggttggcgcacagaatattaccgcaagaatcggcgaacccctggtcctgaagtgcaagggagcaccaaagaaaccaccgcagaggctcgaatggaagttaaatactggcagaacggaagcttggaaggtgctgagtccgcagggagggggaccgtgggatagtgtcgcacgcgttctgcccaattcttctctgtttcttccagccgttggcatccaggatgaaggaattttcaggtgccaagctatgaaccgaaacggcaaggagactaaatctaactaccgggtgcgtgtataccaaattcctggaaagcccgagattgttgactccgcatctgaactcaccgctggcgttcccaataaggttgttgaagaaagcaggcgtagtcgaaagcgcccatgcgaacaagaggtgggtacatgtgtgtcggaggggagctaccctgcaggtaccttgtcatggcatcttgacgggaagcccctggttcccaacgagaaaggggtgtcagtaaaagaacagacaagacgccacccagaaactggcctgttcacgctccagtcagagctgatggtaactcctgcacggggtggcgaccccaggcctacgttcagctgttctttcagccccggactcccccgacaccgggcactgagaacggcgccaatccagccgcgagtctgggagccggtgccactggaggaagtccagctagtcgtggaacctgagggaggcgcagtggcccctggcggtacagttaccctgacctgcgaggtgccagcccagccgagcccgcaaatccattggatgaaggatggtgtgccgctgcccttaccgccttctcccgtgctaattctgcctgagattggccctcaggaccagggaacctactcgtgtgttgcaacccacagctcacatggccctcaggaaagccgggcagttagcatcagcatcatcgagccgggtgaggagggaccaaccgctggggaagggtttgataaggtccgggaggctgaggatagtccacaacatatgtag

SEQ ID NO: 27258 - DNA, 3633 bp, Artificial Sequence
  Description of Artificial Sequence: Synthetic coding sequence
atggccgctcaaagttccctttataacgatgacagaaatctcctgagaatccgggaaaaggaaagacgaaaccaggaggcccatcaggaaaaagaggcatttccggaaaagattcccctgttcggtgaaccctataagaccgctaagggtgatgagttgagtagccgaattcagaacatgctcgggaactacgaggaggtaaaggagtttttatcgacgaagagccatactcataggctggacgcaagtgagaaccgactgggaaagcccaaataccctctgatcccggacaaggggtcgtcgatcccatcctcttcatttcacacatctgtacaccaccagagtatccatacccccgctagtggacctctgtccgttggcaatattagccacaatcctaagatggcacagcccaggacagaaccaatgccctccctccatgccaaatcttgcgggccaccagactcccagcatctgacacaggaccggctagggcaggaagggttcgggtctagccaccacaagaagggggatcggagggcagacggagaccattgtgcatctgtcacagacagtgcccctgagagggaactttcccccctcatctctttgccttccccagtgccacctttaagccctatccatagcaaccagcagactttgccaaggacccaggggagcagcaaagtgcacggatccagcaataactccaaaggttactgcccagccaaaagcccaaaggatttggctgtgaaggttcacgacaaggaaaccccccaggattcgcttgtcgctccagcccagcctccctcccagaccttcccccctccctcgctacctagtaagagtgtagccatgcagcagaagccgaccgcttacgttagacccatggatggacaggaccaggcgccatcagagagccctgagttgaaacctctcccagaagattatcggcaacagacattcgagaagacggatttaaaggttccagcgaaggccaagttgactaagctcaagatgccttcacagtctgtggagcaaacgtatagcaacgaagtgcactgtgtagaggaaattctcaaagaaatgacccacagctggcccccaccgcttaccgctatccacaccccctcaactgctgagccttcgaagtttccctttccgaccaaagatagtcagcacgtgtcgagtgtcacccagaatcagaaacagtatgatacaagcagcaaaactcacagtaatagccagcaaggtacctcctccatgctggaggatgatttgcagttgtctgatagcgaggatagcgattccgagcagacacctgagaaacctccctcctcgtccgctcctccatccgccccacaatctttgccagagcctgttgcttctgcgcactccagtagtgctgaaagcgaaagcacatccgatagcgatagttcatctgatagtgagtcagagtcttcaagctcagacagcgaggagaacgaaccactcgagaccccagccccagagcctgaaccgcctacaactaacaaatggcagctggataattggttaacaaaggtctcccagcccgcagcgccacctgaggggcctaggtccacggaaccccctcgaagacatcccgagagtaaaggttctagcgacagtgcaaccagtcaagaacacagcgagagcaaggatccaccgcctaagtcctcttccaaagcaccacgagcccctccagaggcacctcacccaggaaaaagatcttgtcaaaaaagcccggcacagcaggaacctccacagcgacaaactgtcggcacaaagcagccgaaaaagcctgttaaagcctccgctagagcaggtagtcgcacttcactgcagggagagcgcgaaccgggactcctgccatacggatctcgtgaccagacttcaaaggacaaacctaaggtgaaaactaagggacggcctagagcggcagcatcaaacgagccaaaaccagccgttcccccatcatcggaaaagaagaagcataaatcctctctgcctgccccttctaaagcactaagtggccctgagccagccaaggacaacgtcgaagatagaacccctgagcatttcgcgcttgtgcctctgacggaatcccagggaccccctcacagcggatccggcagtcgcaccagtggctgtcgccaggctgtggttgtccaggaggatagccggaaagatcgactgccactgcctttgcgtgacacaaaactcctatccccactgcgggatactcctccaccccagagtttgatggtaaagattaccctggaccttcttagcaggatacctcagccccctgggaaagggtcgagacaaaggaaagctgaagataagcagccgcctgccggtaagaagcactccagtgagaaacgttcctccgatagcagcagtaaattagccaagaaaaggaagggcgaagccgaacgagattgcgacaataagaaaattcgattggaaaaggaaattaagagccagagctcctcctcttcatccagccacaaggagagctcaaagaccaagccatcacgaccaagcagccagtcatcgaagaaggagatgctgccccctcccccagtttcatcttcatcccaaaaaccagcaaaacctgccctgaaacgctctaggagagaggctgacacttgcggtcaagatccgccaaaatcagcctccagcacgaaatcaaaccataaggattccagtattccaaagcagaggagggttgagggcaaagggtctagaagctcatctgagcataagggttcatccggtgatactgccaatccctttcccgttccttcattacccaatgggaacagcaaaccaggtaagccccaagtcaagttcgataaacagcaggctgatctccacatgcgcgaggcgaagaaaatgaagcagaaggcggagctcatgacagatcgcgtcggtaaggccttcaaatatttggaggcggtccttagcttcatcgagtgtggcattgcaacagagagcgaatcacagagtagtaagagtgcttactccgtgtatagcgaaaccgtcgacttgattaagttcataatgtccttaaaatccttttccgacgctaccgcccctacacaggagaagatattcgctgtcctgtgcatgcggtgtcaaagtatcctgaatatggctatgttccgctgcaaaaaggacatcgccatcaagtatagccggacccttaataaacactttgagtccagcagtaaagtggcccaggccccaagcccctgcattgccagcaccggaacaccatcccctctttcacccatgcccagccctgcttcctccgttgggtcacagtccagcgccggttcagtcggctcgagtggggtagccgctaccatatccacccccgttaccattcagaatatgaccagctcgtatgtcacaatcaccagtcatgtcttaacggccttcgatctgtgggagcaggccgaagcactcactaggaagaataaggagttcttcgcacgtctgtccaccaatgtgtgtaccttggcactgaactcatcccttgtcgacctggtacattacacaaggcagggcttccagcagctgcaggaactaaccaaaaccccatag

SEQ ID NO: 27259 - DNA, 1266 bp, Artificial Sequence
  Description of Artificial Sequence: Synthetic coding sequence
atggcctttacagaacgggtcaacagctcagggaatagcctgtataacgacgatcggaaccttttgagaattcgggagaaagagagacgtaatcaggaggctcaccaggaaaaagaagcgtttccagagaagatccctctctttggcgaaccttacaagaccgcaaagggcgatgaactaagcagcagaatccagaatatgttaggtaactacgaggaggttaaagagtttctgagcacgaagagccacacacacagactggacgccagcgagaaccgcctgggaaagcctaaataccccctaatcccggataaggggagctccatcccttcttcctctttccacacatctgttcaccaccaatcgatccatacccccgctagtggaccactcagcgtcggaaatatcagtcataatcccaaaatggcccagccacgcacggagccaatgccctcactgcacgctaagagttgtggacccccagattctcagcatctcacacaggaccggctggggcaagaaggttttgggagcagccatcataaaaagggcgatcgcagggctgacggggaccactgcgcaagcgtgaccgattcggcccctgagagggaactgagtcccttgataagcctaccctcccctgttcccccactgtcccctattcatagcaaccagcagactcttcctagaactcaagggagttccaaggtgcacggaagcagtaataacagcaaggggtattgtccagctaaaagcccgaaggaccttgcagttaaagttcatgataaggaaaccccccaggactccctcgtcgcgcctgcacagcctccgtcgcaaacgtttcccccacctagcctacccagcaagtcggtcgcaatgcagcagaagccaaccgcatatgtcaggccgatggacggacaggaccaggcaccctccgagagtccagagctaaaacccttacctgaggattatcgccagcaaactttcgagaagacagatttaaaagtgccggcaaaggctaaactgaccaaactgaagatgccttctcagtctgtggagcagacctactccaacgaagtgcactgcgtggaggaaattttgaaagacagccagcatgtctccagcgtgacacaaaatcagaagcagtacgatacctctagtaagactcatagcaattcccaacaaggcacaagttccatgctggaagacgatctgcagctgtctgactcagaagactcagattccgaacagacacctgcgccttag

SEQ ID NO: 27260 - DNA, 3657 bp, Artificial Sequence
  Description of Artificial Sequence: Synthetic coding sequence
atggcatttactgagagggtaaatagtagcggcaatagtctgtacaacgatgatcgtaatctgctcaggattagagagaaagagcgacgaaaccaggaggctcatcaggaaaaagaggccttcccagaaaagatccctctgttcggagagccatacaaaacggccaagggagatgagctatcctccagaatccagaatatgcttggcaattatgaggaagtcaaggagtttctctctacaaaatctcatactcataggctggatgctagtgagaatcgcctggggaaaccaaagtatccgctgataccagataaaggctcatcaattccctcatccagcttccatacttccgttcaccatcaatccattcacactcccgcaagcgggccactctcggtcggcaacatttcacataatcctaagatggcccagcctcgcactgaaccgatgccgtccctgcatgccaaaagctgtggacctcccgatagccaacacctcacacaggataggttaggtcaagagggctttggctcctcccaccacaagaagggcgacaggcgtgctgacggtgaccattgtgcgtccgttactgacagtgctcctgaaagggaactgagtcctctcatcagcttgccttccccagtgccacccctgagccccattcacagtaatcagcagaccctgcctagaactcaggggtcaagtaaggtccacgggtccagtaacaacagcaaagggtattgtcccgcaaagagccctaaagacctcgccgtgaaggtacacgataaagaaaccccacaggactctctcgtggccccagcccagccaccctcccagaccttccctccaccttccctaccctcaaagagtgtcgccatgcagcaaaaacccactgcttatgtgcgaccaatggatggtcaggatcaggctccaagcgagtcaccagagctgaagcccctgccggaggactaccgccagcagacgttcgaaaaaaccgatctgaaagtacccgctaaggccaagctgacgaagctcaaaatgccttctcagtcggttgagcagacctactctaacgaggttcattgcgttgaagaaattctcaaagagatgacgcattcatggccgcctccccttacagcaattcacacgccctcaacagcagaaccctctaaatttccattcccaactaaggattcccagcacgtatcttctgtaactcagaaccagaagcaatatgacaccagctcgaagacacatagcaactcccagcaagggactagctcaatgctggaggatgacctgcagctgagtgactctgaggattccgactcggaacaaactccagagaaacctccgtctagttccgcccctccatccgcaccgcagtctctgcctgaaccagtggcgtccgcacactcgagttccgccgagtctgaaagtacaagtgattccgacagtagctccgattcagaatccgaatcttcttcctcagactcagaagaaaatgagcctcttgaaacccctgcaccagaacccgaacccccaaccaccaacaagtggcagctagataactggctgacaaaggtgagtcagcctgcggctccacctgaaggacccagatccactgagccgcctcggaggcaccccgagtccaaggggtcttcggactccgccacctctcaggagcactccgagtcgaaagaccccccaccaaagtcttcaagcaaggctcccagagctccccctgaggctcctcatccaggtaagcggagttgccagaaaagtcccgctcaacaggagccaccccagcgacagacagtggggaccaaacagccaaaaaaacctgtgaaagccagtgcaagagctggaagccgcacaagtttgcagggagaaagagagcctggtctgctcccgtacggatcccgtgaccagacttccaaagacaagcctaaggtgaaaacgaagggaagaccgagggcggcagcctctaacgagccaaagcctgctgtacccccaagctccgaaaaaaaaaagcataagtcatctctgcccgcaccctcaaaggccttgtcaggacccgaaccggctaaggataacgtggaagacagaacaccagagcatttcgcccttgtgccattgacagagagtcaagggccaccccactccgggtcaggctcaaggactagcggatgccgtcaggccgtagtggtgcaggaagactctcgaaaagatagattgcccttgcccctgcgtgacacgaaactcctgagtcccctaagggacacaccaccaccgcagtcactgatggtgaaaatcaccctcgatctcctgagccgtatccctcaaccgcctggcaaaggatcacgacagaggaaggccgaggacaagcagccaccagcaggcaagaaacattcaagcgagaagcgcagctccgatagttcttccaagttggcgaagaaaagaaagggcgaagccgaacgggactgcgacaataagaagatccggcttgagaaggagattaagagccagtcttcttcaagctcctcctcccacaaggagtcgtctaaaaccaaacccagccggcctagttctcagtctagcaagaaagaaatgttaccaccgccacctgttagcagtagcagtcagaaacctgctaagcccgctcttaagagaagcagaagagaagctgatacctgcggacaggaccccccaaaaagcgcctcgtcaaccaaatccaatcataaagattcttccatccctaagcagcgaagagtggaaggcaaggggtctaggtcatcgagtgagcacaagggttcttccggcgacaccgcaaacccgtttccggtgcctagtttgccaaacgggaattctaaaccaggcaaaccccaggtgaaattcgacaaacagcaagccgatctgcacatgagggaagccaagaaaatgaagcagaaagcggagctaatgacagatagagtggggaaagcgttcaaatacttggaagcagtgctgtccttcatcgagtgtggtatagcgacggaaagcgagagccaatcaagcaagagtgcctatagtgtctattccgaaacagtggaccttattaagttcattatgtccttgaagtctttctctgatgccacagctcctactcaggaaaagatctttgctgtcttatgcatgcgctgccagtccatcttaaatatggctatgtttagatgtaaaaaagacatagccatcaagtactctaggacgctcaataagcattttgagtcatcctccaaggtggctcaggctccctccccctgtatcgcacgatccactggtacccccagtccgctgtcacctatgcccagcccagcgtcatccgtgggcagccagtccagtgcgggaagtgttgggtcatctggtgtggctgcaaccatcagtacaccggtgacaatacagaatatgacctcatcctatgtgactataacaagccacgtgttgacggcattcgacttgtgggagcaggcggaagcgctgacccggaagaacaaagagttctttgcacggttgtctaccaatgtctgcacgttggcccttaatagctcattggtcgatctggttcattatacaaggcagggctttcagcagttacaggaactgacaaaaaccccttag

SEQ ID NO: 27261 - DNA, 1221 bp, Artificial Sequence
  Description of Artificial Sequence: Synthetic coding sequence
atggcgttcacagagagagtgaatagctcaggtaattctctctacaatgatgaccgcaacttgctgcgcattcgggagaaggagcgacggaatcaagaagcccaccaagagaaagaagcatttccggagaaaattccgctgttcggcgagccttacaagacggccaaaggagatgaattgtctagcagaattcagaatatgcttggtaactacgaggaggtaaaagagttcctttcaactaaatctcatactcatcgtctggatgctagcgaaaaccggcttggtaagccaaaataccctctgattccagacaaggggagctcgatcccgtcctcttcctttcacacttccgtgcaccatcaaagtatccatactcctgcatcagggccactctcagtaggcaatatctctcacaatcccaaaatggctcagcctcgcacagaaccaatgccctctctccacgccaagagttgtggccctccggactctcaacatctcacacaggatcgtctgggtcaggaagggttcggcagctcacatcacaagaagggagaccgcagggcagatggagatcactgcgccagcgtcactgactcagctcctgaaagagagctttccccactcatatctctgccgtcaccagtgccgcctctgtccccaatccactcaaaccaacagacactaccgaggacccagggcagtagcaaggtccatggttctagcaataattcaaagggctactgccctgccaaaagtccgaaggatcttgctgttaaagtgcatgacaaggaaacaccgcaggatagcctagtcgcaccagcccagcccccatcccaaacgtttccccctcctagtctcccctcgaaatccgttgctatgcagcagaagcctaccgcctatgtgcgcccaatggatgggcaggatcaggccccttccgagtcacccgagctgaaacctctaccagaggattataggcagcagacattcgaaaaaaccgatctaaaggtccctgccaaggctaagctcacaaaactcaagatgccgtcccaatccgtggaaacctacagcaatgaagtccactgcgttgaagagattttaaaggagatgacgcactcttggcctcctcccctcaccgctattcacacccctagcacggcagagccttccaaatttccctttcccaccaaagattctcagcacgtaagttctgtgactcagtag

SEQ ID NO: 27262 - DNA, 1473 bp, Artificial Sequence
  Description of Artificial Sequence: Synthetic coding sequence
atgcccagccagagcgtcgagcagacatacagcaatgaggttcattgcgtggaagaaatcctcaaggaaatgacacacagctggccgcctccccttaccgccattcacacccccagcactgcagaaccatctaagttcccctttcccacaaaggatagtcaacatgtgtcaagcgtgacacagaaccagaaacaatatgatacatcaagtaagacacactccaactcccaacagggtacctctagtatgctggaggacgatctgcagcttagcgactccgaggatagcgactccgagcagactcctgagaagcctcctcacctccatttgcaggtgttacactccccttttcagaaccagtggcaccaacacattcccgctgttcaatcccaaaaggctcccgtcacgcagacggtgccacagactcagcgagctagagcagtgcaagactccgaagagaacgagcctctggagactcctgcccctgagccagaaccccctacgacaaacaaatggcagttggacaactggctaactaaggttagccagccagcggctccgcctgagggtcctcgaagcaccgagccacccaggaggcaccccgagtcaaaagggagttccgactccgccacatctcaggaacatagtgaatcaaaggatcccccacccaaaagtagtagcaaggcccctagagcgccacccgaagccccacatcccggaaagagatcctgtcaaaaatctcctgctcagcaagaacccccacaacgacagactgttgggacaaaacagcccaaaaagcctgtgaaggcttcagctagagcgggatcgaggacctcattgcagggcgagcgcgagccagggctcctgccctatggcagtcgggaccaaacaagtaaggataaacccaaagttaagacaaaagggcgacctcgggcagcagcttctaatgaacccaaacctgccgtgcctccaagcagcgagaagaagaagcacaagtccagcctgcctgcgccaagcaaggcactgagcggacccgagccagccaaggacaacgtggaggatcgcaccccagagcacttcgccctggtcccactgaccgagtcccaaggacccccacacagtgggagcgggagccgcacgagcggctgcaggcaggcagttgtagttcaggaagactccaggaaggataggctgcccctgcctcttcgtgacaccaagcttctatcaccactgcgggacacccccccacctcagagcctcatggttaagataacattagacctgctctcccgcattccacaacctccgggaaagggctctagacaaaggaaagccgaagataaacagcctcccgcaggcaaaaagcatagctccgagaagaggtcatccgactcttcatcaaaattggcaaagaagcggaaaggtgaagctgaacgcgattgtgataataagaagatccgattggagaaatag

SEQ ID NO: 27263 - DNA, 2550 bp, Artificial Sequence
  Description of Artificial Sequence: Synthetic coding sequence
atgacacattcctggccgcctcccctgacagccatccacacacccagcaccgctgaaccaagtaaatttcctttccccactaaagatagtcagcacgtgtcgtcggtaactcagaaccaaaaacagtacgatacatctagcaagactcacagtaactcacagcaggggactagcagtatgctggaagacgacctgcagctgtcagactccgaagatagtgacagcgagcagacacccgaaaagcccccaagttccagcgctccacctagtgccccacagtcacttccagagcctgtggcctctgcacacagctcctccgccgagagcgagtctacctcagacagtgatagcagctctgactccgaatctgaatcatcctcctcagacagtgaggagaacgagcctttggagacccccgcacccgagccagaacctcccactacaaacaaatggcaattggataattggctgaccaaggtcagccagcccgctgctccgcctgagggaccgcgaagtaccgaaccgccaaggcgccaccctgaatccaagggttcatctgactctgctacctcccaggagcacagcgagagcaaagacccccctcccaagagcagctctaaggcaccaagagcaccccctgaagcaccgcatccaggcaagagaagttgtcagaagtctccagctcagcaggaaccaccacagagacagaccgtggggactaaacaaccaaaaaaaccggtcaaggcctctgcacgcgcagggtctcgcacgagtttacagggcgaacgcgaaccaggcctcctcccctacggatcacgggaccagacaagcaaggacaaacccaaggtgaaaacgaaaggcagaccgagagcggcagcgagcaacgagccaaagcccgcagtaccaccgagctccgagaaaaaaaaacacaagagcagcctacctgctcccagcaaagctttgtctggacccgaaccggcaaaggacaatgtggaggaccgaacacccgaacacttcgcccttgtacctttgactgaatcccagggtccccctcatagcggatcagggtcacggacttcaggctgccggcaggccgtggtggtccaagaggatagcaggaaggaccggctgccacttccactgcgggatacaaagttgctgagtccccttcgcgatactcctcctccccaatctctgatggtcaagatcacattagatttgctgtcccgtattccacaacctcctggaaaaggttccagacagcgtaaagcggaagacaagcagcctccggctggcaaaaagcacagctccgaaaagcgcagctccgattcttctagtaagctggctaagaagagaaagggagaggctgaacgggattgtgataacaaaaaaatccgacttgagaaggaaataaaatcacagtcaagcagctcatcctcatcacataaggaatcttccaagacaaagccttctaggcccagcagtcagagcagcaagaaggaaatgctgccgccaccgccagtttctagttcctctcagaagcctgctaaacccgcactgaagcggtctcgacgtgaggctgacacatgtgggcaggatccccctaaatctgcttccagcaccaaatcaaatcacaaagactctagcattccaaaacaacgacgagtggaaggaaagggttcaagaagctccagtgagcataaaggctcctctggcgacactgctaatcctttccctgttccaagtctccctaatgggaattcaaagccaggaaagccacaggttaagttcgacaagcaacaggccgacttgcacatgagggaagccaaaaaaatgaaacagaaagccgagctgatgactgatagggtgggcaaggctttcaagtacctggaggctgtgttatcttttatcgagtgcggaatcgccactgagtcagagagccagagctccaagtcggcttattcagtgtacagcgagaccgtggatttgatcaagtttatcatgagccttaagagtttttcggacgcaacagctcccacccaggaaaagattttcgctgtgttgtgtatgcgatgtcagagtattttgaatatggcaatgtttcgatgtaagaaagacattgcaataaagtactcgcgcaccctcaacaagcattttgagtcctctagcaaagtcgctcaggccccttccccttgtattgcaagaagtactggaacgccttcccctctgagtccaatgccgagtcctgcctcatctgtcggatcccaatcgtccgccggaagcgtgggtagctctggtgtcgctgccacgatctctactcctgtcacaatacagaatatgacaagctcctatgtcacaatcacatctcatgttctgacagcttttgacctctgggagcaggctgaggccctgacgaggaagaacaaagaattcttcgcacggctgtctactaacgtgtgtactcttgcactcaacagctccctggtggaccttgtgcactacaccagacaggggtttcagcagctgcaggagcttaccaagacaccatag

SEQ ID NO: 27264 - DNA, 2376 bp, Artificial Sequence
  Description of Artificial Sequence: Synthetic coding sequence
atgccagacatgcatttcaaagctcctaagatatctatgccagacgtcgacttacatctgaaaggacctaaggtcaagggtgacgtcgatgtatccgtgccaaagctggagggtgacttaaccgggcctagcgtgggagtggaggtgccagatgtggagttggagtgcccggacgccaagctgaaggggcctaaattcaagatgcccgaaatgcatttcaaaacccccaagattagcatgccggatgtagacttacacctgaagggtccaaaggtgaagggagacatggatgtgagcgtaccaaaagtcgaaggagagatgaaagttccagacgtggacatcaaaggacctaagatggacatcgatgccccagacgttgacgtgcatggaccagactggcatctgaaaatgccaaaaatgaagatgcccaaatttagtatgccgggatttaaggcagaaggaccagaggtagatgttaatttaccaaaggccgacgtcgtggtaagcggacctaaggtcgacgtggaagtgcctgacgtgtcattagagggcccagaaggaaaactcaagggacctaagttgaaaatgcctgagatgcacttcaaggccccaaagatcagtatgcctgatgtcgacctccacctcaagggacccaaagtgaagggagatgttgacgtgtcgctgcccaaactcgagggcgatcttacagggccttccgtggatgttgaggtaccagatgtggagctcgagtgtcctgatgcaaagctgaaagggccaaaatttaagatgccggagatgcacttcaagacccccaaaatctccatgccggatgtgaatctcaatctgaaaggacccaaagttaagggcgacatggatgtctccgtccctaaggtcgaaggagaaatgaaagttcccgatgtggatattcggggtccaaaagtagacatcgacgccccagacgtagacgtgcacggcccagattggcaccttaagatgccaaaaatgaaaatgcctaagttctctatgcctggcttcaagggcgagggccctgaagtggatgtcaatctgccaaaagcagatgtggacgtaagcgggcctaaggtggatgtggaggttcccgacgtctccctggaggggcctgagggtaagctgaagggacctaaattcaaaatgcctgagatgcactttaaaacgcctaagatttctatgccagacgtggatttcaatctaaaaggtcctaaaattaagggcgatgtggatgtcagtgcacccaagttagaaggagaactgaagggcccagagctggacgtgaaaggacctaaactcgacgccgatatgccagaagtggcagtcgaaggtcccaatggtaaatggaagacgcctaaattcaaaatgccagacatgcattttaaagcccctaaaatctctatgcccgatcttgatctccacctcaagtcgccaaaggctaaaggcgaagtcgatgttgatgtgccgaaattggagggcgatctgaagggtccccatgttgatgtttccggtcctgacatcgatatcgaaggccctgagggcaagctgaaaggtcctaagttcaagatgcccgatatgcactttaaagccccaaacatcagcatgcccgacgtagatctcaacctcaaagggccaaagatcaaaggtgatgttgacgtgtccgttcctgaagtggagggcaaacttgaggtcccagatatgaatattcgaggacctaaagttgatgtcaacgcgccagacgtccaggccccagactggcacctcaaaatgccgaagatgaagatgcccaagtttagtatgccgggattcaaggctgagggtcctgaggtggatgtgaaccttcccaaggctgacgtagacattagcgggccaaaggtggacattgaaggacccgacgtgaacatcgaaggacctgaaggtaagttaaaaggcccaaaattaaagatgccagaaatgaatatcaaggcgccaaaaatctctatgcccgactttgacttgcatctcaaaggccctaaggttaagggagacgtggacgtgtcgctaccgaaggtagagggagatctaaaaggtcccgaggtcgacatcaagggcccaaaagttgatatcaacgctccggacgtcggcgtccagggtcccgattggcacctcaagatgcctaaggtgaagatgcctaagttttccatgcctggcttcaaaggtgaaggcccagacggggacgttaagttaccaaaagctgacattgatgtctctggaccaaaagtagacatcgaaggtcccgacgtgaatatcgagggccctgaaggtaagctgaaaggtccgaagtttaagatggctcaacgttggtggtag

SEQ ID NO: 27265 - DNA, 450 bp, Artificial Sequence
  Description of Artificial Sequence: Synthetic coding sequence
atggagaaagaggaaaccactagagagctgttacttcctaattggcaggggtctggcagccatgggctgaccatagcccagcgcgacgacggtgtgttcgttcaggaggtgacccagaattccccggctgccaggaccggcgtcgtcaaagagggggaccagatcgtcggtgccactatttacttcgacaatctccagtctggtgaagtcacacagttgcttaacactatggggcaccacacagttggcttaaagttgcaccgaaagggagatcgatctcccgaacccggacagacgtggactagggaggtcttctcttcttgttcaagtgaggtagtgttaaacacaccgcagccatctgccctagagtgtaaggaccaaaataagcagaaggaagcaagctctcaggctggggctgtctctgtttcgacccccaacgccggactgtag

SEQ ID NO: 27266 - DNA, 17673 bp, Artificial Sequence
  Description of Artificial Sequence: Synthetic coding sequence
atggaaaaggaggagaccaccagagagctacttctgcccaattggcaggggtccggctcccatggtctgacgatcgcccagagggacgacggcgtgttcgtgcaggaagtgacccagaacagcccagctgcccgaacaggagtggtgaaggaaggcgatcagatcgtaggcgctacaatatattttgataacctgcagtccggagaggtgactcagttgctcaatacaatgggccatcatactgtcggcttaaagttgcataggaaaggcgacagaagccccgagccaggccaaacgtggacgcgtgaagtgttctctagctgctctagtgaggtggtgctaagcggtgacgacgaagagtaccagcgcatatatactaccaagattaagcccaggctaaaaagtgaggacggcgtagagggcgacctcggagagactcagagtcgaaccattacagtgactagaagagtgaccgcctataccgtcgatgtcactgggagagaaggcgcaaaggatattgacattagcagccccgagtttaaaattaaaatccctcggcatgagttaaccgagattagtaatgtggatgtggagacccagtccggtaagacagttatccggctgccctccggctctggggctgccagtccaactgggtcagctgttgatattcgcgctggggctatatcagccagtggtccagagttgcaaggagcgggacattcaaagctccaggtgacgatgccagggattaaagtgggcggatctggagtgaatgtgaatgccaagggcctggatctcggcggtcgtggaggtgtccaggtccccgctgtggatatcagttcaagcctgggtggcagagctgttgaggtccagggccctagcttggaaagtggtgaccacggcaagattaagttcccaacgatgaaggtccctaaatttggggtgtctactgggcgtgagggacagacaccgaaagctggactcagagtgagcgccccagaagtctcggtagggcataagggaggaaagcctggcctgactatccaggcccctcagctggaagttagcgttccatctgcgaatattgaaggactagaaggtaagctgaagggcccacagattactggaccctccctcgagggtgacttaggattaaagggcgctaagccccagggacatattggagtggacgcaagcgctccgcagattggagggtccattactggcccatcggtggaagttcaggccccagatatcgatgtacaaggacctggctccaagctgaacgtccctaagatgaaagtgccaaaatttagtgtgagcggggcaaaaggcgaggagactggaattgatgtgaccttacctaccggagaggtgactgtccctggggtgagtggggacgtgagcctgccggagatcgccactgggggtctggagggcaagatgaaaggcactaaggtgaagaccccagagatgatcattcagaagccgaagatatccatgcaagacgttgacctgagtctcggctctcccaagctgaagggggatatcaaagtcagcgctcccggtgtgcagggcgacgtgaaaggccctcaggtggccttaaaaggtagtcgggtagacatcgagacacctaacttagaaggaacactgactggcccaaggctcgggtcgcccagcgggaagacaggtacctgtcgtatatcaatgagtgaggtcgatctgaatgttgcagccccaaaggtaaaaggtggtgtggatgtaacccttccacgggttgaagggaaggtgaaagtccccgaagtggacgtccgcggacctaaagtcgatgtgtcggctcctgatgtggaggctcacgggcctgagtggaatcttaaaatgcctaagatgaaaatgcctacattttctacccctggggctaagggggagggacccgatgttcatatgactctgccgaagggtgacatctccatctctgggccaaaggtcaatgtcgaggccccagacgttaacctcgagggactgggcggtaaactgaagggtcctgatgtgaagctccctgacatgagtgtgaagactcccaagatcagcatgcctgatgtggatctgcacgtgaaaggcactaaagttaaaggggagtacgacgtgactgtgcccaaattggagggcgagctgaaagggccaaaggtggatatcgatgcgcctgatgtggatgtacatggaccggattggcaccttaagatgcctaagatgaaaatgcccaagttctctgtccccggattcaaggctgaggggcctgaggtcgacgttaacctgcccaaagccgatgttgatatctctggcccaaagatcgatgtgaccgcgccagacgtgagcatagaggagccagaaggaaagttgaaaggcccaaagtttaagatgcccgaaatgaacattaaagtcccaaagatatctatgcccgatgtggatctccatcttaaaggaccgaacgtgaagggcgaatatgatgtgaccatgcctaaggtcgagagcgagatcaaggtgcccgacgttgagctcaagtcggctaagatggatatagatgtgccagacgtcgaggttcaggggcctgactggcacttaaagatgcctaaaatgaaaatgcccaagttttcaatgcctgggtttaaggccgaaggccctgaggtcgacgtaaatctgcccaaagctgacgtcgacattagcgggccaaaggttggcgtcgaagtcccagatgtaaatatagagggccctgaaggtaagttgaaagggcctaaatttaaaatgcccgaaatgaacatcaaagcccctaagatttctatgcccgatgtggacctgcatatgaaaggacctaaggttaaaggggagtatgacatgacagttccaaagttggaaggagaccttaagggtccaaaggtcgacgtgtctgctcccgacgttgagatgcagggccctgattggaacctgaaaatgcccaaaattaagatgccaaagttcagcatgcccagtctcaagggcgaggggccagagtttgacgtcaacctctcaaaagctaacgtggatatctcggcgccaaaggtggacacaaatgcccctgacctgtctctagagggtcctgaagggaaactgaaggggccaaaatttaagatgccggagatgcatttcagagctccaaaaatgtccctacccgacgtggatctcgatctgaagggaccgaagatgaagggcaacgtggatatcagtgcaccgaagatagaaggtgagatgcaggtccccgatgtggacatacgaggacctaaggttgacattaaagctcctgacgtggagggccagggcctagattggtctctgaaaatacccaaaatgaagatgcccaaattttctatgccgagtttgaaaggtgagggtcccgaggtcgacgtgaatcttcctaaagccgatgtagttgtgagtggaccgaaggtcgacattgaagctcccgacgtaagcctggaaggacccgaagggaagctgaagggaccaaagtttaaaatgccagaaatgcattttaaaactcccaaaatcagcatgcccgacgttgatctccaccttaaaggacctaaggtcaaaggggacgttgacgtgtctgtacctaaagtcgaaggggaaatgaaggtgcctgacgtggagattaaggggcctaagatggatattgatgctcctgacgttgaggtccaggggcctgactggcacctgaagatgcccaagatgaaaatgccaaaattctctatgccaggcttcaagggcgagggaagggaagtggatgttaacctaccaaaggctgacattgacgtcagtggaccaaaggtggacgtcgaggtacccgacgtgtctcttgaaggacctgagggtaagctgaaaggcccaaagtttaagatgcccgaaatgcactttaaggccccaaaaatctctatgccggacgtggatcttaatctgaaggggcctaaactcaagggtgacgtggacgtgtcgctgccagaagtggagggcgaaatgaaagtgccagacgtcgatatcaagggccctaaggtcgatatctccgctccggatgtcgatgtgcacggtcccgattggcacctgaaaatgccaaaggtgaagatgcctaagttttccatgcctgggttcaagggggaagggccagaggttgacgtcaaactgcccaaagcagatgttgacgtctcgggtcccaagatggacgccgaggtccccgatgtcaatatcgaaggccctgacgccaagctgaaaggcccaaagttcaagatgccggagatgtccatcaagcctcagaagataagcattccagatgtaggcctacatctgaaaggcccaaagatgaagggagactacgacgtaaccgttcctaaagtggagggcgaaattaaggccccagatgtcgatatcaaaggtcctaaggtggatattaacgcccctgacgtagaagtacatggtcctgactggcacctgaaaatgcccaaggtaaaaatgcccaagtttagcatgccagggttcaagggtgaggggccagaggtagatatgaatctaccaaaggctgaccttggggtctcaggaccaaaagtggacattgatgtccccgatgtgaaccttgaagcgcctgagggcaagctgaagggtcccaagtttaagatgccgtctatgaatatacagacccataagatatctatgcccgacgtcggtttaaaccttaaagcgccaaagctgaagacagacgtagatgttagtcttcccaaggtggagggtgacctaaaaggaccggaaattgacgtcaaagcccctaagatggatgtgaacgtgggcgacatcgacattgagggccctgaaggcaagttgaaaggtcctaagtttaaaatgcccgagatgcattttaaagcaccgaagatttccatgccagacgtggatctacacttaaagggcccaaaggtgaaaggcgatatggatgtgagcgtccccaaggtggagggcgaaatgaaggtccctgatgtcgatatcaaaggaccaaaggtggatatagatgcgccagatgttgaagtccacgacccggattggcacttgaagatgcctaagatgaaaatgccgaaatttagcatgccgggtttcaaggcagagggtcctgaagtggacgtgaacttacctaaggcggacattgatgtgagtgggccttctgttgacaccgatgccccagacttagatatcgaggggccagaagggaaactgaagggcagcaagttcaaaatgccaaagcttaacattaaggcgcctaaggtttccatgccagacgtggacttgaatcttaaaggacccaaacttaaaggagaaatcgatgcaagcgtccctgaacttgagggcgatctgaggggtccacaggtcgacgtgaaaggaccttttgtggaagcggaggtccctgacgttgacttagaatgcccagatgcgaagctaaaagggccaaaattcaagatgcccgagatgcacttcaaggcacctaaaatctcaatgcccgatgtggaccttcacctcaagggtccaaaagtcaagggggacgctgatgtgagcgtgcccaaactggagggcgacttgaccggacctagcgttggagtggaggtgccagatgtggaactggagtgcccagatgccaaacttaaggggccaaaattcaaaatgcccgacatgcacttcaaagctccaaaaatttccatgcctgacgtcgacttacatcttaagggccctaaggtcaagggcgacgtggatgtgagcgtgccaaaactcgaaggcgatctaaccggccctagcgtaggcgtggaggtgccagacgttgagctggagtgccctgacgccaaactcaaaggaccaaagtttaagatgcctgaaatgcatttcaagacccccaagatttctatgcccgacgtggaccttcatctgaaaggtcctaaagtcaaaggagatatggacgtgtccgtgcccaaagtggagggcgaaatgaaggttcctgatgtggatattaaaggtccgaagatggatatcgatgcaccagacgtggatgtgcatggtcctgactggcatctgaagatgcccaagatgaaaatgcccaaattctctatgcctggattcaaggcagaaggacctgaggttgatgtaaaccttcccaaagcggatgttgtggtaagcggacccaaggttgatgtggaggttccagacgtctccttggagggacctgagggaaagcttaaaggtcctaaactgaaaatgcctgagatgcactttaaagctcctaaaattagcatgccagacgttgaccttcacttgaaagggcctaaggttaagggcgacgtcgacgtgtcactgccgaagttagagggcgacctgaccgggccttccgttgacgtggaagtacccgacgtggagctcgagtgtcctgacgctaaactcaaaggcccaaagttcaagatgcctgagatgcatttcaaaaccccgaaaatatctatgcctgacgttaatctgaacctgaaaggccctaaggttaaaggggatatggacgtgtcagtacctaaggtggaaggggagatgaaggtacctgatgtggacattcgcggacctaaggtcgacatagatgcccctgacgttgatgtccacggacccgactggcacctgaaaatgccaaagatgaaaatgcctaaattctcaatgcctggttttaaaggcgagggaccagaagtggacgtgaatcttcccaaggcagacgtggatgtctcaggccctaaagtggatgttgaagtgccagatgtttcactggaaggacctgagggcaaactgaaaggacctaaatttaagatgccagagatgcatttcaaaactccaaagatcagtatgcccgacgtggattttaatttgaaagggccaaagatcaagggagacgttgacgtctcagcccctaaactcgagggtgaactgaagggtcctgagctcgacgtaaaggggcctaaacttgacgctgatatgcctgaggtggccgtagaagggcctaatggtaagtggaaaacaccgaaatttaagatgcccgatatgcatttcaaggccccaaaaattagtatgccagatctcgatctgcatctcaaatctcctaaagcaaagggggaagtcgacgtggatgttccaaagttagaaggcgacctgaaggggcctcatgtggatgtgagtgggcctgacatcgacatcgaaggccctgagggaaagctgaaaggccctaagttcaaaatgcctgatatgcatttcaaggccccaaatataagcatgcccgatgtcgatctgaaccttaaggggccaaagatcaaaggtgacgtcgacgtgagcgtgccagaggttgaagggaaactcgaagttcctgacatgaatattagaggtccaaaggtggacgtcaatgccccagatgttcaggcccctgactggcaccttaagatgccgaagatgaaaatgccaaagtttagcatgccgggttttaaagccgaagggcctgaagtggacgtcaacctgcccaaagccgacgttgatattagcgggccaaaggtcgacattgaagggccagatgtaaatattgagggaccagagggtaaactcaagggccctaaactgaagatgcccgagatgaacatcaaagccccaaagataagcatgcctgatttcgatcttcacctgaaggggcctaaggttaagggagatgtggatgtgtcgctgcccaaggtggagggcgacctcaagggacccgaagttgacataaaaggtccaaaggttgatatcaacgccccagacgttggcgtccaagggcctgattggcatctgaagatgccaaaggtcaagatgcccaaattttccatgcccggatttaagggggagggcccagatggagacgtgaagctccctaaggcagacatcgatgtgtcgggtcctaaggtggacatcgaaggtccagacgtcaatatcgagggaccggagggaaagctcaaagggccaaaattcaaaatgccagagatgaatatcaaggcacccaaaataagcatgcctgacatagacctcaacttgaaagggccaaaggtcaagggcgatgtggatgtgtcgctgcctaaagtggaaggcgaccttaaaggccctgaggtagacatcaagggcccaaaagtggacatcgacgctcctgacgtggacgtgcatgggccagactggcatttgaagatgccaaaaataaaaatgcccaagatctctatgcctggcttcaaaggcgaagggcctgacgtggatgttaatttaccaaaagccgacattgacgtctctggacctaaagtggacgtggaatgtccagatgtgaatattgaggggccagagggaaagtggaagagtcccaaatttaaaatgccagaaatgcactttaagactccgaaaatctcgatgccagacatcgatctcaacttgactggtcccaagattaaaggcgacgtggacgttacaggacctaaggtggagggggacctgaaaggacctgaagtggaccttaagggccctaaagtcgacatcgatgtgccagacgtgaatgtccaaggcccagactggcacttgaagatgcctaagatgaagatgccaaagttttcaatgccaggcttcaaggctgaaggccctgaggtagatgtaaatctgcccaaagccgatgtggacgtctccgggccaaaagtggatgttgaaggaccagatgtcaacatcgaaggccctgagggcaaactaaaagggcctaaattcaagatgcccgagatgaatatcaaggccccaaagattcccatgccagatttcgaccttcatcttaaggggcctaaggtaaagggggacgtggatattagtctccctaaggtggagggcgatctgaagggccctgaggtggacattcggggaccccaagtggatatagacgtacccgatgtgggggttcagggtccagactggcatctgaagatgcccaaggtgaaaatgccaaagtttagtatgcctgggttcaagggagaaggtcccgacgttgatgtcaatctgcccaaggcagacctggacgtttcaggaccgaaggtggatatcgatgttcctgatgtgaatatcgaaggtccggaaggaaagttgaagggtcctaagttcaagatgcccgagatgaacataaaggccccaaagattagcatgcccgacattgacttaaatctgaaaggcccaaaggtgaaaggcgacatggacgtgagcctgccaaaggtggagggagacatgaaggtcccagacgtcgacattaaaggccctaaagtcgacatcaatgcgcctgacgttgatgtacagggccctgattggcatctgaagatgcccaaaatcaaaatgcctaagatcagcatgccaggctttaagggagagggaccagaagtggatgtgaacctgccaaaagcagacttggacgtcagcggcccaaaggtagacgtggatgttcctgatgtgaacatcgagggtccggatgcaaaactgaaggggccaaagttcaaaatgccggaaatgaatattaaggccccaaagatcagcatgccagatctagatctgaaccttaaggggccaaaaatgaagggagaagtcgatgtgagcttggctaatgttgaaggagatctgaagggccctgcattggacattaaggggcctaaaatagatgtagatgcccctgatattgacattcacggaccagatgccaagttgaaaggcccaaagctgaaaatgccagacatgcacgtgaacatgcctaaaatttctatgcccgagatcgacttgaacctaaaggggagcaaactcaaaggagacgtcgatgtgagcggccctaaactcgaaggagacataaaggcgccttcactggatatcaagggtccagaggtcgacgtgtcaggacctaaattaaacatcgaagggaagagtaagaaatcaagattcaagttaccaaagtttaatttctcagggtctaaagtacagacgccagaggttgacgttaaaggcaagaagcctgacatcgacatcacagggcctaaagttgatatcaacgcaccagatgtggaagtgcagggtaaggtaaaagggagtaaatttaaaatgcctttcctatcaattagcagtccgaaagtttctatgcccgatgtcgagctgaacctaaagagcccgaaggtgaagggcgatctggacattgcaggtcccaatttggagggggactttaagggcccaaaagtagatattaaggctccagaggtcaatctgaacgcaccagacgtagacgtccatggaccggactggaaccttaagatgcccaaaatgaaaatgccaaaattctccgtgagtggactgaaggcggagggccctgatgtggctgttgacctgcctaaaggggatataaatatagagggtccctccatgaatattgagggacccgatctgaatgtagaaggacccgaagggggtctgaaaggacctaagtttaagatgcccgacatgaacatcaaggcccctaagatctctatgcctgatatcgacttgaacctaaaaggacccaaggtgaagggcgacgtggacatctcactcccaaaattagaaggcgacttgaagggcccagaagtcgacatcaaggggccaaaagtcgacatcaacgctcctgacgtggatgtacacggtcccgactggcacctgaaaatgcctaaggtgaaaatgcccaagttcagtatgccgggatttaaaggcgaggggccagaagttgacgtcactcttcctaaggccgacatcgacatctccggccctaatgtcgatgtagacgtgccagacgtgaacatcgaggggcctgacgccaagcttaagggacctaagttcaaaatgcccgaaatgaacatcaaggctccaaaaatttccatgcccgatttcgacctgaatctgaaggggccaaaaatgaaaggtgacgtcgtggtctccttgccaaaggtcgaaggtgaccttaaagggcctgaggtagatattaagggaccaaaggtggatatcgatacacctgatattaatatcgagggaagtgagggcaagttcaagggcccaaagtttaaaattcctgagatgcacctgaaggcccctaaaatctctatgcccgatatagatctgaacctgaaggggccaaaggtaaaaggcgatgtcgacgtaagtcttcctaagatggaaggagacctgaaaggcccagaggtcgacattaagggcccaaaggtggacattaatgcaccagatgtggacgtccaggggcctgattggcaccttaaaatgccaaaggtgaagatgcctaaatttagcatgcccggattcaagggagagggcccagacgttgatgtgaaccttccaaaagccgacctggatgtttccggcccaaaggtcgacatagatgtccccgacgtcaatattgagggacctgaaggaaaactgaaggggccaaagtttaagatgcccgaaatgaatatcaaagccccaaaaatctccatgccagacatagacctcaaccttaaagggccaaaggttaagggggatatggacgtgtcccttcctaaggtggagggggacatgcaggtacccgacctcgatattaaaggtcctaaagtggatatcaatgcccctgatgtggatgtgcggggacctgattggcacctgaaaatgcccaagatcaagatgcccaagatctccatgcccggattcaaaggtgagggtcccgaggtcgacgtaaacctccctaaggcagatctcgatgtgtccggcccaaaagtggacgtggacgtcccggacgtcaacatcgagggcccagatgcaaagctgaaaggaccaaagtttaaaatgcctgaaatgaacatcaaagcgcctaaaattagcatgcctgatttcgatctacacttgaaaggacccaaggttaagggcgacgtggacgtgagcctgcccaagatggagggggatctcaaagcacccgaagtagacatcaaaggccctaaagtggacattgatgctcctgacgtcgatgtacacggaccagattggcatctcaagatgcccaaggttaaaatgccaaagttttcgatgcccggatttaaaggcgaaggtccagaagtggacgtgaatttgccgaaggccgatatcgacgtgagtgggcctaaagtcgacattgatactccagacatcgacatacatgggccagaagggaaacttaaaggtcccaaatttaaaatgcccgacctgcatttgaaggcccctaaaatcagcatgcctgaagtggacctgaacctgaagggcccaaaaatgaagggagatgtggatgtgagcttgcccaaggtggagggagacttgaaggggcctgaagtagatattaagggacctaaagtggatatcgatgtgccagacgtggacgtgcagggcccagactggcacttgaagatgcccaaagtgaagatgcctaagttcagtatgcccggttttaagggagagggtcccgatgtagacgttaacctgcctaaggccgatctcgacgtgagcgggcctaaggtggacatcgatgtgcctgacgtgaacatcgaaggacccgacgcaaaactgaaagggcctaagtttaagatgcccgaaatgaatatcaaggcaccaaaaatctcgatgccagattttgacttacacctgaagggccctaaagtcaaaggcgacgtggatgtgtcacttcccaaggtggagggtgacctgaagggtcccgaggtagatatcaagggcccaaaggtggatattgatgcgcctgatgtggatgtccacggcccagattggcacctgaagatgcccaaggttaagatgcccaagttttcgatgcccggatttaagggggaggggcctgatgtcgatgtgactcttccgaaagccgacatcgagatctcaggtcctaaggtagatattgacgctcccgacgtgtctattgagggtccagatgccaaacttaaaggcccaaaatttaaaatgcccgagatgaatattaaggcaccaaaaattagcatgcccgacattgacttcaaccttaagggacccaaggtgaaaggtgatgtcgacgtttcattacctaaggtcgagggtgatctgaaggggccagagatcgacatcaagggcccttccctagacatcgacactccggacgtgaatatcgagggcccagaagggaaactcaaaggtcctaagttcaaaatgcccgagatgaacattaaagctcccaaaatatccatgcccgatttcgatctgcacctgaaaggccctaaggtgaaaggcgatgtggacgtctctctcccgaaggtggaatctgacctgaagggacccgaggtcgacatcgagggaccagaggggaaattaaagggaccaaagttcaaaatgcccgacgttcactttaagtccccgcaaataagtatgtctgacatcgatctgaacttaaagggcccaaaaataaaaggggacatggatatctctgtacctaaacttgagggtgatcttaaggggccaaaagtagatgtgaaggggccaaaagtcggcatagatacgccggacatagatattcacgggccagaaggcaagcttaagggccctaagttcaagatgccggacctgcatctgaaagccccaaaaatcagtatgcccgaggtggaccttaatctgaagggccctaaagtcaagggggacatggacatcagcctgcctaaggtcgaaggggacttaaagggtcccgaagttgacatcagagaccctaaagtggatatcgacgtgcctgacgtggatgtccagggacccgattggcatcttaaaatgccaaaggttaagatgccaaagttctcaatgcccggtttcaaaggagaagggcctgatgtcgacgtcaacctgcccaaggccgatatcgacgtaagcggaccaaaggtggacgtggacgtgccagatgtaaacatagagggcccagacgccaaattgaagggccctaagttcaaaatgccagagatgagcattaaggcacctaaaatatctatgccggatattgatctaaacctgaagggtcctaaggttaaaggcgatgtggatgtaacactgcctaaagtggaaggggacctgaaaggaccagaggccgacatcaaaggaccaaaggttgacattaatacacctgacgtggatgtgcatgggcctgattggcatctcaaaatgcccaaagtgaagatgccaaaattcagcatgccaggatttaagggcgagggaccagatgtcgacgtctccctcccaaaggctgatatcgatgtatcaggtcccaaggtagacgttgatatcccagatgtgaatattgaaggcccagacgccaagctgaaagggcctaaattcaagatgcctgaaattaatataaaggctccaaaaattagcattcctgatgtagatctggacctcaagggtccgaaggtcaaaggcgattttgacgtcagcgttccaaaggtagaaggaacccttaaggggccagaagtggacctgaagggacctcgacttgacttcgagggacctgacgctaagttaagcggtccatcgctcaaaatgccgtccctagagatctcagctccgaaggtcactgcccctgatgtcgacctgcacctgaaggctcccaagattggtttctctggccctaaactcgagggaggcgaagtcgacctgaagggaccaaaagtggaagccccaagtctcgacgtccatatggacagtcccgatatcaatattgaagggcctgacgtcaagatccctaaattcaagaaacccaagttcggcttcggggcaaaaagcccaaaggccgatatcaagtctccgtctctggatgtgacagttcccgaggccgagctcaacctggagacgcccgagatctctgtgggaggaaaggggaaaaagagtaagtttaagatgccaaaaatacacatgagcggtcctaagatcaaggccaaaaaacagggctttgacctcaatgtcccaggaggggaaatcgacgccagcctaaaagccccagacgtcgacgttaacattgcgggaccggacgctgccctgaaggtggacgtgaagagtcccaagactaagaaaacaatgttcgggaaaatgtacttcccagacgttgaattcgatatcaaatcccccaaattcaaagccgaggcgcctctgccaagtcctaaactggagggcgagttacaggctccagaccttgagttatcactgcccgctatacacgtggagggactcgacattaaagcaaaggctccaaaggtgaaaatgcccgacgtcgatatctcagtccccaaaattgagggggatctcaagggccctaaagtacaagccaacctgggggcaccagatattaacatcgagggactcgacgctaaagtgaaaacgccttcttttgggataagtgctccccaggtaagtatacccgacgtaaacgtgaaccttaagggaccaaagatcaaaggggacgtccccagtgtaggcctcgaaggtccagacgtcgacttacagggtccagaagctaaaataaaattccctaagttttctatgcctaagatcgggatcccgggagtgaaaatggaaggcggaggagctgaggttcacgcacagctgccttctttggaaggagatttgaggggccctgacgtgaagctcgaaggccctgatgtcagcctcaaaggccctggcgtagatctgccctccgtgaatttgtcaatgccaaaagtgtctggcccagacctggacctgaatctgaagggtccatctctgaaaggggatttggacgccagtgtcccatcaatgaaggtgcatgctcccggactgaacctttctggtgttgggggaaaaatgcaagtgggcggtgatggcgtaaaggttccaggaatcgacgcaacaaccaaacttaacgtgggtgcaccagacgtgacactgaggggtccctccctccagggagatctcgcagtgtctggcgatattaaatgccctaaagtttccgttggggcacccgacctctcactggaggcttcagaggggtcaatcaagcttccaaagatgaaactcccacagtttggtatttctaccccgggaagtgatctgcacgtgaatgccaaggggcctcaggtgtcaggcgaactcaagggacctggggtggacgtgaacctaaagggccctcgaatttcagcccctaatgtggatttcaatttagagggacctaaggtgaaaggaagcctcggggctacaggtgagataaagggccctacggtcgggggtggattgcccggtatcggagtccagggcctcgaaggcaatttgcaaatgcctggaatcaagagctcaggctgtgacgtgaatctgccaggagttaatgtcaaactgccgacggggcagattagcggacctgaaatcaagggagggttgaaaggatccgaggtgggttttcacggagccgcacctgacatctcagtcaagggcccagcctttaacatggcttctccggaatccgacttcggaattaacttgaagggacctaagatcaagggcggtgctgatgtctctgggggtgtgagtgcccctgatatctcactgggtgaaggccatttgagcgtgaaaggctctggtggagagtggaagggcccacaggtgtccagtgctctgaacctcgacacttcaaaatttgctggtggtctccacttctcaggcccaaaagtggagggaggcgtcaagggagggcaaattggacttcaagcccctgggctttctgtgagcggtccccaaggtcacctggagtcaggaagcggcaaggtcactttcccaaagatgaagataccgaaattcacattttcaggacgcgaactcgtgggcagggagatgggggtcgacgtgcacttcccaaaggcagaggcctcaattcaagctggcgctggagacggtgagtgggaggagagcgaggtaaaattaaagaagtctaaaataaagatgcctaaattcaacttcagtaagcccaagggcaagggtggagtcaccgggagtccagaggctagcatcagtgggagcaagggggacctcaaatcctctaaagcttccttgggaagtctggaaggtgaggcagaagctgaagcctcgtcaccaaaagggaagttcagcctgttcaaatccaagaagccgagacaccgcagtaacagcttctctgacgagcgtgaattttcaggacccagcactcctacagggaccctggaatttgaaggcggagaggtttctctcgagggcggtaaagttaaagggaagcatggaaagctcaaatttggaacattcgggggactggggagtaagtcaaaaggccattatgaagttacggggagtgacgacgagacaggcaagctccaaggaagcggcgtctcactggcttccaaaaagtcaagactgtccagtagctctagcaatgatagcggcaacaaagtcggaattcaactcccagaggtcgaactatctgtatcaactaagaaggagtag

SEQ ID NO: 27267 - DNA, 372 bp, Artificial Sequence
  Description of Artificial Sequence: Synthetic coding sequence
atggagaaggaggagactactagggaactgttgttaccaaattggcaagggagtgggagtcatggattgactattgcccagagggacgatggagtattcgtacaggaggtgactcagaacagtcccgctgcccgtacaggagtagtgaaggaaggcgaccaaattgttggggctacaatatattttgataacttgcagagtggagaggtcacacaactgcttaacaccatgggtcaccataccgttggcctgaaattgcaccgcaaaggagatcgctcccctgagccaggtcagacttggactcgagaggtcttcagcagctgctcatctgaggtggtgctgtcgggggacgatgaggaatatcagcggtag

SEQ ID NO: 27268 - DNA, 435 bp, Artificial Sequence
  Description of Artificial Sequence: Synthetic coding sequence
atggaaaaggaagagacaaccagagagctgctgttgccaaattggcagggatcaggcagtcatgggttaactatagcacagagagatgacggtgtctttgtccaagaggtgacccagaatagcccggcagcacgcactggagttgtcaaggaaggcgaccagatagttggtgctaccatctacttcgataacctgcagtccggcgaggtcacgcagctgctgaataccatgggtcatcacactgtgggcctcaaactgcaccggaaaggggaccggagcccagaaccaggccagacatggacccgggaggtattttctagttgcagttctgaagtagtcttatcaggagatgatgaggagtatcagcgtatttatactacgaagatcaagccacggttgaagtcagaggatggggtggaaggggatttgggatag

SEQ ID NO: 27269 - DNA, 261 bp, Artificial Sequence
  Description of Artificial Sequence: Synthetic coding sequence
atggagaaagaggaaaccacgagggagcttttactccccaattggcaaggctctgggagccacggattaactatcgctcagcgtgacgacggggtttttgttcaggaagtgacccagaactccccagctgccaggactggggtggtgaaagaaggagaccagatagtcggggctacaatttattttgataacctccagtccggcgaagtgacccagctgctcaacacgatgggacatcacactgttgggctgaagctgtag

SEQ ID NO: 27270 - DNA, 366 bp, Artificial Sequence
  Description of Artificial Sequence: Synthetic coding sequence
atggagaaggaagagacgactcgggagttgctgctccccaactggcaggggagcgggtcacacggcctaacaattgcccagagagatgatggtgtgtttgttcaggaagtgacacagaactctcctgccgctaggactggcgtcgtgaaagaaggagatcaaatagtgggggctacgatttatttcgacaacctgcaaagcggagaagtgacacagctactaaacaccatgggacaccataccgtcgggctgaagctgcaccggaaaggcgacaggagtccagagcctggacagacttggacgagggaggtattctccagttgtagttcagaagtggtcctcaatactcctcagccgtccgcctag

SEQ ID NO: 27271 - DNA, 2904 bp, Artificial Sequence
  Description of Artificial Sequence: Synthetic coding sequence
atggctaaagggttttacatctccaagagcttggggatcctggggattttactcggcgtggccgctgtgtgcaccattattgccttatccgtagtgtactcccaggaaaagaataagaacgcgaacagcagtcccgtggcatcgaccacgcccagcgcttcagcaactactaaccccgcttcagctacaaccttggaccaaagcaaagcttggaacaggtacagattgccaaacaccctcaaaccagattcctacagagttactcttaggccatacctgacaccgaatgatagggggttgtatgtgtttaaaggctcatcaactgtgcgcttcacgtgcaaggaggcaacagacgtaattattatacacagtaagaagttgaattacactctgagccaaggtcacagggttgtacttcggggagttggaggttctcagccccctgatatcgacaagacagaacttgtcgagcccacagaatatctggtggtccacctcaaggggtcactcgtgaaggactcacagtacgaaatggatagcgagtttgaaggcgagttggccgatgacctggctggattctacagaagcgaatacatggagggcaacgtgagaaaggtcgtcgctaccacacagatgcaggcggctgacgcgaggaaaagtttcccttgcttcgatgagccggcaatgaaagccgaattcaacatcacactcatccatcccaaggaccttactgctttgtctaatatgctccccaaggggccttcgacaccactacccgaggaccccaactggaatgtgactgaatttcatactacacccaagatgtctacatacttattggcgttcattgtgtctgaattcgattatgttgaaaagcaagcgtcaaacggtgtattgattagaatctgggcgcgtccctccgccattgccgctggtcacggagattacgctctcaacgtgacaggcccaatcttaaacttcttcgctggccactacgacacaccttatcctctgcccaagtcggaccagattggtctgccggattttaacgcgggtgcaatggagaattgggggctagtcacctaccgggaaaatagcctgctgttcgatcctctgagcagtagctccagtaacaaagaacgtgtggtgactgtgatagctcacgagttggcacaccagtggtttggaaacctggttactatcgagtggtggaatgatctttggctgaacgagggatttgcttcttatgtggagtatctcggtgccgattacgccgagcctacatggaacctgaaggacctaatggtgctgaacgacgtgtatcgggtgatggcagtagacgcactggccagttcccacccgctgtcaacaccggcttctgaaatcaacacaccagctcagatcagtgagctatttgatgccatttcgtattctaagggagcaagtgtgttgaggatgctcagtagttttctgtctgaggacgtgtttaagcaaggccttgcttcctacctccatacttttgcttaccagaacactatctacctcaatctctgggatcacctacaggaggccgttaacaatagatcaatacaactaccgaccaccgttagggatatcatgaataggtggacattacaaatggggttccctgtcattaccgtcgacacaagcacgggtaccttgtctcaggaacactttctcttggacccagattccaatgtgaccagacccagcgagttcaactatgtctggatcgttcctattacctctatcagagacggaagacagcagcaagattactggctgatagacgtgagggcacagaatgatctcttctccacttcggggaatgagtgggtgctgctcaacctgaacgtgaccggctactaccgagtgaactatgatgaggagaattggagaaagattcagacacagctgcaacgcgatcactccgcaatccctgttatcaatagagctcagataatcaatgatgccttcaatctggcatctgcacacaaggtgcccgtaacattagccctgaataatactctgttcctgatagaggagcggcagtatatgccctgggaagccgcactctcgtccctcagttatttcaaactgatgttcgacaggtccgaagtgtatggcccaatgaaaaactatctgaagaagcaggtcaccccgctgtttatccactttcgaaacaatacaaacaattggcgcgagattccagagaatctgatggaccaatactctgaggttaatgcaatcagtactgcttgcagcaatggcgtccctgagtgtgaagaaatggtctctggcctgttcaagcaatggatggaaaaccccaataataatccaatccaccccaacctgagatcgactgtctactgcaacgctattgcacaaggcggagaagaagagtgggactttgcatgggaacagttcaggaacgcaactctagtgaatgaggctgacaaactgagagcggcactggcctgcagcaaagaactgtggattctcaaccgatacctgtcgtacaccctcaacccagatctcatccgcaaacaggacgctacttccactattatttcaattacaaataacgtgatcggccaagggctggtgtgggatttcgtgcagagtaattggaagaaattgtttaatgattatggtgggggtagtttttccttttccaacctgatccaggcagtgacacgtaggttctccactgagtatgaactgcaacaactagaacagtttaagaaagacaatgaggagactggctttggctctggcacccgcgcactggaacaggccttggagaagactaaggcgaacatcaaatgggtgaaagagaataaggaagtggtgcttcagtggtttactgaaaactcaaagtag

SEQ ID NO: 27272 - DNA, 312 bp, Artificial Sequence
  Description of Artificial Sequence: Synthetic coding sequence
atggccaagggattctatatctccaaaagcctgggaattctgggaatactgctgggagtcgcggcagtatgtaccatcatcgctcttagtgttgtttattctcaggaaaagaacaaaaacgcgaacagtagccctgtggcatctaccaccccttcggcttctgccactacgaatcctgcatcggccacaaccttagatcagtccaaggcatggaatcgctatcggctgcctaatacgctgaagcctgattcatatagagtgaccctccgaccttatctgacaccaaacgatcggggactctacgtgttctag

SEQ ID NO: 27273 - DNA, 186 bp, Artificial Sequence
  Description of Artificial Sequence: Synthetic coding sequence
atggctaaggggttctacataagcaagagcctggggatcctgggcattttactcggggtggccgctgtctgtaccattattgcattgtcagttgtctactcccaggagaagaataaaaacgcaaactcctcccctgtcgcatcaactacaccgtccgcgtctgcgacaaccaaccccgcaagctag

SEQ ID NO: 27274 - DNA, 381 bp, Artificial Sequence
  Description of Artificial Sequence: Synthetic coding sequence
atgaaccagaacacagataagatctcaggcagcggatccaattctgatatgatggagaatagtaaagaggagggcaccagttcttccgaaaagtccaaatcctctggctcctccagatcgaaacgcaagccctctattgtgacaaagtacgtggagagtgacgacgagaaacccctcgacgacgaaacagttaacgaagacgctagcaatgaaaattcagaaaacgatataacaatgcagtcccttcccaaggggaccgtgatcgtgcagcctgagccagtgcttaatgaggataaagatgactttaagggcccagagttccgctccagatccaagatgaaaacggagaatctaaagaagcgtggcggaaaatacaagtag

SEQ ID NO: 27275 - DNA, 7478 bp, Artificial Sequence
  Description of Artificial Sequence: Synthetic coding sequence
atgacagccgagccgatgtctgaaagcaaacttaacaccctggtccaaaagctccatgattttctggcccacagctccgaggaatctgaggagacatcctctccccctcgccttgcgatgaatcagaacacagacaagatcagcggcagcggcagtaactccgacatgatggaaaacagtaaagaagagggcacgtcaagttccgaaaagtctaagtcctccggatcttcccgttctaaacggaagccctctatagtgaccaagtacgtcgaaagtgatgacgagaaacctttggatgacgagacggtcaatgaggacgccagcaacgaaaacagcgagaatgacattacaatgcagagcctgcctaaagggactgtgatagtgcaacccgagccggtcctaaacgaagacaaagacgatttcaagggcccagaattccggtctagatcaaagatgaagacagagaatctgaagaaacgcggtgaggatggcctgcacgggatcgttagttgtaccgcctgcggccagcaggttaaccacttccaaaaggattccatataccgacaccctagcctgcaagtgcttatctgtaaaaactgttttaaatattatatgagcgatgatatctctcgcgactctgacggcatggacgagcagtgccgctggtgtgcagagggcggaaatctgatctgctgcgacttctgccacaacgctttctgcaaaaaatgtatccttcgaaatttgggcagaaaggaattgagtactatcatggacgagaataaccagtggtactgctatatatgccatcccgaacctttgctagacctcgtgaccgcatgtaacagcgtgttcgaaaaccttgagcagctgctgcagcagaataaaaagaaaattaaagtggattccgaaaagtccaataaggtgtatgagcacacctctaggtttagcccaaagaagaccagcagcaactgtaatggggaagagaaaaaactggacgacagttgttctggttccgtgacgtactcatactccgcactgattgtgcccaaggagatgattaagaaggctaaaaaactgatcgagaccacggctaatatgaacagcagttacgttaagtttctgaaacaggccacggataattccgaaatcagttccgctactaagcttaggcaactgaaggctttcaagagcgtcttagcagacatcaagaaggcccacttggccctcgaggaggatctgaatagcgagttcagggcgatggatgctgtgaacaaagagaagaacaccaaggagcacaaggtgattgatgccaagtttgaaaccaaggctagaaagggggaaaaaccttgcgcattggagaaaaaggatatcagtaaatccgaagccaaactgtctaggaagcaggttgacagtgagcacatgcaccagaatgtcccaacagaagagcaaaggactaacaagtccaccggtggggaacacaagaaaagcgacaggaaggaggagccccaatacgaaccggctaatacaagcgaggacctcgacatggatattgtgagcgtgccctcgagcgtgccagaggacatttttgagaatctggaaaccgctatggaggtgcagagcagtgtggaccatcagggggacggctcatctggcaccgagcaggaggtggaatcctcatcggtgaaactcaacatatccagcaaagataacaggggcggaattaaatcaaagaccacggctaaggttaccaaggaactctatgtgaaacttactcccgtcagtttgtctaattctccaatcaagggtgcagattgtcaggaagtcccccaggataaggacggatataagagttgcggtctgaaccccaagctggaaaaatgcggactgggtcaggagaattcagacaatgagcacctggtggagaatgaagtctcacttctcttggaggagagcgatctccgcagatccccaagagtgaaaaccacaccactgcgaaggccgacagagaccaacccggttaccagtaatagtgacgaagagtgtaatgagactgtgaaagaaaagcagaagctctcagtgcctgttcgaaaaaaagacaaacgcaactctagtgattccgctatagacaacccaaagccgaacaagttaccaaagtccaaacagagtgagactgtggaccagaatagcgactctgacgaaatgcttgctatactcaaggaagttagtcgaatgtctcatagcagctcttcagacaccgacattaatgaaattcataccaatcacaagaccctgtatgatttgaaaacacaggctggtaaagacgataagggcaagagaaagcgaaagagctccactagtggaagcgacttcgacaccaagaagggtaagtctgccaagagcagtataatatcaaaaaagaaacgtcaaacgcagtccgaatcatccaattatgactctgagctggagaaggagatcaagtcaatgagtaagatcggagccgctaggaccacgaagaagagaataccaaataccaaagattttgatagcagcgaagacgagaagcactcgaagaaggggatggataatcagggacacaaaaatctcaagacatcccaggagggttcgtccgatgacgcggagcgtaagcaggaacgcgagacattttcatctgcggaggggacggttgacaaagacacaactataatggagctccgggatcgcttgcccaaaaaacagcaggccagtgcatcaactgacggagtagataagctgtcaggaaaggagcaaagcttcactagtcttgaagtcagaaaagtggctgaaacaaaggagaaatccaagcacctaaagaccaaaacgtgcaaaaaagtgcaggacggactgagcgacattgcagaaaagttcctcaagaaagaccagtctgatgagactagtgaggatgacaaaaagcagtccaagaaggggactgaagagaaaaagaagcctagtgatttcaaaaagaaggtaatcaaaatggagcagcaatacgaatctagctcagatgggaccgaaaaactacccgagagagaggagatctgtcactttccaaagggaatcaaacagatcaagaacggcaccaccgacggggagaagaagtccaaaaagattagggataaaacatctaagaagaaggatgagctgagcgactatgcagaaaagtccacgggtaaaggggattcttgcgatagtagtgaagataaaaagtctaaaaatggcgcttacgggagggaaaaaaagaggtgcaagctgctgggaaaatcatctagaaagcgccaagactgctcctcttctgacaccgagaaatattctatgaaagaagacggctgtaattccagcgacaaaagacttaaaagaattgaactccgggaaagacgcaacctttcatctaaacggaacactaaagaaatacaatcaggctcctcaagttcggacgccgaggaaagttctgaggacaacaagaaaaagaagcagcggacaagttctaaaaaaaaagccgttatcgtgaaggaaaagaaaagaaacagtttgcggacgtcaaccaaacggaaacaggctgatatcacctcctcatccagctccgatattgaagacgatgaccagaattcgatcggcgaagggagttctgatgagcagaaaatcaagccggtcacagaaaacctggtcctgagttctcataccggtttttgtcagtcgtctggtgacgaggccttgtctaagagtgttccggtcaccgtcgatgatgacgacgatgacaacgatcccgaaaaccggatcgccaaaaagatgctgcttgaagagatcaaagctaatctctcaagtgatgaagatggctcttcagatgatgagccagaggagggaaaaaagcggactggcaagcagaacgaagagaatccgggagacgaggaggcaaaaaatcaggtgaactctgagtcagactctgacagcgaggaaagcaagaaacccagatatcggcatcgcctcctccgccataagctgaccgttagtgacggagagtcaggtgaggagaagaagaccaagcccaaggagcacaaggaggtgaagggtcgcaacaggaggaaagttagtagtgaagactccgaggattcagactttcaggaatccggcgtgagtgaggaagtcagtgaatcggaggatgaacagcgtcctcggactcgttccgctaaaaaggctgagttagaggagaaccagaggtcctataagcaaaaaaagaagagacgacgcattaaggtccaggaggattcttcgagtgaaaataaaagcaattcagaggaggaagaagaagagaaggaagaagaggaagaggaggaggaagaggaggaggaggaggaggaggacgagaatgatgactcaaagagccctgggaaaggacgcaaaaagatcagaaagattttgaaagacgataagctacgcacagaaacacagaatgccctcaaggaagaagaggaacggagaaagaggatagcggagagggaaagggagcgtgagaaactccgagaggtgatagaaatcgaagacgcatcccccacaaagtgtcctattacaaccaaactagtgctcgatgaagatgaagagacaaaagagcctctagtccaggtgcaccggaacatggtcattaagttaaagcctcatcaagtggatggggtccagttcatgtgggactgttgttgcgaatcagtaaagaaaacgaaaaagagcccagggtctggctgcattctcgcccactgtatggggcttggaaagacacttcaggtggttagctttttacacaccgtgctgctgtgcgacaagctggactttagcacagcactggtggtctgtcctctcaatacagctttgaactggatgaatgagttcgagaaatggcaagaggggttgaaggacgacgagaaactagaagtgagtgagctggccaccgtaaaacggccacaggagcgtagctacatgctgcaacgctggcaggaagacggcggtgtcatgatcattggatatgaaatgtatcgcaaccttgctcaggggagaaatgtaaaatcgaggaagctaaaggaaatttttaacaaagctttggtagaccctggaccagactttgttgtgtgcgacgagggccacatcctcaaaaacgaagcctcagctgtgtctaaagctatgaattcaatccgctccaggaggagaataatcctcactgggacacctttgcagaacaatctgatcgaatatcattgcatggttaacttcatcaaagagaatctgttgggatccataaaggagtttagaaatagatttataaatccaatccagaatggccagtgcgctgactccacaatggtcgatgttagggtcatgaagaagagggcacatattctttatgaaatgctagccggatgtgtccagcgcaaagactataccgctttgaccaagtttctgcctcctaagcacgagtacgtgctggctgttcggatgacgagcatccagtgtaagctctaccaatattacctggaccatttgaccggcgtgggaaacaattccgaggggggaagagggaaggccggtgctaagttatttcaggacttccagatgcttagtcgaatctggacgcatccatggtgcctgcagctggattacatctctaaggagaacaagggatacttcgacgaggattccatggacgagttcatagcctcagacagcgatgaaacctcaatgtccctctcatcagatgactataccaaaaagaagaagaagggtaagaagggcaagaaagattccagcagtagcggcagcggatctgataacgacgtagaggttatcaaggtctggaatagtaggagccggggaggcggagaaggcaatgtggatgagaccgggaacaatccatctgtttctcttaaattggaagaatcaaaggccaccagcagctcaaacccatcttcacctgcaccagattggtataaagattttgtgactgacgccgatgccgaggtgctggagcatagtggcaagatggtcttacttttcgaaattctgaggatggccgaggaaatcggggacaaggtactggtgttctcccaaagtctgattagtctggacctgatcgaggactttctggagttggcttcgagggagaaaaccgaggacaaagataaacccctgatctataaaggggaagggaagtggctgagaaatatcgactactatcgtctggatggctctacaacggcacagtcacgcaagaagtgggctgaagagttcaatgatgaaactaatgtacggggacggctgtttattataagcactaaagccggttctctgggtatcaacctggtggctgcgaaccgagtgattatcttcgatgctagttggaatccctcgtacgacatccagagcatcttccgcgtataccggttcgggcagacaaaaccagtctatgtgtatcgcttcctggctcagggcacaatggaggacaagatatacgacagacaagtgaccaagcagagcctgtctttcagagtggtggaccagcagcaggtggaacggcactttacgatgaacgagcttactgaactctatacctttgagccagacttgctggacgatccgaatagtgaaaaaaaaaagaagcgcgatactcctatgcttccaaaagacactatcctcgcggaactgctccagatccacaaggaacacattgtcgggtaccacgaacacgatagtttactagaccataaagaggaggaagagctgactgaggaggaacggaaagctgcttgggcagaatatgaggccgaaaaaaaggggttaacgatgagattcaatattccaacaggaactaacttgccgcctgtctctttcaattctcaaacaccttatatccctttcaatctgggcgctctgtccgcaatgtccaatcagcaactggaagatctgattaaccagggtcgcgagaaggtggttgaggcaacaaatagtgtcactgccgtccgtattcagcctttggaggatatcatttctgccgtctggaaagaaaacatgaacttgagcgaggcccaggttcaagcccttgccctttcccgccaggcctcccaggaactggacgtgaagcgtcgggaggcgatctataatgacgtgctgactaaacaacagatgctgatttcttgcgttcagaggattctgatgaaccggcgattacagcaacagtacaatcaacaacaacagcagcagatgacttatcagcaggccacattgggtcatctgatgatgcccaagcctcctaatctcattatgaaccccagcaattatcagcagatagacatgcggggtatgtaccagccagtggccggtggcatgcagcccccacccctgcagcgggctccacctcccatgaggtccaagaacccaggtccgagccagggaaaaagcatgta

SEQ ID NO: 27276 - DNA, 7364 bp, Artificial Sequence
  Description of Artificial Sequence: Synthetic coding sequence
atgaccgcagagcccatgagcgagtctaagttgaacactcttgtgcaaaagctccacgattttcttgcacactccagtgaggagagcgaagagacatccagtcctccacggctggccatgaaccagaacacggacaagatcagtggcagtgggagtaattccgacatgatggagaatagtaaagaggagggcacatcctccagtgagaaatccaagagctctgggtccagtcgctctaaacgaaagccatctatcgttaccaagtacgtggaaagcgatgacgagaagcctctggatgacgaaacagtgaatgaagacgccagtaacgaaaacagtgagaacgatatcacaatgcagagcctgcctaaagaggacgggctgcatggtattgtaagttgcaccgcatgcgggcaacaggtgaaccactttcagaaggacagcatttaccgtcacccgagccttcaggtgcttatttgcaaaaattgcttcaagtactacatgagcgacgatatttcacgggattccgacgggatggatgaacagtgtcgatggtgcgctgagggcggaaacctcatttgctgtgacttttgccacaatgccttctgcaagaagtgtatcttacgtaacctcggcagaaaagaactttccactattatggatgaaaacaatcagtggtactgctacatttgtcatccagagcctttgctcgacttggtcaccgcttgtaatagtgtgtttgagaacctcgagcagctcctgcagcagaacaagaagaagatcaaggtggactctgagaaatctaataaggtgtacgaacatacgtctcggttctctcccaaaaagacttcctcgaattgtaatggggaagaaaaaaaattggacgatagttgttccggctctgttacttacagctacagtgctctgatagtccctaaggagatgatcaagaaggctaaaaagctgattgaaacaaccgccaacatgaactcatcctacgtcaaattcctcaaacaggccaccgataactcagagatcagttctgctaccaagcttcgacaactcaaggccttcaagtcggtcctggccgatatcaaaaaggcccatctcgcactcgaggaggacctgaactccgagtttcgagctatggatgccgtcaataaagagaagaacaccaaagagcacaaggtgattgacgctaaattcgagacaaaagccaggaaaggggaaaaaccatgtgcccttgagaagaaggatattagcaaatctgaggcgaagctcagtagaaaacaggtggattcagagcatatgcatcagaatgttcctactgaagaacagaggactaataagagcacaggtggcgagcacaaaaagtcagaccgcaaagaggagcctcagtacgagccagctaacacatccgaagacctagacatggacatagtgtctgttcctagttcagttccagaagatatttttgagaatctggaaaccgccatggaagtgcagtcctcagtcgatcaccaaggtgatggttcctctggcacagagcaggaggtcgaaagcagcagcgtgaaactgaacatatccagcaaggataacaggggtggcatcaaatccaaaaccaccgccaaggtcaccaaggagctgtatgtgaagcttacacctgttagtcttagcaattcaccaattaagggtgcagattgccaagaggtacctcaggacaaggatgggtataagagctgtggtctcaacccgaaactggagaaatgtggcctgggccaggagaactccgataacgagcatctcgtcgaaaacgaagtctccttgctgctggaggaatcagacctccggagatcgcccagagtgaagacaacaccactgagacggcctaccgaaacaaaccctgtaacctctaactccgatgaagaatgtaatgaaacggttaaagagaagcagaagctgagtgtgcctgtgcgcaaaaaagataaaaggaacagctccgatagtgcaatcgacaatccgaagcccaataagttgcctaagagcaagcagagcgagaccgtggatcaaaattcagatagtgatgagatgctggccattttgaaggaagtgagcagaatgtctcactctagctcaagtgataccgacattaacgagatacatactaatcacaaaactttatacgatttgaagacccaagcgggaaaagacgataagggtaagcggaaaagaaaaagtagtacatctggctccgactttgatacaaagaagggtaaatctgccaagagcagcatcatatcaaagaaaaagagacagacacagtctgagtcctctaattatgattcagagctggaaaaggagattaagtcaatgtccaagattggagccgctagaactacaaaaaagcggatccctaatactaaggactttgatagttccgaggatgaaaagcattccaagaagggcatggacaatcagggccacaagaatctgaagacctctcaggaaggaagtagcgatgatgcagagcgaaagcaggagagggagacattttcatcagccgaaggcaccgtagacaaagacacgacaatcatggaactgcgcgatagattgccaaaaaagcagcaggcctctgcctctaccgatggggtggacaaactgagcggaaaagagcaatccttcacttccttagaggtgaggaaggtcgctgagactaaggagaagagcaaacacctcaagacaaagacatgtaaaaaagtacaggacggtctgtcagacatcgctgagaaatttttaaaaaaggatcagtctgatgaaacttcagaggacgataagaaacaatccaaaaaggggacagaagagaagaaaaagccatccgattttaaaaaaaaggtcatcaagatggagcaacaatacgagtcttcaagcgatggtactgaaaagctcccggagagagaggagatttgccactttccaaagggaatcaagcagatcaagaacggcactacagatggtgaaaaaaagagcaaaaagatccgcgacaaaacctctaagaagaaggacgaactgtccgattatgccgaaaagagcacaggaaaaggcgactcttgcgactcatccgaggacaagaaaagtaagaacggggcttacggccgagaaaagaagcgatgcaaattgttggggaagtcttctaggaaacgacaagactgctcgtcctctgatacggagaaatattccatgaaagaggatggctgcaattctagcgataaacggcttaagagaatagaattacgggaaaggcgcaacctgagttccaagagaaataccaaggagatccaatcagggtcaagctccagtgacgcagaggagtcttctgaggacaacaaaaagaagaaacagaggacctcttcaaagaaaaaagcagtcatcgtgaaagagaagaagcgaaattcccttagaactagcacaaagcgaaaacaggcagatatcacctcaagttcctcctcagatatcgaagatgacgaccaaaactctattggcgagggctcctctgacgaacagaaaatcaagcccgttaccgagaaccttgtcctgtcctcccataccggcttctgtcagagcagcggcgatgaggctctatccaagagcgtgccggtgacagttgatgacgatgacgatgataacgatcctgagaatcggattgctaagaagatgctgctggaggagataaaggcaaacctgtccagtgacgaggacggctcttcagatgatgagcccgaggaggggaagaagaggacaggaaaacagaacgaagagaaccccggagatgaagaggccaaaaaccaggtaaactctgagagcgacagcgactccgaagaaagtaagaagcccaggtaccggcacagactgctccgccataaacttactgtatccgacggcgaatctggtgaggagaaaaaaacaaaaccaaaggaacacaaagaggtgaaaggtcgtaacaggcgaaaggtgtcgtctgaggactccgaggactctgacttccaggaatctggagtgtctgaagaagtatctgaatcggaggatgagcaacgcccacgaacccgctcagccaagaaggcggaactggaagagaatcaacggtcctacaagcagaaaaaaaaaaggcggagaataaaggtgcaggaggactcgtcgtcagaaaataagagcaattctgaggaagaagaagaggagaaagaggaggaagaggaggaagaggaagaagaggaggaagaggaagaagacgagaacgatgatagcaaatcccctggcaaaggccgaaagaaaatccgcaagatcctgaaagatgataagctcaggaccgagacccagaatgccctcaaggaagaggaagagaggaggaagaggatagcagagagagaacgcgagcgcgagaaactacgagaggtaatcgagattgaggacgccagcccaactaagtgtcccatcaccacaaagctggtgctggatgaggacgaggagacaaaggagcccctggtgcaggttcatcgaaacatggtgattaaactcaagccacaccaggttgacggggtgcaattcatgtgggactgttgttgcgaatccgtcaagaaaaccaaaaagtcaccaggctcaggatgtattcttgcccactgtatgggcctggggaaaaccctccaggtcgtgtcattcttacacaccgtcttgttgtgcgataaactcgatttctctacagcgcttgtcgtttgccccttaaacaccgctcttaactggatgaacgagttcgagaaatggcaggaagggctgaaggacgacgagaaacttgaagtcagtgagctggcgaccgtaaagcgacctcaggagcgctcctatatgctgcagcgatggcaggaggatggcggagtgatgattataggatatgagatgtaccggaatctggcccagggcagaaacgtgaagagcagaaagctgaaagagatctttaataaggctctagtggaccctggacctgatttcgttgtatgcgacgagggtcacatcctgaagaacgaggcgagtgccgtctccaaggctatgaacagcatccgaagcagacgcaggattattctgacagggacccccctgcagaataaccttatcgaataccattgcatggttaacttcattaaagagaatcttctggggtctattaaagagttcaggaacaggtttataaatccaatacagaacggccaatgcgcggactcaaccatggtcgacgttagagtgatgaaaaagagagctcacatactctatgagatgctcgccggatgcgtgcagcgcaaggactataccgcactcacgaaattccttccccctaagcatgagtacgtgcttgcagtcagaatgaccagtattcaatgtaaactgtaccagtactaccttgaccacctcaccggagtgggaaacaattcagagggcggacggggtaaggccggtgctaaactgtttcaggatttccagatgctgtcccgcatctggacacatccatggtgcctgcagctggattatataagtaaggagaacaagggttatttcgatgaagactctatggacgaattcatcgccagcgactccgatgaaacctcaatgtcactttcatcagatgattataccaaaaagaaaaaaaaaggtaagaagggtaaaaaggattcaagttcctctggatctggcagcgataacgacgttgaggtcattaaagtctggaatagccgatcgcgtggaggcggagagggcaatgtcgacgagaccggtaataatccatcagtatcactgaagcttgaagagtcaaaagctacttcctcttcgaacccctcctccccggcacctgactggtataaagacttcgtgaccgacgccgacgctgaggtgctcgagcatagcggtaagatggtcctgctatttgagattctgcgtatggccgaagagattggagacaaggtgctggtgttcagccagtctctcatctcgctcgacttaattgaggatttcttggagctggccagcagggaaaaaacagaggataaggataaaccgctaatttacaaaggcgaaggtaagtggctcagaaatatagattactacaggcttgatggctctactactgctcagtcacgtaagaagtgggcagaggagtttaacgatgagacgaatgtcaggggcagactctttatcatcagtactaaagctggcagtctgggcataaacttggtcgcagccaatagggttattatttttgacgccagctggaaccctagttatgatattcagagtatctttcgggtgtacagattcggccagacaaaacccgtatacgtataccgattcctggctcaggggacaatggaagacaaaatttacgaccgccaggtaacaaaacagtctctaagttttcgtgtggtcgatcagcaacaagtcgagagacatttcactatgaacgaattaacagagctgtacacattcgagccagacctgctcgacgacccaaattctgaaaagaaaaaaaaaagagatacacctatgcttccgaaggataccatcctggccgagctgctgcaaatccacaaggaacatattgtgggatatcatgagcacgactctcttttagatcacaaagaagaggaggagcttacagaagaggagcgtaaagccgcatgggcagaatatgaggctgagaagaaggggctaaccatgaggttcaacatccctactggcaccaacctgccaccagttagtttcaacagtcaaactccatacattccctttaatctgggcgctctgtctgccatgtccaatcaacaactagaggacctgatcaaccagggcagagagaaggtcgtcgaggccacaaactccgtgaccgcagtcaggatccagccccttgaagacattatctccgccgtgtggaaagaaaacatgaacctgtcagaggctcaagtgcaggctctggctttatcccggcaggcctcccaggaactcgacgtgaagcggagggaggctatctacaatgacgtgctaacaaaacagcagatgctcatctcatgtgtgcagaggatcctcatgaacagacgcttgcagcaacaatacaatcagcagcagcagcaacaaatgacctaccagcaggcaactcttggccacttaatgatgcccaaaccccctaacctgatcatgaatccctcaaattatcagcagatcgacatgagagggatgtaccagcccgtggctggagggatgcaacctccacccctacaaagggccccacctcccatgcgctccaagaaccccggaccatcacaggggaaatctatgta

SEQ ID NO: 27277 - DNA, 369 bp, Artificial Sequence
  Description of Artificial Sequence: Synthetic coding sequence
attaactataatagggacaaaatctccggcagcgggtccaactccgacatgatggaaaactcaaaggaggaggggacaagctcctccgaaaaaagcaaatcctccggaagctctaggtcaaagcgtaagccatctattgttactaaatatgtggagagcgacgatgagaagccgctcgacgatgaaacagtgaacgaagatgcatctaacgagaacagtgaaaatgacataacaatgcaaagcctgcccaaaggcactgtgatcgttcagcccgagcctgtgctgaatgaggacaaggatgactttaagggccctgagttccggtctcggagcaaaatgaaaacagagaatctcaaaaaaagaggctag

SEQ ID NO: 27278 - DNA, 4038 bp, Artificial Sequence
  Description of Artificial Sequence: Synthetic coding sequence
atgtccgagtcgaagttaaatactctcgtccaaaagctacatgacttcctggcacattcctcagaggaatccgaggagacgtcatctccaccccgtctggcaatgaatcagaatacagacaagattagtggttctggttctaactccgatatgatggaaaattctaaggaagaagggaccagcagttcagaaaagtcaaaaagttctgggtcttcccgtagtaagcggaagccctccatcgtgacgaagtacgtagaaagtgatgacgagaagccgctggatgacgaaactgttaacgaggatgccagtaacgagaacagcgagaacgacattacgatgcagagtctgccaaaagacggactgcacgggatagtctcatgtacagcctgtggtcagcaggtcaatcacttccagaaagacagcatctatcggcacccctccctacaggtgctaatctgcaagaattgttttaagtattacatgagtgacgacatttcaagagatagtgatggaatggatgagcaatgccgttggtgcgctgaggggggaaatttgatatgttgtgatttttgccataacgctttctgcaagaagtgtattctcaggaatctggggagaaaggaactatcaaccattatggatgaaaacaatcaatggtactgttatatttgccacccggagcccctcttggatctcgtaacggcctgtaattccgtgtttgagaacctcgagcagctcttacagcaaaataagaaaaagatcaaagtagacagcgagaaaagcaacaaagtatatgaacataccagccgtttctccccgaagaagacatcatccaactgcaacggtgaggagaaaaaattagacgattcctgcagtggctccgtgacttattcttacagcgcacttatcgtgcccaaagaaatgataaaaaaggcgaagaaattaattgaaactacagcgaatatgaacagctcatacgtgaaatttttgaagcaggccaccgataactcagagatctcttcggctactaaactgagacagttgaaggcgtttaaatccgtgctggccgatattaagaaggctcacttggccctggaagaggacctgaactcagaattccgagctatggatgccgtgaataaagaaaagaacacgaaagaacacaaggtgatcgatgccaagtttgagaccaaggcaaggaagggcgagaagccgtgcgcccttgaaaaaaaagacatcagcaaatcggaggcaaaactcagcaggaagcaggtggattctgagcatatgcaccagaatgtaccaaccgaagagcagcggactaataagtcaacgggtggcgaacacaagaagtcggataggaaagaggaaccgcagtatgagccggcaaataccagcgaggatctggacatggacatcgtgtcggttcccagctctgtgcccgaggacatattcgagaacctggaaaccgccatggaggtccagtcttccgtggaccaccagggtgatggcagctctgggactgaacaggaggttgagagctcttcggtgaaactgaatatttccagcaaagacaaccggggaggtgcggattgccaggaagtgccccaagacaaagacgggtataagagttgtggactgaacccgaagctcgagaagtgtggcctcgggcaggagaatagcgacaatgaacacttggtggagaacgaagtaagtcttttgcttgaggaaagtgatctccgtcgttcaccacgcgtgaaaacaacccccctgcggaggcccaccgagacgaaccccgttaccagcaactccgatgaggagtgtaatgaaaccgtgaaagagaagcaaaagctttccgtgcctgtgagaaagaaggataagcgcaacagcagtgactcagctattgacaacccgaaaccgaacaaactccccaaatcaaagcagtcagaaacagtggaccagaactctgactccgatgaaatgctcgctattcttaaggaggtgagtagaatgtcccacagcagctcttcggataccgatatcaacgaaatacatacaaatcacaaaactctgtatgacttaaaaactcaggcaggcaaagatgacaagggaaagcgtaaacgtaagtctagtactagcggcagcgacttcgataccaaaaaaggtaagtcagcaaagtcctctatcatttctaaaaagaagcgccagacccagtctgagtcaagcaattatgattccgagttagagaaagagattaaatctatgtctaagataggcgcagcacgcacaacgaaaaagagaatccccaacacaaaggacttcgatagcagtgaggatgagaaacacagtaagaaaggaatggacaaccaggggcacaagaatctaaaaacttcgcaggaaggatcctctgatgatgcggagaggaaacaagagagagagacattttcaagcgctgaggggacagtggataaagacactacaatcatggaactgcgcgacaggctccctaagaaacagcaggcgtctgcgagcaccgacggcgttgacaagcttagcggaaaggaacagtctttcaccagcttagaagttcgcaaggttgccgagaccaaagaaaaatcaaaacatctgaagacaaaaacgtgtaaaaaggtgcaggatggactctcagacattgcggagaaatttctgaagaaggaccaatcagatgagacatccgaagacgacaagaaacaatctaagaaaggcactgaagaaaagaaaaagcccagtgatttcaagaaaaaggtaattaagatggaacaacagtatgaaagttcttccgacggaaccgagaagctgccagagagggaagagatctgtcattttccaaaaggtattaaacagataaaaaacggcaccacagacggagagaagaagtcaaagaagatcagagataagacctccaagaagaaggacgagttgtcggactatgccgagaagtccactgggaaaggagactcttgtgacagctctgaggataagaagagtaaaaacggtgcctatgggcgtgagaagaaacggtgtaagttactaggcaaatcttctcggaaaaggcaggactgctcaagtagcgacactgagaaatattccatgaaggaagacgggtgtaattcatctgacaagcgactcaagcgcattgagctgcgagagaggaggaatttgtctagcaagaggaacacaaaggaaatacaatccggatccagctcatccgacgccgaggagtccagcgaggataataagaagaagaagcaacgcacatcgagtaaaaagaaagccgtgattgtgaaagagaaaaaacgtaattctctgaggactagcactaaacgcaagcaagcagacatcacaagcagttctagctcagatattgaggatgacgaccagaatagcataggtgagggctcaagcgatgagcagaagataaagccagttacagagaatcttgtgctgagttcccacacaggtttctgccaaagtagcggcgacgaggcactcagcaagtctgtgccagttactgtcgatgacgatgacgatgataacgaccccgaaaacagaattgcaaagaagatgcttctggaggaaataaaggcaaacctttcatccgacgaagacggctcatctgatgacgagcccgaagaagggaagaagcgtactggcaagcagaatgaggagaatccaggagacgaagaggcgaagaatcaggtgaatagtgagtctgactctgacagcgaggaaagtaaaaaaccgagatatcgccaccgactgctgcggcataaacttaccgttagtgacggggagtcgggcgaggagaaaaagacgaaacccaaagagcataaagaggttaaggggagaaacagacggaaagtcagttcagaagattcggaagactcagacttccaggagtctggagtgtctgaggaagtgagtgagagcgaggacgagcagcgcccaagaactaggtccgctaaaaaagcagaacttgaggaaaatcagaggtcgtag

SEQ ID NO: 27279 - DNA, 483 bp, Artificial Sequence
  Description of Artificial Sequence: Synthetic coding sequence
tgacccgactttgtagtgtgcgatgaagggcacattttaaaaaatgaggccagtgcagttagcaaggcaatgaactccatccggtcccgcaggcgcattattctgaccggcacacccctgcaaaacaacctgatcgagtaccattgcatggtcaattttatcaaagaaaacttgctgggttccataaaagagtttcgcaaccgatttattaatcctattcagaatggacagtgcgccgacagcactatggtcgatgtgcgtgtaatgaagaaacgggctcacatcctatacgaaatgttggctggttgcgttcagcggaaggactacactgcactgacaaagttcctgccaccgaaacatgagtacgtcttggcagtacggatgacctctatacaatgtaaactttatcagtattatcttgaccatctcactgtgctccacctcaataagatggggatgctgaaatcaattaagtacttttag

SEQ ID NO: 27280 - DNA, 2514 bp, Artificial Sequence
  Description of Artificial Sequence: Synthetic coding sequence
atgaatcacttggagggctccgcagaggtggaagtgacagacgaggcagcaggcggtgaggtgaacgaatccgttgaggccgatctggagcaccctgaagtcgaagaggaacagcagcagcctcctcagcagcagcattatgtgggacgtcaccaacgagggcgtgctctcgaggacctcagagcgcagcttgggcaggaagaggaagaaagaggagaatgtctggctcgttcggctagcactgaaagtggctttcacaatcacaccgacaccgccgagggggacgtgattgccgctgccagagatggttacgacgctgagcgggcacaggaccctgaggacgagagcgcttatgcggtgcagtataggccagaagccgaggaatatactgagcaggccgaggccgagcacgccgaggccactcacagaagggcgctaccaaaccacctgcacttccacagtctggagcacgaagaggcaatgaatgccgcttattctggttacgtgtacactcaccggttgtttcatcggggagaggacgagccctactctgaaccttatgctgactatggaggcctccaggagcacgtctacgaggaaatcggcgacgcccctgagctggacgcacgggacggactgagactgtacgaacaggaacgggacgaagccgctgcctatcgccaggaggctctgggcgctcgcctccatcattacgatgaaagatctgacggagaatctgactcacccgagaaggaagctgagtttgccccataccctaggatggactcttacgagcaggaggaagacatagaccagattgttgccgaagtcaagcagagtatgagttcccagagcctcgacaaggcagcggaggacatgccagaagctgaacaagatttggagcggcctccaacccccgcagggggacggccagacagtcccggactgcaggccccagccggacagcaacgcgctgtgggtccagcgggtggcggtgaggccggtcagagatacagtaaagagaagagagatgctatcagtcttgccataaaagatatcaaggaagcaatcgaggaggttaagactagaacaattaggtctccatatacccccgacgagccaaaggagcccatttgggttatgaggcaagacatttcgcctacacgtgactgcgacgaccagcggccaatggatggcgacagcccttcgccaggaagttcttcaccgctgggagctgaaagctcctccacttccctacatccaagtgaccccgtggaagcttccacgaataaagagtctcgcaaaagccttgcctctttccccacctatgtggaggtgcccggtccatgtgatccagaggatctgatcgacgggattatctttgcagccaactatctgggcagcacccaacttttatccgataagacaccttccaaaaacgttaggatgatgcaggctcaagaagctgtcagtcggataaagatggcacaaaaactggccaagtcccggaaaaaggcacctgagggcgagagccaaccaatgaccgaagtggatctgttcatctccacccagagaatcaaggtgctgaatgcagacactcaggagacgatgatggaccatcccctgaggactatctcctacattgccgatatcggcaatattgtggtgttgatggcacgaagacgaatgccgagatccaattcccaggaaaatgtggaggccagtcacccaagccaggatggcaagcgccagtataaaatgatctgtcacgtgttcgagtcagaggatgctcagcttattgctcagagtataggccaggccttttctgttgcctaccaggagtttttgagggcaaatggcataaacccggaagacctttcccagaaggaatattcagatctcctgaatactcaagacatgtacaacgatgacttgattcacttctctaagtccgagaattgcaaagacgtgttcatcgaaaaacagaaaggagagattcttggggtggtcatcgtggaaagtgggtggggcagtattctgcctaccgtgattatcgctaacatgatgcacggaggacctgcagagaagtctggaaagctgaatatcggtgatcaaatcatgtccatcaatggtacttccctcgtcggccttcccctttctacctgccaaagcatcatcaaagggctgaaaaatcagtcccgggtcaaactgaatattgtgaggtgtccccctgtcactactgtgttgatcagaaggccagatctcaggtatcagctgggattctctgtgcagaacggtattatctgctccttgatgcggggaggcatcgctgagcgcggtggcgtccgagtgggccatagaatcatcgaaattaatggtcagtccgtagtcgctactcctcatgaaaaaatcgttcatatcctgagcaacgccgtgggagagattcacatgaaaaccatgccggctgccatgtacaggctccttaccgctcaagaacagcctgtgtacatctag

SEQ ID NO: 27281 - DNA, 2469 bp, Artificial Sequence
  Description of Artificial Sequence: Synthetic coding sequence
atggcagccgctgtggttgttgccgaaggcgacagcgactcacgaccaggacaagagttgctggtggcgtggaacaccgtttccactggactggttcccccagcagctctggggctggtgagcagccggacttctggcgctgtgccccctaaggaggaggaactgagagcggcagtggaagtgctccgcggtcacggcttgcatagtgtcctcgaggaatggtttgtcgaagtcttacagaatgacctgcaagcaaatattagccccgaattttggaatgcaatatcacagtgtgaaaactcagccgatgaaccacagtgtctattgctgcttctggacgccttcggacttctggaatctcgcctggacccctatctccgcagtctcgagctccttgaaaagtggacccggcttggcttgctcatgggaaccggagcccagggcctgcgcgaggaagtgcacacgatgctccgcggagtgttatttttctccactcctcgtacgtttcaggagatgattcaaaggctatacggttgcttcctgcgagtgtacatgcagtctaaacgcaagggtgagggagggactgaccctgagctcgagggagaactggatagccggtatgcaaggcgtcgctattatcggctgcttcaatcccccttatgtgcaggatgtagcagcgacaagcaacagtgctggtgccgacaggcgctggagcagttccaccagctgagtcaagtgctgcaccgcttatccttactcgaacgggtgtctgccgaagccgtgaccacaactctgcatcaggtgactagagagaggatggaagacaggtgccgaggcgagtacgagcgcagcttcctaagggagtttcacaagtggatagagcgcgttgtcggctggctcggcaaggtcttcctgcaagacgggccagctaggccagcaagccccgaagccggtaacacgcttcgccgatggagatgtcacgttcaacgattcttttatcgcatttacgccagcctgagaattgaggagttgttcagcatcgttagagacttccctgactcccgaccagcgatcgaagatctgaaatactgtctcgaacgtacggatcagcgccagcaattacttgtaagcctcaaggccgcattagaaacgaggctgctgcaccctggcgtgaacacatgcgacataataacattatatatttcagctatcaaggctttgagggtcttggacccctccatggtaatcctggaagtggcgtgtgagcccattagacggtacttgcggactcgagaggacaccgttcggcaaatcgtcgctggacttaccggcgatagtgatggcacgggggatctggcagtggaactctccaagacagacccagcaagcttggagacaggccaggacagcgaagacgactccggcgagcccgaggattgggtgccggaccctgttgatgccgaccctgggaagtcaagttccaaacgcagatcctccgatatcatttccctgctagtcagcatctacggttcgaaggacttattcatcaatgaatatcgtagtctcttggccgacaggttgctgcatcagtttagtttttcccccgaacgtgaaattcggaacgtcgagcttctgaagctcaggttcggagaagctccaatgcacttctgtgaagtgatgcttaaagacatggccgacagcaggcgcatcaacgccaacattcgagaagaggacgagaagcgccctgccgaggagcagcctccctttggtgtgtacgcggtgattctgtctagcgagttttggcccccttttaaggatgagaagttagaggttcctgaggatattagagccgcactcgaagcatactgcaaaaaatacgagcagttaaaagctatgcgaacattatcttggaaacacacactcggcctggtcaccatggacgtcgagttagcagaccgtactctctcggttgctgtcaccccagtccaggcggtgatactgctatattttcaggatcaggcgagctggaccctggaggagctgtccaaagctgtgaaaatgcccgttgctctcctgagacgtagaatgagcgtttggttgcaacagggagtcctgagggaggagccgccagggaccttcagcgttatcgaggaggaacggccacaggacagagacaatatggttcttatcgattccgacgatgagagtgacagtggcatggcctcacaggctgaccaaaaggaagaggagctcctgctcttttggacgtatattcaagctatgttgacaaatctggaaagcctgtcgcttgacagaatctacaatatgttgcgcatgttcgtggtgacaggtccagccctcgccgagattgatctccaggagcttcagggctatctgcagaaaaaggtccgcgaccagcagctggtctactctgctggggtttataggttgccgaagaattgttcatag

SEQ ID NO: 27282 - DNA, 4863 bp, Artificial Sequence
  Description of Artificial Sequence: Synthetic coding sequence
atgggtgctattggtctgctgtggctgctgcctttattattgtccacggcagccgtcggatctggaatgggcacaggacagcgtgccggtagtcccgcagctggcccacctctgcagccacgtgaacctctgagctacagtaggttgcagcgaaaaagtctggccgtcgactttgtcgtaccgagcctgttccgggtttacgccagagacctgttgctgcccccatcttcctctgagctgaaggctggacggcctgaggctcgagggtctcttgccctagactgcgccccactgctgaggttgctggggcctgctcccggtgtgtcctggactgccggatcccctgcgcctgctgaggcacgcacattgagcagagtgctcaaggggggttctgtgagaaagcttaggcgggcaaaacagctggtactggagctgggtgaggaagccattcttgaggggtgtgtcggcccacccggtgaagctgcagtgggactgcttcagtttaacctgtctgagctttttagttggtggatccgtcagggcgaggggcgtcttagaatcagactgatgcccgaaaaaaaagccagcgaagtggggagggagggcagactctcagccgcaattagggcgtcacagccacgactgctgttccagatttttggcaccggacattctagtttggagagcccaactaatatgccgagcccctctccagactatttcacttggaatctgacttggataatgaaggacagcttcccattcttgtctcaccgcagcaggtatggtctcgaatgtagctttgatttcccatgtgaactcgagtattctcctcctcttcacgatctgaggaaccaatcctggagttggaggcgcatcccttcagaagaggcatcccagatggatctgctcgacggcccaggagcagaaagaagcaaggagatgccgagaggatccttcctgctgctaaacacttctgctgatagtaagcatactattctttctccttggatgcgctcttcaagcgagcattgcacactggccgtgtctgtacatcggcatctccagccaagcggccgatacatagcacagcttctaccacataatgaagcagcccgtgaaatcttgctaatgcccacacctgggaaacacggttggactgtgctgcaggggagaataggcagaccagacaatccttttcgcgtggcccttgagtatatcagcagcggcaaccggagcctttcggcggttgatttcttcgccctgaaaaactgttctgagggaacaagtcccggatccaagatggctctacagtcctcattcacatgttggaacggaaccgtgctccagctcggccaagcgtgtgacttccatcaggactgcgcccagggggaggacgaatctcagatgtgtcgaaaacttccagtgggcttttattgcaactttgaggacggtttctgcggctggacccaggggacacttagcccacataccccccagtggcaggttcgtaccttgaaggacgccaggttccaggatcaccaggaccatgccctcctgctatcgaccaccgatgtaccggctagcgagtctgctacggtgacaagtgcaacttttcccgcaccaatcaagagcagcccctgtgaacttcgcatgtcctggctgatccggggtgtgttaagggggaacgtgtctttggttctagtggaaaacaagaccggcaaagagcaaggaagaatggtctggcacgtcgctgcctatgagggcctttctctatggcaatggatggtgttgcccctgcttgatgtgtctgaccgcttctggctccagatggtcgcctggtgggggcagggatccagggccatagtggcattcgacaatataagcatctctttggattgctaccttacgattagtggagaggacaaaattcttcaaaacacagctcccaagagtaggaacttgtttgaaagaaaccctaacaaggagcttaagcccggtgagaactctcccagacagacaccgatattcgaccccaccgtccattggcttttcactacctgtggcgcatctggtccacatggcccaactcaggcacagtgtaacaatgcttatcagaatagtaacctgtctgtagaagtggggtcagaaggtcccctgaagggcatccagatctggaaggtgcccgcaaccgacacgtactcaatcagcggctatggagctgctgggggaaaaggaggaaaaaacaccatgatgcggtcccatggagtgagcgtgctaggtatcttcaatctggaaaaggatgatatgctctacatcttggtgggccagcagggtgaagatgcgtgtccatcaacgaaccagttgatccagaaagtgtgtatcggagaaaacaacgtcatcgaagaggagatccgggtgaaccgctctgttcacgaatgggctggcggaggtggagggggagggggtgccacctatgtatttaaaatgaaagacggagttccggtcccccttattatagcggcagggggtggcggtcgcgcttacggcgctaaaaccgatactttccaccctgagaggcttgagaacaacagctccgttctggggttgaatggtaattccggcgcagccggaggtgggggaggctggaatgacaacacctcactgctctgggctggtaagtcactgcaagagggcgctactggcggtcattcatgtccccaggctatgaaaaagtgggggtgggaaactagagggggttttggcggaggagggggaggctgcagtagcgggggtggcggagggggttatatcggtgggaacgcagcttccaacaatgatcctgagatggacggggaagacggggtgtcgttcatttccccattgggaattctgtatacccctgcgctcaaagtcatggaggggcacggcgaggtcaacatcaagcactatcttaattgtagccattgcgaggtcgacgagtgtcatatggaccctgaatctcataaggtaatttgtttctgtgatcatggcacagtgttagccgaagacggtgtgtcttgcatcgtgtccccaacaccagagcctcacttacctcttagtttaattctctctgtggtgacatcagctctggtggctgccctggtgcttgcattttcagggattatgatcgtctaccgcagaaaacaccaggagctgcaggctatgcagatggagcttcagtcccccgaatataaattgtctaaactgagaaccagcactataatgactgattacaatcctaactattgtttcgcaggtaagaccagtagcatttctgatcttaaagaggtgccaagaaaaaacattacactgatccgcggattgggccatggtgccttcggtgaggtgtatgagggccaagtgtctggtatgcccaacgatcccagcccactgcaggtagctgtaaagacattacctgaggtgtgcagcgaacaggacgaactggacttccttatggaggctctaatcatttctaaattcaaccatcagaatatcgtgcgttgtataggtgtgagtctgcagagccttcctcggttcattctccttgagctcatggcaggcggtgaccttaagtccttccttcgggaaactcgacctaggcccagccaaccttcatccctcgctatgctcgatctgctccacgtggccagggacatcgcctgcggctgtcagtaccttgaggaaaatcacttcatccatagggatatcgcagccagaaattgcttactgacgtgccccggtcctggaagagttgccaaaatcggcgattttggtatggcgagagatatttacagagcatcctattataggaaggggggatgcgcaatgttacccgtcaagtggatgcccccagaggcattcatggagggtatatttacgagcaagacggacacttggagtttcggcgttcttctctgggagatcttctcattggggtatatgccgtatccttccaaatccaatcaggaggttcttgagttcgtaacctccgggggtcgtatggaccccccaaagaattgccctggccctgtgtatagaatcatgacccagtgttggcaacatcagcccgaagaccgtccaaatttcgccatcatcttggagcgtatagagtactgcacccaggatcctgacgtgattaatacggccttacccattgagtatggtcctttggtcgaagaggaggagaaggtgccagtgcgacccaaggatcctgaaggcgtccccccattactggtgtctcagcaggcaaagcgagaggaagagaggtccccagccgctccaccccctttgccaacaacttcttctggaaaagccgctaaaaagccaacagcagccgaaattagcgtgagggtaccgagggggccagcagtcgaaggcggtcatgtaaatatggccttttctcagagcaatccccctagcgaactgcacaaggtgcacggctccagaaataagcccacaagcctttggaacccgacttatgggtcatggttcaccgagaaaccaactaaaaaaaataacccaattgccaagaaggaaccccacgataggggaaaccttgggcttgagggatcctgtacagtccctccaaacgttgcgactggcagactgcccggtgcaagccttctactggagccctcttcattaaccgcgaatatgaaggaggtgcccctgttccgtctcagacacttcccttgcggaaatgtgaattacggctatcagcaacagggccttccactggaagctgcaaccgcccctggagccggtcattacgaggacacaatcctgaaatccaagaatagcatgaaccaacccggtccatag

SEQ ID NO: 27283 - DNA, 1353 bp, Artificial Sequence
  Description of Artificial Sequence: Synthetic coding sequence
atgggtgccatcggtttgctctggctgcttcccctgttactgtccacagccgctgtggggtcagggatgggcaccgggcagcgtgctggcagccccgcagccggaccccctttacagcccagggagcctttatcttactcccggctccaacggaagtcattggcggtcgatttcgtcgtcccaagcctattccgggtctacgccagagatttactgcttccaccttctagcagtgagctcaaggcaggcaggcccgaagccagggggagtctggcactcgattgcgcacctctccttcgcctgctgggccctgccccaggagtgagttggactgctggcagcccagctcccgcagaagctaggactttgtcccgcgtgctcaaaggcggaagtgtgaggaaactcagacgcgctaaacaactagttctggagttgggcgaagaggccatcctggagggctgtgtcggaccacctggggaagcagctgtggggttgcttcagtttaatctgtctgaattgttttcctggtggatcagacagggtgagggcagattgcgcattcgcctcatgcccgaaaagaaggccagtgaagtgggccgagaaggcaggctttccgccgcaatcagggcatcacagcctaggcttctgttccaaatctttggaaccggacatagcagtctagaatcaccaaccaatatgccttcaccttctcctgattactttacctggaatctgacctggatcatgaaggacagcttcccgtttttaagtcacaggagcaggtatggtaaggaacggtcccctgcagcccctcctcctttgcctactacttcctcagggaaggcggctaagaaaccaacagccgctgagatttcggttagggtgcctcgaggtccagccgttgaaggtggtcatgtgaacatggcgttctcccagtcaaaccccccttccgaactgcacaaggtccacgggtccaggaacaagccaacatccttatggaatcctacctatggaagttggttcacagaaaaacccaccaaaaaaaataatcctatcgccaaaaaggagccgcatgaccggggaaatttaggtctggagggtagttgtactgtgccacccaacgttgccacaggcagattgcccggtgctagcctactgcttgaaccttcctcactcacggccaatatgaaggaagtccccctcttcagattgaggcactttccttgtggcaacgttaactatgggtaccagcaacaaggcctgcccctggaggccgctaccgccccaggcgcaggccattatgaggatacgattctgaagtctaaaaactcaatgaaccagcctgggccttag

SEQ ID NO: 27284 - DNA, 1935 bp, Artificial Sequence
  Description of Artificial Sequence: Synthetic coding sequence
atggaggtccagcttggactagggcgtgtgtatcccaggcctccatcgaaaacgtatcggggagccttccagaacttgttccagtcagtgcgagaggtcatacagaatcccggacctcgccatccggaggctgctagcgcagctcctcctggcgcttcactattgcttctgcagcagcaacagcagcagcagcaacagcagcagcagcagcagcagcaacagcagcagcagcagcagcaagaaaccagccctcgacaacagcaacagcaacagggagaggacggatccccacaggcccacaggcggggacccaccggctacttagtcctcgatgaagagcagcagccatcccaaccacagtcggccctggagtgtcaccctgagcgaggctgcgtgccagagccgggagctgcagtggcggcatctaaaggcttgccacagcaactacccgcacctccagatgaggacgactccgccgctccgtccacgctgtctcttttaggaccaacattcccgggactgtccagttgcagcgcagatctgaaagacattctgagcgaagcgagtacaatgcaattgctccagcagcagcagcaagaggcagtatctgaaggtagctcctccggcagagcccgtgaagcctcgggggcacccacttcaagcaaggacaactacttgggcggaacttccaccatctctgacaacgctaaggagctgtgtaaggcagtgtcagtctccatggggctgggcgtcgaagcgctggaacacctaagcccgggagaacaattgaggggtgactgtatgtatgctcccttgttgggcgtacccccagcggtccgacctactccttgtgcacccctggccgagtgtaaaggttctctgttggacgattccgcaggcaagtctacagaagataccgccgaatacagcccctttaaaggtggttatacaaaaggcctcgaaggagaaagcctgggctgtagtgggtcagcagctgctggctcaagcggcacattggaactcccctcaaccctgagtctgtacaaaagtggtgcactcgatgaggcggcagcatatcaaagccgcgactattataattttcccttggctctcgccggtccgccaccccctccacccccaccccaccctcatgctaggatcaagctcgagaatcccctcgactacggaagtgcatgggcagccgctgcagcccaatgcaggtacggcgacttggcctcgctgcacggagccggtgccgctgggccaggctctggctccccgtcggcggctgcgtcttcttcctggcacacgttgttcaccgctgaagaaggacaactgtacggtccttgtggtggaggcggtggcggtggcggtggtggtggagggggagggggtggtgggggaggcggaggcggaggggaagcaggtgcagtggcaccatacggatatactcgacctcctcagggtctggccggtcaggagtccgactttaccgcccctgatgtctggtatccaggaggcatggtgagcagggtcccctacccttcacccacatgtgtcaaatctgaaatggggccatggatggattcttattccggaccatacggggatatgcgactggagacggccagagatcacgtgctaccgatcgactactactttccaccccaaaagacctgtttaatctgtggcgatgaggctagcggttgtcactacggggcattgacttgcggttcttgtaaagtgtttttcaaacgggcagctgagggcaaacagaagtatctgtgcgcgtcccgaaacgactgtactatagataaattcagacgaaagaactgtccatcctgtcggctgaggaaatgctacgaagccggaatgacgctgggggagaagtttcgcgtcggtaactgtaagcacctgaaaatgaccagaccatag

SEQ ID NO: 27285 - DNA, 1803 bp, Artificial Sequence
  Description of Artificial Sequence: Synthetic coding sequence
atggaggtgcaattgggccttggacgcgtgtacccaagaccgcctagcaagacctaccgaggggcatttcaaaatctctttcaatccgttcgggaggttattcaaaatccgggacccaggcatccagaggctgcctcggcggcaccaccaggagccagcctgctcttactacagcaacaacagcagcagcagcagcagcagcaacagcagcagcagcagcagcagcagcaacagcagcaagaaaccagcccccgacagcagcagcaacagcagggcgaggatgggtcgccccaggcacatcgccgtggtcctaccggctatttggtgttggatgaagaacagcaaccatctcagccccaatcagcgctggaatgccatcctgagcgaggctgcgtgccagaacctggcgctgccgttgcggcatcaaaaggtctgcctcagcaactgccagcaccaccagacgaggacgatagtgctgcgccatccacgctgagcctactcgggccaaccttcccgggactatcgtcctgctccgccgatctgaaagacatcctaagcgaagcctccactatgcaactgctgcagcaacaacagcaagaggccgtttctgaaggcagcagttcaggacgagccagagaggccagtggcgcaccgacatcgtccaaggataactacttggggggtacttcaacaatctctgacaacgctaaagaactgtgcaaagctgtctctgtctctatgggactcggcgtcgaagcactggagcacctgagtcctggcgaacagctgcgtggcgattgcatgtacgcccctttgctcggtgttcctcctgccgttcgtccaactccctgtgcacccctcgctgagtgcaagggatctctgctggatgactcggctggcaagagcaccgaggatactgccgaatactcgcccttcaagggcggttacactaagggtttggaaggcgagtctctcggatgctccggttctgctgcagcaggaagttcaggaactctggagttgccttcaactctcagcctgtataagagtggagcattggacgaggccgctgcctaccagagccgcgattactacaacttcccactggccttggcaggacctcctcccccaccgccacccccacacccacacgccagaattaagctggagaaccctctggattatgggtccgcctgggcagccgctgcagcacagtgcaggtacggcgatctggccagtctgcacggggctggcgcagcaggcccaggatccggtagcccgagcgctgccgcttcgagcagctggcacactctgtttaccgcagaagaaggccagctctatggaccctgcggcggaggagggggaggcggtgggggaggcggtggtggtgggggaggcggagggggaggtggcggaggtgaagcaggcgcagtggcaccatatggctacaccagacctccccaaggcttagctggccaggaaagcgacttcacagcacctgatgtgtggtatccgggtggcatggttagcagggttccctacccttcaccaacctgtgtgaagtcagaaatgggtccatggatggattcctactcaggtccctatggagatatgagactggaaaccgctcgcgatcacgtgctaccaatagactattattttcccccacagaagacttgtcttatttgcggagacgaagcttccggttgtcattacggagcattgacctgcggcagctgtaaggtgttttttaagagggcagccgaaggcttcttccgcatgaataaactgaaggagtcctag

SEQ ID NO: 27286 - DNA, 444 bp, Artificial Sequence
  Description of Artificial Sequence: Synthetic coding sequence
atggtgatgggactgggagtgctgctgctcgtcttcgtcctcggactaggcctcacacctcctaccctcgcccaagacaatagtaggtacactcatttcctcacacagcattacgacgccaagccacagggccgtgatgatcgctactgtgagtccataatgaggcggagagggctgactagtccttgtaaagatatcaatacctttattcatgggaacaaacgatccataaaagctatttgcgaaaataagaatggcaatcctcatagggagaacctgcgcattagcaagagttctttccaagtcacaacttgtaaactccacgggggatccccttggccgccatgccaatatcgtgcaaccgctggctttaggaatgttgttgtggcttgtgaaaatggactcccagtccacctcgaccaaagcatcttccggagaccatag

SEQ ID NO: 27287 - DNA, 444 bp, Artificial Sequence
  Description of Artificial Sequence: Synthetic coding sequence
atggtaatgggattgggcgtgctgttgctcgtgtttgtccttgggctggggctgactccacctactttggctcaggacaatagtaggtatactcacttcttgacccagcactacgacgctaagccgcagggaagagatgaccggtattgtgaatcgatcatgcgcaggaggggacttacaagcccttgtaaggacattaacacttttatccatggaaacaagagaagcatcaaggccatctgcgagaacaagaacgggaacccacatcgagagaatttgagaatctccaaaagttcattccaagttaccacatgcaaattgcacggcggatctccctggcccccatgtcagtacagggctacagccggattcaggaacgtggtagttgcctgtgagaacggacttcctgtgcatctggatcaatccatatttaggcgaccctag

SEQ ID NO: 27288 - DNA, 1494 bp, Artificial Sequence
  Description of Artificial Sequence: Synthetic coding sequence
atgacagtgttcttatcctttgcatttctggctgctatcttgacacatataggctgctcgaatcagaggcggtcgccagaaaacagcgggaggcgctacaatagaatccaacacggccagtgtgcctacacgtttatcctgccagagcatgacggcaactgtcgggagtccacgacagatcagtacaacacaaatgcgcttcagagggatgccccacacgttgagcccgattttagttcgcaaaagttgcagcacctggaacacgtgatggaaaattatacacagtggctccaaaagctcgaaaactacatcgttgaaaacatgaagtccgagatggctcagattcagcagaatgctgtgcagaaccacactgctaccatgcttgaaattggcacatcacttctgtcacagaccgctgagcagaccagaaaactcacagatgtggagacccaggtgctgaaccagacctcgcgattagaaattcagctcctggagaactcattgtccacttataagttggagaaacagcttctgcagcaaaccaacgagattctgaagattcatgagaagaattccttactggagcacaagatccttgaaatggagggaaaacataaggaggaactcgatacacttaaggaagaaaaggaaaacctgcagggactggtgaccaggcagacttatatcatccaagaactagaaaaacagttaaatcgggcaactaccaacaacagtgtgctgcagaaacagcagcttgagttgatggacaccgtgcataatttagtgaatttgtgcacaaaggaagtcctcctcaagggaggcaaacgagaagaagagaagccctttagggactgcgccgacgtctaccaggcgggattcaacaagtctggcatctacactatttatatcaataacatgcccgaacctaaaaaggtcttctgcaatatggatgtgaacggcggagggtggacagtgattcagcatagagaggacggctccctggatttccaacgtggctggaaggaatacaagatgggctttggcaaccccagcggcgagtactggctggggaacgagttcattttcgcaattacctcccagaggcagtatatgctgcggatcgagctgatggactgggaaggtaatagagcctacagccaatacgataggttccatatcgggaatgaaaagcaaaattacagattatacctcaaggggcacaccggcaccgctggcaagcaaagctctctgattctccacggagctgacttttccacgaaagacgccgataatgacaactgtatgtgtaaatgcgccttgatgttaacagggggatggtggttcgacgcgtgcggccctagcaacctgaatggaatgttttatacagctggccagaaccacggcaaattgaatggcatcaaatggcattacttcaagggtccaagttatagtctgcgatccactactatgatgattcgccctctggatttttag

SEQ ID NO: 27289 - DNA, 459 bp, Artificial Sequence
  Description of Artificial Sequence: Synthetic coding sequence
accgtgtccaacctgctggagcataagatactcgagatggagggtaagcacaaagaggagctggataccctcaaagaggaaaaggagaacctgcaagggctggtgacacggcagacatatatcatacaagagctagaaaagcagctgaatcgggcaactactaataattctgtcttgcagaagcagcaactggagttgatggacacagtgcacaaccttgtcaacttgtgtacaaaagagggtgtactgctgaagggtggaaaacgagaggaggaaaaacctttccgagattgcgctgatgtttatcaagctggatttaacaagagcggaatatataccatctatattaacaacatgcctgaaccaaagaaagtcttttgcaatatggatgttaacggaggcggttggaccgtcattcagcacagggaggacggctctctcgacttccagaggggctag

SEQ ID NO: 27290 - DNA, 1497 bp, Artificial Sequence
  Description of Artificial Sequence: Synthetic coding sequence
atgacggttttcctttcgttcgccttcctagctgctatacttactcatatcggctgctcaaaccaaaggcgtagtccagagaattccggacggaggtacaatcgcatccagcatggacagtgcgcctatacttttatccttcctgaacatgatggaaactgcagggagagtaccacagaccagtataatacaaatgcccttcagagggatgcaccacatgtcgagcctgacttcagttctcagaagctgcagcatttggagcacgtaatggagaactacacccagtggctgcagaaattggagaattacatcgtggaaaacatgaaaagcgagatggcacaaattcagcaaaatgccgtgcagaatcatacggccacaatgctggaaataggcacctccctgctcagtcaaaccgccgagcagacccgcaagctgaccgacgtagaaacgcaggtgctgaaccaaacgtcccgtctagagatacagctgcttgagaacagcctatccacttataagttggagaagcagctgttacagcagacaaatgaaattctgaagattcacgagaagaatagcctgctcgaacacaaaatcctggaaatggaaggtaaacataaggaagaacttgacacgttgaaggaggaaaaagagaacctgcaaggcctcgtaaccagacagacttatatcattcaggagttagaaaaacaacttaaccgcgctacaaccaacaatagcgtgttgcaaaagcagcagctggaactcatggacaccgtccataatctggttaacctttgcacgaaggagggtgtgctgcttaagggtggtaaaagagaagaggaaaagccttttagggactgcgcggacgtatatcaggcaggcttcaacaagtctggcatttacacaatttatatcaacaatatgccagagccaaagaaggttttctgcaacatggatgtgaacggcggaggttggacagtcatccagcatcgggaggatggatctctcgactttcagcgcggttggaaggagtacaaaatgggcttcgggaatccgagtggtgaatattggctggggaatgagttcatctttgccattacttctcagagacagtatatgttgaggattgagctaatggactgggagggcaacagggcttactctcagtacgaccgattccacatcggcaacgaaaaacaaaactaccgactctatctgaagggccacaccggcactgcaggtaagcaaagtagtctcattctccacggcgcagacttcagtaccaaggacgcagataacgataactgtatgtgcaagtgtgccttaatgctgacgggaggctggtggttcgacgcctgtggccctagtaacctcaatggcatgttctacaccgccggtcagaaccacggcaaactgaacggtatcaagtggcactatttcaaagggccatcctatagcctgaggagcacaacgatgatgattcgccctctcgacttctag

SEQ ID NO: 27291 - DNA, 894 bp, Artificial Sequence
  Description of Artificial Sequence: Synthetic coding sequence
atggaaggcaagcacaaggaagaactggacactctcaaagaagagaaagaaaatctacaggggttggtgacaagacagacgtatatcatccaggagctcgaaaaacagttgaacagagccaccaccaacaattctgtactccaaaagcaacagctggagctgatggatacagttcacaacctggttaatctgtgtaccaaggaggtgttactgaaagggggaaaacgtgaggaggaaaaaccctttagagattgcgctgatgtatatcaggccggattcaataagagtggcatatacaccatctacatcaataatatgccagaacctaaaaaagtgttctgtaacatggacgtgaatggaggcggttggaccgtcatccagcacagggaagatgggtcactcgacttccagcgcggatggaaagaatacaaaatgggattcggcaatcccagtggcgaatattggctgggtaacgagtttattttcgccataaccagccaaagacaatacatgttgcggattgagctcatggattgggaaggcaatagagcctacagccagtacgaccggttccacattggcaatgaaaagcagaattacaggttgtacttaaaaggacatacgggcacagccggaaaacagtcctccctaatacttcacggtgctgacttctcaactaaggatgctgacaacgataattgcatgtgtaagtgcgcactaatgttgacggggggatggtggttcgacgcatgtggtccctctaaccttaatgggatgttttatactgctgggcagaaccacggcaagctgaatggaatcaagtggcattattttaagggaccttcttacagtttgaggagcaccacaatgatgattcgcccactcgatttttag

SEQ ID NO: 27292 - DNA, 897 bp, Artificial Sequence
  Description of Artificial Sequence: Synthetic coding sequence
atggaaggcaaacataaagaagagctggataccctgaaagaggagaaagagaatttacagggattggttacccgtcagacctacatcattcaggagcttgagaagcagctgaatcgggctactactaacaattctgtgcttcaaaagcagcagcttgagttgatggataccgtacacaacctggtcaacctgtgtactaaggaaggggttctactgaaaggcggtaaacgggaggaagaaaaaccattccgagattgtgctgatgtatatcaggccggatttaataaaagcggtatttatacaatttacatcaataacatgcccgagcccaagaaagtgttctgcaatatggatgtgaatggaggaggctggaccgttatccagcacagagaggacggcagcttagactttcagagagggtggaaggagtacaagatgggattcggtaatccctcgggtgagtactggctaggaaatgaattcatattcgccattacctcacagagacaatacatgcttcgcatagagttaatggactgggagggcaatagagcctacagccagtacgaccgctttcacattggaaacgagaaacagaactatcggctgtacctgaagggacacacgggaacagcaggcaagcagagttcgctcatcctgcatggagcagacttctctactaaggacgcggacaacgataattgcatgtgtaagtgcgctcttatgctcacaggcggatggtggttcgacgcctgtggtccttctaatctgaacggcatgttctacaccgctggccagaaccacggtaagctgaacggcattaagtggcattatttcaagggaccctcatactcactccgaagcacgacaatgatgatcagacccttggacttttag

SEQ ID NO: 27293 - DNA, 1491 bp, Artificial Sequence
  Description of Artificial Sequence: Synthetic coding sequence
atgtggcagattgtctttttcaccctcagctgcgacctggtgctggcggcagcttacaacaacttccgcaaatcaatggacagtatcgggaagaaacagtaccaagttcaacacgggagttgtagttatacgttcctcctgcctgagatggataactgccgttcatcttcttccccatacgtatccaatgctgtccagagagacgcaccccttgagtacgacgactctgtgcagagactacaagtcctggaaaacattatggaaaataatacgcagtggctgatgaagctggaaaactatattcaggataacatgaaaaaggaaatggttgagatacagcagaacgctgtgcagaatcagactgctgttatgattgagattggcacaaatctgctgaaccagaccgcggagcagaccagaaagctcacagacgtggaagcccaagtgctgaatcaaaccacccgcctggagctgcagttactggaacattccctctcgactaataagctcgaaaagcagatcctggaccagactagtgaaattaataagctgcaggacaaaaattcttttctagaaaagaaagtcctggcaatggaggataagcacatcatccaactgcagtccataaaggaggagaaagaccagctccaggtgctagtgtcaaaacagaactccattatagaggaactcgaaaaaaagatcgtcaccgccacggtgaacaatagtgtgctgcagaagcagcagcacgatcttatggagaccgttaataatctgctgactatgatgtccacttccaatagcgcaaaagaccccacagtggccaaagaagagcagatttcattcagggattgtgctgaggtattcaagagtggccataccactaacggcatttacacattgacattccccaatagcacagaggagatcaaggcctattgtgatatggaagcgggaggcggaggctggactatcatacagcgtcgagaggatggctcagtcgatttccagcggacatggaaggaatataaggtgggctttggaaacccctctggtgagtactggctgggcaatgagtttgtgtcacagttgaccaaccagcagaggtatgtgctaaaaattcacctcaaggactgggagggcaatgaggcttatagtctctacgaacacttctacctgtccagcgaggaactgaattatcgcatccacctaaaggggctgacaggaacagcgggtaaaatttcatcgatttcccagccgggtaatgacttttccactaaggatggggacaatgacaagtgcatctgtaagtgctcacaaatgttgaccggagggtggtggtttgacgcatgtggtcctagtaacctgaatggaatgtactatccacagcggcagaacaccaataaattcaatggtataaagtggtactattggaaaggctccgggtattccctgaaagcgacaacaatgatgattcgccctgcagatttctag

SEQ ID NO: 27294 - DNA, 1488 bp, Artificial Sequence
  Description of Artificial Sequence: Synthetic coding sequence
atgtggcagattgtgttttttacccttagctgcgatctggtcctggcagcagcttataacaattttcgcaagtcaatggatagcatcggcaaaaagcagtaccaggttcagcatggttcatgctcgtatacgttccttttaccggagatggacaattgtcggtcaagcagttccccttacgtttccaacgctgttcagagagacgcgccactcgagtatgacgattctgtgcagcgcttgcaagtcctggaaaatatcatggagaacaatactcagtggcttatgaaactggaaaattatatacaggacaacatgaagaaagagatggtcgaaatccaacagaacgccgttcagaatcagaccgcggtgatgatcgagatcggcaccaatttgctcaatcagaccgctgagcaaactagaaagctcaccgacgtggaagcccaagtgctgaaccagaccacacgtctggagctgcagcttctggaacacagcttgagtacgaacaaacttgaaaagcagattctcgaccagaccagcgaaataaataaactgcaggacaagaattcattcctggaaaaaaaggtgctcgccatggaagataagcatatcatccaattgcagagcatcaaggaagagaaggaccagctccaagtactcgtgtcaaaacagaatagtatcattgaagagcttgagaagaagattgtgactgcaacagtcaacaacagcgtcctccagaaacagcagcatgacctaatggaaacagtgaataacctcctgactatgatgtctaccagcaattccaaggacccgacagtggccaaagaggagcagatttcttttagggattgcgcagaagtgtttaaatcgggccatacaaccaacggcatttatactctgacattcccaaattcgacggaggaaattaaggcttattgcgatatggaagcgggtggaggcggatggacgatcattcaaagacgggaagatggatcagtggacttccagagaacctggaaagagtacaaagttggtttcgggaatccgagcggcgagtattggctgggaaacgagttcgtttcccagttgaccaatcaacaacgatacgttttgaaaattcacctcaaagactgggagggaaacgaagcttactctctctacgagcacttttatctctcttccgaagaattaaactacagaatccacttaaagggtctgaccgggaccgcagggaaaatcagcagcatcagccaacccggtaatgacttctctaccaaagatggcgataatgataagtgcatctgcaagtgttcccagatgctaactggaggatggtggtttgatgcttgcgggcctagtaacctcaacggaatgtactacccacagagacaaaacaccaataaattcaatggcattaagtggtactactggaaggggagcggttacagccttaaagctacgaccatgatgatacgacccgctgacttctag

SEQ ID NO: 27295 - DNA, 1335 bp, Artificial Sequence
  Description of Artificial Sequence: Synthetic coding sequence
atgtggcagatcgtgtttttcacgctgtcttgcgacctggtgctggccgcagcctataataacttccggaagtcaatggatagcattggcaaaaaacaatatcaggttcagcacggaagttgctcctacaccttcttgctcccagaaatggataactgcagaagctctagctctccgtatgtctccaacgccgttcagcgagacgcacccctcgagtatgacgatagcgtccagaggctgcaagtgctggaaaatataatggaaaacaacacacagtggcttatgaaagtgcttaatcaaacgacgcgactcgaattgcagttactggagcatagtctctcgaccaacaaactggagaaacagatccttgatcagacgagcgaaattaataagctccaggacaaaaactctttccttgagaagaaggtgttagctatggaggataagcacatcatccagcttcagagcattaaggaggaaaaggaccagttgcaggtgcttgtgtcaaagcaaaattctatcattgaagaactcgagaagaagattgtgaccgccacagtgaacaactcagtcctgcagaaacagcagcatgacttaatggagactgtgaacaacttactaactatgatgagcacgagcaacagcgctaaggacccgacagtagccaaagaggaacagatctctttcagggactgtgctgaggtcttcaaaagtggccataccaccaacggaatatacacgctgacatttcctaacagcaccgaggagatcaaggcatattgcgacatggaggccggtggcggagggtggacaatcattcagagacgcgaggatggatcagtcgattttcagcggacctggaaggagtacaaagtcgggttcggcaacccgagtggtgagtattggttaggtaacgaattcgtgtcccagctgaccaaccagcagcgttacgttctgaagattcatttaaaagactgggaaggcaacgaggcctattctctttacgaacacttttaccttagcagtgaggagctcaactatcgcattcatctgaagggactaacaggcactgctggtaagattagttccatttcccagcccggtaacgacttttctaccaaagacggcgacaacgataagtgtatttgtaagtgttcccagatgttgacgggcggatggtggttcgacgcttgtggacctagcaatctgaatgggatgtactatcctcaacgccagaataccaacaaatttaacgggattaagtggtactattggaagggatctgggtacagtttgaaagcaaccaccatgatgatacgtccagccgacttctag

SEQ ID NO: 27296 - DNA, 1221 bp, Artificial Sequence
  Description of Artificial Sequence: Synthetic coding sequence
atgagcggtgcgcctactgccggagcggcactaatgctatgtgctgccacagccgtcctgctcagtgctcagggtggtcccgtgcagtccaaaagtccgaggtttgcatcctgggacgagatgaacgtgttggcccatggactgctgcaactgggtcaggggctcagagagcacgcggagcgtacccggtctcagttgtcagcccttgaacgcaggctctccgcgtgtgggtctgcatgtcaggggaccgaaggatccacagatttgccgctggcaccggagtcccgagtggatcctgaggtcctccactctcttcagactcagctcaaggcacagaattcccggatccagcagctcttccacaaggtcgcccaacagcagcgtcatctcgaaaaacagcacctcagaatccaacaccttcagtcgcagtttggcctgctggatcataaacatctggatcatgaggtcgctaagccggcacgcaggaaaaggttgccagaaatggctcagccggtggatccagcccataacgtcagccgactgcatcggctgccacgggattgtcaggagctgtttcaggtgggtgaacgccagtccggcctgttcgaaatccagccacagggatcaccacccttccttgtgaactgcaagatgactagcgatggcggatggacggtcattcagagaaggcatgatggcagcgtcgatttcaaccgaccctgggaggcatataaagctggatttggcgatccgcatggggaattctggttggggttagagaaagtccatagtatcactggggacaggaactcaaggctggcggtccaactcagagattgggacggaaatgccgagctgctgcagtttagtgtccatctgggtggcgaggatactgcctattctctgcagctcacggcaccagtggcaggacagctcggagccacaaccgtgccacctagtggattgagcgtccctttctctacatgggatcaggatcatgatctcaggcgagacaagaattgcgccaagtctctgagcggcggatggtggttcggcacgtgttctcatagcaacctgaacgggcagtatttcagaagtatccctcaacagcgtcagaaactgaagaagggaatcttctggaagacctggcgcggaagatactatccactgcaggcaactacaatgcttatccagcctatggctgcggaggcagcaagctag

SEQ ID NO: 27297 - DNA, 1107 bp, Artificial Sequence
  Description of Artificial Sequence: Synthetic coding sequence
atgtctggcgctcctaccgccggagcggctttaatgctgtgcgcagccacagcagtcctgctgtccgcccaggggggtcccgtccagagcaagtctccgagattcgcctcatgggacgagatgaacgttctcgcccatggtctcctgcaattgggacaggggcttcgggagcatgcagaacggacccgatctcagctgtccgccctggaacggagactgagcgcctgtgggtcagcctgtcaagggactgagggatcgactgatctgcctctggccccagagagccgagtggaccccgaggtgctgcacagtcttcagacccagctcaaggcccagaattcacgcattcagcagctctttcataaggtggcccagcagcaaaggcatctcgagaaacagcacttgcgcatacaacaccttcagtctcagttcggccttctcgatcacaagcaccttgatcacgaggtggctaagcctgcgcgtcgcaaacgactgcctgaaatggcccagccggtggacccagctcacaatgtgtctcgacttcaccatggcggttggacggtgatccagaggagacacgacggctcagtagacttcaaccgtccctgggaagcatacaaggccggtttcggcgatccacacggggaattttggctgggcctggagaaagtacactccatcaccggagaccgcaactcacggttggctgttcaacttagagactgggacgggaatgcagagctcttgcaattctctgtccacctgggaggcgaggacacagcctactccttacagctcactgcgccagtggcaggtcaactgggggcaactaccgttccaccaagcggtctgagcgtgccgtttagtacatgggaccaggatcacgacctgagacgagataagaattgcgccaagagcctgtccggcggttggtggttcggcacctgtagtcacagcaatctgaacggtcaatattttagatcaataccccagcagaggcaaaaactcaagaagggaatattttggaaaacttggcgcggtagatactacccacttcaagccaccacaatgcttatccagcccatggcggctgaggcagcttcttag

SEQ ID NO: 27298 - DNA, 720 bp, Artificial Sequence
  Description of Artificial Sequence: Synthetic coding sequence
atggctcagccagtggacccagcccacaacgtctctaggctgcacaggttaccacgtgactgtcaggagctctttcaggtgggtgagcgccagtccggtcttttcgaaattcaaccacaggggagccctcccttcctcgttaattgtaaaatgacatcagatggcggatggaccgtgatccagcgaaggcacgacggatcagtcgattttaatcgtccctgggaagcctacaaggccggtttcggcgatccgcatggtgagttttggctggggctggagaaggtccacagcattacaggagatagaaactcccgtctcgctgtgcagttacgggactgggatggcaacgcggagttattgcagttttctgtgcacctcggtggcgaggataccgcatattccttgcagctgaccgcaccagtcgctggccagctaggagcaacgacggtccctccttcgggcctcagtgtgcctttctcgacctgggatcaggaccacgatctccggcgtgataaaaattgcgccaaatccctttctggagggtggtggtttgggacatgctcacattcaaacttgaacggccagtatttccggagtattccccagcagagacagaagctaaagaagggtattttttggaaaacttggcgaggccgatactaccctctccaggctaccacaatgctaattcaacccatggcagccgaagccgcaagctag

SEQ ID NO: 27299 - DNA, 837 bp, Artificial Sequence
  Description of Artificial Sequence: Synthetic coding sequence
atggagcccagagctgccgacggttgtttcctcggggatgtggggttctgggttgagaggactccagtgcacgaagccgcacagagaggcgaatctctccagctgcagcagctgatagagagtggggcttgcgtgaatcaggtcaccgttgattccatcacccctctgcatgctgcctccctgcagggccaggcacgctgcgtgcagctcctgctggctgcgggagcccaggtcgacgccaggaatatcgacggtagtactccactgtgcgacgcctgtgcgtctgggagtattgagtgtgtgaagctcctcctgtcgtatggtgctaaagtcaatcccccattgtacaccgcctcacccctccacgaggcgtgcatgagtggatcttccgaatgcgtgcggctattgatcgatgttggagctaatctcgaagctcacgactgccacttcgggactcccctccatgtcgcttgcgccagagagcacctggattgtgttaaggtgcttctgaacgctggcgcaaacgtgaacgcagcaaagcttcacgagaccgctctgcaccatgcggctaaggtgaagaacgtcgatctgatcgagatgctgatcgaattcgggggtaacatctacgcgcgagacaatcggggaaagaagccctctgattacacttggagtagcagtgcgcctgctaaatgttttgaatactacgagaaaacaccgctgacactctcgcagctttgcagggtaaatctgcgtaaggctaccggtgtgaggggtctggaaaagattgcgaagctgaacatcccaccaaggctgatagattatctgtcgtacaactag

SEQ ID NO: 27300 - DNA, 396 bp, Artificial Sequence
  Description of Artificial Sequence: Synthetic coding sequence
atggaaaaaatacccgtgtccgcgtttctcctgttagtggccctctcctacacgttggccagggatacgacggttaagcccggagcaaagaaggacactaaggacagtcggccaaagttgcctcagactctaagcaggggttggggcgatcagctgatctggactcaaacatacgaagaagccctctataaaagcaaaacctcgaataaacccttaatgataatccatcacctggacgagtgcccccactcccaggccctgaaaaaagtgttcgccgaaaacaaggagatacagaagctggctgagcaattcgtactattaaatctggtctacgaaactaccgataagcacttgtcgcctgatggccagtacgtcccgagaattatgttcgtctag

SEQ ID NO: 27301 - DNA, 528 bp, Artificial Sequence
  Description of Artificial Sequence: Synthetic coding sequence
atggagaagattccagtcagtgccttcctgctcctggtggcactgtcgtacactctcgcacgcgacaccacagtgaaacctggcgcaaaaaaagacacgaaggactctcgacccaaactgccccagactctgtcccggggatggggggatcagctgatctggacacagacatacgaggaggcgctttacaagagcaaaacttccaacaagcctctcatgattatccaccacctggatgagtgcccacacagccaggcactcaagaaggtgttcgctgagaacaaggagattcagaaactcgccgagcaatttgtgctgctaaatctcgtgtacgaaactaccgataagcacctttcacccgatggacagtacgttcctcgtattatgttcgtcgaccctagcttaaccgtgcgcgctgacatcacagggagatactccaaccggctgtacgcatacgaacctgccgacactgctctgctgctggacaatatgaagaaggctctcaaactcctcaagactgaactgtag

SEQ ID NO: 27302 - DNA, 588 bp, Artificial Sequence
  Description of Artificial Sequence: Synthetic coding sequence
atgagtaattacacagatgccgagtcaagcttttcaaaacaagagattatcagagtggcaatggagaagattccagtctcagcttttctgctcctggtagcgctgtcctacaccttggccagagataccaccgtcaagcccggagccaaaaaggacaccaaggattctaggcctaagttgcctcagacactgtcccggggatggggcgaccagctgatatggacacagacatatgaagaggccttgtataagtcaaagacttcgaacaaacccctgatgatcattcatcatttggacgaatgcccacactcccaggccctgaaaaaggttttcgctgaaaataaggaaatccaaaagctggccgaacagtttgtcctgctgaacctggtctacgaaacaaccgacaaacacctctctcccgacggacagtatgtgccacgaattatgttcgttgacccctcgctgaccgtgcgtgcagatatcaccggacgatatagtaatcgcctttatgcgtacgagcccgcagatacagctctgcttctcgataacatgaaaaaagcgctgaagctccttaaaactgagctgtag

SEQ ID NO: 27303 - DNA, 1251 bp, Artificial Sequence
  Description of Artificial Sequence: Synthetic coding sequence
atgtggcccacacgtaggctggtaaccattaagcgctcaggcgttgacggacctcacttccccctttccctatccacttgcctctttggcaggtatgagaacgaatccctccagaacggtcgcaagtccacagagttccctcgaaagatcagggaacaagagccggctcggagagtctcaagaagtagcttctcgtctgaccccgacgagtccgaggggattcctctcaaaagaagacgggtgagctttgggggtcacctgcgccctgaacttttcgatgagaatctgcctcctaataccccactaaaaaggggcgaagcccctactaaaagaaaaagtttggtgatgcatacaccccctgtgctgaagaaaatcataaaggaacagccccagccgagtggtaaacaggagagcgggagcgagattcacgttgaggtcaaggcgcagagtcttgtgatttcgcctccggctccgtccccccgtaaaactcccgtggcctcagatcaaaggagacggtcctgtaaaaccgcacccgcttcgtcatcgaaatctcagaccgaggtacctaagcggggaggcagaaagtccgggaatcttccctccaaacgggtttcaatctctcgcagccagcacgatatcctgcagatgatctgcagtaagcggcgaagtggcgcttctgaggccaatctaatcgtggcaaagtcctgggccgatgtcgtgaagctaggcgctaaacagacacaaacaaaggtgattaagcatggtccacagaggtctatgaataaacggcagagaagacccgcaacgccaaagaagcctgtgggcgaagttcactcccagttcagcactggccacgcaaacagtccttgcaccatcattatcggtaaagcgcacaccgagaaggtgcatgtaccagcacgaccttacagggtgctgaataacttcatctccaaccagaaaatggacttcaaagaggacttgagtggtattgccgaaatgttcaaaactcccgtcaaagagcagccccagctcaccagtacgtgtcatatagccatcagcaattccgaaaatctactcgggaagcagtttcaaggaactgattccggcgaagagcccttgctgccgacctcggagagcttcggcggaaacgtgttctttagcgcacagaatgcagctaagcagcccagtgataagtgttccgcctcccctcccctgcgccgtcaatgtatccgtgagaacgggaacgtctag
